United States Patent 8,067,671 (METHODS FOR GENETIC CONTROL OF PLANT PEST INFESTATION AND COMPOSITIONS THEREOF) - sequence listing, part 30

SEQ ID NO: 47309 - DNA, 3703 bp, Heterodera glycines
  Genomic contig location: Contig_ID=SeqID_15730; Location=160..3862; Strand=-
  SCN-specific regions: Sequence locations=1-171,210-296,318-363,387 -620,642-683,706-753,776-809,831-943,965-1027,1064-1070,1092 -1380,1402-1648,1670-1708,1730-1774,1808-2160,2200-2251,2274 -2620,2643-2715,2737-2805,2847-3585,3607-3703
  Gene Ontology: Mol. function=glutathione synthase activity; Cellular component=intracellular; Biological process=neurogenesis
aaacatattttaattaataatcaacagtttatcacttgttttaaattatttttaggcgcatttgaacttaaaaggatggcacagtatgccatagaatggtgccacaacaatgcactgattttaaggcgaaaggaggatgagggcaacaggtggacgaaaatccaaattagcattttaaattctaattgaaatgatttttaagaggcgatgctgccctatttcctccattgactttgtttccgtcgccattcccacgcgacgcttttgaacaagcgctgaaagcacaaaaggtgatgaaataaattttaatattaaatgatatgattgatcattaataaattggatttaaattcggagcaaaacaaaattaatataatttaatttatcttgaatttaattaggcgatgaatttgctttattttcgcgttgcgcgtgactatgaatttttgatgaatgcctacaaagatgtgatcaaaggggacgagcatattgccaaattggtggacattttgaagaaagtccacgaggagggaattcggcagacgatcactgtgatgctgcagagagcggtgggcagaaaaaaatataagaaatataatacaaaaatggaataaaataatctatttatggcaaatatttttagaaactgaatttaaataccaaatatttttaatgagagatgtttaagtataaaaaatgataaaatagtgcttcaattattctttcgcattggaataataaagtaagttgtaattttaaaaatgttttaatgttttgcgaaaaatatttactcaattttatttttactaatatttgcaaaaataaatttcaattttcacggttcataataattttgacgaataaaagatgctttaaaaatatacaaaacctatttcttaaaaatgaaacataacattccttcttcaggactatttattagatgttgtggagaacaatgaaacaaacgaagtcaaatatgagccaaaacaggtgaaaaagcaaattctaacattttctttcgttaatcttttttattgttattcatttatttattttataaaatcagcgacattaatttaaattaattaattgactcatatttttatatgcattttttattttggcttttaggtcgaagtcaacactggtgccatcggagcaactgggctcaagcgacggaccaccgaatttcaccggcgaatgctcaaaaaggccaccggaatggacgcaacgacagcgaacatcccggacaacaagccggacgctgctttgatcgacacattttacatggcatggtaagaatgtgctttttgtgcaatttcttatccttcattaatgggctttttgaattctaaatcgttattaaaaaattgagcgccttttgtccttgtggtcttttgtctgtagcttttttacgagtggatccgttgacacaatatcgtcatcagttcactaactttttcgaactttttcttaatgctaaattaggcacttttccgttgttccctctccaaaattaattaacaattttaattctaaccatttggttttactgacaagtgaaggaatttaaaagttaaaagtaagcaacgctctagtgaaattattatgaacatattttaaatggatttttcgatctttacttattgttttttcaaattgttaaaaacacccaaatttcgaattagagcggaattattagttcctaaaaacacatttcaattttttgaatctaaaaccttgctgctgttgtcggcggcaattctgattcttgcacttttcaaaatttcattttttaaatttatttaggcgcaaattcgatgacccaaaagcaataatggtttgtctgatatacagcaacgacccattccaatacgacttgcgatacattgcggaggaactggaaaagaaatcgagcggcaaaatggacgtcgaaatttattcgttggccgattattcggaaagagagaacagcacgaaaaggtggcagaaaagcatttttaaaatcgcacaaaattgtgaaaaataggttaaaaaattcttttaaacgtttaaacatacattaattttgccttaaatttttataagaaactgagcaaattttaaatacggaaatagaaccaggtataaatgttcaatacaattttattaatctataccaaaataaaattaattcttttttatttttattatttttttggcacaacggtgaaaatggctattataaatttatagattagcaaaagattacgttgttttttccaattaagattgcaattggacccggaggacttttcgcttcgtctggacggtcgaaaagttgccattgtttattcgggacagtctgcccttgggtgcaaatttgacgacctcggcatggaattccgacaaatcattgaactgtccacggcaattgtaaaacataataaaaatttgtttatgaaatttgtttattcacagaaagcaccttccttggctgtggcaattagcagctctaagaaagtgcagcaggtgctatttttgagctgaacttaaaaaacaaattgaccaattgaagaaaataaatttgaaataggaaaaatgttaggcttcaaaaaatgtaaaaacctaaaaatcgattattttaaaaactgagatgctcaccatgccgggtgccattgaacgtttcttcccggagcctagcgacgcggcaacggtggcacaaatcagagcgacttttgccaaaatttggggcctggagaatgaggacaacgacacggaaaagctaattgaagtaaaaaacatctgcttaatgagtcgatttggaatatattttgaattattcaaatttaattttaataataattctgaaattgttatcaggtcaacaaataattcactcccttttcctgtcttagacccatcgaaattatttttgtatgtgaaggcattcatacaattaatatttttttcgtttaatttaaccatttttcgttttcattaaaagttggtcaaatttcaaatgagtttcgtccctttaatcattttttgaataaaaaactgttttttaggatgccattgaaaatccgggcaattatgtgctgaagccgaacagggaatgcggaggacataattattatgacgataaattggtggaaaagctgaaagaattcacgcaaactgaacgaggtgcgcacattttgatgcagaaactgcgcccaatggttgtgaaggtaaaattataaaatagggataactattagaattgctcaacacttctctaattgtgcctgaaattattgaatttttatgataccaaacaaatccatcatttaacaaattaattcatttcttttatgatgacagtgctcaattacgcctttaaaaatttgccgtattttaattgtcccaataattcattttaattttacgcggaatggagagagatcaagttaaccgggttcttacaacaaaattcttaaccaattttaaactggcctttctttagaattacgtgcttagaccctatgaggcggcgagattggaggaagtgatccccgaactcggcatttacggctttttgatcggcgatttgaaagcaggccgagtgctgcacaatgtccagcaggggtaccacttccgcacaaaactttcgcatgtgaacgaagccggcatttccgcaggattcggcttttatgactcagtttatctctattagtggtcg

SEQ ID NO: 47310 - DNA, 2747 bp, Heterodera glycines
  Genomic contig location: Contig_ID=SeqID_2492; Location=954..3700; Strand=-
  SCN-specific regions: Sequence locations=1-122,144-155,177-815,838 -1320,1342-2089,2111-2114,2136-2191,2213-2631,2653-2747
atggttcatattgtgttcgacccaagcattatcggatatgatgagtacatgcaatacggaagtggcatagaaagcgaggattacttccgagggtccagccccttccaacgagggtatggacaacgaggcgcaggggtgggggatgtgtttcgcggactttggcgctttttccttcccattcttcgtcgtgttggcactacagtaggatcggaggcactgagcacggggcagcgagtgctggagagagtgggaaacgaaggagtgccatttaaggaggcatttgtcagcgagggaaagaaaggaattgatacggtacttgagaagggcggcctgccaaaacagtttggcggtggtcgaagaaagagtataaaaagaaagaaatctcatgcaccaagccatcagaccataattggacggacaatcagcaaaccaggaaacaaacgtattcgttcagacgcatttggactttactaaataaatggctttccataaaattgataatgacagtgcaaactcaatcaccaatgccttagacttttttcgtattccacccaccaatgtgagcgtctcttcatcaaaagtgtttgagctgcttcccagtaacccactgacggacactccctaccacttcaagcttcactccagccaaaactttattgatttgtccaaatgctacttacaaagtgaattccgaattcgcaaagaaaatgagcatggtcatctgattgacctcgcagctgacgaagttgctccgatccagatgatcggccagactttcattcgaaacatcaaaatgagcataaatggacgtgaagttttcaactccaattcactaatggcctacaaaacatacttctcacatgagctgtcctattccaatacggcaaaggactcgcatttgaatgcggcgggctattaccgtgacatcggcggctcgcttgagacaggggacggatgcattgcgcgacgcaacctgtttgcgagaagcagaacagcgcaattcattgccaaaattgacgccgatttgttcaaccaacctctctacttgatcaacttctgtgagttggacattgaaattttacccaacgacaacgagtttgtcctaatcactacgcccgctgttgcccagggtgctgcagctgctcctcgttaccgcttcgaggttgtcagtttgaaaatgtatgtgaaaaaagtctcattgatggatggactggcgttggacattgcgcgaaaacttgaagtgaaaccggcacgatatgctgtgaggaaaacgctgatgaaatcaatgttcattagtcatggacgtttcgagtttacagccaatttgttcatggatcaaattccccgccgtatcacaatggggttagtggctaattctgactatattggaacaatttcgcgcagtccgttcaactttcaaccgtttaatgtgcgcgaaatctcaattattgctaatggccgctcctttccccaagcgccatacgacttggactacccaaattggaaatatgttcgccctttcaatgacatgaacgaagcagtgggattcgccaactcattggaaagcaatggaattagctatgaacagttcggaaaaacccactgcatttatgtgttcaatttgaccagcagtggagatgatcaagctgcgctgtttgacctgataaagaacgggacaacagcggtgagcatcaaattcaaccaggcagtgcccaccggggggataatgctggtggtgatgggcgaatgcgactctcttgtgatgttagacaaaaatcgatcaattagcacagacattactatttaaggctgtcatttttttttgtatgccactatcatttgaataaagatgaattacaaaaatgttggaattattttcttcatacttcgaattaatttcgatgttgtgtccagtcaaacaaccgaggtatcagcatcatattccgaatatataaaaagactaaaaatgggctggcccaaaagcagccctcaacccagtacaacgcgtgtcccagagtatctaagacgcaaattattgacacgacttcccagtacaacttcgacccggctggcaagtccagcaaccaccacaacaacccatcctcaaccccctaagcaagagaagctgatagatgaacaagtgtcctcaattttgcctccactgattcaattgtgcaaagactcctcaaaggaaaataatttcttccaacaaatcatttgctgggcactgttggctctgtatttgatgcttatcgtcagtttggtcctacaccaattgtgctctgttttttggttgaaacgtaatggacagcacacaaatcaccaaaatattgagagaaaaccaacggacgtcacaaatttttcgaggatgtttcgccagtgaccaattgccttcgccggccaccctacagtatcctgcggcactcattgtgaaccgtgacccccatcacaaagggggctcccattggtgtgccatttatgcccgggacttggacgtgcctgtgatttactttgatagccttgcccttcccataccaccaagtatttcatcatcctttttaaataattttcccaaaggtttacacaaaaacattgaagcctaccagtccccattgacatcaacatgtgccccccattgtattgtctttgtttaccacatgtcccatggaaaatcattcgataaatttatacatattctcaaaacttgttcaaaccctgacatgtattcattattaatgctaaataaa

SEQ ID NO: 47311 - DNA, 875 bp, Heterodera glycines
  Genomic contig location: Contig_ID=SeqID_15758; Location=635..1509; Strand=-
  SCN-specific regions: Sequence locations=1-288,310-423,446-574,596-875
  Gene Ontology: Mol. function=transcription factor activity; Cellular component=nucleus; Biological process=regulation of transcription, DNA-dependent
ggtactgcaagaaggaagaagaaagtcgtgcacaaaactactgcaatggacgacaaaaagttacagacgaatctgaaaaagctttcggtgactaacattcctggcatcgaagaggtcaatatgatcaaagacgacgggacagtgatacactttaacaacccgaaggttcaggcttcggtaccggcaaagtaaacaaaacaaaagttgcgctgtttgtttgccttttttgagttaaatttgggtacatcaattcaattaaatttcgtttccccgctctttttaatatgccaaacacaagcaaaacaaacagtgcctactgttctcttgcggcgcaaagcaataatatttcttgaacttaagcaccttctcgatcactgggacagcggagaacaagcgtaagtcacctaattttaacggcatttaaggaaaccaaatttcaaatttacaactaaaagacccttttttattcctttccctcttcagaaatcacggacatgttgccgggcattcttaatcaactcggggcggagtcgcttactcatctgaagaagcttgccaacaacgtggttcattttgtttgttcaaacttttttggattgtctttataattacagaccacgcaattcaaaccatcggctgaggacgacgatgtgccgggtataaacttagcagagtttacattctcttactcttcccccactttgtttagatttgattggcgattttgaggaggcgtcgaagaacgaatcgaagaccacggaggaacttgtccattagtggtttttaccatcgttacacaagccacaactgttgcagtgggattggccaaccaatttccacattatcaaccccaccgttatgacaaatcagattga

SEQ ID NO: 47312 - DNA, 1570 bp, Heterodera glycines
  Genomic contig location: Contig_ID=SeqID_2498; Location=321..1890; Strand=+
  SCN-specific regions: Sequence locations=1-601,624-722,745-910,932 -1570
  Gene Ontology: Mol. function=glutamine-tRNA ligase activity; Cellular component=cytoplasm; Biological process=glutaminyl-tRNA aminoacylation
tcatttgcacttccacgaggtgggcaaaaacgacacaaccgaaggttatgtgcggacagagaacacagaacgacttctaagagagcacgtcaaagcggtgggaggaaaggttggccatgggatgaaggggaaagggattcccaatgaaaggccaagcccatttggatactgaaactccaacgatatttatacataattgctttttggtaatttcaggttgtcacgcgttttcctcctgaacccaatgggattttgcatatcggacacgcaaaggccatcaacattgatttcggattggcaaaggcaatactaacaaatgacatgaattattaatgacgaataatctttaggcacgtggtggtatttgctatcttcgcttggatgacacaaatcccgaaaaggaggaggagagatttgtgcaggaaattgtggacatggtcaattggctaggtttggtgaattgtttatactctttccacgctgatttaggctattcgccctacaaaatcacacattcttcggattattttgaccaactttacagctgggcattgacccttattcgtaaggtgcaatttgaattcgtttccttttctgtgaatgtttgtttattttcttttttcagaatttggcctacgtttgccaccaaagtacggatgaaatgcgtggctttaaccctcctccttcgccatggcgcaaccgccccatggaagaatcactacgtttatttcaggcacacttcagccgccttgctattatactttttaacgaaattacgaataatttaggcgatgaaaaacggcgcatttgacgaggggcaggcgacgctacggttgaaactcactttggaggacagcaagcaggacccggtcagtcggtcttctattcagaaattctcaggtactttcccagtttaactgacacttttaacacatatttttataactgaaaatatatttatattacatcaaaatttagcattgttttttttttgtcattcatcgaatgaaaattatttatgattgatattaaaggtacaaaaatatgtgttaaaagtagcaattaaactaagaaagtaccgattctcacccaatcaaaaattatccaaaattcaggtggcatatcgcgtcaaatatttgccgcaccatcggactggcgacaaatggtctttaaagaatgccaaacattattaatacctaattgaataatcaggcaaaaaaatatttaggtgcgtttaccccacttatgattacacccattgcttatgcgattcgttagaaaatgtgactcattctctgtgcaccaaggaatttcaagcaaggtgttgttactcacaaaaaataagagcgagttcattaatttatcatcgtggatttacaggcgttcctcgtactattggctgtgcaatgcgctcgacctttactgccctgtccaatgggaattcgcccgtctgaatgttaattacaccgtcgtttcaaagcgcaagttgctcaagcttatccaggcgggcattgtcgagtccgtctgttttaaacggagtaataagcacaaaatctcacgttttagtttc

SEQ ID NO: 47313 - DNA, 2172 bp, Heterodera glycines
  Genomic contig location: Contig_ID=SeqID_2499; Location=4..2175; Strand=+
  SCN-specific regions: Sequence locations=1-323,351-720,780-1376,1398 -2172
  Gene Ontology: Mol. function=glutamine-tRNA ligase activity; Cellular component=cytoplasm; Biological process=positive regulation of embryonic development
acttcgcattaccaattatcgagagttggttttataccagcgaaaagcaccttacgggtcaaacaattcccatcctcaattaatgaaagtacggaagaatgggaaattgcatttgacgagtttgtctacattgagcaggctgattttagagaggtaattgcgtgcagctttactagacattattacgtacactttttaggttgccgaaaaaagttatcgtcgactgacattggaacagccggtgggactgcgtcatgtcaatttggcagtcaaaattgacaaactggagcgggatgagcacggtgtctatttcttatactaagtttattttaattcatttattttgaaggaaatcccatcgaattggtggtaactgcgaatccggtgagtagtgagtgtaagccgaaagcattcattcattgggtggcgagaccggtgctttgtgaggtgcgtctctacgacaaactgtgagtatttactatccctccaaatgttgggtaaacattttttagatttgtacacaaaaatcctgaggaccctgccgaagtccctgggggttttttgactgacataaacccgaactcgctccatgttctttcaaatgcaatggttgacggaagtattattcgcactattcgtccgttggatcgctttcaatttgaacggaacggctttttctgtttggatccgaatgattcgtggtcgagtgagaaaaaagtgaattttttttttaaatttatgtttactttttagttgtgaattttttaaataaaaaattacttctttttagttcgtcttcaatcgcatcgtttctctgcgtgaggatgcaggaaaaaacatttaaacttttccctgcttttttctgtttatttttatttattagtgcattttcattgttttgttgttgatagataaattgttgactctctattttactaacatattcttttttctttgttttttttcaaacgtacatatatttaactgtgcttaaattccgtctcatttgattttcccagcctttgttaacatattaaatggcgtggctcagtcgtgcgactttttgtcctcaccaattacaccaaaaagctgtcaaaacgccgttacagaaagcggtcacttcggcggcagagcgtgcgcttgacattgtcggcaatgcgtcgcgagtgcggcttcaggacttgagggacaacccgggcgcgaggacggtgggcaggcaagtgcgcgcgaagggccacaaccaagcgggtcacaccattggcgagttgcaacacgcgtcgaagccgccgctcggctgggtttggggcgactattacaaaccttggcagcggtcctttgacggcgacagacgcttcaacggggacataaagtaattcgttgatgatgatgttgttgttttacattaatgcatcatttgttcagtctccgccgtgaatacattcccatttctttggtcgagcttcagcgcctcatcgacttgggctggttggacacgagtcgactcgtcgacatcgccgcaatttgtgccaccaaattgttggaacagaaattcaagccggaattgcgtcagtttggcattcatctgactgatgaagtcagtgatttcgcaggtttaattcgatgctcacccgctatttagggcgaagaaatattctcaactccgatcaatttggaggtccaatgggcctcgtgcactgcaattgctgccatcgaacgcgctggtggtcgaattcggacggcttattacgacacggaaagcctcaaagccatgtccgacgccgagaaatggtttcgcacagggaagccgattccgagaaggaaacacccgccgtattcgctgatggaatattacatggaccctgaccacagagggtaatagaaatgtgaacacatgaacattttggtgctgaaaaaagcaattttagatatttggccaaccctgaggacattgagacgtcccgagtccgattggcagacattgtcggctacacattggtcaccggtccaccgcctttcgaaaatgaacaaaaaagaccggaccaagtgtttcttggactcgagcctggccaattggtcagtttggaggacgaaaaggtgttcgagccaacgcatccgacacttgtggaatattacaggggagaagaacaacaagtagccgacacaattcgatga

SEQ ID NO: 47314 - DNA, 2107 bp, Heterodera glycines; identical to SEQ ID NO: 2503
  Genomic contig location: Contig_ID=SeqID_2503; Location=1..2107; Strand=+
  SCN-specific regions: Sequence locations=1-539,595-868,890-1234,1256 -1574,1596-2107
  Gene Ontology: Mol. function=neurexin binding; Cellular component =synaptic junction; Biological process=synaptic vesicle targeting

SEQ ID NO: 47315 - DNA, 1861 bp, Heterodera glycines
  Genomic contig location: Contig_ID=SeqID_2504; Location=367..2227; Strand=-
  SCN-specific regions: Sequence locations=1-20,42-343,365-898,920 -1135,1157-1461,1483-1537,1562-1691,1714-1861
atgggccgtgttcgacgacattgtgttgtcccatttgaatgtgctgcacgcgctcagtgcgtccgattggccggcggcgtttggccatcaaacgaatgccctgcagctgttcaatagggaaattttgcagcgcgaaaaggacgccaattggttcatgcccatcctttacgtgctgtgcagcgacttgcgactcattgcgcgaattgtgggcacttattttggtgtttaatttaatccccgggggcgaaatgagtggtaaatttacctaaacgagttctctggaggaggcgtaggagaacggttcacggagtgtgaaattaaaatggtaccgtttccaacttcttcaaagtgcctttgggtgttcggcttattcccctgctgtgcacacctgccgtcttacaattagacaattacagtatgcctaccgtacactcctgccccttttccaggctgacaagcgcggctgtgtgctgtggggcggccaccaccagcggaagtcggccgacgcgcaaacggcgaccttttacgaagagtcggccgcctcaattatggagagttaccgcatttgtgtggcggagcggtcggacgcgaccacaaagaaagtggccatcctcagtctgaccaaccaattgtttcgcatttattttggggtgacttttgtgctttttctaatgccttcggacacttttctcgggtcaattgccgagagtcttgacaattctaataaaaaaaattaacaaatccaattgcattttcgagttgctcagatcaaccgtttgcatctgctgaaaccgcttatccgcagcattgaccacgtgggcgaactgtacgaccgtttttcgctggccgacaaaatcacttacaaatactttttgggccgaaaagcgatgtttgacatggtgtttctttcttctttttggcattttgattacaatttcggaggatggatgggcaattccattgtaaattgtctggcatggcatggcaatgcgttgtcgtttctgtttgccgcttgtccccaattgtcaattttagacatatttaaaaaatacggtagatttgccaataaatcattcatttttctcggcatggtttcaattttcatccaatatttccctccgctattcgttcgttctttcctttcccctaattttttgcttctcccattttgaggacctttcccgtgccgaggaagcactgaccttcgcttttgagcactgtccggctcatttcatgcacaacaaacggctcattctgatgtatttggtgcccgtcaaaatgttccttggccatatgcccacccaacaattgctcgtccgctacaaccttggccaatttgccgacgttgccgccagcgttaagtcagtcggagaatggaaggggacggaaatgtcctttccccctattttgcccttctaaaatgtatttaattgccgtaagggatggcaatttgcgcgacctgaacttggcactgcaaaaacaccaacactttttcatcaaatgcggcatctttttgatgttggaaaagctcaaagtgatcacctacagaaacctcttcaagcgagtgtaagttattcttcaaatgtgctcctttcttctctttttcctttccgatcactttttgattggattttcttccctttttaatttcagtgcttccattctgaacacccatctgatcaaattggacgctttcctcgccgtccttcgctttttgggcacggacattgacgcggacgaattgtcgtgcattttggccaatttaattgcgcaaaagaaaatcaaagggtacatatcgcatcagagacagactttggtgatctcaaagcaaacgccgttcccttctctttccgccgcttaa

SEQ ID NO: 47316 - DNA, 618 bp, Heterodera glycines
  misc_feature (41)..(41): n is a, c, g, or t
  Genomic contig location: Contig_ID=SeqID_15787; Location=2974..3591; Strand=-
  SCN-specific regions: Sequence locations=1-500,524-618
tttatgatttctcaaacttttgctgatcgagtcgggcgtgncaggaactaatgtgcaggaatcgtaccttcgaatgcatgcaaacgcggccacagaagagctggaactgccacaatttgcacacattgcagaatttcaatatttgtcaatgaggtttttgtaaaatataaagcctttattgttcattttaattcagagctgtttcactgtgcaaggtgcttgccagaattccggacgaaatgactgataggttttaacttaattcaagccctgaattttgtcgggaccctgccctaatttctcaaatttacaagctccttttcgaaattatggctttataatttgtttataaatagcaattttttatgtcttttcagaaggccatttctggagaccatcaaagagattgcttcgtccattaagcaattgttggacacgacaaacgcgatcattgctcttgtgcctcgctgctaccaacctcgtcagattaatttaactccttttctttcttatttttaaaattgtttagttgttgagaaacgtaagagggaatttgtacaagttagcaaaaggttcagcagcacattgaaggattattttaagcaccaagagcccaac

SEQ ID NO: 47317 - DNA, 904 bp, Heterodera glycines
  Genomic contig location: Contig_ID=SeqID_15797; Location=862..1765; Strand=-
  SCN-specific regions: Sequence locations=1-308,330-446,468-839,882-904
cttaattttgtcccccagggctctgtcctgggtcctttattattccttatatatattatcgaccttcctgatgtcataccatcaggagtgaatattaaattatatgctgatgatgttaaaatctatatttgttataaagcaaaaactgaaacggaaattatgcataaagcattgcataatttattcgaatgggcaaataaatggcaaataaaggtttcaattcaaaaaacttttgtattatatttgggttcaaaaaacccaaaagaaacatacaaatttgatgggaatacaataaatgctgtggatacaattagggacttcggaataaatattgataataaattacaattttccgatcatgttaaccaaataacaaggaatgcctatttacgtatgcgttccttgtttagaataattaaatctaaatcttctaaaatctggattacattatataaaacttatattaggcctttattggaatatgctccggaggtttggaatccgtctcttcaaaaaaatattaaaaaatagagaaatgtcaaaaatatttcactaaaatagtgcttttcaagtgtaaccttccaccaattccatacctgaagcgattagaatacctacaactaccaacacttgagaataggcgaaagctatttgatctgttcatggcgcataaaattgtttatggccgaacagatctagatttatttaaaattttcaaaccttctaaacgctttaatgtccccttttataggtttaacacaaaatataaattaggcaaaaaatttattccctttgcggggagggctacaaaattgtggaatcaacttgataaagaaatcattaaaataaattctttaaatcaatttaaaactaaaattaaactccttaacgaataaaatgaccg

SEQ ID NO: 47318 - DNA, 2163 bp, Heterodera glycines
  Genomic contig location: Contig_ID=SeqID_2511; Location=1445..3607; Strand=+
  SCN-specific regions: Sequence locations=1-117,139-183,222-264,287 -496,524-556,615-755,800-819,841-873,896-909,931-1389,1419-1498,1542 -1637,1670-1878,1901-1998,2020-2163
  Gene Ontology: Mol. function=glutathione synthase activity; Cellular component=intracellular; Biological process=neurogenesis
atgaaaatcatccgtatttcgctgccagcttgtgccagacaaatgaagttgggacagtgagttttaaaactgatggaattatcatgctcaaatagtgggaaattggcgaacaaaagcggaaatttatttaaatattctgaggtcctgatttttctgagaaattttatataaaaatcccaggagaaattttatttaaaatatttttggaattatatttttatgtttctcctttttaacttattttagcaaaaaatcttgacaacttggtttgaaagtttaaatttttgaaattccaaaaccccgcgcgagattccgcaacttttaattgcgggataatccatcggagtccaatcacaaaaaaattgattcccaatcccgctgcgggatccgcaaatttgaaaactccggtctttaatcattaacttttttatgtttcattcaaaaaatttgaattcaataataaaaaagaaaatgatgtactaaaatgactaattgtaagatataaattttttaaattgacttttacaaaacctaaatcctcacatattgttgattctttttaaaacataaatatttcgttaaaaaaataaaaatattagataaatattttttaagattaacattggatccccaggacaacacattgcgtttgtatgggcaaaaagttgccgtcacttatatcgcaacggaggcgccaaatccgagcgacgatgaatggaaagtccgacttttgttcgaacgttcgacggccattgtaaaaaaattaaacaaataaatttttaaaaaataaacaattttagaaaagtccaacaattgggcaggatttggcaaatcagaaaaaagtgcagcaggtgaaaaaacgttattttgtgtagaaaataattgggcaaaaaacggacgactttttaatgccaacaaccatttttcagcttctgactaagccgggtatgttggaacgctttttgccggaacctgaacatgccgcaaaggtggaagcgcttcggcgatcctttgccggactgtgggctttgcacgacgaagacgagcaaaccgaacgggcaattcaggcaaatttgaaatggcaattaaacaaaataattacctattttttgccaggatgccattagaaatccgcagaattatgtgataaagccgaaccgggagggcggtggccacaacatttggggcgaagacctgaagcaaaagttgttgaccttcacgaaagacgaacgaaacgcgcacattttgatggaaaagctgaacccggtggttatccatgtgagttaattaaaagccattaaatattttacaattaaaaatgaggaaatattccaatggtttttcggtaaaaaaattgtcggatgtaaaacattctcttttaatgtgaagttttattcattttttttttaaattaataaggtttattatgaaaaatctttaaaaaatcgatttaaaatggaacttttgctgattgtcataaaatccaatgtttacattgattttattactttttaatctttttttctatttaatatttatttctcttttatttgagaatttattggtaaatttcagactgctgcttaatacaattgccttccatagatttatttgaatacataatttatgtaaaaaccatttatttaatttatttattttgtattttatacgatttgaccgtttgtcctttgtcattttggcttctggtcccggcattttccacaaaagcctggtccggtagtgccggtaaaagtcaggattcgaatcttggcatttatcgctttcgattatcattgctgtgccggatgggcgaccttttaattggcaaattcttttccatttccccgttcttttttttcagaattacattgtgcgacctatgccaaacaattacaaatacggcgaaatgaccactgagctgagtatcattggctacgcttttggcaatgtggacgaaatggaagtgaaaaagaatgtgcaaaaggggcattttctgcgcacaaaattagcccacgtcaacgagggcggcgtgtcctttggcaacggcgcttgggacattccctttttgatttgatggcacaaaaagtggcacgcagagaaacacaaaagattcaaaaaatgtcataaaaaattgctaggcaatcaccatgaacgagagaaata

SEQ ID NO: 47319 - DNA, 763 bp, Heterodera glycines
  Genomic contig location: Contig_ID=SeqID_2514; Location=359..1121; Strand=+
  SCN-specific regions: Sequence locations=1-240,262-763
atgatcgttctcaggtgcctcgcatttttgatgatcggagaaaggcaacaaacaaaatcaaagacgtgggatattactttcgttatcatcgacctggaatcgacgcattgccgcggatccccgactgcaaagagcagctctaccggccgaaatacaaagtggggccagaaaaaggagagtttagactggttgtgtcttccgggaatgaaactgtgtctggaagattgggttacctccattttaaagcacattagcacaacattcggtgaattaccccgttcagcgtttacacggtcacacgaacacctaacaatcgtttgttatccattgggtggttttaaattattgtagaaatacaatatttgatgtctgtttatccctccttaagattcgtgagccttggcgcgaaagtcaggcgagatttggcgagaacgactacatcgacctgctcggagacggctctctccatccggcccaacttcagtaccacgtcccccgttggctgcgcgggtttcccgggcaaaacagagcgattgagccggtcaagctgatccactacagaaacctgtacaagtcaaagttggagcagaattcgcctcacaaatggcaccagctgaacaagcgcatcaaatatttgctgcaatatcacaactacgacaaatcggacgaattgagggccgaacggtcgctgggactgtgggaggaggagccggactatttctacaaggacaaatcacgccgatcataccaagaccttgtgtag

SEQ ID NO: 47320 - DNA, 1826 bp, Heterodera glycines
  Genomic contig location: Contig_ID=SeqID_15856; Location=218..2043; Strand=+
  SCN-specific regions: Sequence locations=1-105,153-261,283-298,332 -333,355-451,513-615,637-694,716-1095,1131-1715,1739-1742,1779-1826
  Gene Ontology: Biological process=embryogenesis and morphogenesis
gcattcatctggtgccatacccggcacaatttgctgtcccattgtttcccgatgctgtgaagaagcaatgcttgaaggaattgaaacagcgatatgaaaatgtggaaaaataaaaaataaaatttatttttattttttaaattaaaatttttcagaaagaaattaaaagtccgccggaaaattttgaagaatgggttctgcaccattttggaccccaaattttggatgtgttcttcaatccgtactccaaaaaagtgtggacagtgaaaccgtcgaaaatgtaaaaaaaaaatggggcaaaataattttaaagaattttttttttattttaggtctccaatttgggttggcactcgggtggcaaaattgccacaagaaaagctggaggaactgtgctcaatggatgccaatgtgttgaaaaatgccgattttggatggggcccaaatgcacaatttaatgtaaataaaataaaataaaatttagaatttaaatttaaattttgtaaaattaagttcccaaaatacggtggcaccggcgccgtgtggaaaaatatgacggagaaattgccatcggaatggttcaaatataattcaaaggtgggctgttttaataaatttatgtatatactatgaaaattttcgtaaaattagtgacaaaattcagaaaattttcattttttgcgcatcgcaaaacgaaaattttcttggaaatctattaaaaattttcattatgaatagcaaaaaaaaaaaaacatcacccggattggtagagagttaatattttcgaaaataggatggttttttctattttttatccagaaaatcacggggttggacaaaaattttagtaaaaaaacgggatttgaatcggggctgaacgtaattacggattatggaaattacggcgtttttggatccctgtgatgacggattatggattaccgtaattgaaaatccagttacgcccagccccaggtaaactcggcactttacatttggccaacattttgtggccaacttcttccggaacttccaaaaactcggattttgtgattggctttctcggcgccattttccctaattttgcttttttccaattaaattttaatttttaaatttaaatttttttaggtccttcgcgttgaccatcgccaaaagtgtgtgcattacgtccaactgaatgccaatggtcagccgacgggcccaacaaagtcactgaaatacgacgcactgatcaactccagtcccatcgacgcgttcgtggcggacaacaaaatttgcgagatgccgttgttggagcacaacaaagtggggggtgggggggggagtaattagttggactgctcgagattctcgatcaccgttttaaattcatatatttctatgggggggggataattaatggtaattaccaggactgctcgagattctcggtcgcggttcgacgaaaaaattcataaaaacgctaaaaagccataaaaaattcgcacgcaactttttgcatccttctatttcagtcccaatggtatagaaatttcagtaccgctctctaagattgattatttttcggaatttcttcgctgaaatttaaattttgccttagaaagggcttggattcaattagttcggagtaattaatgtgtctaaaattttttaggtttttgttattggcgtcggattgaaactgccaatgactgagttttgcgaggtaccctaaaaaattaattgaaattttgaaaaattcaaatgtctttaagaaatacacttggctctactttcctgaccctgacgtgccgttctatcgtgtcacatttttttcacggtaa

SEQ ID NO: 47321 - DNA, 226 bp, Heterodera glycines
  Genomic contig location: Contig_ID=SeqID_15860; Location=1366..1591; Strand=+
  SCN-specific regions: Sequence locations=1-19,41-145,214-226
atgattgaaataattattctttatgtaatattttattcaatcatcatgcggctttgccaccgaatcactgcaaagaaaactactttcatccaaatcttcgtcaagactcttgggggaatgacgctgactatttttgcccattcctttgacaccatcgagaatgtgaaggcgaagatccaggacaaggaagacatcccaccggaccaacagcgtatcatcttctctg

SEQ ID NO: 47322 - DNA, 951 bp, Heterodera glycines
  Genomic contig location: Contig_ID=SeqID_2527; Location=736..1686; Strand=+
  SCN-specific regions: Sequence locations=1-85,107-951
atgtcaccgtttggtgcccaagtccgtgactcgcgggaccgggagaagaaggaactcagtgatctgaacgatcgattagccaattacattgaaaaggtggggtttgggtcggctgagcacggccaagcgaggcccaagcccaaacagagcacaataagcaccaggacaaatttaggtccgtttcctcgaagcacagaaccgcaagttgaaggcggacctggacatgccgcaaggacgccgcggcaaggacaccatcaccatcaagacgatgtacgagagcgagattcagacggccaaaaagttgatcgaagacacgggccgatcaaagcacgagttggagcaggacgtggccaaactgcaacgtgacttggacgagcagcgccgcaaatacgaggtacgccatcatgaatagcaaaaaaaacatcacccgggttgattgggaattaatattttctaaaatacttattggattttctgtttttttccagaaaatctcagggttggactaaaaattatggattacggaaattgtaccgtttttggatccctatgatgacggattacggatttccgtagccagttacgcccagccctgatttgaacccaggtaaactcggcactttacatttgccaactctttgggggccagctttttccggaacttccaaaaaaaatttgggtgcgttaactcattgaaaaactcaattaactaaattaattcggtgcccaattttccaagattgcaaaagtgagactctcgagcactataaatagggactaaatttatgtgtccaatttttgccccaaattttcagcattttcaattccacacaatcaacaacgggcatcgccattacaaatcttcgtctgtttgccggttacggaggggaagcgattgcgttttttcccaccttttcaccttttttgttctcatcttctcacctttttcaa

SEQ ID NO: 47323 - DNA, 1529 bp, Heterodera glycines
  Genomic contig location: Contig_ID=SeqID_15868; Location=281..1809; Strand=+
  SCN-specific regions: Sequence locations=1-162,185-282,304-499,522 -1052,1144-1268,1290-1529
  Gene Ontology: Mol. function=GTP binding; Cellular component=mRNA cleavage and polyadenylation specificity factor complex; Biological process=mRNA cleavage
atggaccaaaacaacgaccaacgccgtgctgttaacgaatatcggcttaatgaggacaatgaactgcgtttagaagtgggcaaagaagaagtcattctcgaattgctggagggttctgccgaaatattcggctcccagatatccatgcacaaacgctactctctccccccaggcgagtcactgaaacaatcgcattcacatatctttgctttttgcagggtttcgcgccgccgttttcacatataaaggtgcccttattgaagtggtcggtcgaacagatagtgcttacattgcacaacaaacacctatggttgggtttggttgaacgtcttggaggaatgcctccggggactcgaattttcattaaatttttgcatttccacagattatctatttgaatactcatgccgctctcgagagtatgcgaaaaagtgccgagacacaattggtggccgaccgaacatcttccgcccgtggtccacgtcttttggttgccggaccaactgatgttggaaaatcgactctttgtcgaatattatgcaattacgccgtccgggagggaaggacacctctttatgtggaccttgacattggacaggtaaaactacggaaaaaattcagattttgggaatttaataagcatttacatttgcgagactattatccttttagggcagtgtttccattcccgggaccatcggatgcctttacattgaaaagcccgcagacattgtggacggattcgatcgaaaagccgcctatgttcacaacgtattcaatttacttgtatttccatttcgattttaatttaagttcggtcacatttctccgtccgcgaacattcgactttatgaccttttggtgaaggaattggcacttgcagttcgcaaaaagagcaaatcatcttcaatctgtgatgtttccggattcattgtgaacacttgcggatgggtcaaaggggacgggtcggtgcttaatttttaatgggtacaccccaaaatctcgccgagacaaaatctggccgcagaaatttcaaaaaatttttttcgaacataaatttttcaaataaaaaattcttataaaattttttataagaaaatgtcaaaaaaaaaaattatttgttaagattttttgaaaatttttgagaaaacataatttatcataatttcataaagaattgcttaaaaattttctaaggatttttccttggaaaatttcttaagtttgaaaaaattgaaatttctgcggcgagattttgtcccgtcctcattttaattgccttcaattggtcttttgggacaggtcataaaatcccaactttattcttatgaatttcatttaattgcttaataaattttatggaaagtcccatggctttctttttcagttacgcttgcattgtgaatgcggcggaggcctttgagcccgacgttgttattgtcttggatcatgaacgtctttacaacgaattgcagcaggatttgccaagttttgtcaaggcaatgatcgattattatactattttttag

SEQ ID NO: 47324 - DNA, 102 bp, Heterodera glycines
  Genomic contig location: Contig_ID=SeqID_15888; Location=295..396; Strand=+
  SCN-specific regions: Sequence locations=1-102
gtcaacactttggtcacgcccgatcatacaaagaaagcgtatgttcgcttagccgccgattatgatgctttggacgtggccaacaagattggtattatttga

SEQ ID NO: 47325 - DNA, 667 bp, Heterodera glycines
  Genomic contig location: Contig_ID=SeqID_15889; Location=963..1629; Strand=-
  SCN-specific regions: Sequence locations=1-667
  Gene Ontology: Mol. function=structural constituent of ribosome; Cellular component=cytosolic large ribosomal subunit (sensu Eukarya)
aatcgtgtcgccaaaatagacgtggttccatcggccgcttctctgatcatcaaagaactgcgtgaaccgccaagggaccgcaagaaagtcaagaacggtatgaacaattagtaaaatcaacttttattaaacgattcaaaatcaacaaactattggtaccaaaacacgaatggttagtttattagattcacagagagcaaatgaaacaaacgtaacataactcgttagaaatgtggcgcaattttaaaagtgtcaacttttgggaacaaaaggtcccccccccccattggtttttagtaaaattcaaaacttgccaattttaaagtagcgtcgaaatcttattgctgaataatatcaggaatagaccaaggaataccagtaggtatggactggtcactattataaaacgcttttagtgaagcacagcggcaacctgaccattgaacaagtgatcaacatcgctcgtcagatgcgcccccgttcaatcgcacgaaaattgcaaggcaccgtcaaggaaattttgggtttgtttcctaatccattgcaacaaatttaacgaatttttataggcaccgctcaatcggttggctgtaccgtcgatggacaacaccctcacgacattgtggacatgatcagggcgggagagattgaagtgccagaagaatga

SEQ ID NO: 47326 - DNA, 441 bp, Heterodera glycines
  Genomic contig location: Contig_ID=SeqID_15893; Location=1..441; Strand=+
  SCN-specific regions: Sequence locations=1-236,258-441
  Gene Ontology: Mol. function=single-stranded DNA specific endodeoxyribonuclease activity; Cellular component=nucleotide excision repair factor 3 complex; Biological process=nucleotide -excision repair, DNA incision, 3' to lesion
catgacatgccttctttacccctgatatatttaaaaacggtgcagaatttttatttattgatttcacttaggtgttattaacgcttctcggaattccgtttatgaaagcgcccgcggaggcggaagctcaatgcgtggaattggaacggcttggccttgtcgacggaattgtcaccgatgatagcgatgtttggctttttggaggacggaaggtttatcggcacatgttcagtcggaaaaggcatttacaaaaatactgtgctgaggaaatcggcaagaaattgggttagttgtcactcttcaatccgatgactttgtctgaattggaaggattgagaagggccgagtttgtccaattgggaatgctggcgggcggcgattactctcgcggcttggaaaggatcggagttgtcgccgctcttgagttaatttccgaattcc

SEQ ID NO: 47327 - DNA, 991 bp, Heterodera glycines
  Genomic contig location: Contig_ID=SeqID_15912; Location=379..1369; Strand=+
  SCN-specific regions: Sequence locations=1-57,79-173,196-210,234 -844,868-991
  Gene Ontology: Cellular component=cytoplasm; Biological process =oocyte microtubule cytoskeleton polarization
atgacgacaacaaaagaagggagcatcaaacgcgagcagttttatgtgcgctattatgttggccacaaaggaaaggtgagaattgtgacgagtgttaattcgaagttggtcttttgggtcggagtcattttgagtttttggtaatatggtgcggatttgttcaccgggaaagcaaaataattttatttttagttcggtcatgaatttctcgagttcgaatttcgcccggacggcaagttgcgctacgcgaacaattccaattacaaaaacgacactttgatccgaaaggaatgctatgtgggcaagtcggttatggacgaattgaagcgtatcattgaagattctgagattatgaatgtgagttgttggcaaacatggtcataagaggattatgtgtcgaatggttgcaggaggatgatgccaattggcccgaacctgaccgagttggacgtcaggaactcgaaatattgagcgggaatgaccacgtgtcattcactaccagcaaaatcggttgtctcgtcgaagtgaacgacagcaaagatccggtgggactgcgctcgttttactatttggtccaggacttgaagtgtttggtgttctcactcatcggactgcacttcaaaatacgaccaattgcgcaatgatggactaattggtgacgttcttttaaacgacgaattccttttttgataagcgactttttggcataccaaaatggaaaacaaaaaaagaagacttttggtggtttcataacaagaaattttgcccattgtatgccaatttattttggacttttgatctttatttaacacgttatctcttcaattggtttgttgtttcaccaatttttaaaaatactggaaaaaacattatcatattcagtccaaattgcagggaaagatttggctttttagtgttttcctccaaaacagatcagcaaaaagttatatactataaagacgattgccgatgagacaaaaatccattaata

SEQ ID NO: 47328 - DNA, 1509 bp, Heterodera glycines
  Genomic contig location: Contig_ID=SeqID_15934; Location=1..1509; Strand=-
  SCN-specific regions: Sequence locations=1-132,158-519,541-749,778 -829,851-1340,1370-1509
  Gene Ontology: Mol. function=hydrogen-transporting ATPase activity, rotational mechanism; Cellular component=hydrogen-transporting ATPase V1 domain; Biological process=proton transport
ttttgtctaatttcaaatctgtttcttccccttttgcagtggacatgcgcacttatgtgaccaaatttcagtgggaggccgcgcgctatccgatcaaacagtcgctgaaggcactcagcgaattaatcggaaaggtttttcccattttttggaaattgcgaaactaaaataaatggccaccataaaatacggacttacttttacaagccgtttaaatattacatagcatcaatctttttaaatgttttaattacatgagaattgttaaaaacgatggcattttccgagaaaaaaaaacaaaacaaaaaaatttcccataattttcctgtgaattttttctctgagaaagtccatttccatttggcacacatttcgttttgttcagcaagtcagccaaatcgacaacgacctcaaaatgaaggcgaccgcttacaatgcgctcaaaaatgccctcgcgtccatcgaccgaaaaacggcgtaagtttaaaaagctgccgattaaaggaatcgtttcattcatacgcgagcaaaaaatgaaaagagaaaactcaaatttttaattccgtcagagaaaaagtcgaggaaatttacgaaaaaacgaacataaaatattcattaaaaagcgaaaatgtttcagcggttctctgatcactcgcgatctgtccgatttggtgaaggcggacgactttgtgctcggctccgaatacctccaaactgtgtgtgttgtcgtgccaaagtttgtttttcacattttactttgttttaaaaaataaaattgaccattttggcaacaaaaaaagagacaagcaaccgccggatttatttgttgaaattgagaccatccataaagtcacaaaatgttatggcctgcggcgtagaaaaacaaaattttgagttttcgagctctagtcatttctcatttaattccgcgtatattttgtcgtttaaaccaccaaagtttggctccgttttcccattcagacttttgacgaaggactgggagaccaaataccacactttcgccacaatggtcgtcccggggtcggcgcgcaaaattgtggaggacgcggaccacgcgctgtacacagtgacactgttccagaaggtgttggacgagtacaaaggcgcgtgtcgggaaaacaagtgagcaaaaatggcatgggaaaacgaaatttattgggaaaaatggaataaaaatcatacgaatcattccccctaacttctacaaatggtcaaaaagtgggacccattctcactgcgggatgggcccgatgaaaaagagcttcgacaaatggagggaacagttccccccccccctcccgagtattcgggaaaaggacaaaatttaaaaaaattaaacaaaatttttgagaaaaaatcttaggtttttttaatacgaaagtttctagaaaaatttttcagagatttttttttttggaatttattagagtgccacgggaccgggacctggaagcggacaacatagtaccaaggtcccggtttgaccgg

SEQ ID NO: 47329 - DNA, 1864 bp, Heterodera glycines
  misc_feature (1847)..(1847): n is a, c, g, or t
  Genomic contig location: Contig_ID=SeqID_2541; Location=1..1864; Strand=-
  SCN-specific regions: Sequence locations=1-10,32-60,88-141,165 -454,476-1399,1433-1864
  Gene Ontology: Mol. function=electron transporter activity; Cellular component=lysosome; Biological process=anti-apoptosis
agaacactgcctttgtggatggatcaacaatttacgggtcaaatgccaaggatttgtacgttttaaatttaaaatttaattatttatcgaaactgatctgctgaacaagtgtgctctgatcacaaaaagaggagcccttttccaatgactgaaatgatgacaattctaaaaaaatgcttttgatatatttggctcgatcacccgtgatcagagctggattttggttgcaagacgaatctttccactcgctgccactgatcagctgagtgatcagcaactgctttagactgaaggtccgagacggtcgtaccggtttcctgaagatgtccagcttcaacggaatgatggttctgccgtttgatgccagccgttgcggtgccgccaccaaccgcggcacttgcgcagcagcaacttttgtcacgggggacagccgtgtgaacatggtaacgaaattttgctatttttgaatttaacaaatttgaaatctggcggtattcccgtaattttttggaatttttatgcgattgttacatccaaaagctattaaatgaagattaacctcacatctaaggccaattaaataattgatagacgacaaatgacaattatgttaattatgatttgactaaacgacaaatgatcaattttttgacaaaattgtcatgcatttccttcactttcacagttcattggcctttcctcgttatacacactttttgtccgggagcacaacaggtgccatttcttatgccaaaattgcatgccatttttaaatacatctgacagaattgcccgagaattgcaatcgttgaaccgggcatggagtggtgaccgactttttcaagtgagaaaaaaggcaaaaaatcaaaaacggcaaaaatggtgccaaaatttacttttggtattaacctaatggatgttttggtccttcaaacggatcttgaactatgttttgggcctactaaaaaatcgtaggagacccgcaaaattgtcggtgccgaaatccaagccgtcctctacaacgagttcattccgttgatgcttggcccatccgctgaacgtctgatcgggccctacaacggatacgaccaaaatgtggaccccaccgtggccaatgagttcaccgccgccgccttccgttttgggcacggaacgatcgtagtcagttttgacggatttacaggataatcgggtgattaaggaagatgaattttattggtcaagggcagtgccacgaaacttgccattctaatgggttttagaagctaattaacgggtcagacaatagaggattggatccgtcggagagttaattgaaataaattgttattggcgccaaaagcgcgcggtcgaaattcgaaatttgttgaaattttataagagaactttaattttcagaatttggcaaaactttttaaaataaattttcaagtagaaaaagaactggtgttctaatgttgttaattggctgatcattgacatttttaaggaacaattttcccgactcactgagaatggccagtcaatagcggcgggtccatttccattaaatgaaggcaataagtttggcatttgaaaaaaatgccaacaaattttatccccctaaaggcactttcaaatcgcaaaaattgttgtctgagggcggcattgacccggtgctgcgcggcttttggaacacaccaattaagcgaccgcaacaaatgactgctgcggtgacggaacacctgttctcagtgtatgtaagaaacatggcacaaaatgggacaaatgatcgacacaaaaacaaattaggcaataaatgggaagcgaatggtataaatcacggaaaattggataaatgaacaaanaggggataaatgatcag

SEQ ID NO: 47330 - DNA, 1717 bp, Heterodera glycines
  Genomic contig location: Contig_ID=SeqID_15959; Location=102..1818; Strand=-
  SCN-specific regions: Sequence locations=1-258,297-658,680-828,855 -872,895-996,1025-1333,1394-1717
  Gene Ontology: Biological process=morphogenesis of an epithelium
atggtcagcttcgccgccttcacggtggcatgtttgcggcaatttatgtggagcaagccgaccgctgagcttggcatggcacattttgtgccgaccgccggcgatggcattggcagcagtcgcgcatttctgcaccgttaccgaacggcattccccaaatatgagaactatttgggtcagttttgtgtgtaggtggccagaaaattggacatcaaaaaattggataccctggtaaattggactcataaaaattgatacaaaattttatttatttttaaaatataaaatcaaaattagggaaaaaattaatttactagaaatcatcaaatatcaagccttttgatttattagatatagtgtccatattccagcggtttttgcttcgtttttcgactttttatgagaatttattccccgacaagggtgttttgatcctccccgacattttttaattttttccagccatccccggtatttggttggtgaatttcttctccgatcctcgacttttctccccaccgagggtcggggaggaactctaattcaaatttaaccgattgggattaagtgtatttttgaattttgccagagggaccgccgtttgcgccttgcctagagacgttgatttcttaatttgaagtctgattatgctatatagaatagaagaaaactaaatttatcaaatgtagcggaagtaatggtccgagcgcaaagtcgggaacctatataatttttttagaattggattttgatggaccacttgattatgaggagcgtaaagagcaaatatttgctctactcagatggccattggtgaatttatgtaactaaaatttaaaatattttattaaattcatttttgggcattatctattaatttaattgattaatttaggaggccggattggccaacaaagctgtcagttggttggccgaatttgacaaatacaaaaagaatgttgaatatcgaattgatgaggttaaaagcatgacaagaaaaaattatttattaattcatttaaatcagggtttgcaagttttttaattatgcgcccaaaaattcaattttttttttattattcatttttgtcttaattttttcgtaatacatttttgctgagcgctatttttcaaaacaattcagaggaagtaagaagccagagattccaataggcgccgtgagggaaaaaattgaaaatttttaataagatttttacaaaaaaagcctaactttttaaaagtattcctctccgaccttcaaactcagcactaaactgaagaaaaatcagcacatttgcgaactctcatttaaacaaaatattaaaacttgcactaaaaatttttataaaaaagtaaatttactatttttttttgaattaaatatttaaaaaatcaggactcaattttgcctcttctcacgcatgccttcctgcccgctaaacaatttcacaaattcgcatccgatgtgtacatttcgcaaggccatatccagcgttcgcgcatgtatttggagttgagtgatgaaggccgacaaaatatgtaaagcatttcgccaacaaaattatggcaaaaaaaaaaaatttgaaaatactttctttttttttgaagtgagtatttgatgcacgaaattttgccacgggctcgccatgctggacttcctctcgtattgaaggtgccgttcagcttcaacccggtgcatgacctttgggtaaataaa

SEQ ID NO: 47331 - DNA, 1354 bp, Heterodera glycines
  Genomic contig location: Contig_ID=SeqID_2548; Location=2105..3458; Strand=-
  SCN-specific regions: Sequence locations=1-569,591-694,716-1354
atggcatttcacaaaatcgacactgactccgtgaactcaattaccaatgctttggactttttccgtataccccctacaaatgtgagcgtctcgtcttcaaaagtgtttgagcttctgcccagcaaccctctgaccgacacgccctaccacttcaaacttcactcaagccaaaatttcattgacctctccaaatgctatttgctcacagagtttcgaatccgtaaggaaaacgttaatggacaacttgttgacctaaccgctgatgatataaacattgcgccaattcaaatgatcggtcaaactttcatccgcaacattaaaatgagcatcaacgggcgcgaaatatttaatgccaatgctctgatggcttacaaaacatatttttcacatgagctctcctattcaacaacggcaaaggactcacacctgaatgcagcgggctactaccgggacccgggtgatgtgcttgagacgggagacggatgcacagcgcgacgcgatttgtttgcgctcagcaacgttgctcagttcattgccaaaattgacaccgacctgttcaatcagccactgtatctgatcaacttttgtgagctggacattgaaattttgcccaacgacaacaaatttgtgctaattgcgccgctcgcgggcgcaccccgctaccgtttcgaggttgtgggactgaaattgtatgtgaagaaggtgtctctgatggatgggttggcgctggacattgcgcgaaagttggaggtgaagcctgcccgctacgctgtgaggaaaacaatgatgaaatcactgttcatcagtccaggccgttacgagtttacagccaatttgttcatggaccaaatcccccggcgtgtgacaatgggcctggtggcgaatgctgattatgtcggctcaattcggcgcagtccattcaattttcagccatttaatgttcgcgaaatttccattgttgctaatggtcgctcgtacccacaagcgccctatgacttggactaccccagcggaaggtatgttcgcccattcaatgacatgaacgaagcggtgggattcgcaaactcatcggagagcaacggaataacttttgcccaatacggaaaaacgcattgcatttacgtgttcaatttgaccaacagcggggatgatcaagcggcactgtttgatctgataaagaatggcactacagcggtgagcatcaaatttaaccacccagtgccagacggaggtgtaatgttggtagtgatgggtgagtgtgattcactggtgatgctggacaaaaatcgatcgataagcacggacaccactatttaagctcagcacattgtcatttcatcattttgcaattaaa

SEQ ID NO: 47332 - DNA, 1252 bp, Heterodera glycines
  Genomic contig location: Contig_ID=SeqID_2548; Location=2207..3458; Strand=-
  SCN-specific regions: Sequence locations=1-569,591-694,716-1252
atggcatttcacaaaatcgacactgactccgtgaactcaattaccaatgctttggactttttccgtataccccctacaaatgtgagcgtctcgtcttcaaaagtgtttgagcttctgcccagcaaccctctgaccgacacgccctaccacttcaaacttcactcaagccaaaatttcattgacctctccaaatgctatttgctcacagagtttcgaatccgtaaggaaaacgttaatggacaacttgttgacctaaccgctgatgatataaacattgcgccaattcaaatgatcggtcaaactttcatccgcaacattaaaatgagcatcaacgggcgcgaaatatttaatgccaatgctctgatggcttacaaaacatatttttcacatgagctctcctattcaacaacggcaaaggactcacacctgaatgcagcgggctactaccgggacccgggtgatgtgcttgagacgggagacggatgcacagcgcgacgcgatttgtttgcgctcagcaacgttgctcagttcattgccaaaattgacaccgacctgttcaatcagccactgtatctgatcaacttttgtgagctggacattgaaattttgcccaacgacaacaaatttgtgctaattgcgccgctcgcgggcgcaccccgctaccgtttcgaggttgtgggactgaaattgtatgtgaagaaggtgtctctgatggatgggttggcgctggacattgcgcgaaagttggaggtgaagcctgcccgctacgctgtgaggaaaacaatgatgaaatcactgttcatcagtccaggccgttacgagtttacagccaatttgttcatggaccaaatcccccggcgtgtgacaatgggcctggtggcgaatgctgattatgtcggctcaattcggcgcagtccattcaattttcagccatttaatgttcgcgaaatttccattgttgctaatggtcgctcgtacccacaagcgccctatgacttggactaccccagcggaaggtatgttcgcccattcaatgacatgaacgaagcggtgggattcgcaaactcatcggagagcaacggaataacttttgcccaatacggaaaaacgcattgcatttacgtgttcaatttgaccaacagcggggatgatcaagcggcactgtttgatctgataaagaatggcactacagcggtgagcatcaaatttaaccacccagtgccagacggaggtgtaatgttggtagtgatgg

SEQ ID NO: 47333 - DNA, 1125 bp, Heterodera glycines
  Genomic contig location: Contig_ID=SeqID_15975; Location=99..1223; Strand=-
  SCN-specific regions: Sequence locations=1-106,128-160,182-427,450 -549,571-673,695-751,773-965,987-1125
atgtgttatatttcagcaaagtttctctccaatttaatatgcttcaaattgaaagttaacgcatgaaggaaaaattgcagaacgatatattcctctatatttccataaatttaaagaacaatcatgtcgatcattggtcccgaaatttttttttttctgggaattctttaacaagtttctttgggtattttgaggcgctgagcactagagaccggcgcgggacgggatcccgcgcgggattttgcgggatcccagtccgcattcccacattttttttaaaatgcgggattaatcccgcgggatcccgtcccgcaaagaattttgagttccaatcccgcagcgggatccgcaaatttgaaatttccggtctctactgagcactccatttcaacctatttataacaccagcctgaattcgaataaagtcgaaattggaatttttcgattttgatttttaatctaaaatggtttaaacgattttattgaagcactgatgagtatcagggatgactttcagttcgtttccgtgtgtgtaaacaaaggttgaacaaaatatgaaatttaaaagaactttaattttcaactttttatcagaattttgagttcggtgttcggaatttctggtttcaaattgtgttatggaccagtgtttgttattttaatgattcttttgaaataaattaatgcattttttaattttatatcaaaataatgaggtaacctttcaatgaaaaaaatctggcggcgagatagccaaaaaacaaggcgcggcgagttggccgcggcgagttgggcggcggcgagatagcccgcggcgagttggccacgcggcgagtttctcgcggcgagatggccgcggcgagttggccgcggcgaagtgaccccgaccccaaaccgaagcgcatcaacatgaacccgccgaacggagtgctcggcccaaaggagtccgtcaacgtggccgtctcctgcgacgccttcgaccccggcagcgaggacaccaagggcgaccgtgtgaccgtggagtggaccaacacgccggacccagccgccaccgcgttcaagctcgagtggttccagggagacgggatggtgcgccgcaagaacttgccgatcgagtacaacgtc

SEQ ID NO: 47334 - DNA, 5160 bp, Heterodera glycines
  Genomic contig location: Contig_ID=SeqID_16014; Location=1..5160; Strand=-
  SCN-specific regions: Sequence locations=1-68,90-259,440-473,534 -599,622-678,701-904,1084-1226,1250-1476,1513-1557,1579-1635,1667 -1698,1721-1733,1764-1802,1875-1996,2108-2473,2513-2593,2627 -2639,2661-2690,2767-2949,...
  SCN-specific regions: Sequence locations=...2971-2996,3019-3432,3454 -3467,3772-4478,4500-4714,4737-4786,4837-4852,4874-4962,4985-5160
  Gene Ontology: Mol. function=structural molecule activity; Cellular component=basal lamina; Biological process=lung development
agaatgggctagtttttgtttggcattcaaaatgccaaaatcctctaaaaaaaaaattaaatccaattttctgcagcataacactgagggtgatcaatgccaacggtgtcaggccggatttatgcagaaaaagtggcggccaagccatgagggggacccatttgtgtgcgaaccgtgcaattgccatggccactcatccgaatgcgtttatgaggaggaattggacgagaaaaaagcatcattggacatttatggaaagtaataaaaagaaaatttgtttaaattattttaaataaaattttttggttttttatatatttaagaattttaataggaatttataggaaaatgagaatttttatatttgtaaattagatattttaataaaaataaaaatacatttgtttataatagtttaaatattaattattttttttaagaattttcattggaatttattggaaaatgagatgttttttttatattaattttgtatattacttgaaattattgttttttaaattgtatttaaacatttgaacttttaaaaagattttctggcggtggacactgtcaaaattgccaacacaacaccaagggcatcaactgcaacaaatgtacgcccggctttttccgtccaaatggcaaagaatggtcagaattggatgtgtgccaacgtaatatatattttttaaattttctaacaaatatgattgtaatttgaacagttttttcaataattaaattagtgtacaatcaaatttctaagaacgagattttcaagaattttctgcaagaaaatgagtctttttagtgtttgaaaaataaaaacgataaataaattaaaacaattaggtaaaaaaatgccaaatttaatgaaatcaaatgtaaaattatgcaaaagttatttattcatttttagtatcataaattattaattaatgattaaatatttacattgtcaaattaaaatgtttattttatattaaaaaaaacattgaatttatttgcctaattttgaaaaataggaattaaatttgttcatattgaattatgataaattattaaatttaattaaaatttcaattgcctaatcaaaactgataaataaattttaaataatcagatttaaaatggcctattttaaatgcaataaaatataataaatcgaaaaattgtaatcaaatttcttaatatgcaatatgataaattacaatacctaaatgattaaatataaataaaattatttcaattgcctgattaactgattaattaatttaattgcttttaaaaagcgtgccgctgcgacccgaccaaacacactggaaactgtgccgaatcgacgggacaatgtgaatgtctgccacaattcactggaccaaactgtgaccaatgttcaccgggctattaccatccgcccgagtgccgtccatgtgattgccatgtgaatggcacggaggggagccaatgcttggtgaacaaacacttggattttcttattttttagatttatggtagtttataaaaaagcaaatttagagaattaaaaatactcaattaaggattttaaagggttttagcccaaaattgttgtaattttttatttttcggcatttctttaaatgaatttaggggaaattaaaatcatttaattaaaatttttaaagcattttgtacccgaaaattggtgaagtttttaaattttggcatttcaaaaaatgaattgaatttagatattaaaattattttattaaaattttaaagtattctatgcccgaaagttgatgaatttagtcaatctcattttaataaataaataatttaatttaaaatattaaaaaaaaaataaattttgtatttaaatgaataaaattgtaccaaaaatttgtagcccgacagaccggacggacagtgcccgtgcaaggacggattcgctggacgactctgcgacaaatgtgcagctggttacgcgaacataacagctggtgaaaaaggctaattaattaattaatatcaattaaaatagtaaaaattatttatttaatttaattttatgcttattaaattaaaatttttcaaaaattcctaataatattaacttatttaacagattgtcctccgtgtggttgtgatgcggaaggatcggttagcagtgaatgtgacgtgaaaacaaccgcatgtgcatgcaaaagcaactttggtggcctacgctgcgagcagtgcgccaaaggctactacaagcatccgcagtgcgagttttgcgattgcgacccatccggaacggaagaccaagtacggcattttttgatttgtattaaattaattaatagtttaagcattttaattgggataaatggcaactcgtacaaaagaataactcatattttacaaactaaagcctgagtataaggcctaagcataggcctaacctaagaaattgtatgagttgtcatgacacctttaattgttagactttattaaaaataataataaattttaaataataattttagtgttcccaaaaattaattccattgaaataacaaaaaagcatggaaaaacacgcaagcagaaaaagtcagagtatggcaacaaataaataaatataatttaattaatatttttacgaacaatcaccgttttaatctcatcattttaatatatttgttgcaaaagaccaatgccagatgtttaatttatttaaatatttgcattaaataaaactattttttgttagtttttttttattttaaaaattgaaattttggttgaaattcgttagtgaattttgcccaaaattgtcattgttttgaattaaaaatcccaaaaaaacacacacacttcttatgagcctcaaactgatcaacaaaaaaaaaagtgatcaaataaaaaaaccagcaaaaattcacttatttggttcggatccgctcgacagatgatgagtttattttgatttttcttcaaagtattattcgatctaacatctcattattcagatatttatttaatttattttatgataaccaattgatagagaattgttttgctgataattttttaaggaatttgatggctcaagcatgagtttggaattttttgtgaattttttaaaaaagtaaccttttttattgttttccgaaactttgatcactttttctgatcagtttaggggtcagggccaaaaagccaaaaatttggaatagcaaatcgactaagggttgtttaaaataaaattaattgcccttttaggtttgcgattcggcaagtggccaatgtttgtgcaaggcgggtttcgcgggccggcgctgcgaccgctgcgatgacgaattctacggctacccgaactgtcgtgagtgcagttgccatgagaaaggatcaaagacgaaggaatgcgatcagaaaaccggggaatggtaattcaaatggagaatataattaattaattaattaattcttgaagaaatatgaataaatagttttttaaattttaattaaaaaaattaatttaaaaaaaattctttttcaatttaattgggggacaaataattaatcaaattatttattgataaatatcattaaaatgattttattttaattaaaattcaaaaaataatcatttcaattcaattaaattggggaaaaattattaatttaattgaaaaaatattattaaaatggtttattttaataataattaaaaaattacaattccaaagttaaattgacgaaatataattaatttaattattattgaagaaatattattaaaatggtttattttattgaagtccatgctttgccaactttactggtcgcacctgcgacaaatgttccgctggccattaccgtttccccgagtgtttggcatgcgactgtttttcggccggctccaagggactcacatgcgacttcgatggccaatgctattgtcgggaaaattttgaaggcaaacgctgtgaacggtaaaaaaaaaagttcaatttaatttaattttttgccgtacaaaaaaatatacaatgatttggcattgaaggcatagagaaacaatttatgccctaattaaccccctgaaaatttcaaaaaaaaaaagtcagaaaattctcaaatccgttaaattctcgctttatactgataattagggctccaatttataggcactaaaaccgctaaaataggtaggctttgggctctaaaaaacccccaaaataggctacaaaaaatgaaaaataggctctaaaaagtctcaaatttaggggtgtaaaatgaaaaaaataaaataagtcaaaccagtattgagttatacattattttttaaattcaaaaaattgtccaaaaaaatttttaaatacgatttttgagaagattttcatttcttaggggatttattttcagaaacttttgaatctctgcttaggggtgtatttttaaaattccaaaaaaatcgatacttagggggtgtattttttttattattattgtatttttgctaacaaattttcggcaaaacgccaaaataggcaaaaatagggtctttcaaaattttttaggctttttaggctctaaaaataaaagcctagaaaataggtactaataactcgaaaaatagcttaacaacagcccaaaaaaacatgtttttcgtacgtttcaggccacggggagctcaggaaaaaaatagccttttgcctaaaaattggagccctactgataatgattcaaagctaaacgaaaatattgaacagaaaattcttgggattatcaaaatatatttaaatcatgctttaaccccatttaaaatacaattttatttaattttcctaattttatttaaattattttcatcattggcaaagagttaatattatttttccccaattatgctgaagtacaatgaaatttttcaatatttaactcctaattgacccatgcgcgagtcaataaaaactaaaaagcgtaattctcgcgtattaaaaaaaattttttttttctcatttcatgtgtaaataaaaaagatattcgaattttgtttaaaacatatttattttcatgggtattaagtggcattattaatgtctcattattttatagacaattttttatactaaaaaaaaaatcgaacaaatttcttgttaatgtccgtatatgttttcaatttatatactc

SEQ ID NO: 47335 - DNA, 1243 bp, Heterodera glycines
  misc_feature (1240)..(1240): n is a, c, g, or t
  Genomic contig location: Contig_ID=SeqID_16034; Location=4..1246; Strand=-
  SCN-specific regions: Sequence locations=1-240,263-1056,1078-1243
  Gene Ontology: Cellular component=endosome; Biological process =regulation of protein activity, epigenetic
atgccgaatccgataacactggttgacatgacttcagacaatgtggtggattatcaatggtgcactcgtgaggaattggctgaattgaaattagagacaagggagaggcaacagtacagatctgctttttcttttgcgttgattgaataaagcacttgtattgttaactgaataaatctcttaattatctaattctttttcgctttggttgtcgaacaaacaaaccaatattttctgaaatttatttttggttgcgcacaacaatttatttattgaaaactaataggtatttgtcatcatcactcatcattatgttcctttgtgagataaaagaaaaatgaaaacgtatagtaaagtaatacatagtaagctgtggttgtttcctttcatatgttcgcttattaatgctgataaatttctaatcgattctctgcttttaatttttttattgtactaattaaccaaatcataattaacagacatttactatttaggtatataacattgcttaaaaaacgacacgaaataatgtcatacaaattccaaagatcgctaggtaagtgattatttcacgaccaaagatgcaacagtcaattgcatttttagaagtggccactgatcaaacgttgatagagccaaactgggaagtcattctcgaatgcgttgatatgataaggggaggcgaagtgccgtcagtttgaatttcctttatgacgattactaaagattctttcagtgtgaaagaagcattaaaacacattcaaaagcgttatcgcaattcgaacccgcacatttcacatcatgctttgcttattttggaagcttgtgttaagaattgcggcaaaaaggtagggtttcattgggaaaataatattattttttgggtttagttcattcgggaagtggcaaccaaggaagtcatggacgacctcaaaagcatgattatttcggacccgcctgagaagattagagaaaagctgcttgagcttattcagtgctggacatccgctttcaagggaattcccgagttcaaaattgtggaggacacgcacagtctgttaaaaatgaatggcttcgaatttccgccaattgacgaagcaaaggctatgtttttggctgattgtgcccctgactgggccgaaggagacaattgttatcggtgagtgaaaatgaacattaagatacctgtctgcacatttaactttacagaggccgcgttgaatttggcatgttcacccgntaa

SEQ ID NO: 47336 - DNA, 803 bp, Heterodera glycines
  Genomic contig location: Contig_ID=SeqID_16054; Location=301..1103; Strand=-
  SCN-specific regions: Sequence locations=1-503,526-590,614-739,763-803
atgccgtcccaaggaggtaaaaaagtgctcttatcaacaacattttgccatttaaattgtgtttttttaatttcagaactcaaagaaatcttcaacctttacgatgagggtaaggcaaaagccgagcaaaaatggaccaaatatcaaattggaccaaattttatgttcaatggaggcaatttccgatcaaatttatccgccgagggcaaatttctgatcacctttctgttgaaatgttttggctttgctttttactgatcattttcagaattggagggcaaaatcgacgccacgcaaattggcgacgtggcacgcgcgtgtgggctgaagccgaccaatgcgatggtttggaaagcggcgggcgaagaatacaaacgcaagggcgagaagaaattggcattcgaagaatggctgcccatcttcgaacagttgcagaaggagaaggtgaggtggcaaacagcacaaaaaagcaacggaagggacggcacggggggggaggaaaagcagggggtacggaaggaaggaaggacccatcagcagtgccaaaggaggaggaggatatggcaaaacggggtatggaaggagaggtgtccccaaatgagggccaaaccctttttacacattcagaatcccagcgtccctatttttcaaattttcttttgtttttaaacaaatttcaaaaaatccaggtcaaggcctgggccagccctttacaacacttgatttttcatggcatgatttttgtccaggaaatccaagtccaggcctttctcaaaatgtccaattctaatggcaacatttaa

SEQ ID NO: 47337 - DNA, 2377 bp, Heterodera glycines
  Genomic contig location: Contig_ID=SeqID_2562; Location=696..3072; Strand=-
  SCN-specific regions: Sequence locations=1-115,139-139,167-246,428 -479,644-2191,2214-2313,2336-2377
  Gene Ontology: Mol. function=ATP dependent RNA helicase activity; Cellular component=spliceosome complex; Biological process=RNA splicing
atgaacagactcgaccgatccttggtggaagatctcttcgccgaccgccacattcaagtttgttgttctccattccacattttcattcaaattgcaattgttcaattaattttaggttttggtctctaccgcaaccctcgcgtggggtgtgaacctcccagctcagtaagtttaataaccgtgaaacatagccattttgtacagaataaaccatttactgctaattattctcttttttaggactgtgatcattaaagggactcaaatttacaaccctcaaaagggtgcttggactgaaatcggtccattggatattatgcagatgatgggaagggcagggcgtcctcaacataacgcactcggaaaaggcattttgatgacccacaacaccgaactgcaatattatctgtcgttgatgaaccaacaggttacaaacaccgattttgggttttgtcgtaatgaaaactttttcattcagttgccgatcgaaagtcaattggttgcaaaattgccagacactcttaacgcggaaattgtactcggaactgtcacaaacgttgtggaagcgatggaatggctcacttacacatatttacacgtgcgaatgtgcaaggcaccagcactgtacggaattgtcgcagatgtaagtccattggagcaattagacacacaaaagccaaacttctgttcctcaggaaaatgacaaattgctggagaaaccgcgggctgacttgattcacacagcttgtttgctgttggacaagggaaatctgatcaaatacgacaggaagactggcttaattcaggtttatcggtgtcaagaattgctggaatattcttttgcgttgagtttaggcacaagaattgggtcgaattgcctcgcattattactgtacttacgaaagtatggagacttacaacaaactgcttaaagaaacggccactgaaattgacctcttccgcattttttcgctttcatccgagttcaaacaaatccatgtgcgagaggaggaaaagttggagctgcaaaaattggccgaatgtgtgccgatacccatcaaagagtcactggaagagccaagtgccaaagtcaatgttttgctccaagtatgatgtttacatctttatacaaatgatgcgttttctcattgtcatttaggcatatgtttctcaactcaaattggagggttttgcgcttcaaagtgacatggtgttcatctcccaatccgcgggtcgactcttccgagctctcttcgaaatcgttctttggcgtggatgggcccaactggcattggtgttctcttttttcaaactaaaactaaacaaaaaaaattatttagaaagtgctcggtctttgcaaaatggtcaatgctcgccagtggcaatcgttgaaccctctccatcaattcaaaaaactgccattagacattgtacgtacgttggacaagaaaaatttatcgtttgaccgtctgtacgatttggacgctcatcaattgggcgaactcgtccgagtgccaaagatgggcaaacccttgtacaaattcatacgacaggtgataacgcccatttacgactattgttttgcatttgttcgcttttcagattcctaagctcgacatgaccactttgattttgccaatcactcgttcaactctccgcgtggaactgacaattacgccagattttcaatgggacgaaaaggttcatggaagctcagagggattttggattttcgtcgaagacgttaacggcgaaattattctgcaccatgaatactttttgctcaaacagtgagtacaataaataggttgttgtttaataatgtcactaataatgaatatttcagaaaatattgcgaagaggagcacgtggtgaagatgttcgtgcccgtgttcgaccctctcccgccgttatatttcattcgaattgtatcggaccgatggcttggcagtgaaactgttttgcccgtctcattccgtcatttaattctgcctgagaaatatcctcctccgaccgaacttttggacttgcagccgttgccggtgtccgcgttgaacaacgcgacctttgaagcaatcttctcgaaacgtggaattcgtttgttcaaccccatccaaacccaaggcaaataatcaaccatcactttacttaatagatataaattcaatttgtttggtttagtctttcgaacttgctacgaaagcaatgaaaacgttttgatcggtgctccgaatggcagtggaaaaggcgtttgtgccgagtttgctctcctccgccactttgagaataaccctcctgggtcgaaggcggtttactgcacgccgttggatgacttggccaaaaatgtattaatttcgaatttgttttctttattaaa

SEQ ID NO: 47338 - DNA, 1068 bp, Heterodera glycines
  Genomic contig location: Contig_ID=SeqID_16079; Location=24..1091; Strand=+
  SCN-specific regions: Sequence locations=1-298,320-982,1004-1068
atggagcaaaacagcagtgaaaatcaaggttttatgaaacgggcggcacggttttcggatggtcgaatgtgtgaaacaatggttaagctgaattttgatctagcgcatcagaatgcacggatgcttaacaaccaagacattgtgttcacaattcaccgaaacagcgatgcgcttcttctgcaaacgccgccttggaagaccgtacatgctgatggtacggaaacatggaacgaaaacactgatgagtatcgtatccggctacacgataggcgtgtttatgtgcgcacagtagacgcaacaccaagcctgaaccttgcaattagtaaacaattggagaattctttcgcaaaatacgcgcttcgtaagggggaaatgcgctccgtctttttgggaacaggtcgaaccgagctgtcacataacgtgttcacctcaacgctgcctcgccgcctgatctgcacatttgtctcaacggatgcctattccggcgctcgtcatctgtcaccgttcaaatttgagcatgcgcatgtgcgatcgctcagcgctgaggcaaatggacaaacatttccctccactccgtacctgttttcgttcgagggagggcctgacaacaaacaacaacgcttcatacgcgcattcgtggacatgtatgctggccttgggctcgacgaaacagacaacaataaaacagtgtcaattgatatgcaacgattcttaaacggatgggcattttttgtgatcccgatgacctccaccctagaggatacggcaggatttgagctaatccgtcagggtacgtgcactgttaaggtccaatttgagcagcctataaaagcggacggttatgaaatgttgatcctcggcgagtttgactccatcctctccattaacgcagatcgtgtgctcagcacagacggaagtgtataaataatctggacgcttgctaaaatgaattcgttgcaaattcatttaattctgaacagattacaaaaaactaagcataaatttattggcgtcttcccgtccaataaggttccacttgaacgtaaaagattccctcactgtatggta

SEQ ID NO: 47339 - DNA, 2817 bp, Heterodera glycines
  Genomic contig location: Contig_ID=SeqID_16083; Location=8..2824; Strand=+
  SCN-specific regions: Sequence locations=1-588,629-779,801-1757,1779 -1978,2001-2316,2338-2536,2558-2817
  Gene Ontology: Mol. function=sterol transporter activity; Cellular component=mitochondrion; Biological process=protein targeting
gactcatttcgttttttgttttcttaaggaatgcttttagaccggcgcaggcggaggaattgggcgtacttatgcacttgaatttgcacgcagaggtgccaaagtgataggttagtttagataatattacaatggaaaatgttattacaaaccaagtgaatgacttgggaggggaccgccacggaaaatccgcgtcgacttcggcagcagacaaagtcgtagccgaaatcctagcggcaggaggaaaagcggtgccaaactatgacaggttggccatgggaaatggcaccctatgaagcagccaattggacagtgttgaaaatggagacaaaattgtgaggactgccatcgataattttggtcgaattggtcggtctttataatgcacaatatgtaaaagtaccttcttgggttctcacttcagatatcgtgataaacaatgctggcattttgcgggatgtcagttttggcaaaatgtctgagttcgattggggtttgtcatttttatgcctttggcaattttttaaatgtttctttttttatattgatagattcggtaatgaaagtccacgtgaaggttctaattgttctcactgtcttaatttctctgttttacttttcctaagggtgccttttcggtgactaaagcggcgtgggaacacatgcgggcgcaaaagtacggacgtttggtgtttacttcgtccaattcgggcatttatggaagtttcggccaggcgaattatgcagcaggtgagacgaaaaactgaaaaactaacgggttggcatgaccaaaaaagagaccgatggatttcaaggagtagtcgaaaatggaatcttgaagaaaaaaaaacacacatcataaatacaaatattttaagttcaatgactcgataaatagtgcagcaacccgctgaaacgccttggactaattttaattgtttagcgaaaatggcactgattggtctatccaacactttggcgttggaaggagcaaagtacaacatcgccagcaatgttttggtttgtattcccactatattctattaattttaattgctcatcttcctcattttgaggtgccaactgctggttcgcgaatgactcaaacagtgatgcctgaagaattgctgacggcgatgaagccagaatttgttactccgcttactgttttcctggcacatgaaagttgcaacgccaccggaagagtttttgaagccggggcggggtggtatggcacaggtcaatgggctgggcttgggggatagggaaggccaaggagcggaaaatggccagaaaactgtcaattatttgagcattttggccaaccaacttttacataaacgaaaattttcaaaagttagaaaaatctatgtaatacaaaatttttgaagcgctttcgaaccgtaccaagaatgtttaatttggtttgaaaaaaatcgtgatgcggtcgacgttttgttcttctccgcttcgaatcacagtgtgaaaatgcgtttgtttttgttttagttgagcagttccgttctcgaggaaaagttatcgcagaaccaaccgtggagaaatgtcagtttgacattaaaaatgcgcaactttgacaatttttttcagtggtcgaaaattgggaggaaatttgcgatatgagtggggcacagcacattgggagcatgcgagaagtgatggagaatttgatggacgccctcggggtgaacaaatccaaaatgtgatatggcctttaattaggccccgtaaagccggtaattaacctaaccaaactttgtagattctgagccaaattaataaaagtgccataaatgattttttgagatgattcaagaattttgttgagaaagatattgacaacggctaaaaagttgaagggtgggcgtgggaagatgggatattcggggcacgaccggacatttggacaatgggcatttcgacagacaacttccgttttcttggcttatatcgactgaattttagcattccattttcctaagaacttcaaaaaatatttggttttttactaaagtcatttttattttttaaaaattctttttctgtcgtaatgtccgctgtccatttctgtccgaatgccattggagcattcggggggagtcgaatcgcgaggctttgcccccggggctttgttccgccgtttgccgctctccctgctgatattcttttctttctgctccctccctcggcttcatttcagtccgctgtgctgcagtcggctgctcaactgttccaccatcggatcactgctcgcttgacggcttgtcgagcgccgaatttcctgccaaaacaaattgaaagcatttgcattttgatcattgcaattgtcggcttcgcttttacttcgatgcgttgttcgaagttcgaatctctcgaactcgcactcatcgattgctgctgacgattcgcttggcgttgactttcggtcattgcttaaaagcgattgttcgttacgctgtcaataccaaacaatgacagatcagagaatgatccgctcactttcgtccctcaactgttgcacaaatttcaatggacttggcacatttggcggggatgtgtagggcgggtagggcccgaatctgtgattggcaattgtccaaaagaggggagtccgtcccatcgatggcttacgattcctctacggtctgtgtgtagtgttggcgggtgattgtccgcgtggtctccaggctcgggtcgatcactgtcacgggcgttgtggtcgcgtattggtggatcagctcgcgtgggttcgtcacccggtagtccttcttaatctcatagcgcattcccggctcatat

SEQ ID NO: 47340 - DNA, 2194 bp, Heterodera glycines
  Genomic contig location: Contig_ID=SeqID_16103; Location=169..2362; Strand=+
  SCN-specific regions: Sequence locations=1-193,215-626,652-1052,1074 -1399,1424-1829,1861-2194
ccctccgttccgcggctgcccaggcccggctgccgtacgatcgtgatgaccaaaaaggagttggagctgttcccggagatgagccgagcccaggcttcggtggcactgttcctttacattcgcaatcgaacggtggctggcactttttctgaatgatttcttccgtcggattattagtacaatattccccacttttttccttggctttttgcccttttctgacgacatcccataaactgcttaatggtcaaactttttcttaattccgagcccattaaattgagttatttgctaattcagtcttgaaaaaggcaactaaaaatgaacaaattgaaaaatcaacaataattatgtgcgttttgatcatattattaacactcactttttgctcttttagtaaaatttcgcttcccttttcagttggtcctttggcaactcgaccctttggttgagctgaccgtcgaatacattctcaccgaacttccggcaccctttgacagttcgattttccctcttttgagtcgttttatccgtcccttctttaggtgacgttgagttggtcaccggcattcatgcgtatttgcagcgctacggcttcatcaattttggccttttccaccaactaacgggtttgttttgttttgtttgtcatatctgaatgacaatgaattcggcaaaaggcacgccctttacggttttcaaaatggtcctttttaaaatgaaatttagcgcgtcgtttggaccgcccgaagactgtcattgtcatcggtgccggcccggccgggctcgccgctgcgcgtcagctcaaattcttcggcttttccgtcattttgctggaagggcgggtgggaaaggggcgcggtaaggcaaataaatgccatcaatgttctcccttttcaggctcgtccgggtggacgtgtccaaaccatcaatcgcacccattccgcggaccttggggcgatgattgtcatgggcattagtgcgtttcactctgtttttcattccgttgcttttactttggccactatttgctaatttcagtgggaaatccgttggtcactttgatccaacaggcaccggtgaccgttttccgtgccagcaatcgctgtcccatttatgacaaccaggcaagttcgtttgtttgttagacaatttccaactttgcatcgtttgtttttcactcacaattattgaaatttgtgggttttagggcaaattggtggacagtcgcaaggatgatatgattgagcgttcgttcaaccgcattttgggcacaatttcctatctttcgcacgccgaaggcgtcaccgagacgaaactgcccggggaaacggcggggcggaaaatcagcctgggcaaggcgttcgaactgatcctcaggtcactccctcttattcgcttataaaacaaatgcaaatttcaatgatttcaaaatgcggtccctgggaaagggaggggcaaacggctaattgtaaagggttcattttgacatgacttatgatttgacaatggacacttttcttccttttcagccaacaggaattgcgcgtcaaaaacaaatggctcaatttttggcagaaatactactacttgttgaaaaagttggaaatcgaaaaactcagagtgaggcgaaggcaaaaaaactaaaaaaatagcggggcctaattcattaaattaattaattagtcgtttccaaactattgggttagttgcttttgttttcaattcctcaggtcgattctctccacgctcagcttgccgattgtatgcagagactgcgcgaaaacggaattgcgaatccggcggaagcgaccgcggaaacggtggggtttttatttattttttttaaaaaatatttttgagccatgtatttgcaaatccaacaattttggaatcaccccctcgccccaatttttcgtaaaccatttcgggactcaaattatgctgcatttctcagattgccgtcaattttgaagaatcggccgaaaaagttgaacagcaaatgattgtgcgggctttgcgtaaaatcacggagatcactttggaagtgggctatttttttggcttctgtttattggcataaatttccaataaattttttttctatcctttcaagaagtatgacgaggccgagcgcgaacggaacaacaccgaaaacgtattgaaggacttcaaacagatggaaccgaggtga

SEQ ID NO: 47341 - DNA, 3659 bp, Heterodera glycines
  Genomic contig location: Contig_ID=SeqID_24; Location=7416..11074; Strand=+
  SCN-specific regions: Sequence locations=1-57,80-184,206-430,454 -595,617-1254,1276-1330,1360-1764,1786-1955,1978-2567,2589-3249,3271 -3355,3377-3659
atgccttcatccaactcattctatgtgatcgttccttccaacacaaatgttgaaggaaatcgcacaaactcttttcgagttcgactaccaagaaaacttcaatttaattcggaatgggatgtgggcttaggtgtgatcatatacccccattcgtggccctcactcggcacatcagaggaccaatttgttcaaattgaatggaaaattggagagaatgttcaaataccaattccatcctctaacgtgacaaaccccgttgagctttggaaaagtctttacaaactgcttgaagaaggcaacaaaccgttcgcagttaaagtggaaggcgtacagaaaaaatttactgaagcggccaatacagcacgtcaattgggcagagccgagtacatcaataaacaacaacaacaacaaagagacaaaagaaatgttaatgatgatgatgatgatgatgataaaaacgaagaagaattattaaacgcccttttagcgggggttgacacgttgcttgacctttacggagcaaccagtggtggtctacttgagagagaaaaacgtgcagcaacaagcaaggtccccctgcggaattgggatgacactgaagaggaatatcagaaaaagcttgataaatattttttgcgtctacgtggccgtaatttagaacacttagagggactgataacagaaaagttgaatgcggaaattgcactgatggatgacgaagaaaggacaattctcgatcaaaccaaagaattaggcatgacagcgtggataaaaatttttcaatcagcgtactctgcatgtttcctgcattttgacagtgcaacgaacagattttcgttgaaactggacgatcgttatgtgcaaaaaataaaaatttcagaccaattggcctacattttgggttttaactcaaccgatttcactgaaaaagaaacgattgcaaaatttatgccagacatgagtggaggagttgcttcttttcatgtttatgcacctgatctaattgaaccaatgatgattggtgacgtgattgccccagttttgcgtatcgttacgattcggggaaaacctgacgaaattatagaggagcagtttctctccgtccaataccatcgcgtactagtcaaagaaataagtgaaattttcatcgaaatcagaacatccggtggtaacctaatgccatttcaatacggtacatgtacattaaccttacactttagaaaaagttcctacttttaaaaatgaacagtgttcaaataaataaaattcttgctcgaaacccagtcacgcgttcgacctttttagggtgttttccatcagatcaaattccagcagtagcagccacaccagctccttattcaatggtgattaacgttgatccgagcggttcacctggttcacattgggttgccgtgtattgcgagcagcaaaatcgggtggaatactacgattcgacaggaatttggccaccgctaagccctttcatccaaaaatttttaaagagttttgctcaaattcagtttcatcaactttcgctccaagcaccatactcacactcatgcggaaagcatgtgattttctttatatttggacggtgtatggggatgcactttgaagcaattttgcaactgctaaaacgcgcaaaaatatcaccagatttttttgtaaacaaatttatgcaaaaaaatgtgtttaaacaaatataaataactagaaaactcaatttaaaaagcgcaaaaaaaaaaagaaagaaaaatgcacgttgattttgatccttttaaagttgaatggtcagcattaacccaaatttctccagaagtagtcgtccaatacggtggttataatgtgttcagaggggttccataccagcgcggtagtggtatcgggtctgtttttaggagtctattgcgttacctaataccaattgggaaagaaatcgggacagccatcgggcgccaaggacttgaatctggaaatcgagttctatccaatgtattagagggtagggacctcaaagagtcacttgttagtgagggaaaaacggggctcaaaaatttgctagagaaagcagccaacaacataaatgcccaaaaaggtcaagggttcgactttaaacgatacacaaagagaaatgatgcaagagaaggtggtgcaattggtaaagcgaaaaaaggtataaataaactacaatcaaggttgggaccacacgatttcctaccagcaaacaccccagcaggtcggaagaaaaaacacactaaacagaaatcggtcaaacgccttcgtaccgatatacttggaacctattaataaaacaaccccccagaagcacaatcatgagttgttcacaaaaaattagcgaaagtagtccccttgccacaaatagtgctttgaacattttttcagtacctccaacaaatgtgtcggttgtgcgctcatatttccgtgaagtcctccccctagtgacaataacgcaagaatctccgtatctttttcgcctgtacagtgacaatctttggaccgatctttcccggatttatctcttccttgacctttcaatagaaaaaccggatgtggacggcaactgggtgtcaatcgcagctaccgatgctcaagtcggcaccattcagggaattggtcaaacatttgttcaacaactaaaagtctcagttggaaacactgaaatttacgacagcggaaatttgtacccatataaggtttacattacgaacacactttcgtttccgatgaacgtcaaaaaaagcttcctcgcttcaactggtcactatgcgacacgcacacacgacagcgtcgctgatgagggctttaaagctcggtgtaaaatttttgagggtgggaagcgagcccaatttctttcacgtctggactttgacctgggaaaccaagaactttatttgttgaacaatttggatcttttatttacaatttacaaagctcgtgacactttcatcatgcagacattgaaagcaaacgatactaccaaataccgcgttagagtccatgacgtaaaactgtatgctaaaatgattgatgttcagtcatctttgaatttaagcatctacaaaacgcttgaaaaacaaccagccacatatgcagtgcgaaaaactgaaatcaaatcatgctttataagtgaaggtaggtttgaaattgactacaatgtattcagtgcaacaattcctcgacgtatgacaatcgcacttgtcgcaaacggggcatttaacggaaattatgctctctctccatttaattttaaaccgtttgacattcgagacattgcagtgtacgctggaggcatgatttacccaattgttccatacaaacttgactttgccaaagatatttttgtccgtccttttgttgacatgtatgaggcacttggcatggctaattcagagcgttctttcgacatcacaaaagagcaattcaaatctggttggaccttttttgtaattccactcacatcgacgctcgacgatagcacagggtatgaactcttaagaagcgggacaactagcattcgcgcaacatttaatagtgcaattcctgagggcggagttgaaatgatagtgctgggtgaatttgaccaaatgataatgatagactacaaccgtcacattgtttccgattcaaagcttagttaa

SEQ ID NO: 47342 - DNA, 1400 bp, Heterodera glycines
  Genomic contig location: Contig_ID=SeqID_16122; Location=1..1400; Strand=+
  SCN-specific regions: Sequence locations=1-631,653-1400
  Gene Ontology: Mol. function=calcium ion transporter activity; Cellular component=integral to plasma membrane; Biological process =calcium ion transport
ccccccccccccccaattaggccgagtacgaaatgatcacgaaggggcccaagtcgcgtgccttttaccgcgtccaggcgacgcgtcgcctcgtcggcggtggcgacatcgtgcgcaaaaggttggagcgcgagcacgacaaggcgggcgatgtgacagtgcaggaacaggagagacaggcacgacgacacacgtgccgcattttcttcgacccggcacattacacagtgctagagagtgtgggcgtattcgacgtgatggtcggaagggacggcgggccggacggactgacggtgatggcggattattacacggaggacggcacggcgaatgctgggtcggactatcagccggtcaaaggcacgctgacattccacccggaggacaaacaccaggcgagaatggcaaaagatgggccaaaccatttgccaagggatgaccaaatgattggcaaaagatggagcaattagttaattggtcaatcatttgtcataatctttggcaactgattttgccaattgcttgtttttgatctctttgttgcccttttcagaagattagcatcgaaattgttgatgatgatgtgtgagtgtcgcttcgtccctttgtcttttcaatttccgtccgttttttcagatttgaggaggacgaacacttttacttgcatttgaccaaccttcgggtccgaactcgggacggactcattttggacccctcgcgaatcggaggagtgccggtggccatgttcgacttggtaatgaggcatcatttcacggcatataaatgcctctgcaatcctctgtaatttattaatcgctcccttcccaaatcagccgaccaccgcgaccataatgatccttggtccgtttgcctaattgaccacttattatgctcatttgtttgcagatgatgaccatgccggagtgttctctttcgagcacgaccattacgtaactgtggagaactgtggtcacgtcactctgcgagtgcagcggacgagcggatgccgtggccaagttgtgttgccgtacaggtggcaaagccgggggaggggaaagtgccaaaacaatgcgaattgacacgaaaggaccatcgacggcacggcatccggcggaaagcatttcgaggtcaaagagggcgaagtggttttcgagaacaatcaaacggagtaagtgaaaggaaaggccgaattggaaagtgccacaatttagggcattcatcgacattggcatcatggacacggaacagtacgaggtgagtgattggtgagtgatcgctctgatcactccagtgcctttacaatgtttgccgtccattcattcctttaattcattcttttaagcgttccgactttttctccatggaattgaaagatccaatttggacaaagaaaatgtcag

SEQ ID NO: 47343 - DNA, 673 bp, Heterodera glycines
  Genomic contig location: Contig_ID=SeqID_16135; Location=1..673; Strand=+
  SCN-specific regions: Sequence locations=1-219,241-673
cgaaggggacgggcccggcctgaaacagttggtggagcaggtggtgcgcaccaccggcatcaacgaggtggcggacacaggtgggcattcgtcagtcctacctctaattagttcgttctagcactaatttagtcagtcctgccgctaattagtcagtccattactccttaaaagtcatcccatattactgcctaaaaaatcatcccccctcattatcccctaaaaatgccattcctaattgtccccccccccccctctttccaatcacacagaaacgatgcgtgtcgtcaagggcgagacgtcctcccgccagtcgtaccaacggtcggccaagggcaatgtgtccattttggagacgtcgccggagggcaaatacgtggtgttggagaacacacaccgatcaaaggaggagaccattggagagtggaagctgaagcgtcgcattgatggcaagcgcgaaattgtgtacacattgcccgccaactttgtgctccgcccgatggcccgtctgaaggtgcgttttcgtttttggcgtagagcgcagttagcccgctgatcgctgatcagagcattatcgattggtcagagtgaaaggaagaaaaacacagtgagcggtttaacccaggggtgcgatcggttcttatttgtaagaaatgttctgattttgggctat

SEQ ID NO: 47344 - DNA, 1686 bp, Heterodera glycines; identical to SEQ ID NO: 16143
  Genomic contig location: Contig_ID=SeqID_16143; Location=1..1686; Strand=+
  SCN-specific regions: Sequence locations=1-94,117-145,168-414,440 -1037,1060-1274,1296-1336,1367-1686
  Gene Ontology: Mol. function=receptor signaling protein activity; Biological process=signal transduction

SEQ ID NO: 47345 - DNA, 1113 bp, Heterodera glycines
  Genomic contig location: Contig_ID=SeqID_16145; Location=144..1256; Strand=-
  SCN-specific regions: Sequence locations=1-46,69-329,351-462,484 -517,539-864,886-1037,1059-1113
  Gene Ontology: Mol. function=protein binding; Cellular component =lamin filament; Biological process=pronuclear envelope synthesis
atgacatcgttcagcgacgaagtggagcaccgttaccaggccaagctgcaggaacagctgcaggccatgcgggacgactttgacaatcgcattgcgcagaaccgtgccgaggtatgtgtccagggtgaatcagcaagccggggcaattttcttaaagcgaaaaacaagaccaatgtcagggatggtaccagaaatttggtttggtttcaggtcgatgagctgtaccgcaacaagctgggcgaggcggctgaaaacgcgaacagaaaccgtgacttggcggccaaggcgcgcgaggaagcggcaatgtggcgcgtccgtgttcaggacttggagaactccagcaaagaccatcagggcatcgtcgagtcgctgaaccgtcgtgttaaggtttgtttttttctcgcgaaacccaattcgttgagttttgaccccaaaatgtctaaaaagctatgaattctgaaattttctccctgttagaaaagtgtaaaatattcggagaatttttttttttttggatttttgacacgaagagcaaaagccctgaccaactgattatgatttgctcacatttttaaggacttggaggcggcgttgcgccgcgcgcacgaggacgccgacattcgcattcaacagcgcgacgaacagattgagcaactgcagaaggaaattgcgttgatgatcagtgactaccaggacttgttggatgtcaaagtgcagttggacaccgaattgcaggcgtaccagaagatgttggagcaggaggagaccaggttggcattgatggggagaagagagcggaattggggggggggttgaatttgtaactgtcccgtttatttttttggattcatttgctttgtgtttcaatttttaatcaaaatttctctccacagattgcacattacgccgtcgaccagtccgaacacgtcggttgtcgggcagaacatcagcacgcctaacatggtcatttccacgccacgtccggtcagcccgcgtttggcgacgccggttactcagagcgaaagtctgaccaccgtccgccgtggggtgaagcgccgccgtctcaaccaggatgacattgtctccttcgacaaaacgtccagctcgtggaag

SEQ ID NO: 47346 - DNA, 757 bp, Heterodera glycines
  Genomic contig location: Contig_ID=SeqID_16146; Location=55..811; Strand=-
  SCN-specific regions: Sequence locations=1-572,594-757
  Gene Ontology: Mol. function=structural molecule activity; Cellular component=lamin filament; Biological process=pronuclear envelope synthesis
atggcttcgaaaagtaaacgaacgactcgatcacagcgcgaagctgccattcacattgatgcaagtgcggatgagaccatcgaaagcaggttaagttaaaaaactgttttcagtgatggcttcgatttcaataaatttccaacatgcaaaaaaatttttttgttagcatttatgctttttggaaaatcaaatgctaatttttcgcttcccttttttcagcagtaatggctcaacaattaacagttcatcgggtcatctgtcgtcgcgtcaggacgagaagaaccacctgtgcaatcttaacgaccgtcttgctggctacattgaggtttcgcttttttatagagtagaaattgagttttaaattttcggtggtccgttgatgcctcgaaatttcatttgaattcatctaactttctcattgtttgtaatttttgatgcacaacagccattgctatttcagggatggatgggaatcccgccaaaaagtgattatattagtagtttttcagccttaagaacctcaatggaaacccaccaatggataaaaataaataccagtaattaagatttacaaataaatgttttccttcagcgcgtgcgcagtctcgagacggagaatgcgcgtctacagatccaagtgcgcgaggttgaggttgtggagcgcaaggagaaggaaaatttgtcggcccgctacgagatcaaaatcgacgaactgcgcaagcagttggagttcttcacgcgtgaaaaggccaagtag

SEQ ID NO: 47347 - DNA, 978 bp, Heterodera glycines
  Genomic contig location: Contig_ID=SeqID_2577; Location=1354..2331; Strand=+
  SCN-specific regions: Sequence locations=1-44,66-978
  Gene Ontology: Mol. function=endopeptidase activity; Cellular component=proteasome core complex (sensu Eukarya); Biological process=sporulation (sensu Saccharomyces)
atggaattttcttcaactgattatctcaatgagcatcaacgttttgactatcagattttgccaaaagtagaatacactggtgtatgttataaaacgaccttttttttaattcgggagctaaattttagacaactttggtgggcatggaatgctttggcggaattgtcgttgctactgattctcgttcttccagtggaacttatatatcgaatcgcacaaccgacaaaattaccatgcttaacgaccgtattgtgatcctgcgagcgggcactcaagcagacacacaggccttggccgatatcgtcatgtattatgcggaagcgcatgcgtgtgttcttttattaaaaagacgcattcacaatttttctcatttcaaggatcatggacgaagaggatgagattaccgtgcgcaacgttgccaattacgcccgcaaaatgcactacaattatcgcggacaactcaacagcacttttcttgtggctggttacgactccctcaacatgggtcaactgtatgtcatcccaggcggaggatacaccacgcgacacccttattatacgtctggcagtgggtcgtcatacatccgagaatatctccaaaaccaatggaaggaagatttggacggagaagttgttcgtcaggtatttaagttcaattcgttattttatataatacaaatagaattaaacgagtatgtcaggatgtcttaatttttcagattttgaaaaaagctgtttttgaagcgcagagaagggacggtgcttcgggtggtttgattcacacggcaataattaatgcgaaaggaatctcgcgaaaggtttttataatttatttttttgtttctgctaagcttttttaagacttatcgccccgacaaagaagattttccaattgtttcgcccgaaaaattctacccaaatttgcctgagcatattctacagcccggcttggttaccattgaacgcatggaaacttga

SEQ ID NO: 47348 - DNA, 2060 bp, Heterodera glycines
  Genomic contig location: Contig_ID=SeqID_2583; Location=2300..4359; Strand=+
  SCN-specific regions: Sequence locations=1-416,439-473,496-549,572 -610,633-974,997-1345,1367-1554,1578-2060
actaaagatacaaaatgttaccaatgaggcagcagcggatgcatggagcgaatcatgaggaatctacgtttaagtcacaccttcaagacgaagtgagacaaattctgctcacttgggaaaacgaacaccggaacaatgattgggaaattgagccatctttgaaacggtcagtttccaaaattagttcacagctcttattcgcgcatacatccgccggcaccatccctaccttattctcctgtcatgctttaatgtatttagaatggccgaaatactcgaggaagcgataaacgattatctacagaacaacccagacccaatggttgatacaattacattaactgtgaaaaaaagatgtttaggatgaacggcacccattcaaatcgcaaccctcgcgcccgctaggctatttgctgaaaatgataacaaaggaagagaactttctcaacaaggtttctattttttcgctttgctctttctcattccattgttttcagttgatcatttcgtatcttctcgccagggacaacccccgactgaatatgttcgctgcccgacttcttttggatttgttgcctggaattgacaccaatgtgatccttgcggtaattaataattattcaattacaattggatttaatcgttcttaggatgccgaatcattattaacacaactctttcgctgggcagaaaatggcgattctcgcgaactcagagcgtatagtatggctttacttggatcggcaatggacgctgaacaagcgcatcaatataggcagcagaacgcgactttgatcccaatcgccttgcaacgccttcagtcgctttatgtaacattaaaagttacgcaccgaaatactagtagagcattgttttcttttagtcacaaatgttgtcagaatatgatcatcaagacgagcaactcagaaaggaaagcaaagtagtcgggccaaccgatttttcacttttacgtcaagaagaacaacatgaagaagcatttattggtacgacttctacaccagattctaatgaggaaatgcgttgccggccatcaatatccaatgtgaatttattcttaaattatttaccaatatttaactgattaacttctgcgaaataaatggatcaaactgtccattatcttacaagtcttcttcaggaagaactcataaaggtcgccagaaaacggcataatgaacgacagagtggattgtcaccaacttcaaagcggtcatttcccgaccaaattacggacaatgatttctatgctgattaattcgatacggggcgtttctaccattgacggcggtaacagcaacagcagttggcgtcaaataatgcagccgattttggttggcacccattcattgtacccgctttcgattgaaatggagcaacgacttattcttaactatttgggaccgaccagtgaatatcaagatgtattttcgggttttatctaactttatttccgtaccttctttagaatcttagtattgttctcgagaaccatgcacttgatgttgttttaaactttttggaaatcgatggtccgaatcacaaatgcagagacattcggcttcttttcgacggcgttcgctatatctcctcgctgctcattcaccgcaaatttgcctgggaatttattgcggcgcagggaatccaacgcctcctgcgaatcaatcgtaaatcaattgcctcaactgcagtgaccacgtgcctttattatttggcctattcagcggatataatggaaaaagttttactgtgttttgttattgattccatccaattcaaaataggtgtgtcatttgcctgaacaagttttgaatgacatcatcgattacgctttgtatgcgcttgaccataaccatgaaagtggtcgtgcttcaattgccatgtttcttgcccatgccctccaatttcgtcccatcctcgaccgttttgaccagcgtgatggtcttcgccgtctctacaattacatttcaacattgaccgtactgcagagaattgaggaagacgggtcagatctgctcaacgacgatcacatcgcgcaaagc

SEQ ID NO: 47349 - DNA, 2596 bp, Heterodera glycines
  misc_feature (2406)..(2406): n is a, c, g, or t
  misc_feature (2561)..(2561): n is a, c, g, or t
  misc_feature (2568)..(2568): n is a, c, g, or t
  Genomic contig location: Contig_ID=SeqID_16174; Location=1..2596; Strand=-
  SCN-specific regions: Sequence locations=1-378,400-507,529-688,711 -770,792-829,853-1108,1131-1273,1295-1657,1679-1868,1895-1949,1971 -2162,2184-2477,2501-2538,2560-2596
  Gene Ontology: Cellular component=membrane; Biological process =extracellular carbohydrate transport
gaacggctaatttccatcattatttcggtgatgatggtcattacgggtccgtcatttatttttaggactgtaaaaatcaagaatttttttaaggcagcgttaacacattggcagcgaagtaagtgtttgggttgagacaaccatgcttccccggattcacaaatgctaaaaatgaaaaaacagactgggttaagaagttgtgaaaagaccagcgatgtgttggaatgccaatttccgattgctggtttccttccaacattttggggacatgaattccaaaatttctttgggccgtcggaatgccgattgccaaaattttttgagggcatcggcacacattcgtggtgtagttggtatgtagtacctcttttttgtcaaaattatttttattctaaatttggaattttccgacagttttttcaaatcgaaaaggcacaaatacggaaaaccattcgagattttaaaaaatatgcacttttcatattttgtgtgcagatgggcggacagcattgtggtggacggagtcctctttgaccatccctatttccaagcgttttgcatgttcatcggcgagttcagctgcttggttgtgtttgttgtcgcctatttggtcaaaaagcggcgatggaagaaccgaaagttggtggagattcaagacaaaaaaaaccaatttttttcaatcgaaatgtaatggaaaggaaggtggggggatgagcgtgaatttcagggaatggaaggaaaatatgtgacagggacggttccaattcgtgaaattttttgtaaaatttgggtgagggatgacttggagggaataccaataaggaaaatcgaaaattttctcacaaaatgttatttattctttcggcattgggaaggaaatgccagactttggaattgatgatgattcgaaccctctcatatttcaaaaaaaaaaattgctaaaaatttctccagtcaatacggcgacgggggtgccatcatcgaaattggcaccgatgaggagccgaccctcccgcgctttaacccgttcgttttcttgccgcccgcctgttgcgatgtgttgggcacaagcacagttagcaaatattacaattgaaatttagttggtcatggattggaatgacaattttttggttgggattaagacaaattttgacaaatttccattctttcccgtttttaaatgcatttaaataattccatgttttttttgtgcagatgtacgttggtctaaacctgacgacagcgtccagctttcaaatgctcagaggttttttaagcaattattttttatgggtaaagccctcatttagcaaaaaaaactgaaaaatatgaaattatcgccgttggaaagaatgtggcgtgtttttagcccatttaataaactctgtcttttgccccaacaatgttaagtttgtgtaggttttttgggttaacattcgtcagattttttcgggtttttttttgaaaatttttaaatttaaccacccccccccctttgccccacaggcgctgtgatcattttcaccggtctgttgtccgtctcatttttgcgtgcccaactgcgcggcttcaaatggctcggcatgggccttgtcgcgttcggccttgtgattgttggcgtcacggacatgtgaataataatgcatcgaccaaatttctcaccccccaaattttgattgaatttgcgttgcggcagagtaaagattcggaaatttgggtcaaaaattcggaaattttcatcaaattttcttggcgaatgcatttttgacattctaatagagtagtgagtgccacataagatttcgaaaacttttccaacaaattgctgaaaactcgaatttttataataaaatccgaaaaaaaaattttttggggggtgggtgggaagaaatattgtgcatcccttgtaaatctcgtccccttttttgaaaaaaattcaggcctcggtttttcaataaatattcatttgggatttacccgctcattttgtctgcaaaatctcggcattttatagacgtgttgcttttgttgactgtttttttcccttttgcatagaatgtttgacgacaacccaaaagatgacatcaacggagtgatcactggcgatctgctgattgtcatggcgcaaatcattgttgccatccaaatggtacggattttttgaataaatattttttcttagggggctcgacagcttgaaaaaaaattccttgtcttatccttgacctggggactaactaagggcatggactttatttgacaaaaaagaatcacggtccataaaaaaaaaccctgggaggtagtctcaatttgtacataatcaagtcgatgaattttcattttttttgcattcatttatacccaaaattctaattaatttcagtgttttcacacttatattanacttttttatgtttttcaatttgtaataggcttaagaaaaattagtttgacgactccggctataattcgacatttttaaaataattttttttttctggggtttgaccaaaaaaagcaaaaaaaaaaagataatttattttattccaattccctanggtttgngagcagaaatatctgatgcaatacgacg

SEQ ID NO: 47350 - DNA, 566 bp, Heterodera glycines
  Genomic contig location: Contig_ID=SeqID_16199; Location=1109..1674; Strand=+
  SCN-specific regions: Sequence locations=1-24,54-62,85-141,222-566
tgacattccgtctctttagacttcgatgaggaggcgcccaacgccaccatggagaccaaagtggcgggcggcggcgcggcgccgaagcgcgttgggcgctggacgttgtcacagctgcgccagacggacggtatcatcccgtcccaggccggttggaacaagggagactcgcagaagttgatgaccaactttggtacgccgcgtaacaccaccaccaaagtgagtgatttgtgatgattgtctctgatcaatcaatcagttatcgattgattgttttttaaccggcacatactgtactctgccccgctatgactacagtactataccggatcaaaattgatcttgattatatctgatcaattatcgattacgataattgcttttgaccggcacatactgtagcttgtcttgccagagctacaatagtactctgtttgatcaacacaggtcaaagtggagaatctggccgagattccggaggacattttgctgaaaagccacggggaggtgcgtctgcagtccggtaccaaccggttcgcctcccagaagggctttgtttcgttcgg

SEQ ID NO: 47351 - DNA, 1871 bp, Heterodera glycines; identical to SEQ ID NO: 16200
  misc_feature (1725)..(1725): n is a, c, g, or t
  Genomic contig location: Contig_ID=SeqID_16200; Location=1..1871; Strand=+
  SCN-specific regions: Sequence locations=1-301,323-336,361-418,445 -636,658-1513,1540-1584,1609-1871
  Gene Ontology: Mol. function=troponin C binding; Cellular component =cytoskeleton; Biological process=muscle contraction

SEQ ID NO: 47352 - DNA, 2301 bp, Heterodera glycines
  misc_feature (163)..(164): n is a, c, g, or t
  misc_feature (180)..(180): n is a, c, g, or t
  misc_feature (195)..(195): n is a, c, g, or t
  misc_feature (221)..(221): n is a, c, g, or t
  Genomic contig location: Contig_ID=SeqID_16211; Location=310..2610; Strand=-
  SCN-specific regions: Sequence locations=1-324,363-762,784-789,823 -929,951-1007,1035-1201,1224-1530,1552-1754,1803-1808,1835-1860,1884 -1991,2014-2301
ttccttgcaatttgccatttattgtttccagctgttagtcggcggatcccgcagtgttcccgattgtcggggtgggagggacgaggacgtgctcagtttgggcctttccccgggcacttacctcgaattctccatggacgacaggtggattttaatcatatannatagatagggtaattnaatacaatttccttntctttcgcagggtttctttccaattngaggccgcttgggactcttcgctgcacaattcgccgcttctcaaccgcgtctcgggctacggcgaaaacgtttacatgacaatttcggtaccgaattcaattcaatttaataattcaattaatttattcattttattaattgtttaggcgtatatggaaattgaaaattgtgcgcagtcggcaattatcaccaaagatttgggtctgattgtgtacgcacgggactcgaagatcagtgcggccagcagattttgccggtcactgatcggcggaatctcaaaaagcgcgggtaaatgggcgacaaaaatggcaacaattggcctacttcgatgccttcagaaatgaaccgtgtgcccggcgtttaccttctcaccgtaatggaggacagtgaggcgaacaacagtcccggcacggcacggagaaagcggcgaattttggacacatcgtcaacatgtgggaagacagctaacaaaaaagagccatcggttcattctttcattttccacagatgtgcgaggcgaagagaatcttggcacttggaggttggcggaggaaaagcgaaaattccaattaaaaataataattaaattaaaattatttaggccccgaggggactcaatcattttggagcaccaattggagttggagaagctgagcaaacttcagcaagtggagcgaatgcgactgttccttatggtcagtgcttcgcatttggaaaaatatttttaatttagctgagaaaatcgcgcaaaacgggcaaaggcgacacaccggtgggaaaagtcgaaaaataaatatttaattattatttttggaagatttcaccatgttcgcccaaatttcccattccgaattctgtgaaaatgagtggaaaggaacgaaaattggccacaaaagtgttggaattgatccgactgaaaatcccagtgaacaaagacccaccgacgggcaaaaaagtgggaaatttcgaaataaaaggcgaaatgcaaatggaaaaatacataaacagatggaaatgctaagcagcgacagttcatcacaaagtggcggaagcattgaggggtaaaatggcaaaataagggaaaagccaatggcaaattgggaaaagccaatggaaatgcgaatttgttcagtcagaccatgccaaagagtgtcactctgaccgcggacattcgcaccaagtcgcggtcttttgacgacctgaacatcgaatacggtgccatgaacgagtcaatgacccgttcgacttccggaaattacatgttcaaaacaacggcaccctcaacaattcccgaggtgcgagttttatggaaattatcaaattaaggtaaattgacaggtcacagaagaaagggtcggtttggtggtgtccaagaagggacacatgcactttctggagggagcaagacaagaatggtatgggagaacaacaattggccaaacgttgtgctgtttttacagggtccgacgatgggtggtcattcgaaggccgtacattttgctgtacagagacgacaaagacctggtcagagcagagaaagagaggggcgagagaaagggcgagagagagagaaacagagaaaaacgaaaatttaaaaaaaaaataaaaataactgatttatagggcaaggaaaatttcacaattaaaaattaaaaacatttggaaggaaattggcatcgctaaaaatcggaactgtcccttaattgacaggtaattcgtggcataatcaacttggcaattgccaaaattgagtacaacgacgaacagcaggaaaacgcccccaacacttttaccgtgtgcacttcccatcgcgcatttttcatgcaggcactgcccggagacgacgtaataaaaaatgccaggggttctgccggttccctttttttcgggtggcccaacactgcctgaagtcaaatacgaaccatattaattaggataatttatatagttgggcatttttaagttgttcgattggatcgccgctttaaatccgttgttggccggtcaaattcgctcaagaaaaatcacaatcattccgaaggcgatcaactgacaatgagtgatcaaacgattggcaat

SEQ ID NO: 47353 - DNA, 872 bp, Heterodera glycines
  Genomic contig location: Contig_ID=SeqID_16237; Location=887..1758; Strand=+
  SCN-specific regions: Sequence locations=1-111,133-520,542-568,590 -709,731-872
  Gene Ontology: Mol. function=cleavage/polyadenylation specificity factor activity; Cellular component=mRNA cleavage factor complex; Biological process=growth
acaatggccagtgatgataattcggacatgttcactttcatgccactcggttctggccaagaagtgggccgttcctgtcattttatgcaattcaaaagcaaaaagattatggttggattttcatttctcggatttttttctgattcgacatttgcttttttcagttcgattgtggaattcatccggtaattattgcgatagcatcaattagtttgttacccatccgcagggaatgcaaggcgttgacgcgttgccttttgtggatttcattgatgtggaggaattggacctgctgctgatcacccatttccatcttgaccattgcggagcactgccgtggcttctggagaaaacggcattccgcgtcagtgacacgaaacgaacgcattaattcctatggatttattaaaaatttttttacctatttttgaatttaaaaaacatttttgacattgtcagggtcgctgttttatgacgcatgctacgaaggccatctaccggacgttgattggcgattgcatcaaagtaaaaatggaaaacaaatttataaagggtttgaagggtgatgcttcaggatagaaagaaataagcagggttttaaaacagactgaaactgccccttttaaccggtaaataatgtaacatcaaatggcttgagatagcaaaatacggcagtggcggggccaatgaatcgcggatgctttacacggaggaggaccttgagaggagcatggacaaaattgaggtggacaaagcctttcaatttttatgttaccctttacttataaaggtactcgattttcatgaacaaaaggaagtgaatggcatcaaattttggtgttacgttgcccgccatgtgctcggtgcctgca

SEQ ID NO: 47354 - DNA, 3023 bp, Heterodera glycines
  Genomic contig location: Contig_ID=SeqID_16282; Location=69..3091; Strand=-
  SCN-specific regions: Sequence locations=1-925,951-1468,1490 -2160,2182-3023
  Gene Ontology: Mol. function=ATPase activity; Cellular component=cell cortex
atgggctccaagtcggcccctgcaaccgccgacgtcgcttatgccaattatcggctgtttgacgaactgaacaggaaagtgcgggaaagtctgagaaaggccatcgaagctgacgagacgagtctgtaaagcaacataaattgaatgggacggaatggatggattaattggtgttgttaagggattgccaaatcgcgagtgatcggattgtacgagaatgtgttaaagcaaataaacaaagcattggagatacggcacacttcgtgcccttcacacaagcagacggaaatgcaggaacagcagaaaaaattgtggttttgacaaagatattttgaagaatatccaaatcgtttttagaaaagcctttgttggacagacgaaggatcggctggaaaagttgggtaagcgggtggacttcttggtataacttattaaatttattcagcatccattgagccgatggcgcttagagcgacgcctcttccactggcaacggtcgaaaccggcaacaacagagcaaggagaatgccgtgcacttccacggaccaaagggtcggcaaaaaagcagtaaaggaaattataaatagtactaaatcattaatagtaagtcattacattttattaatttcgtcttttagctcgtctcaaatcgtcaaaatttgtccaaaatgtctctgctgaaaagcgtcgactccaaactcggcgatgaaattctcgccaccatcgtggaaacgacggacattcgactcgacgacatcgaaggaaatgcaatggcaaaattagcgctggaagaaagtgttgtactgcctgcactaaacccgaaactcttcatgggtctgcgggcgccgtgcaccggaattttgttgtttgggcctccggggaatggcaaaacgatgctcgtgggttaattaggcaaattcattggctaataaatgaaaatttaaggcaaaagccgtggcgagtgagtgcaattcgacgttttttagcatttcggcagcgacaattatgtccaaatgggtgggcgacggagaacgactggtgaaagcgcttttccaagtggccagaaatgcacagccatccatcattttcatcggtaaaattaaaaaagggaaatgagtaattcaaagacatcgaacccaataacatcagatgaagtcgattcaatgctttgtcagcgttttgagcaggaaaatggagcagcaaggcgagtgaagacggagtttttggttcagttggacggatgttcttcggaaaaggaggcaaatggccacgttttggtgttggcagcaacgaatcgcccccaagaattggacgaaggcattttgagacgatttcctcagcgaattttcatcgatttgccggacaaaaaagcacgttttcaaatgatccgaaggacctttaaacaaagcaacaccaagttacaactcaacgatgccgaattggagtaatccgtccggtactcatttgtcacccaaagccattttcaggaaaatcgctgcaatgactgacaattactcgtattccgatttgaaggccctctgtcgagccgccgccctttttcccgtgcaaagtgcgagaatggaaaacagggatttgaggcgatgtacggctgaacaattgcgcccagtgaatgtaaccgatttggaaaatgccattcgcagtgttaggccttcaatcaatgccgaaagcaggaagaaattgatcggatttgcggaaaaccatgccaatttaaccacatgatttttctttttgctgacagatttttattgtaaatttgattaatccgatgaccaaatttcaatttctatatattcggtttgacttcctgttatttcctaatttgctcctatcactgtctatcaaatcaaaaaggatgggcttagaaattgccgatgaagaggaaggcatttgcactgacacagtgcagcgaaatcctctcgattgtctgcgatgcttttccgtctgtttcccatgctttttcacattgtttttgttattttttccattttagcctatcaaatgccccgtccgtttgccttgtcagcactatttttgtcgtttgtgcatcgccgatgagaagtgttgtgtgatttgtggtcatccgattggctgttccgagttagtagaggacaaagtgctgaattacgtgttggaaagttcgagtgaggtcactgagacatgtgcaaattgcgaccaggtaattaactgaaacaaattaactgccgcccttgcctttaattaattagagcaaattaactgcccttgcctttcttggtatgttatttcagatttcgcaaccgatgttcttctgcgacacgtgccatcagccgctttgcagcgggtgtcgcgagacgacccacaaagttgggaaaaagagaatttgccaatcgtttcttttttctttaggccaaaatattctcgactcatcacatttttgagttggaggagcgcgggagggtaaacggcgaaacaaaaacagaaaaaaatagtgatttcagttgagaagtcgccccatctgtccacagcacaatgagccgttcattttattctgtctcgactcgaaatcgctgatgtgcatcgaatgcttcaattcgtcttcgttggaacgacggttttccaaattaattaaaattcgtatgaattgtattttcaccagcggacatttcgtcaacatcgaactggcgcacaaaatttgctgtgataaattggagaaaaatgcgttgaatttgcgcatttttcaggaggaacttcgtgagcaaattgagttgaggaaacgattgacggacgaactttcgaagaacagcgagaatttgagagaggagtgaatatttggtttaattccttcttcattttttgcttaagaatcgatcacaaatgtgatgtgatcattgaccggctgaatgagcttcgccgtcatttattggatcgagtggttcaggaaaaagcggaaaagcagcgaaaattgagtgcccaactgaacaaactgctcactttgggcagtcctatcagcgtcaacctgctca

SEQ ID NO: 47355 - DNA, 1755 bp, Heterodera glycines
  Genomic contig location: Contig_ID=SeqID_16315; Location=1227..2981; Strand=-
  SCN-specific regions: Sequence locations=1-164,186-250,288-486,509 -735,771-1151,1173-1513,1535-1616,1656-1755
  Gene Ontology: Mol. function=RNA binding; Cellular component =cytosolic ribosome (sensu Eukarya); Biological process=reproduction
atgaagctgattgaatccagcgacatcgtcaaattcccagacaatgtcacattcgcgctcaacaaccgtgttgtgactgtgaagggaccgcgcggtacgctcaagcgcgactttcgccacttaaacattgaaattatgcgagaaaacccgaaggtattctgagtaacaaacaaacaaaatctgaaatttatagtgctcttttcatttctaattgttgttgaaatgattgcgctttcgtttaaaatagtctcaaatttaaacttttatttttccaactttcaaaatgctaaaatgtgggtttttagctgctccgtgtgcggaaatggtttggcatccgcaaagagttggcagccattcgcacagtgtgctcacacattgaaaacatgatcaaaggtgtgactgttggatttcggtacaaaatgcgctcagtctacgcgcattttccgattaacatcacgcttcaggagaacaacaccgtcgtcgaggtttgttttgttttgtcttctttgcattatatgcaatccagtaaagtcccgggattttgaattggattagttactagcgacttttttggtgcagggggggggggcgggtaatgggttaatttactggtcccataaaaaaagaataaataaggcggtttttacgattctttgtcacacgggggttacttgggccgctgatcacaaatatgacatccatttcgaccaattcctaaaaccggacctgatttcgaacaaagaatcgaagttaaatttaaatttgggttaatgtctcgaaaacgacttaaatgcatgaaaacaaactgaaagtcatcattcctgtaataaaagatcacataagccttttttagacgaaaaattcgaaattcgttgaaatgcgaagttccgattttttttgtttaaatattaatatgacgatcaccaaaagataggattttcagagtcactggttacgaattgatacacattttgagcaatttcgaatttgtttcatgttttcacattaattgcacaaaatcgaagcaatgtaagaaatgaccattcagaatgtgcgggagggataaactgaagtgttaccaacaaaaattacccgagtttagttaagggtcgggttcggataaaacattcattgttaagtactggtacactaaatatcctgagaaaggtcaggggccgcgtcctgcatcacgaaaatccaaaaatttcgttacctttggcaaaaccggaaaaagtgacatttttagattcgaaacttcttgggcgagaaatttgtgcgccgtgtcggactaccgcaaggcgttagcgctgtaatgtcgaccaaacagaaggacgagttgatcattgacggtaccgacatccaaaaagtgtcccaggccggtgagtgccgataaatgtcgacccaatttgactggttttatttaccggggtcggttccatggaataatcccttttcgggaaaactgccattttcaaattggactcttgatcatgaaatcttgcattacaatttgggcaggcattgcattccaatgttaaaagtctgtgttcgtttttgttctaccaaagagttccaagcgaatggttttcgaccgaccgatacaaccccataaataaaaaatatttgtttaataactttttctccccaaattcagctgctcgcatccaacagtcgacgaccgtcaaaaacaaggacattcggaaattcctggacggcatttatgtgtcggagaaggtggccattgccgatgaatga

SEQ ID NO: 47356 - DNA, 5267 bp, Heterodera glycines
  Genomic contig location: Contig_ID=SeqID_2612; Location=315..5581; Strand=-
  SCN-specific regions: Sequence locations=1-768,791-836,870-1118,1140 -1199,1343-1355,1393-1487,1529-1534,1556-1805,1835-1893,1917 -1935,1958-2173,2217-2669,2691-2738,2773-2951,2990-3031,3083 -3276,3305-3309,3337-3611,...
  SCN-specific regions: Sequence locations=...3653-3671,3693-3725,3747 -3776,3799-3956,4016-4048,4070-4352,4390-4436,4495-4561,4590 -4896,4940-5049,5102-5166,5211-5267
  Gene Ontology: Mol. function=zinc ion binding; Cellular component =integral to plasma membrane; Biological process=body morphogenesis (sensu Nematoda)
ccacggcagaagaacggaagaagaatgccaagcggaaacggaagagacggtcagagtgaagacggaaactgtagacgaaccgaagcagaatgagccggaagaaaatgccaagcggaaacgggaagagacggtcagagtgaagacggaaactgtagacgaaccgaagcagaatgagccggaagaaaatgccaagcggaaacgggaagagacggtcaaagtgaagacggaaactgtagacgaaccgaagcagaatgagccggaagaaaatgccaagcggaaatgggaagagaaggtcagcgtgaagacggaaactgtagacgaaccgaagcagaatgagccggaagaaaatgccaagcggaaatgggaagagaaggtcagcgtgaagacggaaactgtagacgaacagaatgacgttgaactggagcaacagttggaagagccgagttcgagttgtggagcggaagaagaagaggatccggcattgaaagaattgaagaggattttggaagccaacggcacaaagatggaggcgaatatcccacttcccctaccccgttgggttcggggaagtgggtcattcaaaaagaaatataaaaaaatatatgataatatgataaaaaggaaaaatatttagtgataattagagttcgaagttgtatgattttgcatattttttctaaggatacgactttttggcaaattaaaaaatacatctttaaaaatcgaaaaattttgaaccttttgtaacaatgaaaaaatttgtttttgtaaaaaatgtaattttattttagcatatactaaaaattttaaattcaaaatcgttcaaaattgcatacataaattttttgaaattaatttttttttaaattgtctaaaacactacttcgccattgttttggtgtttttaaagtcaattctaaatgtttacacaattatttggcattttttgagagttaaaaactattttaggcaatttttaaggaatattttagtgcatatttggcttttttcgtgtttttagggcatatttgggggggggggggggggtttagtgcatattttatgcgcatatttggcattttttagtgcatacaacttcgaaccctaataatgataatgctgtgtttttgtttgttgttaaacaaaatttttaaatgaaaaaaggagaaataaaaattgataaatggattggaaagggcaaaaaaaaaaaaataataaaatgaaaatttgaataagaaatttaaaaaataaaaaacattttaaaaattgaaaagaatattttttgaataaaaataaattttattttttaatccataaaaagaaaaatttagaaatataaattggtagaaagacgcatataatttaaaaaatgtaaattttttgaattataatctgtttatttacatttatttctagataaaataaatcatacctaaatggtagtcaaaaatcacaaaataagtgtcaaattaaacaaacaatatttatttttgtggtttgaattgtttaattaaatataaatgtaattgataccttttattttttgctaaaattttaatatgaagttgtattaaagcaaaactaaattcaagccgatgtttccaaatcagtttcgacaattatttatgaaatcccattatcttttttgcattttctaatacatatttataagttttacatagattttagcatgaaaaatgcgaaatgtcataatttttgcatttactttttttttataattaattggacatttatttacttcaattttagctaatatgtaataaaatcaatctggttttatgaacaaatttaaaaaatatattaattaaaaattcttctttattgagcaatccattcaaaaaaattctcaaaaattttgaagaaatatttggcaaaggatggaacaaaaatgaaagagaagataaagttataaaatggaacaaaatgacccaaatgaacataatgaaagatcagcagcagttgatcaaatgggtggagaaatgggaaatgacccaaatgatcaacaaaaaacagaaatcattcaaaaatttgatgcaattaaagaaaagcttaaggaaaaaggaaaacatcattggaaaacagaaagagaattgagcaaaaactggaaaattattgggcgcaaatcgcccaaaaatatacaaatggaaaaaggaattaaatttaaataaaaagaagaataagaatttttattataagtctgcacaatttcaaaaaattatattataagatatggcgtttgcagcgccgaaatggctagaaaacttggctttttttgaggtttttagcagccatataatttttttgccataagagaatgccaattgctttaaatcataccgagcttattaattggatgataaataattttagcgtcaggcgcaagatgactggcgccaaagaaaaaatggagtaagtaaaaatcgtatttccgcttaaaaagctacttaaacaatttaagcgcttccaattccttctacaagcacctttatacaacccattatgagcgctaaaattatctgagtgtcgaaaatcggcattagatttaagcctagaaaaaatggagtaagtaaaaatcgtatttccgcttaaaaagctactcaaacaatttaagcgcttccaatttcttctgcaagcacctttgttttcgtacatgtgatgcattttattgtgcgtattacaaaatctaaatttgtgatccaattaaaaatctgatcaaaattaatttttctgttgtttttggttttgtttctaaatttgtccaacacaaaagtcagatgaatttctgtaaaaaaaacaatttgaacagatgaaatggaaaatatttaattagcataaaaaattattactaagcatgaccatgtgtaattaaataaaagtcagaagatttcacggaaaattaattctgaggaattataaaaatgtctaattggattattttatgaaaaaaatgaattttttttaattaaaacaattgcatataaatagttagttacacgccatattctataacataatatttaattatttttgtttaaattaatttaaacaattgtttatatttgattcttttctaccaataaaaaatgtttttcttaataaccaacgattttaaactttaaaaaaaaaacaatttacgtcaaggtcattatttcttcatttaattttcttttgttaaattaagcatgaccaattagcgatttaagaattcacagctataataaattttaaggaaaacggggaccgaattgacacggcaataaattaaatagataaattttaatatctaaccatttttcttcaaaaatttttattaatcattaaacgaaaatttttttattgacaaaaaattgataagtattaatccgaaaagattaattaaaattatttatcgttttcattcggtagaattgaatttttcatttcaaaagcaccgcaaaaacgtgtaaaatcacattaccaccaaggtcactgcgggaatggagtttgtggagttcgtttttttatacattgacgagacattatgacctaaaaagtatatttgaaatcacataaattgagcgaaactgaaccattttcagtgataaaaactgttattttaaattaattaatatatttttaaatagattttaaagaaatgatgcaaaatttaatttgtttactattttctctgcttttttacaatttgcattcggctccaataacgcttaaaaactcaattttgctggatgatgaggtgaagttgtaaagagctatgctttttatttttaatatttaattgaccatttaaattattaattacgcctaattaaccataatttagtccccgatggacatcgctgcgctgagacatatcaaacaatctgcgacggttgcttgatcggattcaaattactgggctcaaccacaaagggcacgttacgagtgcttcagaggtgaattttaatcttaaatattaattattaaattatgtgttaatttaattttttttttttttgagaatccaacaaaattgctccaacggctgagaattcaaaacaaaattggcgcaaatgatggcacggagttgagcgtgaacagagacattgcgcatcaactgtttgagggcgacattctgttgaaccggccacaagcccaacaaattttgcgcgaaatggaaaacggtgtgccaaagaaattttaaaattacgaaattttgaatttagaagcgtcacaaacactgatgagacgcatgcgcccacgccaattgaacccggacccaaacacattttggacagaaacaacaattccatttacaattgccggtgggcaaaatgacggtaattaattagttcaattaattattattatgaatcttaattttttttttaacttaagtgttggctcaatcagtttttgctgcacatcgacatatttcgtaataattttttttatcattgaaatttacaataaatttatttaaattatttttttttaccacaaatcaaatcttaggaatatacttaatcaaagaactttaatttaacttttcaattcaactgacaaatttttgatttaaaaattaaaaaaatgaacaaattgtggtgaaaatggaggaaaataattgcatttattaattagagttttttttgaacatttacgaattttaaaaaatttgaaatcggacatatggacaaattcgcttttattaattttcagaagcctaacttgcatccgcttcgcttattaccgagatgccaatgatttggttggcagaagagactacatggaatattctcgtttgtcgggctgttggtcaatggtcggacgacagggcggttcacaaattgtctcaattggttttggttgcgaaacggtaagcccaattggcataatgccaaaatttaaatgaatttttaatgctaaaaataaataaaatttagttgggcattactgtgcatgaaacaatgcacgcattgggagtttggcatgaacagtccagaactgaccaagaaaattatgtgacaatcaattacaacaacattttgtcggtaaaattttttaaaataaatataattttaaatatttaaaattatttatttaagggaaccgaatcaaacttttacaaacgatcgccggacacttcagacaatcttggccagccttatgtaaataaaataattatacaaaaaataattttttgatttatttaaggacctcggttctgtgatgcattactcaaacaaagcatttgcaagggatttcaacca

SEQ ID NO: 47357 - DNA, 3002 bp, Heterodera glycines; identical to SEQ ID NO: 16322
  Genomic contig location: Contig_ID=SeqID_16322; Location=1..3002; Strand=+
  SCN-specific regions: Sequence locations=1-50,77-78,100-315,343 -376,398-755,778-841,863-901,957-1151,1176-1445,1467-1696,1718 -2032,2054-2564,2586-2695,2717-3002
  Gene Ontology: Mol. function=signal transducer activity; Cellular component=nucleus; Biological process=embryogenesis and morphogenesis

SEQ ID NO: 47358 - DNA, 4079 bp, Heterodera glycines; identical to SEQ ID NO: 16323
  misc_feature (1370)..(1370): n is a, c, g, or t
  Genomic contig location: Contig_ID=SeqID_16323; Location=1..4079; Strand=+
  SCN-specific regions: Sequence locations=1-160,183-642,673-1134,1156 -1288,1310-1730,1752-1786,1814-2273,2295-2366,2388-2471,2493 -2605,2627-2959,2984-3115,3137-3203,3226-3689,3712-3721,3747 -4033,4055-4079

SEQ ID NO: 47359 - DNA, 2070 bp, Heterodera glycines
  Genomic contig location: Contig_ID=SeqID_16334; Location=1..2070; Strand=-
  SCN-specific regions: Sequence locations=1-106,128-923,945-1252,1274 -2070
  Gene Ontology: Mol. function=ATP dependent DNA helicase activity; Cellular component=cytoplasm; Biological process=DNA replication
gataggtgaattcactgtcttatacgccactgtacaattgtccaagcaaacaatgccattgaaagcaaagcggaatggccgtttggagatgcaattccgcggttctaaatttgtgaagtttcaagaaatgcgcattcaagaattggtaattgctttgtctaacttgcatccttttcaccgcacttaaaattagagtgaccaagtcggagttggcagcatccctcgctcaatgaccatttatctcagtggggaaaacacgagaaaggctattcctggcgatgttgtcgagatttgcggcgttctcatcccaatgcttcgtaccgggtttcggcaaatggctggaggtcttgttactgagctgtttctcgatgcttatgtacgttttcattttatagttatttttgcatattaaattttttagcatgtcaaaaattatcgtgatacaaatgaagatcttttggatggagagttgaacgcggaggaaatcgaattagtcagccatgagaatttttatgaacatattggtaagcaaaatgttagcagatttgaatacttctttatgttattgttttggtttccattgggtgtttcaaattcattctttttcttttagcttacagtattgcgcccgaaatttacggtctcagcgatgtaaagaagtctttgcttctcgctttaattggtggtgttaacaagaacgcaaatggaatgaaaattagaggtgatttattggcaattgttaagatttttggtccgggattcagaatttggcaaattgaggcaagatttgtgatcaacccccttttatccgcttaatcactgcaaaagaaatttctaattttatttttatcgggtccgcaaatgctaaaaattggagattttttaaacttatttttaccgtgttacattgagttttaggggccttaaacattttgctgatgggtgaccccggagtggcgaagtcacaacttctgacttatgttgatcgccttgccattcgaagtcagtacacaactgggagggggtcaagtggcgttggactgacggcagcagtggtcaaagatcagttgactggtgaattaaacttttcaaaccaattcaaaaatggtttttaataaaggcgaaatgtcactcgagggtggggcacttgtgctggcggatcggggaatctgttgtatcgacgaatttgacaaaatggtggattcagaccgtactgcaattcacgaagtgttgtcagagcaattgctttggcttcattttggttttaaggtaatggagcagcagacaatttcgattgccaaggcgggcataatgacttcgcttaatgctcgcacttcgattattgcagcagcaaatcccgcatttgggcgctataaccccaacaagtcgattgaagagaacattcaacttccggccgctctcttgtctcgttttgacctgctatggcttatccaagatgtgcctgatcgcgaaaccgaccgcaaattggccgaccatataacatatgtgcaccgtaaaggcgaacaaccgcaagccgatttcgaaccaattaacatgaaactcttcaggcaaatgattaatcaaacgctattatttcctgcaatttttagaaagtacctttcgatatgcaaacgtaaggaacccgtggtgcccaatgccctaaaagaagtgctggtggagaaatacgtcgaaatgcgctgtgaggcgaagaacagcagcgactcgaccttcacttcccctcgtcttttacttgtgcaatttccctttttcaaacatacgcaaagggtttctcgaccaatccgactttgcaatttgttaacagaaattcgaaattttgacctgtctcgagaccccttgcgcatgaatattttatttacgtcccataattaggcggcaattcgcatgtgtacggctcttgcgcgtctccgtctcgcggacgaagtggaaatgatcgatgtcaaagaagcgctgcgactgattgacattgccagaaactcattgcacgcacacaaaagccaaacgacatttaagtgagaatccgtttcggcttttctttttgaaaagattatt

SEQ ID NO: 47360 - DNA, 1325 bp, Heterodera glycines
  Genomic contig location: Contig_ID=SeqID_16352; Location=53..1377; Strand=-
  SCN-specific regions: Sequence locations=1-849,871-1325
atggcatttcacaaaattgactcgagcagcattgattcaattaccaatgctgttgactttttcagtatacccccgacaaatgttaccgtatcatcgtcaaaggttttcgagattttgccgagtaacccactcaccgacacaccttaccattttaaaatacactcgagccaaaactacattgacctgtcaaagtgttaccttttgacggaatttcgaatgcgaaaattgacaccaccaaatggtgaatggggacatttggatactaatgatcaggttgtaccgatacaattgatcggacacacgttcatacgagacatgaaaattgcaataaatggtcgtgaaattttcaactctaattcactgatggcatacaaaacttatctctctcatgaactttcgcaatcacttgaagctaaagtttcgcatttaactgctgctggatacgaccgtgaagatgctaacaatctacaaaactcaaattccgaaggattcaaaagcagaagacaacggtatttgggaggtcgaacagcacaatacattgcaaaaatcgatgccgatcttttcaatgtaccccaatatttgattaatcattgtgaaattgacataacaatacaaccccatgacgacaattttttgttaattgacaccttagaccccccggtcagccatataatattgagcttgttggattgaaactttactgcaaaaaagtcagtcttatggatggtttggctcttgagttggcgaaaaaattggaaatgaaaccagcacggtatgctgtacgaaagacaatgatgaaagcactgttcataagccctggacgctatgaatttaatgcaaacttgttcatggtccaagttccacgccgcgtaacaatgggacttgtcgcaaattcagattatgtggggaacaccaaaaggagcccgttcaactttcaacactttaacgtacgggagttgagtgttgtggccaatggtcgctcttatccccaggccccgtatgacattgactatgaaaattggaaatttgttcgtccctacaatgacatgcaggaggcgcttggttttgccaactctacatatggaaatggaattgattacttttcatttttgcacactcactgtatttatgtgtttaatatgacaaacagcggagacgatcatggcggtttattcgatctgatcaaaaagggatgtacagctgtaaacataaaattcaaaaaaccagtacccgatggtggaattacacttattgtgatgggtgaagcggactctatttactttttggataaaaacagaacgattgcaactgatacaaccatttaa

SEQ ID NO: 47361 - DNA, 708 bp, Heterodera glycines
  Genomic contig location: Contig_ID=SeqID_16354; Location=1..708; Strand=+
  SCN-specific regions: Sequence locations=1-134,160-165,187-237,260 -616,644-708
  Gene Ontology: Mol. function=proteasome endopeptidase activity; Cellular component=proteasome regulatory particle (sensu Eukarya); Biological process=ubiquitin-dependent protein catabolism
acgaagtgcaacggacgatgctcgagttggtcaaccaattggacggattcgactcgcgcggggcaattaaggtggccgggggacatgcggaacacgtggggaaaaggcatccaatgcgtgatactcctaggttttgatggccaccaaccgaccggacactctcgacccggcgctcgttcggcccggtcgcattgaccgacgcattgaattttcactggtaaattgttatcagcgtacactgctcattcttgtgaatcatttcagcctgacgtaaaggcgcgtaaaaacattctccaaattcacaccaaacggatgagcatcgagcgaaacattcggtcggtcattattatcattgtcaacacataattatcatagtttggttttcagatacgaattgattgctcggctctgtccgaacacgacaggtgaacatccccaaaatgaatctccatttcaactgacggagcaatgcaacaaattaaccctaaggtcgtttcgctttttaggtgccgatttgcgcagtgtttgcactgaggcggggatgtacgctttgcgtgcacgtcgtaaggttatcacggagcaagactttctcaaagctgttcagaaagttgtacgtttttcctgttttctttactaaaaataatgggaaatttgtaggtgaaaggctatgcaaaattcagttcgacgccgtcctatttgacgcacaat

SEQ ID NO: 47362 - DNA, 1389 bp, Heterodera glycines; identical to SEQ ID NO: 16372
  Genomic contig location: Contig_ID=SeqID_16372; Location=1..1389; Strand=+
  SCN-specific regions: Sequence locations=1-25,51-73,96-148,170 -722,745-1020,1044-1236,1258-1389

SEQ ID NO: 47363 - DNA, 1946 bp, Heterodera glycines
  Genomic contig location: Contig_ID=SeqID_2623; Location=446..2391; Strand=+
  SCN-specific regions: Sequence locations=1-414,437-505,528-736,760 -1031,1053-1322,1354-1629,1651-1946
atgacttgcccacaaaaaatcagcgacagcagtcctctagcaattaacagtggcctaaacattttctcagttccaccgaccaatgtgtccgctgttcgctcattctttcgtcaggtgcttccactcgcaacaataacgcaagaatcgccttatctatttcgtctttacagtgacaatttgtggactgatttgtctcgggtttatctttatctcgaagtgtccattgaaaaaccaggagcaaacgataaatgggttgcgatagaggacggggatactcatgtctctgccattcaagggattggtcaaacatttgtccagcaactaaaagttacggttggcaacacggaagtatacgatagcggaaacctatacccattcaaggcctatatcaccaatgagttaagctttccaataaatgtcaagaaaaattttcttggttcaacagggtattatcacaccgtaaatcaagatgattcatcagacgatgggtataaagagcgttgtaaaatttttaagggtggtaaaaatgcgcaattcctctcccgtctcgactttgatttgggaaaccaagagctttatctcttaaataatttggacttgctcttcacaatttacaaggccaaagatgtctttcttttgcaaacattaaaagcaaatgattccaccaaatatcgtttgacagttcacgatgtcaagatttatgccaaaatggttgaggttcaaccctcactaaacatgagcctttacaaaacccttgaaaaacaacccgccacatacgcagtacgcaagaccgaaatcaagtcgtcattcatcagtgttggtcgatacgaatttgagtacaatgtattcagtgcaaccattcctcgacgtgtgacaatagcgttggttggaaattcagcatttcatggtgactacaaactgagtcccttcatgtttgagccgtttgatttgcgtgagatttcggtacatgctggtggcgtagtttacccagctgttccttataaactaaatttttcaaatgatcactttgtcagcgcctttgttgacatgtatgaggcactcggaatggctaactcggaacgttcatttgacatttcaatgacccagttcaaaaaagggtggaccttttttgtcattccattgacttccacgcttgacgacagctgtggatttgagctgttgagaaacggtacgacaaacgtacgagcaacattcaattcaccaattccgcttggtggtgtagagatgattgtcttgggtgaattcgaccaaatgattatggttgattataaccggcacattgtgaccgactcaaagcttggataaaatataaataaataaaaatattattatgtaatgttaaaatgaataacaccaacacaacaaaacctgacatacaaattttgaattccccagaagagcctaatgaaactcttttgcatgtactgcttttttctcattatcttcttgcatttcctgtgtttttgcttttttggttcgttttaattcggtggcttaaaagtcacggtcacctctcgcccagcgaggccgagacagtaatggaagagatgaaaaatatccctcgacaaccaccaatatttttcgcaacaaaatgatgcaaaattagagaaaactgacaatgaaatctctcttcagtatgacaaaatcgaaaaagactcaagaggatttgctcttgaattggtggcgtgaagacccgacaattgtaagcttgtttttttttcaatttagcattttttaaatttcatcacattttttcagattcgtttctttttggacaccgtcgaatcgaagccgcgcttcttcagcgcgccgaacgcgaggccgaaattttgcgccaatacgcagagaatcagcaatgaaaagggaggaccaatcagttatcattttcgtatgtttttttttcatttatgcaatttaaattatga

SEQ ID NO: 47364 - DNA, 179 bp, Heterodera glycines
  Genomic contig location: Contig_ID=SeqID_16416; Location=1..179; Strand=-
  SCN-specific regions: Sequence locations=1-78,101-179
  Gene Ontology: Mol. function=signal transducer activity; Cellular component=shmoo tip; Biological process=signal transduction
gaccaggacagtctttttttctgtcataaaattggtgagcaaatcatctgtgcatgatgcagaccatcaaatgcgttgtggtgggcgacggcgcggtgggaaagacttgtctgctcatttcctacacaaccaacaaatttcccaacgaatatgtgccgacagtgttcgacaattatgcg

SEQ ID NO: 47365 - DNA, 1264 bp, Heterodera glycines
  Genomic contig location: Contig_ID=SeqID_16439; Location=689..1952; Strand=-
  SCN-specific regions: Sequence locations=1-388,410-432,454-529,554 -575,597-750,781-840,862-1055,1086-1131,1161-1264
atggcttcaatcaacaatggtcatgccgcggttggcgctgccaatggcattcagcaaaaaaagttgctgcaacaggcacaggggacgaacatggcacaactcccgctcaaggccaatgactacgcgttggccgcagtgcgcaatgatgccgagctgaaattgttggccgagtacgcggttgactacgcgcattcaattggtaaagcggcaccgatttttggcagtttgacaatttggtttttttggccaataatgcccaattgtatggcaaaaaatagaatttttgtgccaattggttaagtgcgatgctgacatacaattaactgaaaaactgaaatttaaacggaattactgtcaccacattaagtgccaaaatgaattttgaccaacacagtttggccagacaaacattgctcaatttcattacgagttaaaaatgcctaaattgtcaaaattctactacactatggcacttataactttcttggccttttactacaatttttactattttgataattactttaattttacaagaattaatgatcaaaaaagccgtggcaaatgagtatttgattattttttatattaattttccaaaaaactcggataattctttggtttaatttgatcaaattgaacattagcaagttcataaaaggggacaattaaatgtaaattccaataattaatgaatctacaattaaactataccaaatatttcacacaatttaatattaattggcttccaatttttatattttaaaattaaaattttatgacattttgctaataattttaattaaagaagcgtatttttttaaaattttcaggcctcgttggacgcagtggggatgacaagtacaaacactccaacgatgtgtcagtggcgcctccaatcgccctgttgccgtcgccgttcccccgcgagttgtacgagcaggcgactgacgcgcaacagtcgctgaacgaactgtacttccgcatcgcatgcgaccacgacttcctgatggaggcgtacaaggacgtgatcaaggtgggaaatgaattttctgattaaaaaaaattaaattaattttaattttcgggcacagaaaagaaaactcatcaaatttttaaattttttcagtatgtttggtggagaattctaaaaaatgtttgagttaatttactcgaaaaagcatgagaaattttcaatttcattgaaatataaaactaaaaatcactttcgtcaaatgaaaactgatttttttcattaaataaa

SEQ ID NO: 47366 - DNA, 2245 bp, Heterodera glycines
  Genomic contig location: Contig_ID=SeqID_16449; Location=42..2286; Strand=-
  SCN-specific regions: Sequence locations=1-237,268-356,378-470,527 -664,738-1080,1114-1117,1141-1273,1304-1404,1426-1843,1865-2016,2039 -2245
  Gene Ontology: Mol. function=transcription factor activity; Cellular component=nucleus; Biological process=morphogenesis
atgcctctccgtcttttgatttgttggccgccctctgtgccgcgggtgcgcacccgtcgaatcagcagcaggcggcactcgcgcgtcaaatggctgccaccgcggtcatgcttggctttccgcagccgcaagcgaccgctgccgcaatgattcaccaggcggcggcagaatttccgcccgtccagcaattttttagcgcaaacgcatcacaaagtaaggcacaatgccaattccaagaaaaaatagtttaaaaaataatttaaaattgtacaaatttaggcccatttccgcgccaattccatccgatgcatttgaactgttcaacagatgcttcgccccatttgtcggctgaatcggcacaactccaacatcagcaacatcaaattcacaatcatcaaaggacgccgacaacgccaaaggggcgaaaacggcgccaatcgtcgacaagtccggcgacacaaaacggaggcaaataaatacataaaaattaacaattaaaaatatattttaaaattattttatttaacaggaacagaaagaaatcatcgacagactccgcaaaatttgatgcaatcatccgcagattcaccgctcaatttgagcagattcaaagtggaaaacggtgaaggaaggtaagcgaattgaccaattggggaaacatcacttaaataaaagaattcaattaattaaaataaaaaaaaattcaatttattttattttaaaaatttattttttttgtttagccatttcgatttgtccaacaaccgaacacaaaatcagcaacatttgattcatccaacaaattcaggcactttttattttatttttttacttcataaattgggtaattttagacacacaaaattcctgttcttcttcgggcaaaaattcgccgaataatttccataataattcggcaaactcggaaaagtcaaatggcgacaaatccgaggcgaaaaatgcaaataatggaaaaaaggtaaaaaaaacagataaaagaaataataggtaattaaataatttacgattcagtcaaacggagggaatcagcagcaaagggcgggggcgaagtcgccgaatcacataaagcgaccgatgaacgcttttatggtgggcatttagaaatgaatgcattttaaataatgcaaaaaaaacattttgaaggtttgggctcgggatgaacggcggaaaatcttgaaggaatgtccggacatgcacaacagcaacatttccaagatactcggctcacgttggaaggtgatcaaaaaaatggaattaattatttttatttaataatttttaaggcgatgagtaattgcgaaaagcaaccgtattatgaagaacagtcgcgactgtccaagcagcacatggagcaacatccggactacagatacaggtgggagagaagcattttaaaatttggaagaatagcgaataaatattagccaaataaatatcaattaaaaaacaaaaacaaaattcatttagaccgcgaccgaaacggacatgcattgttgatgggaaaaaggtgggcatagaattggcaaaaacgaaacggacaaaaattcaaaagaaattaattacagaaattaaataattaccgttaattaaggttcgaattacggaatacaaaaacatgctgaaaggcggaccgaacaacgggacaacggtggcgaaggacgcgccgcaaaagcggcaaagtttgtccacgagttcaacgccggcggaggcgacgagcgccggtggcggcacttcggacgcggcgccgctcagtccgacggcggtgtccgaggaaagcaatgaggtgaaacaatgccgaacaattaatagctagacaagtgcaaattgaaatgcattgctttggcataacagttatccttttagtcccccgtcaccgccggtgccatccccgcgatgcttttctccgccgcccccgccaatgggtcgtcccctccggccaaatctttgatggaccacccatttgctgggcaatttgcacaaaacccggtataattattgaaaattactaaagtgtaaactttgacaatgcttcttaggcactcgctgccgccgcttggctttccgcggccgccgtttccggtggagcccagcgcggcggtgccggcggagtgtccgcgttgcaccaggcgatgctgctggccgaccagctgcagcacaaccaccatcaccactcggcaatgccgttggacttcggcaccgccgccggcgttgttgccaatgcgat

SEQ ID NO: 47367 - DNA, 1431 bp, Heterodera glycines
  Genomic contig location: Contig_ID=SeqID_16450; Location=1074..2504; Strand=-
  SCN-specific regions: Sequence locations=1-456,478-494,516-833,855 -1125,1147-1206,1228-1322,1345-1390,1414-1431
  Gene Ontology: Biological process=embryogenesis and morphogenesis
atgctttcatcaactgaagcaaacaatgtcgacgacgaagacaatgatggcatcacccaacttggtgctattggcagttggcctgtgactaacgaatggtcgacacctccggcgactgaactgccagaactcccgaatgggttagttctgccattgtgagtaaataatgtattgttgtgctttccgttgacagtgtcggtactgatggtggcgttgtgtccgaacgactgatgctgtcaatcaacgagacagtgctcaaccaattgctgcaccagtttagatgggacttcaaaattatcgaagaggtgagtggttttattgtcagatgcttccacttacatccaatattattttagaagatcccactgaacagctcgagattgccggaggaaacgcgggacttgtgagtatttggcataaatagctaatttttctccaagcctgtgttctgctcgaaaaaattaattttgtttacagttttgccaacctctgtccccagtgcatttttattttcaacgtgtcggctgacggacttcccagtatgaccatcgaagacgactccatcctgatcaaaatgtacaacgcatcgttttctactacgttaaatttgtcttttggctgatttctagacacaaccgaattgctgccgaagttgagaatccaacaattggagagagcggacagaagaaaacggccatcgatctgacactttctctggccgtgcaactgatcccacaagtgcgggacggtattttccacacgcagctgaacctgaaggagcgcaaaattgacatgaaaaacaagacagcatttccgaaacagatgaagccggtggtggaggaactgctgcagggtgaggctaatggcgaaacaattactataataatgaaatcttgattggtatgcaattgcagatatgatcaaggacgatgtatggccggctgtaaagcgcggcattgagccactgatttacgtgaagggcgtggagttgccagcaaactgcggagtggaccctaagtctgcccaattgcactttggacaccgcaaaatcggcgcctctgccaaactcaacatcaaagaggtgaaaatttagagaggattaagattttaatagaaaacaactcaaaaatatataatattgcaaaatttcttttttagatttccctcagtcactgcgtcgaacagttcaagagcaaattgcctgacccggccaccctgttcaagatcaacgggacatctttttagtatttaaaatgatctcttccgccttcatgtgcatttactcccacttgattgtttattgtacattgcatcgcctattactgtgttcaaaatattattaattatcgcccagcacagatacccatgccaaatattgcctttctattgcatcattgatactactgtaatatacaaaagacgatgaataaa

SEQ ID NO: 47368 - DNA, 1405 bp, Heterodera glycines
  Genomic contig location: Contig_ID=SeqID_2647; Location=997..2401; Strand=-
  SCN-specific regions: Sequence locations=1-701,740-1085,1107 -1121,1143-1405
  Gene Ontology: Mol. function=ATP binding; Cellular component =eukaryotic translation initiation factor 3 complex; Biological process=regulation of translational initiation
atgcgaccgcttgcactcaaaggtcacgaaagagcgatcacccgagtccgactgaatcgcgagggcgacattctcttctccgcttccaaaggttccgccgtctgtgcatggtatgtcgtcgtctttttttcatcaatttttagttttcatacactgccttaggtatacggagaatggagaaagaattggcacttatgaaggacattccggtgtcgtttgggacatcgacgtcagttgggacacacaaacgatggtatccgcatctggtgaccagaaagttatggtaagttgatgaaacagaacagttcgataaattcggaaatacccccgattctgtgctccaaactatattttcctccctctttaattggttttgtttaggtttgggacattgagacgggcgtttccaaggggttctctgagcctggttccgttgtccgttccatcggtctctcctacagcggcaatttggtggttttcacgctgaacaagccgaccacgggcggtctcccgggcattgtcgtggccgaccttcgcgacaaaatgacgcaacccatcctacgcgacactttcgacgaccaatgcaacgcatgtctcttctcacacttagacgatcacattgtagccggtaagttagctgcgattttctttttaatttcagtcgacattgggtttcaagcactaataaccaaaaatcccccaaatttatttatttataaacaaaatcttttaataatttcaacgattttcaaaaaaaattccttcgccgtctttcggtatcgttttcttcccaatctccctaatttttgaaaattcgggagcaatatggacttcagttaatggtctgattgtgagttttttaggtgatcataccggacagctggcgatgtgggacctgcggcagccgggcgccgctagcaatttcacacacccgcacaaataccaaatcaacgaccttcagatcaccgccgatcagacatttatcatcacagcatcgaaggtgaaatttaatttttccgttctcttacaatttcttacgtgttgtatttgaattttacaagtttaaggacaaaacggcacaactgcacagtgcacatgatctgcagcatttgaaaacgtacaagtgagtgtcatcaggagaacatttttaactatttattttgtgattttcaaataacgttttccaggtccaatcgcccggtgaacaccgcctccgtctctcccagccgcgaccacatcgttttaggcggtggtgaagaacacatggaagtcactcagacggccacaacagcggagcaattcgtggcccgactgtaccatttgattttcgaagaggaatttgcccgattcaggggccatttcggacccatcaattccatcattttcgaccccacgggggacattg

SEQ ID NO: 47369 - DNA, 1338 bp, Heterodera glycines
  misc_feature (1317)..(1317): n is a, c, g, or t
  Genomic contig location: Contig_ID=SeqID_16481; Location=1..1338; Strand=-
  SCN-specific regions: Sequence locations=1-1338
  Gene Ontology: Mol. function=NADH dehydrogenase (ubiquinone) activity; Cellular component=membrane fraction; Biological process =mitochondrial electron transport, NADH to ubiquinone
cgccaacgaaattgccggggtgcccgacttgggctcgaccggcagagggtccgacatgcaaatcgggacgtacgttgagaagctgttcgcctctgagctttccggaaatgtcatcgacttgtgccccgtgggtgcactgaccagcaaacagtacaggtacacccattactttcagtctgtacaatagccgagcctcaaaacagactcattgttagtctgacaatgaggtggcaaatgtcaccgccggggactcattttgacaaaaggcggcacatattttttctatcaccatgagcaacaaaaaggtcgactgggggaaaggggtaatcccttgaaactagtagtttttcccggcgacgcttccccccccccccctattcctcaaaaattttttgaaaaaggcgaaatgcaaaacaaaaaaagtgcgaaaattaaaaaaggtcgccactgagaaaaatttggaccttcgtttgaaaaatcgatccaaaataccccctgcctcaatctttagtctaatggcccttggtgcttgtgagcaccccctttatatgatcccttattgataataatgcgcaacaattcctccataagtttcgttgcccggccatgggaaactcggaaaacggaaagtgttgacgttatggatgcattgggctcaaacattgtaattgcacacagaacaggagagattttgaggataattccacgaatgaacgatgtataagtgaccaaggcataagtgaatcagtcgaccattgccattttgacaggaagtgaacgaagaatggttgtcggacaaagcccggttcatttgcgacgggctgaagcggcagcgactgttacagccgatgctcaaaaatgagtcggaagttctgaggttggtccatagtttgccattcattgcccatgctcctgtaaattcagtccctgcaattgggaagaagccctcttcacagcggcacaaaaacttcgtcagatcactccaaatgcaattgccgggttggccggcggcctcgtcgatgcaggtccttctaatcgccaaaacgcaatcatatgtggatttttaagaatctctaatcgcattgaaggatctgctgaatcaaatcaactcggaaaatgttttcagtgaaggggaattgccaattcttagcggggggactgacttgaggttgtcattttagtcgaaaattgcagtcacagtcatacgtgtgcaaggggggggggtcaggaaaagggtcgtgcgttcggcgatgcccccccccccctaggggggggtcagcgtcaaagatttttgcggggtgaccatttttaccccgntgaagacctttttttgctttt

SEQ ID NO: 47370 - DNA, 2003 bp, Heterodera glycines
  Genomic contig location: Contig_ID=SeqID_2648; Location=32..2034; Strand=-
  SCN-specific regions: Sequence locations=1-359,387-428,450-652,674 -718,740-825,847-949,993-1382,1404-1525,1548-2003
  Gene Ontology: Mol. function=procollagen-proline,2-oxoglutarate-4 -dioxygenase activity; Cellular component=extracellular space; Biological process=embryonic development
atggcttccaaataccgacagagcaatgagaaattgcagacgaacatccaaagtgtgtccaatccgataaacgctttccgactgatcaaacggctatcgaatgcgtggaaagaacttcaaaacgaaatgcgggcggacgtggcggacgaatatttgcaaaatgtgacgactgatggccatgcgctttttcctacagatgttagcaaaaatgacaaatttgggaaacaatggatgcctttttaggaggatttgagtggcgcagcgatcggattgcttcgtttgcaggacacttaccgattggacacgagggatttggccaacggatttgtgcaggacataaaaattggcaatgaaatgacaggtactgaatgaatgaatgaatggccgtagtttcaccaaattgccaaaaaaaatttcaataatttaggacaaaagttaaaatcaaatcaaaatcttatgtacattttcacattgttttagcatttgattgctttgaaatcggtcgcattgcgtacaatgacgaggcgaacactttcatttccgttcacccgaataaacttttgagtttcaggatttttaccacactttgctttggatgcaagaagcactcggcagggcaaagcgcgaaaaaacgccgacaatttctggtcggattttactaaattcagagaaatgtccaataatttatttcccccccccccaaaaaaaagtgaatttattaacttttccctttcttttcagagtccgatgtgctcggtttgtctcttcgctttttgactttgtaaaatgcactttctctcagaatacctcgcctttgccatgtttaaacagggaaacctcaaaagagccctcgtaacgacagatcgtcttgctgagattggtgcgaactttcaaaatatgactttcaaaagaaaatttgttcagctccgacgcacccgcgagccaaaggaaatataaaatggtaaattaaaatttggaagttgggaaagtgacaattcgttgaatatttcaacaatggcaaaaacacacgaaaggtacgaagaccaattgactgcggatggagtgaaatccgcggattaccgcagggacattcccccgatggacaatcgacgccgtgacgactcattggacaactcggaaaggcgagcgcatcccgtgccaatgacaattaaattcaattcttacttttctattttaggaatatttacgaggctttgtgccgtgatgaagtgcccgttgtaagctcactttttggctttttttctgatttcacctttaagagcgtgaaacaaacctccaagttgtattgctactacaaaagggaccgcccctttctcctattggcgccgttcaaagtcgaaattgtgcgcttcaatccgctcgctgtgctcttcagaaatgtcgtgacagatgaggaaattgagcgcattcaggagttggccaagccgaaggtggtcggaatggcacggaccaaacatttttatgaattctgatgttaggtctattttctttgctaagaaatggtcaaaattacccctccctcccctaactttggttataccaaatgacaaaacccaaattttattttagttggcacgtgccacggtgcaaaacagtcaaacgggaaagttggagacggcatcgtaccgaataagcaaaagtgcttggctaaaaggcacggaggacgaagtggtcgatcgaatcaataaaagactgaatttgatgaccaatttggagatggaaacggcggaggaactgcaagtactcaatcaaatgacttttgttttggcacatttcccttttcaatttcaggtggccaattacggaatcggaggccattacgacccgcactacgactttgctagggtttttcgttctgtaaaacgacaattatttaaattgttcagaaggaagagacaaaagcgttcagtgatttggggacgggcaatcgaattgccacggcactgttttacttttctcagcccgaaaagggcggcttcacg

SEQ ID NO: 47371 - DNA, 2109 bp, Heterodera glycines
  Genomic contig location: Contig_ID=SeqID_2651; Location=2216..4324; Strand=+
  SCN-specific regions: Sequence locations=1-138,160-938,960-1086,1108 -1257,1287-2109
  Gene Ontology: Mol. function=fumarate hydratase activity; Cellular component=cytosol; Biological process=fumarate metabolism
aaaatgaattctgataatttccgcgttgaacgcgacactttcggtgaactacggtaatttcgaattaattttactttgaataaacaaatcgtgactttcgctttgttttagtgttccttctgatcgttattatggagctcaaacggcaaggtaaaagattcgaaaaataagaaaataactacaaaatggacctttatttagatcgatgcaattcttcaaaatcggaggacccgaggagagaatgcctttgcccgttattcatgcatttggctatctgaagaaggctgcagcaacagttaaccaagattttggattgaattctaaagtggcagcggcgatttgtgaagctgcgggtaaattcgcattttattaaaattgacgacattttttattctatttttagatgacgttatttctggcaaattggatgagcattttccgcttgttatttggcaaactggaagtgggacgcagtccaacatgaatgtgaacgaagtcatctcgaacagagcaattgaaattctcggaggcgaacttggctcgaaggtacacccaatgattttcaaattttaaccgccaaaagtcggccctttttcagactcccgtacatccgaatgaccacgttaatatgtcccaatcgagcaatgacacttttccgactgcaatgcatgtcgcggtggccgttgagataaacactcgtcttttgccttcgctgcgtttgcttcacgacgaattgtcgaaaaagtcaaaggaatttgagcacatcatcaaaatcggccgtacccatactcaagacgcggttccgctgactttgggtcaggaattcagtgcttatgtcactcaaattggaaacggaatttcgcgtgtggacgcaacgcttggccgactgtacgaattggccgccggaggaacggccgtagggacgggactgaacacacggaagggatttgcggaaaaggtggcaaggtataacaaacaaaagcgaataattaagcaacattattcggaagtataataatttgatttgggccgctttgtcaaaaaattttcattttttcaacgcttaggataaatttaaaaaattcaaaattatcttcgtgatttattttgaaatatttttacaaaagcggatccaaattaatttgtcttggccgagtttagcaaattggctgagttgacgcgtttgcccttcaaaacggcaccaaataaattcgaagcattggctgctcatgacgcccttgtcgaggtgttttttcgataattaagtttttattattttttttattgagattaggttcatggcgcgcttaacgtggtggcaacttcgcttatgaaaattgcaaatgatattcgctttctcggctcgggcccccgttgcgggttgggcgaattgtcacttcccgaaaatgagccgggctcttcgattatgcctggcaaagtgaatcccacacaatgcgaagcactaacgatggttgctgcacaagtattcgggaatcaggtgaaaagcgtgaacgagcggcgcatttaaaagggattagagtcccaatgtttgcaaatctgatcattttgctcaatttcccacttttgtaaggttgccgtcactgtcggtgcgtcaaacggtcactttgagctgaacgtattcaaaccgttgatcgtccgaaatgtgcttcagtccgttcgtttgttggccgatggtgccgaatcgttcactaaacattgtgtgataggaataatagccaatgaagaaaacatcaaaaaactgttgaacgactcgttgatgctcgtcacggcactgaacccgcacattggctatgacaacgcggcgaaaattgcaaaaacggcacacaaaaacgggacgactttgaaagtgaatgttattttgttggatttgggtggtccacctgtttataaattggcacattttcaaagaaaataattttacttttcatttattgggagttttaacatttaaaattgcggattaatttttcctttttgaatccttattgaccattctctaatcctaaggaggaagctgtcaagtccgggctccttactgctgaacaattcgatcaatgggtgcgacccgagcaaatgatcagtcccaaa

SEQ ID NO: 47372 - DNA, 493 bp, Heterodera glycines
  Genomic contig location: Contig_ID=SeqID_2654; Location=3859..4351; Strand=+
  SCN-specific regions: Sequence locations=1-11,33-378,400-493
  Gene Ontology: Biological process=mRNA splicing
aaggctcgaaatgctgagaaggcaatgacggcattggcccgatggcgccgaatgaaagaacaggaggagaagggaccgatcgccaaacggccgaacgacgttcgcgagtgcaaaaagttgggcgacgctgaacgatttcgtcgcgaattgatccatgacatttcgaaaagaataacgcgaattcacgtgccgaatttgggaactaacaataagtatttacacaaactattgcctcatgatttttagaacccgcgacttggcgagttcaaaatcaaagacctcaacgaccaaattaaccgactgttgcggataaaattggcatgggaaggacgcattaaggagctcggcggagtctaccatcggtactgaataaaagaattgtaaaattcatacttaattttgctcggctgaatgatttctgaatttgttccgagtgacaaataaacaattcgtcttacaatcagacgaatcgcgccgcgggagttggaccggg

SEQ ID NO: 47373 - DNA, 3429 bp, Heterodera glycines
  Genomic contig location: Contig_ID=SeqID_2656; Location=1..3429; Strand=+
  SCN-specific regions: Sequence locations=1-34,56-159,181-622,644 -766,788-797,827-1132,1157-1299,1321-1661,1683-2234,2558-2607,2629 -2660,2682-2887,2911-2987,3016-3140,3162-3429
  Gene Ontology: Cellular component=clathrin coat of trans-Golgi network vesicle; Biological process=intracellular protein transport
cccgtggccttgtgtcaaactgcttcatctgctgcagattacccgcctccggaagaccccggaaaccgcgcgcgactgctcgaatgtttggagggcattctgaacaaagcgcaggacgcgcccaagtcgaagaaagtgcagcatgccaatgcgaaaaacgccgtgcttttcgaggccatcgcactgatcattcactacgacagcgagccgggactgctggtgcgggcatgcaaccaattgggcacatttctgtcccatcgggagaccaatctgaggtgaggagcggtcaaacggctaatttatcgcattttgcttttatgttggcatcttttgcttaggtatttggccctcgagtccatgtgtttgttggcaacctccgaattttcgcatgacgcagtcaagaagcaccaggagaccattatcaactcgttgaaaaatgaaaaggatgtcagtgtacgacagcgggccattgtaatcaccaaactgttcatcgattaaaacatttttccaccgactacaggatcttttgtacgcgatgtgcgaccgttccaacgccgaaaatattgtggcggaaatgctcacttatttggagacggcggactacgccatccgcgaagagatggtgctgaaagtggccatcctggcggagaagtacgcctccgactacacttggtacgtggatgtcattctgaagctgatccgcatggcgggcgattacgtgtcggacgaagtttggtaccgagtcattcaggtcagttcctggcttttcctcaatttggattgttttctttgtattattcaaattgttttctcttttcctggcttagattgtcgtgaatcgggaggacgtgcaagggtatgccgccaaaacggtgttcgaagcactccaacagccaacttgccatgaaaatatggtcaaagtgggcggatacgtcctcggcgagttcggcaatctcattgctggagacccgcgatccaggcacaaacaaatatttttacatttgtacttgtattgatgcttgtgttttgatttatatttgtttatattgatgcttatgtgccatttgctcgctcccttttcccagtgacaatctctccccgccttttcagtccgatggttcagttcgacattttgcacagcaaataccatttgtgcagcatcaccactcgctgcatactgttgaccacctatgtgaagttatgcaaccttttccccgagataaagccgcacattcaggcacattattattccttttgatgcaataactatttcataattaatttattttttgtgcttcatcaggagattgtgttgcgggctgaccacaacctgaagaacccggacgccgagttgcagcagagggcggtggagtatttgcagctgagcaaagtgacgtcgccggatgtgttggcaacggtgagaaaggaacgggcgaatggacgagaatattaatgggcatttgccatcaatttggtaccattttctacagatactcgaagaaatgccccaatttgcggagaaagaaagcagtcttttggccaagctgaagaagtccaagccccaagctgaggagacggacacccaacagatcgaaaagaaacaaaggccatccgccgtaatgtctccgcaaaaaccatccgcggttcgttgagacattgctgttgtaactgttttcatgtttaaattttgtacgtctgttttttctaaaggagtcatcgccagcgacttccactgccaccaaactcgtggacctcagcggtgtcggcaccactggcgacagtttggacaattcgatgaccaacggcggcggggagacggcgaccaatgcattcagtcagctgaacgacctttttgccatgattcagcctccaaaaacgaatggaatcgccgcttcgtccgccgctggcggtgcttcggccgacggaatggcggcgacagaaattgggccaatttggaataaaaatgactatacaaagtgaattcccaaacaatttaaaaaagatcattagaaaataccaattataaggttcgttatgaagtccaacggtgtgctgtacgaagacgaaaccattcaaatcggatgcaaaatggaaaagcgtgccaatttggcacggctgggcatattctacgggaacaagacaaatttcaaattcagcaactttcaaacgacagtcacttgtcctgggatgctcgcagatgaaattctttgtcaagttgctctttttcagattaatttttctattttttcctcacactctctttcctcttctcatgcactcatttttctcccccccccctttttccccctttcttttcactattctcactctctctcttttctctccctctttttttcttacccccattccttctcttctcttccacccaccctctctatcttttacagccccctttctccttttccctcttttctcctctcactctctcctctcccttctcttctttcttcccactttctcaaactctctctatctatctttccccccccccctctctctccccgttttctcttctttactctctctctctctctctacatcaaatttccaggcaaaagctgttgacccggacattgacgccggttcccaagtgcagcagctgatcaatgtcatttgtcttcagtttttcactgcccctccaattttcaatgtttctttcacattttcgtgagtttcttctcttacattgtttttctttttattttctctttttgattttcagtgcccgcgatggctctcctcaacaattttcgcgcagtttttaccttcccgtttttatcagcaaatttttcgaaccctccgacatgtcatccgaacaattctttgcacgttggaagcaactgagcctgtactactgcactcttacaaaaaaataataattttttttttcaggccgtcccaagaatgtcagaaaatttttgcaacgattaatccaattgacagtgaccaaattcggatatcggtgcatttatacatttttgaaataaaaattgggcctcacaatgctatagacctggaattttttaaagaaccggggatggattttgaattgacctgtctgtctttcatgtctaataaccgtttgaattccagcaaatccctgaaattacctaaataattttggaataaatataaaatttagctcgcaaatttgggcgcacaaattctgcaaaatgttgacccgaaccctgaaaattttgtctgtgctggtattttacaaacgcaggctgcgcaaatcggctgtttgatccgcttggaaccgaacaaacagaccaaggtggtctatccgttttatttattaattaatgactccgtttttttgctcacaatcagatgttccgcttgaccattcggagcagtcgggagggagtcgcggcgacactttgcgagctgatgggtgggaatttc

SEQ ID NO: 47374 - DNA, 855 bp, Heterodera glycines
  Genomic contig location: Contig_ID=SeqID_16507; Location=2569..3423; Strand=+
  SCN-specific regions: Sequence locations=1-227,250-565,615-855
  Gene Ontology: Mol. function=axon guidance receptor activity; Cellular component=plasma membrane; Biological process=axon guidance
atgcccgatgctgctgctctcccctcatcacctgggcaacccaaagtgctgaatgtgactgaaaacagcattgaattggagtgggcttccccggaacggcatggctcttctccaattactgactaccttcttcagtactggagtcctgaattgggagaggtggggtattataatgataatgagcgatttattttaaatttcgttgtagtcttggcgaaatatattggatgttgtggcaaagtcccgttttcgcatcactggtcttcagcccgaacattcttatgtttttgttatccgagcggagaactcaaaaggcattggacttccttcgtctatgagcgaaattgtctcaacaaaaaaatcgaccgaaattgaagagggcaattatcgaagtcagcgaatgaatcgacttttggacttggaaacggctcgtcaaagactttcttcggaacaattggtcaaactgttagaagtgcgtgcattaaatgcaactaccgttttattagcatggaaacggcagagaaatgtaagtagaaaatttgaaaaccaaaagccaagggcggcgaaatttaattttaaaaatgggattttgaaaaaataacattttttaagaattgtttttcgaatttgcaggaacctctagtccaaggatattatataaaatggcgaggcccgccgcttgcgcaggaccacagttgggtcaatgttaccaatccggagactgatcacgtggtcattaacgggctcaggccgttcaacaactacgagtttttcgtgattccctaccaccaaactgtccaagggatgccgtcaaattcgctcgacgggaccacggctgaatctcgtatactttaa

SEQ ID NO: 47375 - DNA, 894 bp, Heterodera glycines
  Genomic contig location: Contig_ID=SeqID_16508; Location=1694..2587; Strand=+
  SCN-specific regions: Sequence locations=1-53,75-203,225-371,393 -444,474-484,507-894
atgttcaaaaatgtaagatattagcagaaatatttcaaaagtcttttttaagaaaatcaattgttaatggtccacaaactcaatcaacacagaataagattaaactttctgacattgaattgaatgcgggaataatttggaatatattaagaagacttccccggcgtaattccacttcaccggataatgttccttacattttattaaaaaattgtgcagaaccaattacaaaaataatagcagatatatttaggctaattttggattccggtcaaattccggaaatatggcgaacatcattggtggtaccaattttcaaaaaaggcgaaaaaactgatccattaaattacaggccggtgtcattaaccagcactgtctgtagagtttttgaacgaattttaagtagcaaaattttagaatttctgaacagtacaagattctttgataaagaacaatttgggtttttaaaaaatagatcgactacaacccaaatattaaaaatgatggacgatatatataattctatacaaaagaatcaacaaattgacataatctatattgattttgtcaaggcgtttgattctgttccctaacttattactaaaaaatcaaagttttaaggttaaaattggcgaagaattgtcagaaagtttcagaatattttcaggagtgccccagggaagtgtcttagggccattactctttttaatttttataaatgatctgccgtcctttattgcaaatgaagcatcatcagttggcataaaaatgtatgccgatgatgctatattatattatacacatgaaaacgatgaccattcgaatcagttggataaagcaattgaggctatggaaaaatggtcaaaaataaatgagttatcatatttcaactga

SEQ ID NO: 47376 - DNA, 1410 bp, Heterodera glycines
  Genomic contig location: Contig_ID=SeqID_2664; Location=46..1455; Strand=+
  SCN-specific regions: Sequence locations=1-86,108-997,1021-1116,1138 -1410
  Gene Ontology: Mol. function=structural constituent of cytoskeleton; Cellular component=hemidesmosome; Biological process=microtubule -based process
atgggattggatgctgaacctgagcaagtgctggagggccacctgcgcgacgcgtacaatgccaaggcatttgtggaggagtcggagcaggtggagcagcagatgcagcaacagttggaccatcttgatcgtgaatattctcgtactgatttttcgctggacgatggtgaacagatgttgcgacagcttgactctgtccgtgaatacatccaacaattgcatgcgcgactcatttcactgaccgacaggtgtgcccaaatttcaccgctttggcaacgtggcgaacgcatttcaaaaccgctgccggtgatggcactttgcgagtacaagagcaaggacaaaattcacatcagacaaggggatgagtgcactctgttggacaaccatgaccaaattcagtggcgagtgcgcggtatggacggcgttgaggcttccgtcccatcggtggtgttccgcattcctccgcctgacccgcgattggcctcgttcctcagccgactgcacaaccaattcgagaagttgcgcaaactgtgggatcgcacccatcatttggtccgttacaacatggtgctgaacacaatgcgcacagtgcgtgcatgggacttggacactttcctgtcgattccatccgatcaacgggacgagatcatcaaagctttgaatgaggacgtgaacaagctgctgtccgagatggaccccaacgatcccttggccaagcggcttaaggacgagctgcggatgacgaacgaacatttctacgatttgttggcacgcgctcagaaagagccggagcccgactactccaaccagttcgatgctgcatgtgccgagttggtgcgcaagttcgaggagggctggaagcagctgaaccaccgggtgcaggaacgagtggccaccaacttggaggagttggaacgccaaatcaaagagcacaaggcattcgaagatgcactgcagacgcttgacgtggacgtgtcgaatgtgaaggaactgtaccgccagctgccccacccaacgcccacccagcgtgcagcgcacgacaacatggtgcagcgctggcaagacatttgggagctgtcgcgcatgtacgtggagcggctgaaggggcttgaatcggtgttgaacgggttggacgaagtgacggacattgtgcgacgccatgagatcacgctggcctcctttgacgacatgccggccgcgctggagcgcctgcgcggcgtgcacgcccagctgctggagctgaatatggtactgcaacagcaggaaaacatcgtcaagaagctgaaccgggacactgcaacgctgcgccaacatgttgcgcgcacgcgtttcggcgctgcaaaccatccggtgctaccagttaagccgtgccgggtttcgggattcggcctgcttagttccgacccctga

SEQ ID NO: 47377 - DNA, 256 bp, Heterodera glycines
  Genomic contig location: Contig_ID=SeqID_2664; Location=220..475; Strand=-
  SCN-specific regions: Sequence locations=1-256
cctcaacgccgtccataccgcgcactcgccactgaatttggtcatggttgtccaacagagtgcactcatccccttgtctgatgtgaattttgtccttgctcttgtactcgcaaagtgccatcaccggcagcggttttgaaatgcgttcgccacgttgccaaagcggtgaaatttgggcacacctgtcggtcagtgaaatgagtcgcgcatgcaattgttggatgtattcacggacagagtcaagctgtcgcaacat

SEQ ID NO: 47378 - DNA, 684 bp, Heterodera glycines
  Genomic contig location: Contig_ID=SeqID_16553; Location=81..764; Strand=+
  SCN-specific regions: Sequence locations=1-557,579-684
atgaaattggccatcaaacggttgcattggaatgaaactgatgggatttggtatgactacgacttggagagagaagtacgtactcatcccctggctgaaatactcattaagcttggcacactttcaggctcattccaatacctattacgtgtccaatgcattgccgttatattcaaaatgttacgacgacgaggatgacgtcacgccgtacaaagttttcgagtatctgaaggtgtctagagatgtttgcatttatgaaaacagcaacaatcggccaatttatgtagcgtgaaggtgtgctcaacttcaccagaggcatcccaacttcgttggcgatgggcagcatccagcaatgggacaaggagaacgcatggccaccgatggtgcacatggtctgcaatgcaatctgacttcaaatcaattctaatccatgattttcaaggtagttgaagcatttcgaacaagcggtgatctaagtcttatgaaagccgcggaacaaatggcaactcaatggttggtcgtcaattataaagtgagtttttacaaaataatgattgtaaaactatgaatgtttaaacattcctttagggttatgtatcaacctatgcgatgttcgagaagtacaacgtttccatgatcaatgaagagggcgttggtggttcaggaggtgaatatgaggttcag

SEQ ID NO: 47379 - DNA, 2428 bp, Heterodera glycines
  Genomic contig location: Contig_ID=SeqID_16565; Location=1..2428; Strand=+
  SCN-specific regions: Sequence locations=1-343,386-412,434-441,464 -1255,1277-1360,1382-1642,1665-1736,1759-2104,2126-2428
  Gene Ontology: Mol. function=rRNA primary transcript binding; Cellular component=nucleolus; Biological process=35S primary transcript processing
aaatgccatcaaagcgttggacggcgcgtacattggcggctcaaaacttacggttctgttttgttggacaccatttttgttctttgggtggaaattcaatttttgactgggaaaattttttagattttaatgccttttcagtaaatgacaaattacaggtcgaagagtgtaaagcattgacaactgaccgaacggcgatcaccaaacaactttcgttgaacaaacgcaaaaaactgaggcaaaaaggcaaatggtaagcgcaaaatttagttttcttttttaattatttgttttgaattcgttttattgctttcattttccaatttctctccgccattttaattattaattgcattaataaaaattgttttacattttattcttttaagcgaagttgatgaggaggaggacaaagaagaaggtgccgaagaggcggacgtcgactcactaattgaaaagcaaattttggacaccggacgtaaacaatttgacattttttggcacgagggttgggaagggatgcataaattggcactaattttcaaaatcttttgcgactcgatttttctgtatccgaatttgcactgttttcaggacttttccttcgaaatttgccctttgtgtgctcggaagagcaaatacggcaacttttcgagccgtttggaccactcgccgagttggaatgtgtcgtggacaatgcgggcaaatgcaaagggtacgccctgtgcaccttcatcttcccggaacatgcggttgccgcgtggaaagcgttggacggcaccgtttttatggtactcatttggacataaactgagactatttccacagctttcttctcattaatagggttgcaaattatatggactaaaaaaacgctaaatatggactaaaaagctcaaaaatggccaaatatggactaaaaacatccaaaatatatgttttaaaccctcaaaaattccaaaaaggtttatatagctattcaatacttgcttaaataagaaatacaataaccaaccaaaaaatggatttaacatttaaaaatgcaaatttttttattgtcgtccgttgtataaaaaacacctctaagtttgccaatttcaaaaaaaattcccatttaaaaaaaaagaaaagttcgcaaaaaatggtgaaaatatttattaaaaatgccaaaatgacaacgaaaactcaaatttttcgtatttttggggggtgtaatttgtaaaaatttccaaaaagtcggtcttcaggtgtatattttcagcttttttaaatttttcttgtgaaaatttgccaaaaatggccaaaatatggactaaaaaccaaaaaatgtcgaaatatggatttattcccgaaaacccccaaaatatgtatttatatggactaaaaaccttcgccaaaacaaaaaatgttaacgcagaaatgctatttttgagcccctttcttcatagcatatgcgcagaaaaaataggtaaatccatacaatttacaaaacttactcatcaaaaacaatgaacagtttggagaaattctgaatattatctttttataaaaaaagaaaataaagggccgaatgctgcacataatcgccggcgaagagaagagagtgcggacgaacggtgcagacgacgacagcacaaacgacggatgccaaagtgcgttccaacgcgaacggaacgaaaaacgcaaggcgaacgacgcggaaggggcgacagaggcggcgacaaacaatcggtgagcaaaaaaggcaacaacaacaaagcctcggaacaattatccgaccggtggcaatgtgctgcctcggaattgtctcccattaattaatgcatttgcaactaataatgttttcctctctgttcagttgcacttggaacgcgctgtttcttggcactgacgcggtggcggagacattagcggaaaattatgaagtggagaagcgcgatttgctgctggttgacggcaaacagcagaacaggtgagctggggacggagttggaggagtacggattcgacgtatccctccgtacgcccccgtctctgttttaagtcggcatcaaaattttaagatgttttattgtttaaaaattagcctcatttggttgccaattctgctctctttccccctttaattgatatttctcccatagtgccgcggtgcgcgtggcaatggccgaggcgcgtttggtgcgcgagacgcgcaaattcctgcttgacaacggcgttcggttggacgcgttcgcccagcggcggcaccttttgagcaatggtggcgacaacgtcgacggcactgaggacggaaccgcaaaaatgagacgttcaaagacgacaattttggtcaaaaatttagacgccacgagggaagggaaaaaggaatggctgcactctctgtttggacgctttggggtcgttaagacggtgctggtgccaccag

SEQ ID NO: 47380 - DNA, 1618 bp, Heterodera glycines
  Genomic contig location: Contig_ID=SeqID_16573; Location=1246..2863; Strand=+
  SCN-specific regions: Sequence locations=1-788,810-1618
atggctgttctaattgagcgcaacccgcctctgttgggcgccgtcctgcgttacattgaccgccatgttgaccaccttgacgagtacgctgtcaacattctgtcaacagtgccgttaggcttttgcactgtctccgccgaagacatcagcgaccgcttgggcaagtggctgatcagccgatccattgaccatccggcatccgccattgcgcggtgagaaagttgtggctgctcatcatagcctaaaaactattcagaagagttctgtcctctttgaactgggactgtcaatcgcctcaaccggcatcgttgcacaaatcctcagttacatccgtgggtagccaacctcaatcaaatcggctttgtctttccgttgaaatacatgacctttgcgcagaaacgcttgtgaaggtggtgttattgtcgtttgagacaattggattgatatttttggacgatatttaaggctcacattgtccaatgcaaacagagaaacaatttgattgccaagtcggtgaacaaagcggcacgaatggcactgaaatgtcccgacttggagcaacagttcgaccgcttctgctgggacgtgttgttgaggctaaaaatttcggaaaaggtcgacagcgtcatctcccttcttcaattttgtattactttttgaactttgttccaaaatttcagccaaattgtccgactccgccaaatgatctcaccgccttttacgtgttctgtgtccaaaagtgtctttcatcgtgcgttttaaattgaaacagttcaaaaagttgttcaatttcctcttttttaagttccaatctcttcttcgaagcgggtcttccccttttccaagagttagtcaacgcttcgtgcttcaaggcggccgccgtacttttgattcgaattgtacatgccttccccagcagcaaccacatgcagaatttcatcgcaaatcccacgtaaaaatgaattttttttttaacttttccattttcgaaataatttgtcatacgttgctttttccgattttgaattatgcacaatttaaaattttttttagattctgtgaggtttttgaacgacttctccacgcggacgaatcggcgtacgctgttcagctgttaatgggagctgacaaatttcctggtccggtgctcagtctggtgtccggcggaatcattgtggagaaacaaaattccaattcaattcccaaatttttttttcagcaccaaatttccatcgacgccttccattttgagcagcgtaaagtgtacgcgcaggcctgggttcgcctgttgacatgcgacaaacgaacgcacgagtggaactcggacaaattcgtgctgtacttgcttggctgtgtcgcaaagtgttgccacctcttcgacccgcaggacaattttgggatggtggagcttttgcgggacctttacaaggccggttaacaccggggaaacacagattaaaattctgtttttcaggcccgacaccaggcctggagggacaccgttcgaggccccctctcctggttctcctcctcgtccatccctcctcctctgatcgctcaagcccaattcaccgtctctccatgggccacgttcatgttgttgcgtgccgagcaggaa

SEQ ID NO: 47381 - DNA, 885 bp, Heterodera glycines
  Genomic contig location: Contig_ID=SeqID_16575; Location=1..885; Strand=-
  SCN-specific regions: Sequence locations=1-84,108-383,406-885
  Gene Ontology: Mol. function=receptor signaling protein tyrosine kinase activity; Biological process=signal transduction
atggaggctgttgctgaacacgattttaacgctggtgagcctgacgagctgagctttaagagaggtcaaattttgaaggtaaatatattttagttggcatgaaaaaatttctgttaaggtcgctaatctaaacaaagccaaattcaggttctcaacaaagacgaggacccgcattggtacaaagcggaaattaacggagttgagggattaatcccttcaaattatattcgaatgatggaacactcttggtatctcggcagcatttcgagaagtgattcggaggtaatgagcaataaatgctagtcatgaagaaagtaagggctctcctttaaatgtgaatttttgaagtttcttaaaaatcataggggactcttttggttagcaaaaatttttatttataattaacaacaaattgggaagattttctggtcgcgaatcacaattctgacatccatttcgccaactttgaatctctgactcgaacaaatatcgacaatttcttactttgttattaaaacaatcaaggacttttccattgtttttgaaattttaaccttaaaggttcacaccaggacttttaatgtcgattgaagtggttgatttcaacactaaaatcaaaaaattgggaaaaactgtgtttttgacttatgaatgaccggatgacatcacgttgccaaacctaaaatcactaaatatttccgtttttgcccaatttcgtactgctcgagaatcttgattaaaaatagtagccttttccatttagctcctcctcttgaaaaatggcaacccagacggggcctttcttgttcggaggtcggagtcgacgcccggcgaattctcaatattgcgtaaggtaaagaaagagcggtaatagtgctgatatga

SEQ ID NO: 47382 - DNA, 4416 bp, Heterodera glycines
  Genomic contig location: Contig_ID=SeqID_273; Location=2686..7101; Strand=+
  SCN-specific regions: Sequence locations=1-120,142-280,318-1389,1413 -1557,1579-1606,1628-1994,2016-2328,2350-2982,3020-3449,3472 -3687,3719-4416
  Gene Ontology: Mol. function=ATP binding; Cellular component=muscle myosin; Biological process=cytokinesis
atgctcgaaaaatgctcgaaaaccaaggttttttgagttcctctagccataacttttttgaatcgtaacgaaattttttgaaattttgtagacttatagagaacactaagggctatcgaatgatatcaagaattaaaaattcaattgcttttcagctaagttataaataatttttcatcaaatcataatgatggttttttaagtaacgactccgccccctaaaaaccgatctgtacatttctgtgttcccatgcgcgactgatcaatcgatcgatcggtcgagggagggagagagagagggacgaattgggggagggcgccttagcctaaccctttttaactggtcgaaaatgagtgcgtttttcaggaacgcattgctcagaacgccagaaaggagcagctccgggaccgggctgttcgcttagacgattctctgacggcattggtcaagcaggcccatgacaagctgaatgagtcggctgcgatgcctcagtgctatgagcaactgtgcaatggactggctgaacagattgagcttgccgagcagtttggcgccgagaatggcatcacagttggcgaagaacggattgcgcaggcaaaggaggtgcgcgagcagctggcacagcgatggcaccattgggacgagtttgtccggcttcgagatctgggcaccgcccaactggataaggcgcgtgttgcgattgaccagaccgagcaaaagacatgccgaagcgtagcggaggccgagtcggaccatgacaacctgctggtaagtgtccaggctaattaaaaaggggatttgcaatgcaatcggactgactgatggtttgcaggaggcgcagggttcgcttgcttctttgaatgccaccatcgaccaactgcagcagttggctgacaagcttgatccgctggcgacgactcatgctgaagtgcgattcctggatgtggaattcgaacagctggagaagcatttcggagacgtgcttgaccaaatgcacaacgaaattgagcaggaaaaggcactgatggcggaaactgagcgagccggacgagaaactgacgacatgacggcacagctgccgacgatggcgaacaatttgaaggcattgcagcatgctcagcagacagccatccctgccctggaggcgaaagtcgtcatgctgcaacaacagagcgagaaggagaagccgctcagacagtacgtgctccgctccactgccgctccttctccggatgaactcgcgcagcgcttagcactgagcaaaggccgggcacaggaagcggcccaacagctggtggacacagcagttgtccgggtccaaaatgtgcttttggggacaagccaagctgctgccgaacttccctccgatgaacaaattgatgaatgcgccaaagagctgcaggacaacatcccgcttgaacatccgcacaatgaacagctccgacagcaattggagcagctgagagagaaggtgatgcgcagggatgccatccgatcgcatattgaccagcacttggccaccattggcaaggaattggaagggttcagcgagcagttcatcagcagcagcaccaccaacggcaaaaaggtgccgccctcctccaaaaaggaggccaaaaagaagaagggcaaaggaggcgaacccgagcagcaaaaacgagctgaaaagatggccagcagagaagagcacatcgacgagctgcgaaaagcactgggacgcctggaaagcggcattttgcctgccttgaacacgcttcatgacgaggccgtccagcagggcattcctttacaaccgacagaggaacaccagcatcagctgatgcgagccaatcaaattgtccaaagtttaaaggtgtgcttttgttgaagcattcattgattttcgtccatttccccaatcacttgcaggaggaccttgacaagagtgtggccgagaacgagcgggcgagcgtggtcatcaacgacatacgccttctgaaaagcattgttgatggcacggtggtggaagcagaaaccgcggcggaagaggcgactctccaactgctggacgtggagtccgtagaacagcataagcgagacatggaagaggcagccaaaaagttgggtgaacagctcgccaagatggcggcagatgcacatcaggtcagcaccagtttggagccggaagagcaagcactgatgaagcgggtggaagaggaggctggcaagaagatggacaggctgaactccctcaactcggtgctccagcatcagatggaagtgctccgagactgggcacgcgataaggacaggcttgagcagcacacgtgctcactgattgaccagctgaagagagtgcaggaggagcgggaagaggctggccctgccccagcagaggaagagttggccaagctggatgccctgcagagcgaagtggacgaggccagggatgagatgaagcggatgcagagctggctggtccaaaagctgcccaagtgcgggagggctgcggtcgaactgcaacttcggccggtcgaagagagcttagtgaagctgaacaccgacatggacggcacaatggagcagctgaagaagaacgtgcaaattgaacgccgtctgttggaagagcgcaccgcgcttctcaatgctgccaacgagctggatgagcaagttcagcaagcccatgcgtttgaagagccgcaggagcagatcagcgagctggacaagctgcacaaccaactggagcaagtcgaacagcaaatgcgcactgttgaccaacaatccgagcagtacccaacgccacagaaggcgacaacactgagcgaacaaattgcacatgttgtgcacaagacgaggacaaacattgaagatgcccgtcatcagttggaggtgaggtcatttcgtctgttgatgattggaaatcacccataaacccattgatcacggatctgtacatttctgtgttccttcagtcacacgactgatcaatcgatcgatcggtcgagggagggagagagagagggacgaattgggggagggcgccttagcctaaccctttttaactggtcgaaaatgagtgcgtttttcaggaacgcattgctcagaacgccagaaaggagcagctccgggaccgggctgttcgcttagacgattctctgacggcattggtcaagcaggcccatgacaagctgaatgagtcggctgcgatgcctcagtgctatgagcaactgtgcaatggactggctgaacagattgagcttgccgagcagtttggcgccgagaatggcatcacagttggcgaagaacggattgcgcaggcaaaggaggtgcgcgagcagctggcacagcgatggcaccattgggacgagtttgtccggcttcgagatctgggcaccgcccaactggataagcaccgcaacagtcttgacaatgtccgttccgcgcctttaatctccgaattgaacgatgctcagcttcaactttcctctttaaaagtgcttttcatttttgtgctttttcattttgcattttttaggacaattcgcttcatttttcgcaaattcgtcaacttttgtctgatttggtctctctttccaagtccctttctcctctttccgttgtcgatgatattctccgttttatgtttgtggagctcgaaagtttggaatcagccaatgaggtgtttttaacattttctctttttttcatttgatttttaaaaatttatttagcaaattgtccatcgattcgaagccgaaattgaacatcgaaatgaattggaacaaatgtttgatgggatctcttctaatgtcagtacttctgagaacaattttgatcattttctgcaacttcggaattccgatcgaatgaatgtaatttttattcttttcttttttttttgtccttttaattaatgtttttaacaaataaaaaggacttgctgactgaacttggcgagatcggcgcacaaattgatcagcttgaacagagcatttggcaagggaatgatcagcaacggatttttgtgcaaagtttcgacaagaaacgcctccgaattttgcgagaacgaatcgaacaattggagaaaaacatttggggggctttttccgaactgagtgaagggccgtcgacggaagcggcggaagaacagccgaagtacgacgtggacgcggcggtggaaattctgtcggcgatttacccgggccgagagccactcgaagtgatgagggaacacgggctggacaagttggagttggacatgaacgatgattatggggacggacagacggaaggggaagaaggtgaggacggacaaaagggggaaattggagaattttaactgatcaatcaattcacaccccacaaaaagagacatgcaatttgtgggtgtttaattaggaatgaggagatgaaacgcgcgcgaatgataatgcgta

SEQ ID NO: 47383 - DNA, 261 bp, Heterodera glycines
  misc_feature (112)..(112): n is a, c, g, or t
  Genomic contig location: Contig_ID=SeqID_16594; Location=1..261; Strand=+
  SCN-specific regions: Sequence locations=1-261
  Gene Ontology: Cellular component=nucleosome; Biological process =establishment and/or maintenance of chromatin architecture
agagaccaaatggcaaaaaattcgggaaattccctggtaaaacattccccaaggaagaagcgtgcccagctttggcttggtcccggtgcctacataaaccacgactgcgccncaaactgcgaatttgtgccgaacaaacagcaaaccgcgacgataaacgttctgagggacataaaagcgggcgcagagattaattgcttttacggggacaactttttcggagacggaaattgcaattgcgaatgtttaacatgcgaaagg

SEQ ID NO: 47384 - DNA, 659 bp, Heterodera glycines
  misc_feature (43)..(43): n is a, c, g, or t
  misc_feature (52)..(52): n is a, c, g, or t
  misc_feature (104)..(104): n is a, c, g, or t
  Genomic contig location: Contig_ID=SeqID_16601; Location=986..1644; Strand=-
  SCN-specific regions: Sequence locations=1-144,166-188,211-282,306 -335,357-450,489-659
cagttttattaatttttcctccattgcttccatggacaattcngcgagtgtntacagggcatatgctcgctggaccaggtccccttcccccccccctcccaaantgattcgcctttccttctctttcagttggtcattcggctcgtctcttttctcctcaatttcgctcttttacgcctcgtcgacccttcccttttgggctttttcaatgtgaagtatgtttttacgaatactaattacttttttggaaatccctagcttttaaaatggattgtttttcggcttttaccttttgcaatttccctccccccatttcttcagaatgactttgctttacaccaccatttgctttctttcccgtgagcccatccgccggctctgtctcagttccgattttccgctccacaaagtgccgtcctacgcttcgctaaggtttcttttacccattgctaattattttaaaaattcatttaaaatatgatatttttgagaatttatacttaatttatcggcatttctcataaaaatcccccaaatattttggcacatattttcttttcgtcttttggcacaatttcaaacattcgtttcattcaattcccaaaactcgtcagtccagtccgctgttcgccttggccaccctttccctctgctgtgtc

SEQ ID NO: 47385 - DNA, 1537 bp, Heterodera glycines
  Genomic contig location: Contig_ID=SeqID_16607; Location=1172..2708; Strand=+
  SCN-specific regions: Sequence locations=1-126,148-799,821-1492,1516 -1537
  Gene Ontology: Mol. function=lipoic acid synthase activity; Cellular component=mitochondrion; Biological process=embryogenesis and morphogenesis
atgacattgcatgactttttgccgcagaacacaaaagcgattgatttcactgataatggacaaaaaactgagacggtgcagcgacggacggcggacggacgccttcggttgccggaatggctgaagagggacgtggtggccaagcagagcgatgtgagtgagaaaatcagacaatttggagcggcttctttggcatttggaaatgtttgtgatcccatggataaaacttgaccgtgatttttagatttttggatggaattaaacaaccatccatttttatcaacaggtgaatttgatcagaatgaagaagcagctgaggggactgaagttggccaccgtttgtgaggtacaagtaatttggcaaattaccatataaatcaaatgttaattgctttttcaggaagcacggtgccctaacattgggtaattaagagtaacaataaaaaaatgattccgtttctctcatttttattgtagcgaatgtttgggcggtgggcccggcaggccgtcaaccgcggccattatgctaatgggcgacacgtgcaccagaggatgccggtaaatcaatttaatgccagatttggcgttgtttccattctgaattcgttctggaggtttcacttgccatctctagcattattttaggtcagtctttccaatactaatcagtccggtccgtcctcactttttaactgtcatagggtcagatcagtaaatggtttaattggctgacaaaatccctgggtaaatcacacccaaatcggctgatcagacggaggaaattattgattcaatgggcaattcttaattctatcactaaggatgaatccggtctaagtttgctcttacaggttctgctcggtgaaaacggcccgccgacctccgccgccggacccggaagaaccgctgaacacggcgaaggccgtcgcgagttggggcgtcgattacattgtgctgacctccgttgaccggtgggcaaccgaaaattcgacgcattggaattctcgaatttgtttattaagcgacgatttgtcggacggcggcgcggcacacatttcggccaccgtccgccgtctgaaggagcagtgcccccatgtcctcgtcgaatgccttgtgcccgactttgcgggcgtgttgcccagtgtggagcaagtggcccagtcggggctggacgtgttcgcccacaatttggagacgggtgactgactgttgtggcatggtgttatttataaattgtgcccttttcagtccgtcggctgactccgctggtgcgcgacccccgtgccaaatacgaccaatctctgcgggttttggcacacgcgaaaaaggcaaatcaatcaatgattatgcctaaatcggtgccaaattgcaggcgaatcccggcgtgttgaccaaaagttcgctgatgcttggccttggcgaggcggacgcggaggtggaggaggcgatgcgcgaccttcgcctggtcggcgtcgaggccctcacactgggccagtacatgcagcccaccaaacggcacttggccgtctccgagtgg

SEQ ID NO: 47386 - DNA, 1154 bp, Heterodera glycines
  Genomic contig location: Contig_ID=SeqID_16623; Location=302..1455; Strand=+
  SCN-specific regions: Sequence locations=1-143,165-868,890-972,994 -1027,1051-1154
  Gene Ontology: Mol. function=DNA-directed RNA polymerase activity; Cellular component=DNA-directed RNA polymerase II, holoenzyme; Biological process=transcription from Pol III promoter
atggcagatgatgaagattatgatgggggagaaatggacggcgatgagtttatggaggaagagcccatagaagaccttgatgcggaacaccaagcgggagaagaagaggaaggcgcggagaatgtccaagttattaatgtaacctattattttacatattatttaaattttggttttcaaggtttctgacaaagttgcatcgtccaaccgagtgacaactccttttatgactaagtacgaacgtgcaagagttcttgggacaagggcgctgcagatagctatgggtgcaccagttatggtcgaaattgaaggcgaatcggaccctttggaaattgcgcgtaaggagctcaaggtgaataaatattccaatttcaataatagcgaggtaccagttaatctaacctaacatttaggaccagaagattcccataatcattcgtcgttacttacctgatggttcattcgaagactggggcattgatgaattgcacattacggattggtgaaaatgattaaccgcgtaattggcattttttctatttatgtttaatgaatttttgattcactaatattttctgcttattttgaccgatttttaattgacgttaataccttatttaaactccattatgcgtttatcaatcagacacttttctagaggtgttttgtcaatgtctattcttcagaaactttctcctgtaaacatcgactctaaaggcgtttttaagtacattctcataaaggtttttttctgtgaagattgaagcaaaatgcgaatttaggcttctgatggcgcaactgaaagatttttggttcgtggttatggtcgttgtaaatttcacgcggatattttggaggaagtgcaggcaagcgaaggagagaaggccattgaattttcttgtgttggcggaggccggataaaacatgagccggaagccaaacgtatcttcgtctacggatattcccaggtgcagaattctcaaaaagatttttatcggttgtttgaggggtttggccgtgctgaccatgcgaaatctgtcgaaatcctgagggaacgttatccaaactacacaatcgaatggtccaacgaaggatattagggcagtaaatctagtatacaatattgtaacgttttttgttttctatatttaaaa

SEQ ID NO: 47387 - DNA, 1284 bp, Heterodera glycines
  Genomic contig location: Contig_ID=SeqID_16631; Location=417..1700; Strand=+
  SCN-specific regions: Sequence locations=1-690,714-932,954-1086,1116 -1284
  Gene Ontology: Mol. function=calcium-transporting ATPase activity; Cellular component=integral to membrane; Biological process=hearing
atggcatcggacggactccgaacgttcgtccgttttgttgacagttcttattgtaagcatctgctactgtttagcatcgctttggcctacaaagattatgtcgtcgagaaaggagaagcgaacgaagtgcgcttttcattttgaatttcgccctttggcattgtgccattcccttgacattccgttttcttcagattccgctcgaaggagccgatgtgaattgggatgacgagcagattctgcgagagggaatgacggccatttgcgtgttaggcattcaggacccggttaggacggaagtgccggatgccatttcgaaatgccaacgcgcgggaataaccgtacgaatggtgagtgatttttgaccagtcttgctaatttagtaaacaatatgtaaaatgcgcctaaggtcaccggggacaacataaacacggcacgttcaatcgcaacacaatgcggcattttgaggcccggggaggactttttggcattggagggcaaggagttcaacgcacgcatcagagactcggatggggttgtggaccagcggaagttggaccaaatttggcccaaactgcgggttttggccagagcacagccaaccgacaaatttgtgctagtcaaaggcatcattgagtccaaatgcacgaagaacaggtcatcaatgattggtgggctgaaaatgagtcaaacgctgcagggaagtggtggcagtgaccggcgacggcacaaacgacgcgccggcactgaaaaaagcggacgttggctttgccatgggaattgccggcactgacgtggccaaagaggcgtcggacatcattttgacggacgacaatttcacttcgttcgaccatcaattcgcatttatttattgtctgctcgttttagcattgtgaaggcggtgatgtggggccgcaatgtttacgactccatcgccaagtttctgcagtttcaactgactgtgaacgttgtcgctgtgaccattgcctttgtcggcgcgtgtgccaccaaagattcgcccctaagggtgtgccgtgccgtcgtcccttgccctcgtcctcatttttgctactttaggccgtccaaatgttgtgggtgaatttgatcatggacactttggcctctttggcgttggccaccgaaatgccaaccgaagatttgctcaagaggaaaccgtacggccgaacaaagtctttgatttcgcggaccatggtgaagaacatcatcgggcacggcatttaccagttggccgtcctcttcggacttctcttttttggtcattga

SEQ ID NO: 47388 - DNA, 1042 bp, Heterodera glycines
  Genomic contig location: Contig_ID=SeqID_16682; Location=743..1784; Strand=-
  SCN-specific regions: Sequence locations=1-264,288-868,891-980,1002 -1042
  Gene Ontology: Mol. function=pre-mRNA splicing factor activity; Cellular component=spliceosome complex; Biological process=mRNA splicing
atgtcaaaactgtgtgttaagagaaaccaattggctacggaaaagctaatcaatgcctacaaagacgaacacggggaacgcagcaaagaagtccaatccattggcggtccaaatgaattcgccgagttttattctcgtttaaaaacgttgaaggatgttcatcgaaaaaacccaaacgacactgctcgaacactgacaattgagtttcaagagatggccaatttcatccaggaccccgaccgattagaaaaggagatggtccgtttcacggatgaggagggatacggaaagtttttggacctccattctttgcacgagcaatatgttaacctgaaggaagtcactgtgagtagtgaattcaacatttaactattgtattaacgtgtttcccatttagcgtgttgattatatttcatacctttcgaagttcgaccatctccacgaactttccagagaaaaaacgaagaagacgggtgcctacaaaacatatgtcctttctctggaggaatatctgagggatttcatttcccgggccaagccactcattgacattgttatggaattggatcgtgtggacaaagtaaattaataaaaggacacaaaaattaatcatggacttaaattgtatacgtttaaaggattttgaagaaaaattgaaggaaggcaaagtgattgggtggtccaacgaaaagccaagcggcgcaatgaaaaagttcgcgcaaccgtccgcagagatcgatgtgtccaacttcaacagccccgaggaattggaggaattaggcgccgaccgactcaaagcggcgttaatcgcactcggactcaaatgcggagggtttgttgtctcttttcaaaataacacacataaactattaccaaatcaactcatatttaggactgtgaaagaaagggctttccgtttattttccaccagaagctccgatggttcaaatgctgtcaatggaaatggaaaactcaccgctgaagacacaaaagaagagaatcggaagtacactcttgccaaggcggaagcgcatattttgag

SEQ ID NO: 47389 - DNA, 825 bp, Heterodera glycines
  Genomic contig location: Contig_ID=SeqID_283; Location=657..1481; Strand=+
  SCN-specific regions: Sequence locations=1-188,213-795,817-825
  Gene Ontology: Mol. function=v-SNARE activity; Cellular component =integral to membrane; Biological process=nonselective vesicle transport
atggactctcccgctggtgctcagccgtcgaacccaaacgctcaacaacaaggtggagcccgaccatcgaacaaacgactccagcaaacgcaggcacaagtggatgaagttgtcggcataatgaaggtggttacagtttttcgagtaagtcagtcaactaattggtctatttgcaggtgaacgttgagaaagtgttggagcgtgaccagaagctgtcccaattggatgatcgtgctgatgctcttcaagttgttgtgaactctttgactcgttaaattcatttttaggaaggtgcgtcgcaattcgagaaatctgccgcgacgctgaagcgcaaatattggtggaagaacataaaggcaagccttgttttcggctctttttccataattgaattttgtttagatgatcgtgatcatgtgcgcaattgtcatcctgctgatcatcatcatcgtcatttgggctggaaaatgaacgacgtgtgctgcggtcggatgctcgagaatttccaagtcttcgtgaattgaaaagatccatttacaaacaaaacccgcgaatctaatttaaccagagttcttgaccaacaattcctaagtctgtttctcatctcctgtttgtgtaccacccaaaaatccgagtacatacgacacttacttcggtcccttcccacattcctaattttcaaaactgtagagtacgcttggaatgcgatggattgacacattttatgtgatgtggataaactgaatatgtaatttctgtttctttttaaattggttgcattgacactttcctcccatactttttctgttatttattagtattaaa

SEQ ID NO: 47390 - DNA, 825 bp, Heterodera glycines
  Genomic contig location: Contig_ID=SeqID_16744; Location=269..1093; Strand=+
  SCN-specific regions: Sequence locations=1-120,151-193,215-468,495 -517,556-668,822-825
  Gene Ontology: Mol. function=heat shock protein activity; Cellular component=centrosome; Biological process=reproduction
gcgcatgacatcgaaaacgacccgagcaaagccgataaaacatggaccatcattgacacgggcattgacatgaccaaagccgacctcgtcaacaaccttggaaccatcgccaaatccggaacgaaggcgttcatggaggctcttcaggttttgtttttcgtttggtcaaccccccccccccaatctaaaaaacacttttgctacttaagaccggcattgtcgctttaatgcccgggcattttggcgccggtttctactcggctttctctgtggccgaccgcgtcacatcaaagcacaatgacgacgattgctaccaatgggagagctcagctggtggctcgttcatcattcgcaattgtgccgatcctgaagtcacccgcgggacaaagatcgtcctctacctgaaggaagaccaaacggcatatttgcaggtttgttgtactttggttcaaaaagtgcgtttttgacgctcaaaaattttacatttttctttcgcagtaaatgcgcaattgtcaacaaattatatttttaattaaaaatcatcaaatttttattgagttcaggtgttggtgctggtgttgtgcgtgttcatctgtgaatgcggtgtggggagaaagggcggccaagcaggcggtgaaaggagcagccgcgggcgaccaaacaatgacggcggggggacaagcggcggagcgggacagaaacggggaggaggacgtggcggcggtcgcggtggtggaaaaggcaatggccgcggtggtggacgaaggcggcggcgggcggggagggcgggcgccgcagcacccacaggaggctgatgaggaagag

SEQ ID NO: 47391 - DNA, 492 bp, Heterodera glycines
  Genomic contig location: Contig_ID=SeqID_16745; Location=1..492; Strand=-
  SCN-specific regions: Sequence locations=1-2,57-66,246-272,491-492
  Gene Ontology: Biological process=N-linked glycosylation
atgaaagaggaggacaaaagagaggaagaggaggacaaaagggaggaagaggaggacaaaagggatgaagaggaggacaaaagggaggaagaggaggacaaaagggaggaagaggaggacaaaagggatgaagaggaggacaaaagggaggaagaggaggacaaaagggaggaagaggaggacaaaagggaggaagaggaggacaaaagggaggaagaggaggacaaaagggaggaagaggaggacaaaagggatgaagaggaggacaaaagggaggaagaggaggacaaaagggaggaagaggaggacataagggaggaagaggaggacaaaagggaggaagaggaggacaaaagggaggaagaggaggacaaaagggaggaagaggaggacaaaagggatgaagaggaggacaaaagggaggaagaggaggacaaaagggaggaagaggaggacaaaagggaggaagaggaggacaaaagggaggaagag

SEQ ID NO: 47392 - DNA, 1759 bp, Heterodera glycines
  Genomic contig location: Contig_ID=SeqID_16749; Location=232..1990; Strand=-
  SCN-specific regions: Sequence locations=1-314,351-1044,1066 -1338,1360-1759
atgttgcttataagtttcgtaaaaatttgtaaaaaaccacaaatttttgcagcgaccattgagcatgagctgtcgctacggcacaaatacgacttggaacgcattgacgcggacgtgcgcgccaaggcgcgtgccgcacgcgacaaccgtgacgtgaacctggagatgatgcgtgcgagtgaggaggagcgacgcaagacggtcacggaacagattcggacaaccgccggcgttgtgggcgctggactgtccgagtttctctccgatcgctccaaaattatggcggcagtgagtgcttttttatgcccaatttgttaattatatttgtattttatctaaaaatgttttccgttttttatggttttatctaaatagaaaaaaaattaacaaatgctagcaaaaagaatgtgaaacaattactcatttttcagttttttcaattttgaaagggctaattttcaattttattgtcgacttgatgaaattgtatccgattttgttgaaaaatgagcttttgtatatgtaatggcttttagaattttgattttggagataaaatgtgatttagaatgacttttttgactatgagttttcaattttaattccatttcttttataaaattatttttactattttacaatacccatatctgaattttacatacagtaacaactatatttataactgcaatttataaatacttccactttttaaatgacccctccttcctccaaaaaaggtcggtggtctgactgtgctggcggtcggttggtacagtgccaagcgtggcactggcgttgtggccaaacaggtggaagcacggcttggtaagccgtccctggtgcgtgaaacgtcccgcctcacactgttcgagctgttcaaacatccaattgcgagtgtgcggacactgttccgtgcccgcgaggacccgctgaagggcattgtgctcaatgtgagtgcgcaaatcatttaccgtgctttatggagagatttacccccccccccccccacgggcagtgcctttcgatgctttccgacccacatttttctatttttaaatcttaattgaatcaatgtcctctaaaaatggtcatttgttgtaataaataaaaattttgctacagaattgttttagccaagcctcgagtcgcgtctgcgtgacattgcgatcaccacgaggaacacaaagcgtaactttggactgttccgcaatgtgttgttctacggaccgccaggcacggggaagacaatgttcgccaaggttggtccaccattttgttgcattttcttgggaaattttacctcctttctatggggtcatgcaaattcattcccctattttaatattttaaattgtttatcagagtttggctcgccattcgggtctcgactacgccataatgaccggcggtgacgtggcaccgatgggccgtgacggagtgtccgcaattcataaaatttttgactgggcccaaacgtcgcgcaaagggtgggccatttgaaattaattagccgtttttcaaatgaataattttcctgcattttttgtcagtttggtgctctttgtggacgaagcggacgcttttctgcgcaagcgaagcacggaacagatcagcgaggacatgcgcgccatgctcaacgcgttcctcttcagaaccggggaacagtcgaggaagtcagtcagtggtgcttcatttacgaattatttggctgccacaatttttaggggcagctcgtttccatcaccctaaaattaaa

SEQ ID NO: 47393 - DNA, 1784 bp, Heterodera glycines
  Genomic contig location: Contig_ID=SeqID_16756; Location=121..1904; Strand=-
  SCN-specific regions: Sequence locations=1-237,259-419,456-948,970 -1584,1668-1784
  Gene Ontology: Mol. function=trypsin inhibitor activity; Cellular component=extracellular space
catcacagcgcaatgggatgggcgagaatttgtacatgacgagttcgtcgtcaatttcggaaggtaaaagcaatgaaaacgtgtttgataattagggatgatatttttaggcaaaagcctttttcctgagctccccgttgcctgaaacgcacgaaaaacatgtttttttgggctgttgttaagctacttttcgacttattaatgccttttttctaggcttttatttttatagcctaaaaagcctaaaaatttttgaaagaacctatttttgcctattttggcgttttgtccaaaatttgttatcaaaaatgcaataaaaatgaaaaatgcaccactaagaaacgacctgaacattttataaatacacccttaagtaattaaaattttctcaaaaattcatcttcaaaataatttatttatttcttgacaagaatttttgattttaagaattatttagctaaatactgttttccctaatttttttacttttttgtaattttgtcattttaaacccctaaatttgagactatttagagcctattttccattttttggagactatttttagggtttttagagcctaaagcctaccacctattttagtgttttccggaaaaatttggacttcagaaaatctggttcgggtgtgtttgcaaatcgtttatcaaatgggttttgctggatcaacaagattaagcttagagtctcagttatttttgtttgtctttgagtacagcctttactcgggaatgaatttgatcaaatggatttctggataccgaattgataaaaaaacaatttctcatgatcaacactgttttttagctgatgcgctgaaacaagcttgcgacacgtggtgggcggagctaaagcaatacggcatccaggaaagccttgagctggacagggaacagttcaacaagggcatcggacattggagccaggcaaaatgaatgaatgcttatttttacgggtggcaaaaatttttttcgtaaatccaaatttttcccgtacgataggatgaaataaggacaaatcttataaaaaaaagacgaattacaatcttgttttatatccattttcatccactacttattttactgctctaacttcgtttgttgctttcagcaagcctgggccaccactgctcaaattggctgtgccatggcacgctgtcccagcgctgactggaagacatgggttgtgtgcaactacaacacaacgtgagtgcaagaaattctagcgtacaagggaatttttcaaaatcactttcaaaagatttttatcggatagagcgtggtcgatttgatattgtaaattttcggctttttggatactgcaccaaaagtgatcagaaaaaatcgatcaaagacccgaaaaatcgatgaaatgggcaattttaaaaatcagaaaaaatttacaaataaaacaagagttataacatttttaaaaataatcagtaaaaaatttctcaatcaaacggtatattaaattttaaaaaatccgctgaataaaacaatgccagatggaaaaaaagcccaaaatcaacaatagcaaattaactattctctacacgataaagtgatttaaatgataatttattttataaaattatagtatatattcctaagattttgtattgatttttttaattttaaaaatttaatcgtttcagtggcaatcggttggacgaggtggtctataagaagggtaccgcatgcgctagttgttctgactacaatggcgcgtcatgtaacagcaccagcgtactgtgcattttgcca

SEQ ID NO: 47394 - DNA, 595 bp, Heterodera glycines
  misc_feature (576)..(576): n is a, c, g, or t
  Genomic contig location: Contig_ID=SeqID_16771; Location=69..663; Strand=-
  SCN-specific regions: Sequence locations=1-496,520-551,573-595
gtctgtggctccaacaatcaaacgttcgcctcgctgtgccacctctatcgccagcgttgtgtgtgcaaaaagcgcagtgactttgaaactgagttggttgggcattcaaaatttatgcaaattttttttaaatttttcactcctaccccccccccctagttggaaaaaaattttccccctaaattttgcagctgtgagaatccgtccaacgccaaaattcatctggaatatttgggccaatgcaagcagttggacgagtgcacggacgagctgatgtcccagttcccgggccgaatggccgactggcttttccaggtgtcaaaaatttcaaaaaaaaattcaaaaatttttccaggtgatgaaagagttgaaaaagcgccgtgagctgcacaacttggagtgggagcagctgatcaacgaggcggagcaggacgacgagaagcgccacgtgtacccggtgatctggaaattctgtgacctggacattaaggcaaagaatttttttaaattaaaaaaaatcggcgaaaatttcttccaccaaattccagcctcatgacaaacacgtgtcacaccatngaattgatcccgatcactg

SEQ ID NO: 47395 - DNA, 2289 bp, Heterodera glycines
  misc_feature (2273)..(2273): n is a, c, g, or t
  Genomic contig location: Contig_ID=SeqID_16811; Location=78..2366; Strand=-
  SCN-specific regions: Sequence locations=1-23,45-658,680-2289
  Gene Ontology: Mol. function=RNA binding; Cellular component =chromosome; Biological process=mitosis
atgaacaacgagaaaggtatgttatttaaaacaaagacattatcaatccgaatttaactttgcctactaacatttagtggaagacttaatgagaagaacgggcgccaaagtgaacattccgccaccacacgcaaacaacgagacgataatcataacgggcgaacgcgacggcgtcgatgaggcggcggtcgaaattttgaagattttcaatgagaaggttcacgggaaataagctgattgggcaacacacgagtaaattaatgattttttagaaagagtccgttgtctccgtggaagtgaccgtcccaaaggcgcagcatcgctacgtcatcggccaaaaacgtgcggggttggaggagattttccgggaaacggaggtgctggtggagttgcccccagaggacagcgattccgaaactgtcattctcagaggacccaaggacaaaattggtgacgccgctggcgcaggttggaattttcaatgattttttctccattaaaatctttccaagtttagtctaccagaaagcgagtagcaacatcgccattgaattgccttacaaagaatggatgcgacgccttctcattggggcaaagggacagaatttgcacaatttggtgccgaaccacgaccagttgaagatcgatttcgaagacagtgtcatctacatcgaaggacccaccgatctggtcaaacaagctcagcaacagctcagtgccgaaattgcgagattggaaagcgagccccgcttcgaggcgatgaggaacgcgccggatgacacgcgaccgggcgaagaaagggtgggctggcagagccaatgggaagacaaagagtagacaccatccaatttattaaggaaccgcaatcgaagattcaattcaatgtcgacccaaaacatcaccgacacttcatcatccgtggcgcggaagtgctcaagaatattcagaaggatttcgaatgccaaatttcgtttccgaaacaagagacgggcgactctttggtcacaatccgaggccgcaaggaattagtcgaaggagcgaaggctcgaattgaagcaattgtggaagacatggaggcccaggcccaaatccaaattgatgtcgatccaaaacatcaccgacacttcatcattcgtggcgcggaagtgctaaagcagattcaaaaagagtccgaatgccaaatttcattcccgaaacaagagacgggcgactctttggtcacaatccgaggccgtaaagaatttgtcgagggagcgaaggctcgaattgaagcaattgtggaagacttggtaagtatcactggaagtaacaaccgggctggcgccttgaatttaacaacatacgtttagttatctgattaaattttgggcataattcgtagcgctataactaatgtataagcaagcctttttattattccttcactattttttcatgataggaggcccagacgcaaatccaaattgatgtcgacccaaaacatcaccgacacttcatcatccgtggcgcggaagttctcaagaatattcaaaaggaattcgattgccaaatttcgttcccgaagcaagagacaggcgactctttagtcacaatccgaggccgcaaggaattagtcgaaggagcgaaggctcgaattgaagcaattgtggaagacatggaggcccaggcgcaaatccaaattactgtcgaccccaaataccatcgtcacttcatcatgcggggcgcggaagtgctcaagcagattcaaaaggaatttaaatgtcaaatttcgtttccgaaacaagagacgggcgactctttggtcacagtccgaggccgtgttgataacgtcgaacgggccaaatcccgcattgaggagatcatcgaagaattggtaaatctcactacttgtccaacaaaaaaaaacgcagtttttcagttcgacctttatgatgaatcccagtacattgtacgacgtgatgacccaccgccaccaaaggctgagccaaatgacatcgaaatggtgaacgcaccatggcagattgactcaatcgaacagttccccggactgtctggtgatactgttgctgcacagcagcagaagcccgttacggcaaccgctgtttggggtcagcgtcgttgatgtcactggaggggagtgaatgggacggggtgtgctgtgttcgcgattaattgttactattctttgttaaatgagtgcctttattctgtcacttccttttgcaatactcgtatctttctttaatttcaaatagttttgtttaattaactanatattctataattaaa

SEQ ID NO: 47396 - DNA, 2185 bp, Heterodera glycines
  Genomic contig location: Contig_ID=SeqID_16812; Location=330..2514; Strand=+
  SCN-specific regions: Sequence locations=1-241,265-560,582-764,786 -2140,2175-2185
  Gene Ontology: Mol. function=dynein ATPase activity; Cellular component=cytoplasmic dynein complex; Biological process=oocyte cell fate determination (sensu Insecta)
atggacattttgtcaattgcacttgggtcagccgaaggatttgaacaagcggacaaagcgttgcattcgactagccgatcgggaagatggattctgctgaaaaatgtgcatttggcaaccgaatggttgactcaacttgagaagaaatttcgccttcacaatccacacccacattttcgtctgattttgacagctgaaattggctccgctctgccaatttctatgatccaggtgtataatttaaaaatttacttttttcaaattccaactttttttcacgcttcgcgtgtacttattttcgaaccatccacagggctgaaggcgaatctgttgcgttctctttcctccatttccccagcacgaattgcgaaggcgccagcggagcgagctcgtctgtacttcattatttgctggttccatgccattgtgcaagaacggctccgctatcagccactcgggtgggccaattcgtacgagttcaccgacgcagatttccgagtcgcgtgcgatactctcgattccactgttgacatggtcgcacaggtcattctttgttttttgtgatgatggttttctttttctatttagaacagggcgaatgttaagccggataaattaccatggctggctctccggactctgctctctcagtgcatttacggaggaaaaatcgacaatgattttgatcaggcaagtatacagtgggtttataagggaaagaaataataaaaattttcatagtattataaatgtttggttttgaatatcttttagccattttctcacctttctcgctagatgcattatttcacacttaatataatttaggtgcttctcgatactcttctcgacaaactgttcacatcaaattcatttgacgctgactttattctcattgaaaacatcggagtgaacgccttgaacatgccagacgaaactaactcaaaggatgggttgatcaattgggttattaacatcaaagccttacaaaagcctaattggattggacttccaaacaacgcagaaaaagtgcttatcgccgaaagaggtactgctttcacaaaccgaaatgccatcatgacgaaatcatttatttatcaattatagggcaagaatttatacggaagatgatcaaaatgtcggacgatgaacttgcatacgaagcggatgatttggaacgtaacaagcaagcccctacctggatggttcaattttctggacagtgcaaatcttggctcgatgctttgccacaagtataccgtctttccctctgaaaagattgacattcatttaattgttttcgtttattgtttcctattctattttttttagcaactccagcgtcttcgacggactaaagaaaatgtgcgcgatccgttgttccgattctttgaacgtgaaatcaacttgggcgccagacttttgtccgatattcgacgggacctcaacgaattgttgtccatttgtcatggggatcagaagcagaacaatcacagccgtgaattaatagctgcattggtcaagagaaaacgtgtgccagacaattggctccaattttccgtgccaaaagacgtaacagcacttgaatggatgcgagactttgtgcaaaggatggaacaactaaagcgcttgtcactttctgaaaatctgagatatgaggaagtttggctgggtgggatgttctttcctgaagcgtatataacggctacgcgtcagctggtagcccaaacgaatggctggtcgctcgaacagatgtacatgcatatcacaaaaacggaggaaggacaattaaaatcaacggcattcacattgacaggtggttgatgatgatgaacttcgttttcatcgcacatttatttatagaccttcgcgcaattggcgttctttgtgaggccgacgaaattaagctgacagatgaagtgcatgttggagtgccacggcttcagttcacgtggaccttggaaggacattctccagcgagtgttgtggtgcctgtttatctgtactccaacagggccaaatttttgttcggacttaatttgttaccaattggatttgatcattctatgctaagccagcgaggagtcgcctttgtctccaattgttcgctttgattgacttttgtatcttttgtctcaaagaatatttatttatctgtctattgtttttaatttgtttccaatga

SEQ ID NO: 47397 - DNA, 1685 bp, Heterodera glycines
  Genomic contig location: Contig_ID=SeqID_16812; Location=1874..3558; Strand=-
  SCN-specific regions: Sequence locations=1-473,495-889,912-954,977 -1055,1090-1685
  Gene Ontology: Mol. function=7-alpha-hydroxysteroid dehydrogenase activity; Cellular component=plasma membrane; Biological process =lipid metabolism
tttcgtctgatgatcaagtgaaaaaggcaatggacgcaacaacggagaaatttggtggtctcaatgttttggtcaattgcgctggaatcgctttcgcgcagagattgtacaatccgtcgagcagagcccaaatggacctcgacaaaattcggcgactcatcgacgtttgaccgccaaaatgccgtccattcatcctgtaactgtttcccaaaggtgaacatcttcggcaccatcaacgtgatcagacacgccctcccgctgctgattgacaatgtgccggacgaaaacgaccagcgcggagtgatcatcaacacttcatcaattgcagcctttgaaggacaaatgggacaggtggagagacaaatttgtaattacagcacccttccagttcactggctttgttttcactttaaccagtttcctcccgacgtggtgccggattttggaacgactcaaatgcgcaaaatcgagccaaaacattttaatgaaccaaaaatactgaacaatgttactcatttaaatcaaacagcggccagtcaagtctccaacaattcgaaacagttccatgaacttgcttggttacaaaaaaaaaatttctaattgtgttttatatagggatgtatgttgcaaagctactttctaagacacctcaaaacggaatcgcagaagctattcgcttgaaaggcccagattttctcaatgtgcaccagcaagcaaattgatttgatgagtgaaagtatgtgagacccatccaattgtttcattggcttacacactttaaaatttttcaatttggatttattcgaatcatgatcattcctttcttattttgaatctgcattacattctatctgatttggtgattcaccattaattaatattttactgtgctttttactttaccctaacgcgcataaggctctaaagcagtgcattagacaaggcaattaattcgattactattcataaatcatggaagtataagggaaaaataaaaatccctttccctaatttagtctgcaaaaaacgcaattcaaaatttattcattggaaacaaattaaaaacaatagacagataaataaatattctttgagacaaaagatacaaaagtcaatcaaagcgaacaattggagacaaaggcgactcctcgctggcttagcatagaatgatcaaatccaattggtaacaaattaagtccgaacaaaaatttggccctgttggagtacagataaacaggcaccacaacactcgctggagaatgtccttccaaggtccacgtgaactgaagccgtggcactccaacatgcacttcatctgtcagcttaatttcgtcggcctcacaaagaacgccaattgcgcgaaggtctataaataaatgtgcgatgaaaacgaagttcatcatcatcaaccacctgtcaatgtgaatgccgttgattttaattgtccttcctccgtttttgtgatatgcatgtacatctgttcgagcgaccagccattcgtttgggctaccagctgacgcgtagccgttatatacgcttcaggaaagaacatcccacccagccaaacttcctcatatctcagattttcagaaagtgacaagcgctttagttgttccatcctttgcacaaagtctcgcatccattcaagtgctgttacgtcttttggcacggaaaattggagccaa

SEQ ID NO: 47398 - DNA, 1179 bp, Heterodera glycines
  Genomic contig location: Contig_ID=SeqID_16841; Location=680..1858; Strand=+
  SCN-specific regions: Sequence locations=1-89,111-230,252-381,403 -1156,1178-1179
atgtcgattaaaaagttcgactccgctactaataaatatattatactcaaaaataacgaacaagtggctacaatcaatatgatcggttcgacttggataaagaacctaaaaattatcgtccaagggcgcgagatttatgactctaactctttgtatgcttataaagcatactttgacgcggaattatcatattctaaagatgttaaacattcgcatcttcaagcaagtggttattacaaagacagtgacaaccaggacggaactgataacaaagcacccaaggatttgattgtagaagaaaattattttctgaaagccagactgtgcaatttattgcaaaattggatgctgatgtgttcaaccaggatagatatatggttaatggaattgagattgacatacaaataacgccgaatgacaacgattttatgataatggcagcatcagacgataaatataaggttgagatcacttcttgtaagctatatgttaagtcgttggaaatcgttgatggtctcgctttggatctacagaagaagcttgaaagcaaagaagcaaaatatgcccacagaaaaactttgattaaatcagtgttcatcagtgagaatcggaccgagtttaatggaacactgtttacagggcaactgcctaaaagagtaattctcggaatggttgaaaattctgcatatgtaggctcacaaaagaagagcccgtttaattttaagccatttaatcttcgatcagtttcgttgatcgctaatggaaaacaatggcctgcagcaccttttgaacttaactttgataaaaatttatatacacgcgcattccatgaaatgaatgaatctttgggaatgaattccaccactgacagtaatgggatcaccctagaaaaatatcgaagtgggtggacaatttttgtattcaatatgacaaatagtatggaagaaaatgagtgtattgatcttatcaccgaaggtacgaccaccgtttcggttcagtttcgaaaacccgttcagtcaggagggattactctaattgcgatgagtgagatggattctatcttaattttggacaaaaaccgtaccgttatgacagacactagcgtttgatgtatatttaagtgaattgttttagagtattctatttgtcaaaatgtttttatttattgtgttaatttta

SEQ ID NO: 47399 - DNA, 2414 bp, Heterodera glycines
  Genomic contig location: Contig_ID=SeqID_16892; Location=24..2437; Strand=-
  SCN-specific regions: Sequence locations=1-186,208-307,342-607,642 -2414
  Gene Ontology: Mol. function=acetyl-CoA carboxylase activity; Cellular component=mitochondrion; Biological process=mitosis
actgtgcaaattccaaccatcgaatggtcgggcagtggtttggttgcacctgagcaaaatgccgacaattcgacggccgaattggaaattccgaaggacctttatttaaaagcgtgcgtcacgtcagtcaaggaaggactgcagtcgatggacgacaaaaacatcacatatccggtgatgatcaaagcatccgaagggggaggagggaaaggcattcggaaatgcttgagcgatgaagacttccgattgaattttcgaagagtccaagccgaagtgcccggcagtccaattttcatcatgaagttgtctacagctcagagttgttctgatttgttttgttttatctaggtgtatggttaacgctcgacacattgaagtccaactgattgcggaccaatacggccaagtcatcccaattttcacgcgcgactgttccatccaacgacgctgtcaaaaaatcatcgaggaggcgcctgcagggatcgtaccgcaggaaatccaacggcaaatgcaaatggacgctgtgaatttggcaaagaaagtgggctacgtcagtgccgggactgtcgaagtgggcgaatttcacggaagacaatgctgcaattgccctttcagtacatgtatttgccatctgagcagaagtactattttctggagcttaacccgcgactccaagtggaacatccgtgcactgaaatggtcgccaacattaatatccccgccgtccaactccaaatcgccatgggcatccccctgcacagaatcactgagattcgtcttttctttggcatggatcgatacgggtcagttcagaatcaacagctcgattctcaagtcgatctgattttcaaaaattaagcacttctccgttgcccgaagaacagtgccgaacggacacaaatatcagcgtaattgcggcacgaattaccagcgaggacccagcagaaggcttccgtcctgcgagtggcgccgttgaagtgctcaatttccagtcgaatcagaatgtttggggttacttttccgtctccagtacggggaaagttcatgagtttgccgattcacagttcgggcatctttttgcgaaaggaatgacaaggcaaggcatcaaatgacatagtaggaaattggattaattgcgcattttcagatacgaagcgatttctgcccttttgtgtgcactcaaagaattggaattgcgtgccacttttacctcccaagtgaattacctcgttggccttctccacgacaaggaattcgaatgcaacaactttcacaccgggtggctcgacgcccgaattgcctcacgcgtccaagcatccgtggaatacccaccgcacattagtgtggcaattggggcgactctgagtaacaaatccaaccgtggttgatgaatttggactaaagagaaatttaagttggccacgctcggattaccgaagtattttccaaattccaaagtgcgctcgagaagggccaaatcctgccaaagtccggacttgtggagacgtgggaattcgaattggtgcacaacaacaccaaatactcagtgatggtcaatcgctttgggcccatcaattttctcgtccggttgaatgaaagcatcgtgtgcactgttgtccgtgagcttggtaatggaactttgcttgttacccatgaagaccaggcgtacacttgccatttggaggaagaggtactcaaaactgacaatgagcaaatggccaaacaattcatatttgttttcagtctgaacgcttcaaagtgataattggcaaaactttaaccatattcgagaaagaaaatgacccttcgatgttacgatcgaaaaatgctggaagatttttgcagtatttgaagaaggacggacaatatgtcacaattggagaggtttttggagaaatggagtcgatgaaaatggtcataaatttggaaatcagaaaggcgggtggtcgtctagttcaggtacatttgggttagcatgttacgaaagcggccaaattgttcaggttgcgcaaccgggacaagtccttttccctgggactttaattgcgagattggaggaccaggaagacattgccgtgtccaaacccgtgaatttcaccggtccgatggaggagtgggacagtacacgagaaaaggagttgcagtcacggaatcaaataaggatgaacacacgatttgaagatctcattcaggtatttgggtgattgtgacaatcctttcattttgtttaccgtaattccaattgaaggcgtgcaacaacattttgtccgggtacgccatgcctgaaccatatttccgtgaccaaacagctcgtctcattgatgacctcttcgtggtgatggacaaccctcgtttgccatacgtccttttcaaagtgatgctcaacgcagtcgaaaatcgaatcaatcgtaaca

SEQ ID NO: 47400 - DNA, 337 bp, Heterodera glycines
  Genomic contig location: Contig_ID=SeqID_16894; Location=245..581; Strand=-
  SCN-specific regions: Sequence locations=1-337
  Gene Ontology: Mol. function=protein transporter activity; Cellular component=mitochondrial inner membrane; Biological process=growth
atgctgagcaacggacagagtgtgctggatgaattgggattgtggacatggtggaagccgtcgagttggatgcgttgggttatggaatacgcacatttgacattggacattccctggtggggcacaattattgccagtgagtcggaaaaccaggggaattttttttatttaaataactaggcgttcatttaagcaactgtcactttgcgattgctttgctttccaattcccgtgaacatgcgcagaatgatggcccttcatcaaaaatacgccccggaattgaaggaattcaccgataaaatgcagaaggcatcgcgggagggaaacaacgcattgt

SEQ ID NO: 47401 - DNA, 1865 bp, Heterodera glycines
  misc_feature (25)..(25): n is a, c, g, or t
  misc_feature (81)..(81): n is a, c, g, or t
  Genomic contig location: Contig_ID=SeqID_2742; Location=784..2648; Strand=-
  SCN-specific regions: Sequence locations=1-568,591-878,901-928,952 -1425,1447-1493,1520-1655,1690-1733,1755-1865
  Gene Ontology: Mol. function=dihydrolipoamide S-acetyltransferase activity; Cellular component=pyruvate dehydrogenase complex (sensu Eukarya); Biological process=acetyl-CoA biosynthesis from pyruvate
atgcaaaagaaggaaggtgaccaantcagcgaggtgatttgcttgtgagatgagacggacaaggcgacgatgggtttgaancgccggaggaaggctatctggcaaaaatcattattcctgaagggacgaaggatgtgcccattggaaaggttatttttacgacaattcagagcaaattatcaatttatttccattttagctcttatgcataattgttgagaaacaagaagatgttaacgctttcaaagacttcaaaggcgaggaaagtgtgccagaaacaatcgaagccaaagggaccccggaaacgaccaaactcacgcaaaagacactccccacggcacaacccgaacagtcacagccatcgcctcagaatgtgatgtcagaccaaagccgtgtcaaggcttctccatatgccaagaaattagctgatgaaaagggaattgacctttcggtgggtaaaatgaacccgatctataggaaggtggttaaatgcccaagtcaaacgatcataggcggtaaaaccgctattttatggggtaatgtggagagattaatttacattagttttattttaaagcattttaaaaaattcaaatttaatatgttataatcagctcaatttcagtcgttttctggctctggccctagtgggcggattttggctgccgatttatcaaaggctgaaggggaatttccgagccgtgggactcaaagctccgcttcttcgttcatcgatattccgctttcgaacatgcgcaaaacaattgcgaagcgtcttagtgaggcaaagtcgacgattccacattattacctcacttctgaaatgcaaattgacaaattgcttgagtaagttggttgtttcgtcgtttattgttttcgtttctttttcagagtcagaaagaaattgaacattttgttggagagagaggccaaaaagaaaggagaaaaaatgccttcgaaattgtccatcaacgactttattataaaggcgtccgcactcgcctgtttgcgtgttcccgaggctaattcctcctttatgggctctttcgttcggcagcacagttcggtggatgtttcggttgcggttagcaccgacgtcggtctgatcactccgatcattttcgacgcacacactaaggtaatccaagcaacggattgctccatttccatcgccaattttaagggcgttgcgacaatcagcaacgaagtgcacgcattggcagcgaaagcgcgtgaaggcaaattgcagccgcatgaatttcaagttgtaccttcattgtccaactccgttactttcggttttcagggaggaacattcaccgtgtctaacttgggaatgtttggaagtgtcgaccattttacggccatcataaacccacctcagtcctgcattttggcaattggcgctgcgcgtcgaatgctcgtccctatggaagaggaagacaaatcggattcaaacgaacggtgtttttcgaacagttcagagtattcagattttaaataacttttgttttcagtttccgcgcagtcacttcgctgaaagtaactttgagctgtgatcaccgagtggtggacggtgcagtgggcgccgtttggcttcagaatttcaagcagtttatggaagagccatttacgatgatcctttggggcacaccggggaatgttttttaattgtttctcctcattctcggcccaattattaggcttccgtggttgactctctcctagtgatgacttacaataggataaaaataccttacaattagcgggtgaaaattgtcattgtttttgttagagtgaatgataaattataattttgaacaaatgggccataaatttctgcccctttccctccgcctaataaa

SEQ ID NO: 47402 - DNA, 810 bp, Heterodera glycines
  Genomic contig location: Contig_ID=SeqID_16975; Location=3260..4069; Strand=-
  SCN-specific regions: Sequence locations=1-400,422-506,528-810
ggtgggaagcgagcccaatttctttcacgtctggactttgacctgggaaaccaagaactttatttgttgaacaatttggatcttttatttacaatttacaaagctcgtgacacattcatcatgcagacattgaaagcaaacaatactaccaaataccgcgttagagtccatgacgtaaaactgtatgcttaaatgattgatgttcagtcatctttgaatttaagcatctacaaaacgcttgaaaaacaacccgccacatatgcagtgcgaaaaactgaaatcaaatcatgctttataagtgaaggtaggtttgaaattgactacaatgtattcagtgcaacaattcctcgacgtatgacaatcgcacttgtcgcaaacggggcatttaacggaaattatgctctctctccatttaattttaaaccgtttgacattcgagacattgcagtgtacgctggaggcatgatttacccaattgttccatacaaacttgactttgccaaagatatttttgtccgtccttttgttgacatgtatgaggcacttggcatggctaattcagagcgttctttcgacatcacaaaagagcaattcaaatctggttggacctttttcgtaattccactcacatcgacgctcgacgatagcacagggtatgaactcttaagaagcgggacaactagcattcgcgcaacatttaatagtgcaattcctgagggcggagttgaaatgatagtgctgggtgaatttgaccaaatgataatgatagactacaaccgccacattgtttccgattcaaagcttagttaa

SEQ ID NO: 47403 - DNA, 1854 bp, Heterodera glycines
  Genomic contig location: Contig_ID=SeqID_2750; Location=789..2642; Strand=+
  SCN-specific regions: Sequence locations=1-135,157-374,396-422,444 -445,472-828,850-1368,1390-1796
atggtgcatcaaatatttgatccaaactcagttagttttgatgattttgttgtagtagagcagattggctcgggagaagcctttaattattttcgcgggatacctccataccaacgaggatatggaagacagcgaggtggaggagtaggagatgtgttgaggtttttatggagagcacttttaccaaaattaaaatctgctggtacattattgggtagagaggcattagacactggaacacgtgtattggatacaatagagaaagctgaaacaccaaacaaacaagcaataattaatgaagtaaagaagggaatggataatgtactcgaaaaaggtggggttgggcgtcaattcggaacgggaagaaaaaagagtattaaaaggaaaagaattattggaaaaactatacctaagacagtaataaagaagagaaaaagatcagacgtatttggaaaattattttaaaatggtcttcaagaaaattggcaaggaatcggtaaattctataacttcagctttgtcaatatttacccttccaccaactaatgtgtcagtgagtagttcttcagtgcgggaatatttaccgctcaatcctttaacggacattccttttcattttaaaattcaccctaccgctagtttctttgatttgaacaaatgttacatcttaaccgaaatgtcaattaaaaagctggattctgacaccaataaatatgttaatttgaaagtgaatgagcaagcggcaacaattaatatgattggtgcgacttggataaagaatttaaaaatcactgtgcagggacgtgagatttatgactctaactcactttatgcttataaagcatacttggatgccgaactttcttattccaaaaacgtaaaggagtcagacctgcaggcgagcgggtattatgtggacagtgagaatcaggacggcacggatattactcagcagggttttgatctgagaagaaaattgttttcacaaagtcaaactgcacaatttattacaaaattggatgcagatatttttaatcaggacagatatatggtgaatggagttgagattgatatacaacttacccctaatgacaatgagtttatggtaatggcagcggccgacgataaatatagaatagaaattaccgcttgtaaattatatgttaaaactcttgaagttgttgatggtcttgcattagacatacagaaaaaacttgaaagcaaagaagcaaaatatgcccatagaaaaactttgatcaaatccacatttataagcgagaatcgaactgaatacaatggaacgctatttacgggtcaattacctaaacgagtcattctcggaatggtggagaacgctgcatacgtaggcaaccaaaagaaaagcccatttaattttaaaccatttgatattcgatccgtcacattgatagcaaacgggaaacaatggcccgcagcgccatttgagcttaatttcagtaaaaacttatatacccgggcattccacgaaatgaatgaggcattaggtatggccagttcaacagacagtaacggaatttctcttgagaagtatagaaagggttggacaatttttgcgtttaatatgactaatagcatggaggacaacgagggtattgatcttattacagaagggacgactaccgtgtgcattcaatttagatcacctgtcccatcgggtgggatcaccttaatagccatgagtgaaatggactctattttgatattggataaaaatcgaacagtaatgactgatacaaccatttaatgtatttaaagtgatttattatttattatttataattttttaaaatgtttattttgtttgttttattttta

SEQ ID NO: 47404 - DNA, 950 bp, Heterodera glycines
  Genomic contig location: Contig_ID=SeqID_16993; Location=1276..2225; Strand=-
  SCN-specific regions: Sequence locations=1-208,230-314,336-905,928-950
atgattgatgttcagtcatctttgaatttaagtatctacaaaacgcttgaaaaacaaccagccacatatgcagtgcgaaaaactgaaatcaaatcatgctttataagtgaaggtaggtttgaaattgactacaatgtattcagtgcaacaattcctcgacgtatgacaatcgcacttgttgcaaacggggcatttaacggaaattatgctctctctccatttaattttaaaccgtttgacattcgagacattgcagtgtacgctggaggcatgatttacccaattgttccatacaagcttgactttgccaaagatatttttgtccgtccttttgttgacatgtatgaggcacttggcatggctaattcagagcgttctttcgacatcacaaaagagcaattcaaatctggttggacctttttcgtaattccactcacatcgacgctcgacgatagcacagggtatgaactcttaagaagcgggacaactagcattcgcgcaacatttaatagtgcaattcctgagggcggagttgaaatgatagtgctgggtgaatttgaccaaatgataatgatagactacaaccgtcacattgtttccgattcaaagcttagttaatgaactgtataaataagatgcataatgcgaaaaaatgccaccataaaaatggccttcttaaacactacagtcaacgccagtttaaagccagagatacaagtactaacatttgaaaacaaaagcgttcatcctaacctcctcgtgcaacttctattgcttgcccattatctcattgcttttcccgttttcattttatgctggtattctttgataaattttcttaagagaagaggacatatttctcagcgtgatgccaatgagatgatggatgatttgcgaaattaccaattaccaaaaaattcatcagttatttttccaagtttatcaataaa

SEQ ID NO: 47405 - DNA, 1117 bp, Heterodera glycines
  Genomic contig location: Contig_ID=SeqID_16996; Location=8..1124; Strand=+
  SCN-specific regions: Sequence locations=1-30,54-96,118-231,263 -428,450-654,689-1117
  Gene Ontology: Mol. function=RAN small monomeric GTPase activity; Cellular component=cytosol; Biological process=embryogenesis and morphogenesis
atgaaccaagaacaagacaatatcccaactttcaagcttgtgttggttggtgacggtggtaccggaaagaccacttttgtgaaacgccatttgactggagaattcgagaagaaatatatcggtgtgtcaaaataataaccgcgattctttaattttgtcgtttagctacgcttggtgttgaggtccatcccctcacttttcacacttcgcgaggtcaaatccgattcaacgtttgggacacagccggccaggagaagtttggtggacttcgtgatgggtattatatccaaggttaatgaattaggaatcacttttttttactcaaacatcatatattcttaggccaatgtgctattgtcatgttcgacgtgaccgccagagtcacatacaaaaatgtgccgaattggcaccgcgatttggtccgagtttgtgagaacatcccaattgtgctggtggggaacaaagtgagaagttcaacggttctactttacttaaccatcaataaatctcgcctccttttaggtggatgtcaaagataggaaagtcaaggcgaaaagcatcacttttcaccgcaagaaaaatctccaggttcgttttttgtctatatatattcataaagcagtaccatctttgtagtattacgacatttccgcaaagagcaactacaatttcgagaagcccttcctttatctggcacgaaagctgatcggcgaccccaacctcgaattcgtggcgatgccggcactcgctccgcccgaagtacaaatggatcccgctttggctgccaaatacgagcaagaagtggccgaggcagcaagcgctgaactcccggacgatgatgaggacatttgaagagatggaaggacggctgggacagattcctgggacagcaatttccgagcagacaaagttatgtccattgttttaactgattgtttgatgagtaaaggaaagcgaatgaattgggatagaattttgtaatttgactaaattttcctagaacatattacctcaggaaatgacaaaccgtacaaaaattaaaagaaaatctaaaaaaatttcttcgctgggcttaccctaagaatattttctttcgctatttcaacgacgatctgca

SEQ ID NO: 47406 - DNA, 1446 bp, Heterodera glycines
  Genomic contig location: Contig_ID=SeqID_16996; Location=1109..2554; Strand=-
  SCN-specific regions: Sequence locations=1-391,413-1357,1387-1446
  Gene Ontology: Mol. function=co-chaperone activity; Cellular component=mitochondrial inner membrane; Biological process =embryogenesis and morphogenesis
gatgcaacattcgcttcactgaaggagctattttgcactgaccatgcgttggatcctgccaagacgcgcttccttttgggttcaattggtaaatcggaacaaaatccaaaacttattaaatatagaaggattaattatcaataaaatttttaagttagaattcaagatcattttttcagaaatgatcgctgatgatgaaacgcctaattcgcttgggttggaggacggagattgtattgatgtgatccattttgaataatgacactcctcgcctttacatttgttttatttacgacataaatttaccaacaaataaaagccttggttttgttagccattgaaagtgttttgccttaattttcatgtgctatttattcctttgattaatccgtgatcaatccgttctttttctatcttttcagcccgtttgttggagatgtccaatgtgcgcgttccgtccctccccttcagtttttaccctgaaaagtgcacccattgtcttattggactgtacatccaccggtgcttgtcattctctcattcaacttcaaataaccgccacaatgatgttgctgcccacaaaaatcattaccaaactttgggagtgtctcgtgatgcgagcgcaaaggatatcaaaacggcattttttgagctgaccaaagtgtgggcgaacccttaaaatgtcagcttaaaaacttgttattttgtcgtacagaaacaccatcctgacatgaaccctacggataaaacgaaagcagccgaggcgtttcaaaatgtaagaattatacgattacatttttaatcaaatgatagtgctttgtcaggaaagcgtttttgtttagaaatttaattctattatattgttttaaaatcgtctttccttagataactgatgcatacgaagtgcttggttccgaagagaaaagacaaatttacgatacgctcactgctccgaaaccgcaagcccatttcggcagaacgccaaatttcagacggactcgttccaaccatataaacatgggacctgcaggagggcataaagattggaccgatttggacatcgatttcagagatttcgagcacttccaacgagaaaaccggtaaaattgttggttcaagcattgaattttgcttcattttaggagccggcagacgttcaaagactgggcccgggcgaatacaaaatccgaattttactggtcatctcaccaatcttcgaaatcatataaaagcccgctagcgttggaaagagagaacttggagaagaaaatgcacgacgaagtcatggagagacgaaggcgaagcgcgacaattcccatgtttgacgaactgcaaagagacaagcagaaaagggaacaggaagagaggaagaagagaatgaagaattacatcatctttctgccgatcgcacttttcatattattatttattgcagatcgtcgttga

SEQ ID NO: 47407 - DNA, 808 bp, Heterodera glycines
  Genomic contig location: Contig_ID=SeqID_2756; Location=958..1765; Strand=-
  SCN-specific regions: Sequence locations=1-7,29-41,63-218,242-443,467- 519,542-808
  Gene Ontology: Mol. function=DNA helicase activity; Cellular component=nucleus; Biological process=mitotic chromosome segregation
aaaaagggaactaaattcaaaaatggaaaaacagtcgaaccatattaatttgtttttgaaaccctcacagcagcagatttggcccgcattttgtgagtccgcacgttcccgcgagggtgccgtccttttcgcggtggtcggcggaaaactcagcgagggttcggttttttacggcagcggggggtggggggggaatttgtaaatttatgaagttttggatattttttatatatataattatgatttcaaggcatcaacttctccgatgagttgggccgttgtgtgctgatggtcggacttccgtacgcgaacagaaactcggccgaattgtcagaacgaattcgggtgagttttatgatttaaaccgttatttgttgattttgatcaaatttataattacaattgatcatttttcaccgtttattttaattccttttttcatgttttaaaatatttatataaatttggcaccttttgtttcttacaaattcttatgctaataatagcataaattttctgaccaaatttgcccccattttttgcccagtatttggaccagcacattgggcctggcgcgggcacgcgcttctacgagcagttgtgccagcaggccatcaaccaggccatcgggcgtgccattcgccaccgtgtcgacttcgccggcattgtgctgctggacgagcggtacgcgcgcgacacaattgccgccagtttgcccggatggattcggcaacggctgacgcgcgcggttccgttgcccgaggcgctgcggcgtttggacaattttttcagcgtccacaattgtgag

SEQ ID NO: 47408 - DNA, 1344 bp, Heterodera glycines
  misc_feature (131)..(131): n is a, c, g, or t
  Genomic contig location: Contig_ID=SeqID_2758; Location=2505..3848; Strand=-
  SCN-specific regions: Sequence locations=1-204,237-259,281-302,324 -370,393-621,644-1014,1042-1165,1228-1344
ataaatgatctgccgtccttttatacaaatgaagcggcatcagttggcataaaaatgtatgccgatgatgttaaattatattatgcccacgaaaaatgatggccattcgaatcagttggataaagcaatgnaggctttgaaaaatggtcaaaaataaatgggttagaaatttcaactgaaaaatgttttgttttatatttagggaaaaataatattaaaaaagaatattttattaactcaaaaaagatttcagaatcggataatgttcgtgactttggaattataatgcactcgaaacttaatttttcagaacacataagcaaaattatacgaaacgcatatcttagaagctttcagattttgagagtcttaaaaaccagggaaataaagactctaacagcagcttataaaacttttgtacgacctcaattagaatacgctaccgaagtttggaaccctaatttaaaaaaagatatagacaaaattgaacgggtacaaaaatttttcacaagaaaagcttttcgaaaatgtggatttgtgtacaaaaaatatatggaaagacttaaaatcatacacaaattggaagaaagaagaaaaatcaatgatttaacaacagcttttaaaataatcaaagggttcaccagcctcgatgctgggaaaagtttctttttctcagaaaggctcaggaggcctttacttttacgggtaaagcgccacacggccaaaactcaaaataattttttcaatagaatagtaaaaagctggaataaccttccagtggtagcggtgcaaattaataaggcaaaggaattcaggggtttactaaaagcaatgagttagagtaggaaatttctgtgccacaattacattaaaataatcacctgtgaatttaacatttgatttatttttatttcacatttattacatcattttgtatttttaatttgacactttttatttgtttgtttctttttggcgccatataagagcactaatgtgcctttggtttgctcgataaatttaattaattaattaaaaaaacacaggatttattttcctcactttcatcactttttatcgaagattttctctaaatttatttcttttcaattattttataatgcaaaaattgcacttttcacctcattcatttcgagcaactcgcaaaatcgtctttttctgcacaaattttgcacattataattaaaataaatttaattaattattgtaagagtacctattttgcattttcactatttcctcttgcacttctttcaaatttcgctcaatgttcacagccatttctgttgcaaccttacaaaatatttaaaagcacaaattaat

SEQ ID NO: 47409 - DNA, 1418 bp, Heterodera glycines
  Genomic contig location: Contig_ID=SeqID_2766; Location=2847..4264; Strand=-
  SCN-specific regions: Sequence locations=1-136,158-301,323-455,477 -910,932-1042,1090-1170,1193-1227,1264-1418
atggtcggcatggggcaacccaaatggattaacccggaacgatttgacgaaaagtcgaccaaattgttgtccgaaaggacggtaattgggtgatcattgattattggaatatatttaatcattttttgattgatcaattctcatatttcaccaattatttccgccacagattgtcaacactttgcccgttaccgttttgtcctcttttgtcctccgacaaatggtcaaacgccgtcgcggtgctgtcataaacatttcgtccgcctcggcgtatatgaaatggtaccagtacgccgtctattcctctacaaaggcaattttggaagagaggggggaggggggggggggcttttccatgccgaaatcccggacatttctcccattctcgagaattcaaataatgtcccatttccgtcatgttctcgacaccactccaatttctggcaatggcaccgaaattattttttataattctcgaggccgtccgtttccgctcctttcccattctcgcgaatagccaaatttcattttttttttttttctaaaatgccattgtcctataaaatgccactcccattttgccaattcccctacaaatgccatccccgtgccccttcttcagagcttcattgtccatttgtccgaaatcttgcgcaaggaattcgcctccgattgtccgggcattgccatccaaacggtgtgtccaatggtcgtggccaccaaactgactcagcgttcgtcccgtgacggcctttcttcccttttggccgccagcccaacggaatttgcgcgtcaagccatccaaacggttggcctcgtgccggagacgagcggatgtttgtcccaccaaattcaggtgggccattaaaaaggggggggggaataacggaatggcattggcacggaaatttgaaatttttgacacggaaaattgaacatgaaattgggcaccaccaccattttggaggcatatttttggatttggcacaggaccaattgatcaacaatttaattatgttgacctcgaattaaacattgttttcaatttgtgccaatttttgggaataattttattttaaaaattattttgcataaatttctaagcatattttttcatttttgcacattttattttacatatatatttgtttttaatataggtagctattattaatctattttttcaaaatttcgattcaccaaaataatgacagagattttaggagcataaattaataaatcattaaataactaattaaaattcctctcaattttgttttaattgcttttttcaggttgagctgttgttctcccttttgctcactttcgtcccaaattcgctgttcgactttttcgtccgtttggaggcgcatttgcacaaaagtgtgctgaacacgacatccaaacagcacgactaa

SEQ ID NO: 47410 - DNA, 277 bp, Heterodera glycines
  Genomic contig location: Contig_ID=SeqID_17047; Location=1..277; Strand=-
  SCN-specific regions: Sequence locations=1-182,204-277
  Gene Ontology: Mol. function=structural constituent of ribosome; Cellular component=cytosolic ribosome (sensu Eukarya); Biological process=protein biosynthesis
atgaagctgaaccctttcgtctcctcctcagcgcgcaaatcgcgcaaacgccatttcaacgcgccctcgcacatccgtcgtcgcattatgtccgcgccgctgtcgaaggatttgcgcaataaacacggagtgcgttctacgcccattcggtacaaaggggcgggcaaattaacctataaactgtttaataatccactgattaagcattgatgacgaggtgactgtcacccgaggccactacaaaggcaatgccggccgtataatgcgtgtgtatcgg

SEQ ID NO: 47411 - DNA, 1279 bp, Heterodera glycines
  Genomic contig location: Contig_ID=SeqID_17047; Location=1116..2394; Strand=-
  SCN-specific regions: Sequence locations=1-85,107-332,368-475,518 -826,872-1279
  Gene Ontology: Biological process=embryogenesis and morphogenesis
ccggatgcatagagacgtgccttttgtttccgcaaaccaaactgattttccgacaacagttgcacaatgttcttgccgttgatgccataaaacaggtgaatgatgataagccaaacaccgggggactaatagggacggacacgaaacttcgaaatttgggctatggacagaatgaagttggtaaagcacacttaataaggatggaatatgggaagaatttcgtttgaccgtctcttttcagctccgtcgtgagggcttacacctcctttaccgtggccttcttcccccacttattcagaggacaacaacgcgttcgattatgtaccttttggacagaattttatttaaaaaatgctatttttaggtttggaacttttgaaaagtatcaacacgcttttggctgtgacccaaatgtgtccagcttcaccatttgtcacgctgtttccgcctttcttggttcgattagcttaaagttaatgtggaagaaaacagaaaaatataaaatgggatatgaattgaaaatttcatttcgttttccaatgccaaatatcgtcgcctttccaattacttttgcttttattgcattagccggtgctacggaagccattttatgccctttggagagaacacaaacgcttctgcagacgagcaaacactttgacaaattcaaaaacactggcgaagcctttaggattatgtacagaaattatgcaccaaaagagtgggcaattcatttttatttgttagcctttaatatagtcagccttaacagattttatcgaggattttccgtcatcgttctccgcaatgggtaaattcaaaattgttaaaatttttaatcaaaatatcttttcaatattattattttttagttgtagcaatgtaatgtttttcactttgcgtgagccgttccgcgaatttgtgctgtcaaagcttttccattcaactgagagcagaacgaaaacgcaacatttgtgcgcaaattttctgtccggtgccattctcggggcgtgcatttcgaccattttctttccgtttaatgtcatcaaaagtcggatgcaagtccgttttcctgtcttttgtaaacgctttcactcatttgttttagtcaaacattggcattgacttttgtactccgtggtttatgttcaaaaaaatcctcgcagaacggcatggctcaattcgtgcgttgtatcgcggtgctcagctcaatttcagtcgctcattgcttacctggggcatcacaaacagtctttatgagctattgatgtacgaactg

SEQ ID NO: 47412 - DNA, 1986 bp, Heterodera glycines
  Genomic contig location: Contig_ID=SeqID_17061; Location=114..2099; Strand=-
  SCN-specific regions: Sequence locations=1-190,212-222,251-885,907 -1307,1331-1468,1490-1796,1818-1986
  Gene Ontology: Mol. function=RNA binding; Cellular component =cytoplasm; Biological process=mRNA polyadenylation
tgaaaaaacggcggacctccacaaagttgaggacgccttcgtacctctgatcaaactgcgctacgatggcattgaactcgacattttattcgctcgtttggcgttgaaagaaataaaggaagaccaggaactctcagacgacaatttgcttaagaacttggacgagaagagcattcgttctctgaatggtgctctttttcatttcctttttccttgaatatgatcatttctttccatttgaatcaatcttctattttcaggttgtcgtgtggccgatgaaattttgcgattggtcccaaatcgactgaatttcattttggttcttagagccgttaagctttgggctaaaagtcagttttttctacattttccattcattcactgtgcctctttcgcagaccatggcatttattccaatgtgttgggctttcttggcggcatttcttgggcaattctcgtcgcccggacctgtcaattgtatccaaatgcaacaccttctgttttattgcagaaatttttcctcgttttttctgcatggtatggacaaagggcaaacggtgggaagcctcgaccggcgtgggacagtatccatggggaaagggtgggtacgaagggcatacgaaccccagctaacatacagcggcttctccgagtgtttcttagtaaatttgaaacttttttttggctacagtggcaaaaaaaaattaatttgtcaaatacaaattttaagtgcagtagtttttttctgactcacagggattggccacatcccgtcattctgaaggatgtcgacgctaccccgcggattgacataccctatttcattgacatgatttgggatccgagaacacgcgcatcggaccgctaccatttgatgccaatcattacgccagccttcccagaacagaattccacatttaatgtgacaaggtcaacgagacaagtgatgaccaatgaattcaaagaaggtgggcaaagcgaaggcattaagggagggacacaagcaaagtccaaaagacacagtgccatgggtagggaaggggaggcacaatttgaatcattaaattggggggggggcagagaagcctcgaattcccccccccccctctctctctgtctcccttcattctccacttctcttttactctatgatgtgcacagagtagagattgaatatgcttcgcattgctttatgcacaattttattctgattgatgctgtggtgtccgaccgtacgagtttcttttgccgtgtagtgtctcaccgaaaatgaggaggaccacctgaatttttgcgggttggttgagtccaaaatccgccatttggtggcgtccttcgagcggaattcctgcgtgaatctttgccatgtcaatccccggcagtataaacccgcatacaaattggagctcgacatcgattacgagtaatttattattattcaactcacgaactaataaattatctctcccccacccacgcttaaaatgcgtggcattacaaaatccaaaaaatgaaaatgaactgacaaagaatgatgattcactctgttttaacttttcattcattgttaaggaaccccgtgtgcactttgtggttcatcggattggacctgaacaagcaacttacgaaaaaaattgatctcacagaagagttgcagggatttacggacaccgtttacaaaagtgcgtccgtgctgaaggacttcaaagaaacgatgagaattcacccctcttacacgcgccaaaggaatctcatcaaatggtccttttatttgaaaaattatttttggcagtgccaaatataaattcttttttgttgatgtgtcacggttttgcttcaaattgcaggctttccaaggaggacttggaccggggtagacgagcggaacgacgctgctccgccgcggcggcttctccacgcgtgtccatgctaaacaattccctggactcaaccggaaaatcattggacaccagcggaagcaattca

SEQ ID NO: 47413 - DNA, 1371 bp, Heterodera glycines
  Genomic contig location: Contig_ID=SeqID_17062; Location=988..2358; Strand=-
  SCN-specific regions: Sequence locations=1-1371
atgagcgtaataaagaaaattcacaaagacagtgttgaaggccttgagggtagcctttcactgttttctcttccgccaacgaaagtggcgataaataggaccaatgtccgcgaattgttgcccttgtcggcacttaatcagaccggcccgtatctgttccgtttgttctcggacagtcagtactgcgacttgagcaaaacatacatgtatttgctcagctctattgagcgcaaaaatgccgcaggtgaatgggttccgaccagtgatgcggagccggaggataagcgcgttggtgtaacccaaaactttggcagcagctttgtccgctcactgaaaattaacatttccggtatagaagtgttcgacagctccatttattaccattaccgggactacataatgaaggaactgggctactcccatgaaattcgtaagactttccatgaggcagcgtgctattataccgatgaggatgattgccaagatagtgccaccaatgagggcttcatcgcccgtgcagcgcgattctctaacggaaagcaatgcgaaacgatggtgaggctgaactttgatcttgcacatcagagtgcattgatgttgaacaaccaggacgtgatattcaccattcatcgtaacagtgattctttcctcctgcttacgccccccggaaagaaagcagacggaacattgcaggaaaacagcaaggaataccgtattcgcgtgcacgatttgcgtctgtatgttcgtaccgtagacgttacgcctagccttaacctggcaatcagccgtcagttggagtcaacctcagccaaatacccgctgcgtaagattgagatgcgctccatttttctgggcaaaggcaggactgagttggctcacaacgtgttcacttcaaccttgccccgtcgtctgatttgctgctttgtctctacagacgcttattctggcgatcgaaagttatcgcccttcaaatttgaacacgctaatgttcgagcgataagtgcggaggccaacggtcaatcttttcccagcaccccatacctgctgtcgtttgacggtgcacagcaacgttttgtgcgcgcttttgtcgacatgtacgccggtcttggtctggatgattcagacacaaaaacggtgtccattgggatgcaacgcttcctcagcggatgggccttcttcgtaatcccgatgacctccacgctggatgatacgcccggctttgagttgatccgtcagggcacgtgtacgcttaaggtccaatttgaaaagcctataaaagaggacggttacgaaatgttgatccttggcgagttcgattctgtcctttccatcaacgctgaccgagtgttgagcacggacggaagtgtttaa

SEQ ID NO: 47414 - DNA, 1561 bp, Heterodera glycines
  Genomic contig location: Contig_ID=SeqID_17067; Location=147..1707; Strand=-
  SCN-specific regions: Sequence locations=1-24,46-135,188-479,532 -567,590-1493,1520-1561
  Gene Ontology: Mol. function=transferase activity, transferring groups other than amino-acyl groups; Cellular component=integral to endoplasmic reticulum membrane; Biological process=fatty acid elongation
atggcttccacttcggcagcagaattgtccaccccgaacactttcctcggcgtttctctcgcttctccgtttgactatgcggctgctcgagaatacaccgcttacacccaaggaccggtaagcaataaaatggggaataaaataaatattaaaataaaatatataaaaatttaaatctaaaataaatgcattaaattgcgaacaaatatatttgaacaaatttgttaaatgtataaatgcacaaaaaattgtcagaataaaagtaccaatgcccgagaataattttaaccatttttgtttttatttggctaattgctttccttccctttgcaggcgatttggatcaccacggcatatgtggtgacaatctttggcattcaatggtacatgaaggaccgcaaaccgatgcaactgacgctgagcctcagactgtggaacctttggttggccatgtttaggtgtgccagaattgccttttcaaatatttattattttttaataaatcaatttaaagcatttaaattaatttttgattaagttgcactaattgagacaaattattttattataatttcccttttctatccttagaaattagatttttttgagtaatttaattttattccattcattgaatttgattttttttaattaagaaattttaaaaggatttccaattttcacttttagcattgccggctgtctggtgaccagctacgcgctgctcagagagattggcacctacgggctggtcagctcgtacacgaactgtcgcgacttcttcgagggattcaccggcttgtggacctggtggttctgcatgtcgaaatttgccgagttgggcgacacttacttcatcgtcctgcgcaagaagcccctgatgttcctggtacgtcttgctatcacatgatataacgatcaacccactgatccgcacatgagtgtcgtttgtccccccgtttagcattggtaccaccacgtggccacgctcaactacggtctgatgtcctacgtggacaacaccgcgttcaacacatggattgtgtggctgaacttcagtgtgcacgccgtcatgtacacctattactttttggccgcctgccgcatccgtctgcccgcttggttcgcccagtgtttgaccacctctcagatcacccagtttctgatcactttggccatccttgcccacgtcggtgtgcgactgttggtcgggtcccacgtggacaccagtgagtttcctttttttggttcatcaaaaattggaacaaacgaaaaggattttaatttaataatccaaattccaaaaatttaaaatcaaacatcgaatttttcgttaaatttcttactataaaaacagtcgattagaaatgaaaaaaaaacacttaattttggcacaattaaagcaccgatgacctatgtgtactgcttgctgatggagatcagctacgtggttttgtttggcaactttttctaccattcgtacatcgccggagggggcaaaaaattccaaaaggaaaagcaaatgaaacagcagaacggagaagcagtgaagagcgaatga

SEQ ID NO: 47415 - DNA, 1600 bp, Heterodera glycines
  Genomic contig location: Contig_ID=SeqID_17070; Location=1..1600; Strand=-
  SCN-specific regions: Sequence locations=1-123,145-610,632-664,705 -811,899-963,987-1135,1169-1178,1210-1600
  Gene Ontology: Mol. function=ATP binding; Biological process=signal transduction
aaaaaagcaacaaaaaaaaaatgtcgtttatacactgagaaaacatttttttgctatgcctaaaatttaccgaattgtaagaaaaatgccaaaacggggtaattttttttaaattagtcataaaaatttactggcataaagttggcactatgttttacttattgttagatagggcacttgcgaaatagaatattgctattataaaaacttgaaaattagcaaaaaaaaaaaattttttttgttcaattttcaggcaaaaaaattgttgaatattttttaggaaaaaaaattcgaggttttatttgtaaaatttaaaaaaatgtgtccaaattgccattgattgaccgttttttccaggcccctgaagtgattcgcatggacggccccgagccgtacagcacccggtccgacgtgtactccttcggcatatgcgtgtacgaactgctcacctccagattgccatacgaggaaatcaagaatcgggaccaggtgtgccaaaaaaacaaatattttttcgaaaatttcatttttttaatttttcagtgaattaattttcaggcctttgaattttccctttaaagaaattatttttttctttgaaattcgattcaaaaattgcatttatttgtttcataaaatgattttgcctttaataacaagttgcttaaataattttttaatattgtttttttttttgaatttttctcggaaaattctctctaaatttcaattgggaaatatattggattaattttatgactgaaattggcaatttcatgccacttcgtttatacaatggaatttgtacaagttaattttatataattttttttattattttccaattttctaacaaaaaaaaattcacttgaaatttcaaaaaaaaaaataattttttgtacgaaattccgttttgtacgaactgtgccattgattttggcgcccaaaatggtactttatcaaaaccataacaataaacacaacaacaacagatcctctggatggtcggcagtggacggctgaggccgagcatcgccgacttgcgcaccgacacgcccaaacagttgcgccacgtcttcgagcagtgcacgcgcttccaacgcgacgagcgacccgaatttcgaattgttcgaacatttatattttttaaatatataacataaaaattcttaggttttggcaattttttaaaaattttcttgggaggaatgaagaaagtgtgtaccttttttattgccatttttatagtaactggagggctcgatttttgggataaaatttctttgccgttgtccgaatttaataaattggcgtcattcgatagcactaagtgctttaatcttgtaaaattccgaaaatttttttttgttaagattcaaaaaattaagcccaaaaatgttgggcgtaaaagcaatttttttttgcgcattttttggcttaacttttttgaaagcaatgaaatttttcgaaaaattttgcgaacaaaaaaaatggagaattctttggaccattgtgaatgaaatcaaactggattcaatttgtaacaactatgaaagcagttttgactagagttgagcgggaccgggacctgaacacggac

SEQ ID NO: 47416 - DNA, 460 bp, Heterodera glycines
  misc_feature (26)..(26): n is a, c, g, or t
  misc_feature (52)..(53): n is a, c, g, or t
  misc_feature (81)..(81): n is a, c, g, or t
  Genomic contig location: Contig_ID=SeqID_17103; Location=633..1092; Strand=-
  SCN-specific regions: Sequence locations=1-251,273-460
aattagtcatttttgacccctaatanggcttttgggtacaaatgcctcactnnggcgtcagtttcatctactccaccattnacgagaatttccgaaatgttcttcatgttaatgccaatattcaatccgcgcccgttgtctctgctttggccggtgagaacaatcaaatgccattccaaatttgttggtattcaggcggattttctagcattttcactcaaataatattcgtccctaccgacatcataagttatcttcctttttcattttgtaaatccgtcccattcactacggtttccctccgttttagtcagcatatgatgatctataataatcccgcaaaatttttgggctctgctaaaaatgttgccgttttggacttcgtgcgaacggatggaaagtcgggccgtttgacctttgggcttcgaattgtccgagcggtttatcacatcgatggttt

SEQ ID NO: 47417 - DNA, 687 bp, Heterodera glycines
  Genomic contig location: Contig_ID=SeqID_17107; Location=535..1221; Strand=+
  SCN-specific regions: Sequence locations=1-687
tctgttgatttgccctccaaacttgtccaatgttttgattgtcgtcagggcgcaattcgcgccgttcgcttcaacggtaagcggaattggttactgtaattttcgtcgccaaatgtggctcattgcgtcaccacttttctcctcatttttttgttttgttttaaagcgttaatttcctttttaattgcagttgacggtaattactgtatgacagccggcagcgataagtccgtcaagtacgaattgtgaacagtattaaatctacggtattggtggatagtatccaaaaaaacaatggactggtattttggaaacgcattggcaaggcgttgctggcttatccatatgccatggcactttttcgtacaattggtccaaatgccatgacattttttcattcaattggtccaaatgcaatggcacttttttcatccaatcggtccaaatgcaatggcacttttttcattcaatcgctatttgtccccaaaaggctgtggaacccataccgtcgtgtccatttgaagacgtacagcgggctgggccaagaagtgctggacgtggccggttcgagtgacaattcgttgattttggccggcgggcgtgacaaacagccgaccgtgttcgatgtcgagtcgggcaaaatggtgaagcggtggcaaagccacgggggcgcagtcaacgcggtcg

SEQ ID NO: 47418 - DNA, 875 bp, Heterodera glycines
  Genomic contig location: Contig_ID=SeqID_17113; Location=2042..2916; Strand=+
  SCN-specific regions: Sequence locations=1-153,179-290,312-513,536 -561,635-875
atggatttgtatctgttccatgccgaccggtatcaacaattgtacaactgcagctacgatgtgaaccaagtgccgttcgaggatcgtcaacacattgcacttggcacaatgttcatcacattggctggaattatggaggtggacgagtttttgatattattatttaatatattattaaggaaatcaaatatccttgaatatattttttaaaaggcaatgctgagaaaaattctggaattgttaaaaagatttccaaggaatttgtggaaaatttttcgattgaagtttggtttaattttaaagaaatcttttttatccgggggcataatgcgaaattgatgggattaaagtagagtttaaagaaaagttctaatttaataatgctaaagttgattttcaattaattcaaggacatttgttttgttggtaaaacccagtttaaggcgtacttaaaagcaaggacaaacctttctcaaccaaaacatacaataattgttgttgctcttatttggtcttaaatatttaaaattatttgcttttttgttggctaatctataactcattaattaataaaaattaattaattaattttaatgatactctagcactaattaattaatttattaaattaattgccctaattagctgctctacattccatgcacatttgccatttggaaacaccgtgaaaatggctgctacaaaatcatgttttacattgcgatcaccgacatgatggcaatgttgatgaacggcattgccaccggctggttggccattatcggcgccgtgttctgtactcatccgaatttgacttacattttgggtgcctatgggatgtgtaagagaagcaatttttaaatttacaatttaaa

SEQ ID NO: 47419 - DNA, 1464 bp, Heterodera glycines
  Genomic contig location: Contig_ID=SeqID_17160; Location=1130..2593; Strand=+
  SCN-specific regions: Sequence locations=1-495,517-597,619-647,677 -1209,1248-1259,1291-1464
  Gene Ontology: Mol. function=casein kinase I activity; Cellular component=bud neck; Biological process=signal transduction
atggaagaactcgtggcgctctcccctggaatccgcgtcggccgttggacgatcacaaagaagctgggcgccggagcattcggagccgtctacctgtgcgtgaacgaccaaggagagcaggccgcgctgaagacggagccggtcaacacgccacatccgctgctcgtcatggaggtaggcgggggaggaggggcgaaaggcaattcaatttaaaattttttttcaccacccaggctcacgtgatgaccaagctggacacccttcgagacggagacgggaagcacttctgccgctgcttggacctcgggcgcgatgagcaacaggaccaacaatcgggacaaatgaagaagttcaactacatcgtcatgtcactcgtcggtcgtggcctggacggagtcgtcaaggatgccggtggccgcctcagccttggaagcgcagtcggcgtctcgatccagatgctcgccgctctcagaggactccacaccgtcggctacctccaccgcgacatcaagccgggcaactcgaccatcggacgtccggaatcaaacgagatccgcctgctctacctgatcgacttcggaatggcgcgcaaatacaccagggacgacgtgagtttgagtgaagcgctttgaaaaaaacaaaaataatttgttccctttccccccttttcaggggagccaacaccgcccgcgcgttgccaccaacttccgcggaagcccccgttacgctgcgatcagcgctcatctcggacgcgaatacagccgcaaggacgacatcgaatcgtggttctactgcatgatcgagctcttcaaaggcgcacttccgtgggccagcgtggggggcatgaaagaggtgagcaaatgggagagggagggataatcagaattctgatttcatcgttttagatcggcgaggcaaaggtcaaacgccagaagaaacaaccggaagccgttcgacgccaggcaatcgccgacttgctctccggatgcccgaacgagttcggccaggtcctcaaatacatcgtgagttcgttcgttcgttttttccaaaattaataaactaacaaattaaattttgcaggacgacatgaagtacaccgacaagcccgactacgactggatcatcgcgacattgcgcagcagcctcagcaacgccggcgtccaggaattcccctacgactgggagacgggcaagcgcaacgcggcaccgggcgctggaggcggcggaggaggagggggaggagacagctacttcaactgatgagccgtgcagcagcagcagcagaagaatcgccaagaagcgtcaccgtgcagaattgatcatatgaccactattactgtattgtatgtattattttgtgtccatgctgccatccccgatatacacatgtattgtattgttgacatatgtattgattgaaattgttgttgcataactgtgtttgtacatatgacttttggcgaa

SEQ ID NO: 47420 - DNA, 1695 bp, Heterodera glycines
  Genomic contig location: Contig_ID=SeqID_302; Location=1..1695; Strand=+
  SCN-specific regions: Sequence locations=1-354,376-692,714-1204,1241 -1695
  Gene Ontology: Biological process=embryogenesis and morphogenesis
cgatttgtcccatacaaaagggcacacggcgcctatcaattcactttgttggcatcccttcgtcaaaagcgaatttttgagttgttcggacgacgggtcagtgaattatcgcgacaaattctttgtttttccgcttaattggtgccatttttcagttccttacgaatttgggacacaaacgattttaaagtgatcacaaaatgcataaacactcagcggaaattgataaagacgaaaaatgcgacggggaaacgggcgattccgacgacgtgttgctactcgtgggacgggaaaatgatagcggcgggttgtgacgacggatccatccaaatttggaacaatgcgaagatatttgtgcgtttttcctatgaatttgtccattaattattgccaacccaaaaaagggattcttttgtctgttcggtcggccctttgtccaccgtttgttcccttttcaggtaaacaccgccttcctgaaccgttcggcccattccgggcccgtcactcggttggaattttccccggatggtcaacgcatcgtttcccgctcccgtaactaacacattcctgtccctcattttcatatttttggtgctttagttgacgacacgctcaaactgtggagtttgaaggacttcaaaaagccgtttcgcatggccaacggattggacaccgttttccctcagtaaatttttccatttctcttttcccccgcgttttgcctttccaaggaccgactgcggttacagtccccacgccgagtttatttatacgacgacaaatgcgaaggacaaaggcggcggagagagaggcgctttgctctttttcgacgcggaatcattggaattactctataaaattgagtacccaaaacaggtccaatttggtgccttgcatttgccattgattggctcatttgttcgttttcgacgagtgtttttccagggatgcatccgtgccttttggcacccgaaaataaaccaaattttggtcggtctgagcgatgggacgagcaaaatttactacgacccgtccatcagtctgcgcggggccctccaatgcgtcagcaaaccgatgaaacggtcgcgcgagtcggagatggtccgcgaggaattggtcctctcccgtacggactcgcaaaataaatttggaagatttcgattgctttttctcttaagcattgactctcgaaatgttccaaccgcgcggcgaagacggcgaggaaaaggaagtgacggagtggcgcattcggaaattcttgcggatgcaaagcaaacagaagcggccccaatttcggcaacccgccgcaatgccaatgtccgggccaagtgcgtccttttccctcaacgaccaatggcttttgctgttgcaattgttggtttgaaggtgctggtggacgcattcggcaaaccggggggacgctgcactcgtacatagccaaggaaatggggatgagccggaacaaggagttcatgcagcacgaggacatccgctcttcgatcctccggcacgctgacgaggcaattttgggagggaaaatcgaagcgaaaagtccatcaaaaacaggcagagaaaaacccgcaattcgtggccatggcgtacaaacggacgcagccaaaccccgtgttccaagaaactgccgaggagaacgaagagggcgaggaggagcccgtgtacaaagtgccgaaattagga

SEQ ID NO: 47421 - DNA, 4731 bp, Heterodera glycines
  Genomic contig location: Contig_ID=SeqID_295; Location=323..5053; Strand=-
  SCN-specific regions: Sequence locations=1-213,301-624,656-717,740 -742,764-772,819-866,894-944,996-1164,1191-1256,1305-1340,1496 -1544,1566-1753,1775-1799,1831-1966,1995-2251,2274-2582,2604 -2659,2696-3085,3107-3244,...
  SCN-specific regions: Sequence locations=...3266-3402,3471-3912,3939 -3983,4005-4418,4440-4454,4476-4731
  Gene Ontology: Biological process=growth
ccgcttcaaaaaacaaagactttcttcccctttcaacaggtgttgtccgaaattgggccagccgtgctcatctccacgctgaccaacattttcgcggacggctgcggttggtacacgtcgtcgccggagcttggcgcactttgcctgggcaacatggtgtccatgttcgtcgcgttcatctaccaggtacggtaatcaaaaatgaaacggtagaaaaattacaaaaaaaaatatttaatttttttgaaaaattttttttttgataatttaattcaaatgcaaaaaaattttaaaatttttcattgaactgctcccagatgaccttttatgccggtttaatgtcgctggttggccgctacgaaattgccacggagcgacgggaacggcgcgagctgcaggagagcattcggcgtgccgtcgaaacgggcggtgccggcatggaactgggcaaatcgagcgtgaagcatggactgacggtacggtacagggccgaatgtactgtaccatgtttaccgtaccatgtttttgggcactattcaattgatcaaaattgcttatctttgatcaaagagtcttggcatttaaaatttctttttgtcaacagaggttggaattttagttgcgaaaacccaaaaataattaaaattttcttaaaagtggcggatctaagaaaaaaaacatttcattagatttcaatgctttaattctatatacccttaaacttttttaagaaaatccagctttttgaaaaatatatagaaaaaatggcgtgaaaattttttctaaaacaattttttttatttattattattattattccagtgaaaaaaattaaaatgaaattttttgattttgggtccatggagaaagtgaaaagtttaaggtttttgtttgagagttagtttttttttgttcatttccgatttgaccccttgaaaatttggtatattttcaaatttatagaaaattatacaaatttttttcaaaaaaaaaaacgcttaaaaattttcattagttaatttttgaattttgtcgtttttccagcgccagcacagcaaattccacgagcacactaagcattacatcagtgaatcaatccaaacatatgtgagcattgtggccaacaaattcggtactttttttacagtaaccgcattactgtaaattgtttatttattcattcattagttgcaatgctgatcgttgtactttactttgtctatttgggcatgtccatttgggtaagtgggggcggcaattaattgagtaattaattaattttggttgggtaattaattaactaaatgaacttaactgtgagattagctacgcgggagcagatttttaaaatctaaaaaagaatttaatttttcaaaagtttacttcttaaaaaataagaaaataaataaataaagaaaatcccaaaaatccaaaaatttctaactttttaaaaatcaaattaattatattaaaagaatttaaaattcaatttttagaggaaattttaaagaaatgcaattaaacattttgtgctttattgtcatagccaaaaaataaaattgctggttaattcacgagaactgagcccatgagtaaagacatataaccgattaaataggaaattctcaattttgaatatttcaacgctgaaaaaatgtaaaatttttgaaaaattttcgaaaaatcaaaaattttgttagaatttccatataaattcagggagtcactcaaatggaggtcaaactgtccatccaacaactgttcaccagcgattcgccacttcttaaggtgatcaggcccgaacaaatgttaaaatttaccaaatttttggcattttcaggttgacgaattgcgtgttggttaccaagtgccgcatttcatggtaattcatttagacaaatgccccaatttagtaaattaaaaatatttaacattttatagtgttgttttaattcaacatgcagcgatttaatgataattaaattaaaattattgaatgttatgagagagtttacttgcttgctaattaattatattattgtttaagtgctaattatgcaattagttcaattaaattataaatgccctatttagttaaatcaaataggtatttaacattctgataatgattaaacacgaagtgatttatgctaattaattgaaatttttgcttgatgaattatttgctaattaatatgattgctggtcaattgctaatgcagcaatttgtgcttttcacagtaattatttttattaattgttcccccttcccccgtgaagagttccaccgttttggtgttcaacccgggcaacctcagtgaccccgaacggttggccaaaatgaacaaatttgtggccgaaatggaagcgatcaatggctcgtggggcccaattgggaccaaatattttgtgcgcgactttatcgcctatgaattgcgggacgaaggtggtgaaaattgaaaaaatgggagaaatttttttggccatttgtcaggccaagcggtggatgccatctcagcgccaccaattcagtctccaactttgaaaatttctatgaattttccaacctatagagagctattgtcttgaaaattttgaaatttttgtgaattttggaagaaaaagtctaagttcagatggcactactcactctatgggcttaaaaataaatattaatatttttaaaatttaattaggtttatttttccgaaattaaaaaaaattgaccttttcagtaaaaaatccgatgcttataatttagtgggcccaatttggcattcattttggccatttcgaatgccgaaccctaattcgaacaaaaattccgaaattctacgaatttcggaattttgttccaatctatttttgatgctttattagtaatagtttgcaatattttgcttaatttatttatacttgatttaatcaattttttagaacataaatgcgaaattcggaatgtttgatcgaatccggattttagggtttggaattggtcgaacaaaaaaaaaataaactaaaataaatgcgctggatccaagaaagggtcaaatttcgatttttaattcgtgacggggggggggggaatgcagtttatcaggatggaattggacaaaatttcgtcgtcgaaattaaaaaaaatttaaaacttagaaattttcaaggaaaaaaacctttgataattttttaaagaaaattcaagaaaaaaaaatcttagaactttttttataacaaaatttcaggaagaaaaaatcgtagaaaacaagaaaaaccgtcgaatttttttataaaatttcaaacaaaattttgaacaaattttcatgttttgtgcaaaaattttggaaaaattagtaattcatcataaaatttcaaaatattcgaattttcaatttttcttttgactttttttttaaaatttatttaagattgttttcttgaaaaatttctaacttttaaattaaaaaaaatttggcggcaaaattttggggtacaaccatcagcaggagggtctctacatcattgatcaatgctaattttacttgatcatctatcttttcagatgatctggagtctgaactggctgcgctcgatgccggcgtggaaagcacaacctcagcagtcggtggcggcgagacggcaatggcactgaccacacaaacgccaaacggaccgtaccgcgaggaggacttgcgcgcgtttctgcgttggcccgagtccgaggagtggaaggcgtacatccgactggacaacgacacgtaagcttttctaataatgcttttcgagagttctgtataaagcaagtcttggattcgagtaatctcggaaattctcactcttaacggcattcgactgatcaagggatctaatcctgatcaatcgattctcgtttcttttcaaccaatctgggagaaagtaaaaatttatttacaaaaatttcatctatcccgagggccaaaaatcctaaatttttttgattgattaaattttgagaatgattcaaaaactttttgaatttttcagtaaaacaaagttgtgtttcgcgcttcgtattttcgtgtttttagggcgtttcgtttttttgtattttgcattttattttcgttttgcaacaaccctgctaatctgctaatcacgcttctttatattccttctgatttctgatcatttaatctaaccaaatcctttggtctagcatatctgagaatcttatctctgatccgatcacttcaattattgtttaattttgttatctgaaatgcttggacttagtctgatcgtctgctgattttataatgaccatgtcacctgaaagaaaattattcaatcatttaagcattcctatacgatactcagtctgatcctggatcatttaaaaactgatcagatcattttaaaactgatcagatcatttaaaaactgatcaatgtgctcattttttgcttcaggggacgccttgagcgcttcttcttcaccactggctaccatggtgatcagctcaaaatatggaccgaacgtggccacatgctgaaccaatggcgtgccattgtggacaaatatgccaagtgagggcccttaaaagtgatcggaaacactgatcatcgtgccaatggcattttggcagatcggaaaatttcaatgcatcagtttactatgacgactcaatcttcttggatctgatcgacaacatgccaaccgacacactgcaatcagtcattggcacattggtaagtg

SEQ ID NO: 47422 - DNA, 2307 bp, Heterodera glycines; identical to SEQ ID NO: 2796
  misc_feature (2281)..(2281): n is a, c, g, or t
  Genomic contig location: Contig_ID=SeqID_2796; Location=1..2307; Strand=+
  SCN-specific regions: Sequence locations=1-550,572-835,859-1270,1292 -2307
  Gene Ontology: Mol. function=metabotropic glutamate, GABA-B-like receptor activity; Cellular component=integral to plasma membrane; Biological process=synaptic transmission

SEQ ID NO: 47423 - DNA, 739 bp, Heterodera glycines
  Genomic contig location: Contig_ID=SeqID_17194; Location=390..1128; Strand=+
  SCN-specific regions: Sequence locations=1-215,237-284,306-366,388-739
atgactcacaccattctgctgattcagtcgagttccaaagtcgactcgcggacatggcaagactttatgattttgttaagctgctcaaattcactaatccttttgaggagtgattacgaaactctgaccgattttatggaggcggtatgcaaaatttacgaggaacatctgaagaagctgaaccccgacgtcccctgcatacagtgagcgaatcgtgacataaataaccgtaggaaaatggcattacttttggccaatttccaatcccaaacccgagcaaagtcgagaattcaaattttaaaattatgttcgaaccctgagttcagattcatgatcatctatttttacactagaaagtacaaaaagaaaaattttaaaatttattttccttgggacaccaattctccagtattaccttattttcatttcactaattgtttttttaggtacgacatatccgcactgttcaagttcatcgaccgattggctgatttgagctgcatggtgttggacaaaagtgtatatgtgccaaaggtaacaaaacaatgccaaattctgattatatactgcttttgtaacggaattttgaccaatattcagggcgaggatttcatcaaagagcagattttcattttgctccgtggccaagcggcgtcgaacgcggcgaagaagtgcccggctgaaggatcgctctgatttttgatcgcattccttttatttgtaattaactttcatacaa

SEQ ID NO: 47424 - DNA, 1526 bp, Heterodera glycines
  Genomic contig location: Contig_ID=SeqID_17213; Location=662..2187; Strand=+
  SCN-specific regions: Sequence locations=1-7,29-166,219-431,453 -537,589-614,645-675,714-1243,1265-1270,1301-1331,1356-1526
atgagtttgctgtactttcgtgtttcacgtgacatcgactttctgaagatggtttacaaggatgtgattgatagtgatttgtccattcgaaactatttgaaaatctgtgaagatgtgcacaatgaaggcatcaagcagccgatttccatttatcttcaacgatcggtaaaaatgattaaaattaataattaaattcaaatttttaaaacatttaaattcgctttttaggattatatggtccatgtcagcgaaagtgatgatggtgagaaaaaatatgagcttaaacaggtaaaaaaaaaacccaatgtattaaaaaagctttaaaacgttaaaacatattagtttattatctaaaaatttactaaggtttttaaaaacgaaaaaattttttgaaaatttttgatttttaatgatattaaactactaattaatatctataaagtgagggaattgcatcaatttatttgggacctttttgcacttacttcccaatttgatttgctaatgttgagtgagcggattggatttattaaacccaatttttgccaattttggaaagtcaattacatttcataatcctttggatgttatacatacaaatcaaaaataaacttctttttaataaaaataacatttctttttaaatatagattccataaaagtggcatttttctgaatttatttattttcgtattttttaattttttttattagattgaagtgaatggcggctctattggtggtgcaaatggcatcccgccacgcatcaccaaaatccatgaacgaatgttggaaaaagcgggcttcccaaatttcccagaggatgtgctgccgagaagcaccaaggcagagagtgcatcagcgcaaatgcttttaactgcttggtatgagtgtgttcactgctaatgaaaaaaaactcatctccaaatagctatgggagaaagattggccaattagtggtggtctaattaggacataatttcattaatatgccagttagtggtggtttaattagcacaaaaattaattatgccaattaatggtagtttatgacgacaaaaggtcattaggacaattagtggtctttaattaggacaaaaattaattaaagccaattaatgatagttttcttagtggaacaattaattaaaatgctcgtcaaggaattagttaggcttagaaatttatgatttagactattaaattcacaaaataacgccaatttaatcaaattaccgtcagattaacaaatttattggaatgttttttcataaaataaaaaatattttttacttttaaactgaaaatttttcatctggcactgcctaaattattttaatttctttcattttaaaaattacaggaaaaagtttaaaaatccaaaagcaattattgtttcactcgttgtaaaagaaaaaagtaaatggcacttctgcaagcgttttgacgagtatgaaattgaccgaattactaacaagaaagtgaaagtctattacttgtcaatggaagaagctgttaaaatgtaa

SEQ ID NO: 47425 - DNA, 1067 bp, Heterodera glycines
  Genomic contig location: Contig_ID=SeqID_17219; Location=622..1688; Strand=-
  SCN-specific regions: Sequence locations=1-75,150-345,388-550,572 -577,602-899,923-1031,1058-1067
tatttgatttattttcggctacattctatggctgctcgagagttgtaattccgagattcgggaaccgagatagggaattaaaatattaaaaaaatttccgtttaattattttttaaagttttttttttagtaaaaaatctaaaaaaatagatttttcaaatcatttcactttttaaaatgtttcttggaaaatttaaaacaattgtcaagttctgcttccttttttttgtccattccagcctccgtttatccaaatcctttgaatgaaatgccccgtggccatttctcacacgattcaccatcaaacaatgttgagtacttcgaaatggacgtggtatggggccctattttaattttttatttaataaattttttaaatttttatatccagaatacattgaaccgttgttttgatgacattgaacgctttgtggccagggttcagtcggtggcattggcacagagggaactcgaaatgcaaaaaaatgacggcaaacagcggaagagcaagaagggtgcattttataattatagttttattgctgtggccaattttatttgtttaaattttttgcggatttttttttattttttaaattttccatagttttctaaattatatttcaattttttcttttagctaaagaagcagcaaaagcggctcagaatggcattttgcatttgcgctcacaaatgccgacccaggacgaatttgtggacatttttcaaaaattcaaactctgcttcaaccttttggtgccgccctattttcttgcatttttaaaaagaatttttcttttttttttgtcaggcaaaactcaaaaatcacattcacgagccgtccagcccagagtgggattcatttccttaattattctctaattaaaaaaaattaccgcataaaacaaaatttttaatttggataggattaactgataagttgtcatccatcttctttagactcatccatttcctcttcacccctttgactgttctgttggacgcttgtcattgggggttgggccaacaggtaattaattaattaattaacttattattattaattg

SEQ ID NO: 47426 - DNA, 4056 bp, Heterodera glycines
  Genomic contig location: Contig_ID=SeqID_2807; Location=1687..5742; Strand=+
  SCN-specific regions: Sequence locations=1-24,46-110,133-167,233 -849,871-886,923-1470,1492-2448,2472-2491,2514-2712,2739-2949,2971 -3027,3049-3231,3274-3458,3480-3888,3965-4056
  Gene Ontology: Mol. function=AMP deaminase activity; Biological process=purine nucleotide metabolism
atttgttttgttttcgttttttccaatttcaaattgcccaaatgacgagaagaaaagaagcggcacacaatacaatacaaaatagttaattatccattaattcgatcgggttacatttttgttttattttacgggattgtttcacttttcatttcttatttccaaacaatttttcttaatttgtaaattctttattatttatattaatttttcacttttaattattataattggctaaagcattgtgaatgaattgcttcgtatttgcctggggttttctatttgaaatttgccaatgcttttaattgctctcatttgaggtcattagataatcggttcaaaggttttaatggaagaaaattcaaaaaatgaaacccaaaagaaaagtggcggcacatttaaacaacagccgcaacaaaacatacaacagcaaaggcccaccgaggcaatgcttcgcgtgtcatttttggaacaggcggcgacactgttggccaacaacgaggaggacgaggggccaagcagttcaagcggaagaagttgtagcacaaccggcggacaaacggaggtgccaaacactgccggacatggcacgtcgaacttgctgagtcggctgttgttgcgggagttgcgcgagtgcgcattcgttgaccaattgcgaatgcacagggactttaaacgcagcaattgcaaaaggcacagtcaaaagcatcgcagtttaataactgtgctcttttccggggtcaatgaactgatcaaattgttcaaggcagtgaaaaccgagtgaaagaggacggctgatgttatttctgttcttttcaattgaaatttaaattgttttgcaagtgcaaattgtggttaaatttttaggatccgatattatttggcacctttttcaaatttaaaatttgtctaattctttaaataaaacctaccttttttcttagtattttagttttcgcatcgaccgatcattgggacaaaatttgcttttttcattaggcaaagaccaaatgccggtggtgaatgtgtactcgacttcggtgaccagcgacaacatttcgcgcaacgatcttttgtcatgggtcaacgactgtctccaagtgagaaacattgacatttgaaatgcgacggcaaattcgaattgagaggcctccgtttgccatttcagtccagcctgaccaaaatcgaagagatggccacgggcgcggcctattgccaactgacggactttctcttcccgacccaagtgccgctcaaaaaagtgaaatggaacagccgatcggacgtcgattgggtgcacaattggcgcgtgttgcagcaatcgtggaaaaccatcggaaatagttttagcgattttgaggatatataacatgcgtcggttcgacttcattccatgatttttagacttagctcgttaagagctttcgaatgacaccaaatttgttcaaaatttttaaaaaaatggattttgactgattttaagctaattttcgtgatttaaaccggttcaaaaaacggtttaattttccaaaatggatgtcatatcgatcttcagcgacctcgaaaacccctaaaaatgtattttctttgtaatttatcacaaaaccgaaaagtaccgacaatacgttttatatatttataggtttgcaattcaatttgtatacattttttgtttgtaatcttgactcaaacttgtaaattttttctggcaatttttagatttttttatcattgatggagcaagaaataagtgaaatttctcaacagaaaacggcgaagaagacagaaacagtggcacaaaatgcattggagctagcctctccgcgacacttcgaaatgcacactttccgtgatgcaatcgacgtcaattatcaacggatggtactgaaggattttcgaaaaaaaattgccattgatcggaaaataagcattttttgtgttcctcccttttcagtgtctgaacggcgaagaactgtccggagtgccgttggacgacttgcgttgcgcttgcgcagtgagtacatggagcgcatcgggtcgcacttccccaaaaccacgtgcaattttctcaacggtgaatctagaagctaattaaaaaaacattttgggaaaatttatttcgttttagggaaatatcctggcggattgcatgcggagaggcgaaagggcggcgcgcagccatgtaagtgcttggattaggatataatcttttgaagtaattatacttatgaaccaatcctgaagggaaggtcgccttgatttttttatccgtccctgactcgtaattggtcaattattgtatctatttgacttttttagttactctttcaacagccacaatgtcaccaccatcggcttcctcggaccattggggacagtgttccgcaccgcgacttttacaacattcgcaaggtggacggacacgcacatccacggtgagtgatggtcatttcaataaaaaataaattcaattaacaatttgagaccctcacaaaaatacaaaacttcaatttgactatttattgaattactttgcttattcttttctttttttctgctaaattcattaattttttcgcttttagccgcagcggcgatgactgaccagtgcgtttttggctttatttacttagtttcaattctctcttatttcctttcatcaaaaagaaaatgcgcaccgatgctgatgaagttgtgcaggagaaggtacacaaataaataaataaaattattttaaagaattgtgccaataaattttattataacggtcatcatggcccagctgttcgacaaacttgacgtcggcccgcacgacctgtccgtggataggctcgaagtcagagcggatgacacgtaaacggcaaaattttgttgtctattttacaatttcaattttcagattccaccgcttcgacttggcacggtgggccattggacacgatgtgagtgaataaatttcaaaaaatttgataagtgctaatttgtgattgatcgaaatgagatttctgatcaattggtcattcatttaatttgtttttcccaggtttggtccccaaatgcccgttggataatccaagtgccgcgtctcttcgacatttaccgtgccaatgtgagcaaataccgtagcacttctctgatcacattcacatttttccattttcagaaaattttgaaaacttttgacgactttctcgacaacctcttcactccgctgtttgaggtattttctccaaaaagtaaatttttaaaaaactggcattttcaggtcaccaatgaccccaacactcaccctgaacttcaccgattcctcaaagtgatcgaaatgcaaaaataccataaaacactcaaatttcagcatgtttccgggattgattcagtcgacgacgagtccaagccggaaaatgtggcatttacgaaggattcaccggagccggcggattacgacaacgaccaggtaaaaaggatcaaaataatcaattcgcgttcaaaataaatcatatttcagaatccgtcctactcctattacttgtactacatgtaagccaattattttgttgattttgtctccgatctttaatcattttttctctaccctccaaaggtatgccaatttgacggcactgaacgccttccgacggatgcgcggactgaacaccttcgcgctgagaccgcactgtggcgaggcgggcgctgtcagccacctgagcgtgtcgtaaggagtccttggggatttggtgtccccaaaaagtgaatcccactttcattttgcagctacttgacctcggaaagcattgcgcatggccttttgttgcgcaaagtgcccgtgctgcagtacctcttttatttggcacagattggaattgtcagtggccatttacttattgattgtctttctatgcctctctcaaatactatttcactcctttctttctctgtcctctctcctttctttcgctctctctctaccattaacgtcattatctcttctaattaaactccccgccctaggcaatgtcgccagtgtccaacgattgtttattcataaaaaataaaaaa

SEQ ID NO: 47427 - DNA, 1714 bp, Heterodera glycines
  Genomic contig location: Contig_ID=SeqID_17253; Location=283..1996; Strand=-
  SCN-specific regions: Sequence locations=1-568,590-695,718-1171,1193 -1253,1293-1371,1394-1714
atatttgcttccgtattccctctttgttgtcctgtccattcattttccatgctgctcaacaatcggtctcaattgccgttgagtgtttacggcggtggcattggcagcggagtttcggcactttccgccggtgccaaagaccattccgccaccgcttcttccgcgtccgttcgtcggcccccggtcagccaatatcagagcacggagtgcgtgctgttcggcagcattttcaacgatcagaaagaccaactgatccaacggctgaagggtctgtgcgacccggacggaccgacgcccttttttgagcacaacatggtgttcaagctgagttcagtttaagccaattcggaatttgtatatgtggtttaggtggaccaaattttgaaaaagagaggggtccgttttggtatttaaaaaattgaaaattattttttgcagacctaattgttttttttcaaaaaattgggccacctaaaccgtacaactaaaaaatttaatttttgtccggttgaaatcatgcattacaatattgatgtctttctgttcgttttcatgtatttagtaaatatttcgacccaaaaattcggatttcacaaatttgagttttcgattttttttttttttttttacgaattttggtccgggtgatgaattcgctggaatgtatgacttttttttttagtcagcgatcctttaaagttccagcaaaatgtttaacaacccgtaattttgcacgcgtttattttcctaattataaatgattttccgatttgttgcccaattctcattgctctaaaacaatttcagagacgggcattgagtcgcctgtccaagtgcaaatgcgccgtcgtttcaaagtggacactgtgcattggcactgccgttacgtgtcccaacccgaggcacacattaaggcgggtgatgagccgggcggggtcgtccaaaacgttgccggaaaaagtgccaaataaaatttttacaaaaaaatggcaaaaaaaaacccatgggatattgaaaatgccgcccagaggcttcatgcattgtcgaaaaacgataaaattggcaaaaacagttagaattattcacttaaagagttcgtactttaaaatataagaatttatcccttgaaaaattttttttttacaaaattggcaatttttcttaacgcaaaaattgttaaatggaatttgtaaaaattttatccaaatttccaaattcattgaaaaattcttcgctatttcatcagtctgtaaaaggatttttgatttttccccccaaatttttacaaaaattgcctcaatttttttgacgaatgcaaaaattccgtttcccctcccgttccatgaccaacgcatgttaaaaattagccacttttttgtgtaaaatttttataatttgcatttaaacgcaatttttggttgcgatattgccttttcctccccctaaacgcatcgtttacccctcagaaaattttgcccattttcaaaaattgccgatttttgccccttttcaggacgtggtcgtgcgcaaggtcatcgactcgttgattcattccaccgacatgatgagctttgtcaaatcgttggggctgaggtgaggtcgaaatcgaacattttgtccccggcaaataaattgtgaattccgtccccctcatttcaggatggaatacgaatacattgccaacggtttcctgttcaccaagggtgacatccgc

SEQ ID NO: 47428 - DNA, 3911 bp, Heterodera glycines
  Genomic contig location: Contig_ID=SeqID_2808; Location=935..4845; Strand=-
  SCN-specific regions: Sequence locations=1-713,736-894,960-1189,1211 -1666,1692-1866,1888-2591,2617-2671,2693-2712,2736-2864,2886 -3273,3296-3528,3553-3602,3782-3911
  Gene Ontology: Mol. function=acetylcholine receptor activity; Cellular component=nicotinic acetylcholine-gated receptor-channel complex; Biological process=synaptic transmission
gcctttctttggacattgttcgactgcgagttttttccaattttggccagccacgatgaacggcgattgtaagtcgaaattcgaagtgggagaggggggagggggacgaatggaagaatgaatggccatggcattaattggacttggactaccattatatggcaccaaaggtacgaggatttgttgcgcgactacaacaatttggagcgaccggtggagtaccacgcgaagccggtgattgtccatctgaaagtgtccctccaacaactgatcgatgtggacgagaagaaccaagtgagtgggtggtgggcatggcgagagagggacaaatcgatcgatcaataatcatacccattaatatcaaaatgattcatattgatttatcggtcattggatgacagacgaattaatcaatggcagaatgttagagccgtttagaaaatattattgatgatttgtgaccatttgaagttggctcctcccaattcagattgttcacatcagtgcttggcttgactacgtattttaatttgctcatttgcgcctctttcattgtgcctttttcagttatggaatgactataaattacggtgggattcgtcagagtacggtaacataaggtcggttgtcccattctccgcgggttctccaatctttcgcgttttttcttgtagcaatgtccgatttcccgttggcaaaatttggaggcccgatgttctgttgtacaattctgtggacgccagtttcgactcgactttccccacaaatatgatcgtgtacaatgatggaaatgtgtcttgggttcccccgggcatctttaaaatcagctgcaaaatcgacatcacttggttcgtttgtcggctggccatggacggtgtttccttccaattgggcctcactttctctctctctccctctatgtcccatttcagtctctctctcctactctttctctctcttccccgcactctcttttctcctcttaggttcccttttgatgagcagcgttgcttcttcaaattcggctcttggacatattcaggttcgtccgccgtccattctccaatccatccttggttaactttcctttttttgccaggcttttacgtcgatttgcaacctgcggaaggcggcttcgacaccagcgaatatttgccaaacggagaatgggctttgccaagtcaatttgattttgttaaaatgccatacttttccggaaattacagtgactacggtagccagaactgagaaattttacgattgttgtcctaacgagccttaccccgacttgactttctttttacacatgcgaaggtgaccaatgccaaagtcgaccatttaagcccattcgttgacatttcagacggactctttactacggctttaacttgataatgccgtgccttctcaccacgacaatgtcccttctcggcttcaccttaccacctgaagcgggggagaaaataacacttcgtaagtgcgaaaatgaatgggggaagaaggcgtcccatgacagccccacttctcgggaaatgcctccggctaaacccttggcgggtggccaaactgaggagtgatcaaagggaaagagtaattggcaaattatggctaaattggtgttggctactcaaaagaatgacagtatttaagagatcaccgtcctgttgtccatttgcttctttctctccattctttccgaaatgtctccgccgacttccgaggcggtgcccctcctcggccttttcttctcgagttgcatgctcatcgtcacagcatccaccgttttcactgtttatgtgctgaatttgcactatcggacgcccgaaacacacgaaatgggaacaaaggtgggagaaatgaattgggaacaaagaaaggtaaattttggaactggcacgggggagggaatggcactttgaaatgaaaattgggaaatgaacggacggccgatttctctgtttgtcaggcccgcgccctgctgctgtattggctcccgtgggtgcttcggatggaacggcccggggtggtgctttgctgggtaacttcggtcaaacgcatttcgctcctaatcgcctaattaaggaaacgcttccgtcgctttttccctgctcaaagcaaaccattttattgcctattaatgctgactgaaatcatttagggttttgcagtccaaaaagcatagcgaatcgctgatgcgaaatgtcaaagattgcgaaagcggcgctcggtcggttcaatttccgaatgattcgctcctttgtccctcattgaagcaaattaagcacatccatcgaaattgaccaccgagtacagcagctgctgttcggcaatggccgagcattgagcttccgacgaggcgcctccaaatcgatggctgccggagggactgagtcggcggcactgtccgactcggccgggccggcaaaaaaaaaaccccccccccgtcgtttccccccccaaaattttttttcaaacctagaaattttttcataaaaaaattcttagaaaatttcttagtaagaaaatttcaagaaaaaaattctttgaaaaatttttcagcgattttttttatgaaaaaatttctaggtttgaaaaaaatttaaaaaaaaaatttttcgggaggggaaacgacgggggggggggggaacgacctgctcccgggcgtgaaacatagtgcacctgctgctggaccgtttaacccaaaatgtgctgttttttatattaaatttatttttgttcgttattattgcctgaggcgccctctcggggcaataactaacatctgttaattggctaattaattttgcctgcctcctcctattaacgcgcgtcccccccccccccctcccccagggcacttcgccaaaaaatgttggtttaaaccatcacacacacccataattgcctcattagacaagtaagcaatttgtaatgataattcacattttcgtcacctcaatcaaccaattagtcggttcattgtcaacagcaggtggcatttcgccaaaaattgtttttcccccaatcgcacgcattctgtcccttctcgagggcattttgccaagaaaatctttttttaacaattttacaatcgcattgggcaattaattggtaaatattttcgctctgtttataagttcccctcgtaggtattatttcaccattaattaactgataatatgtttttttcctttattagcctacaaattcaaaaatttcatttaattgcaaaagaaattatgtatggctcaaaaacccccaaaattggacacgttttttaaaatcatttccccacaaattgaaaatatttaatttacttgagttagaagaacagtaattaatttagaaaagtgtcacattttgggggggggcaactttttggcatcaaattattcagtgcattttggcacggacacatcagtcccggggcaccaaaaaagttaaaaaaccccaccacagtttttcgacaaaaaatgaattctgtttgtataatagggttgccaaaaccggtggccatttcggcatcgtccaccactcacatcaacaacaacagttccagtaactgtaccaccactacggtaacggaactgcggcgacgactgaacaacggcagccgaagcggcgccggtggcaccggcgacgagcggagcaacaacaacagtcggaaaaacagtaacttcagcggcggcataaacatcaagcaggagcaactgttggtggacggcaccggcacaattcacagcagtagcagcagccatctccagcagcaggccatcagcagggttggtctgcaggatcgcaattttgaatggaaaagccgggatttgccggcttttggggttcggtgccgggtttttgaaaaacttgatggccttttgtggggtttggttcagcaaatcacaaaagggacc

SEQ ID NO: 47429 - DNA, 903 bp, Heterodera glycines
  Genomic contig location: Contig_ID=SeqID_17274; Location=179..1081; Strand=-
  SCN-specific regions: Sequence locations=1-287,310-388,410-504,526 -839,862-903
  Gene Ontology: Mol. function=protein phosphatase type 2A activity; Cellular component=shmoo tip; Biological process=cell organization and biogenesis
atgactacgacagcgcctattgcgacagaagagggtgaggacagtttgtaccctatcgctgtgcttattgatgagcttcgtaacgaagatgttcaggttcgttcttttgatatgaatgttcgctgtaaccattcaggaattgtaattgatcaattttaagcttcgtctcaactcaatccgtaaattgtcgacgattgctttggcattgggcgttgaacgaacgcgcaaagaattgattcaattccttacaggttattttaatactaataatccgattacctaattacataaaaatatattgcataaataaattttctacatttattacaaattcagacaccatttatgacgaggatgaagttctattggcattggccgaacaattggggaatttcactccgttggttggcggacctgagtatgtgcactgtttgctgccgccacttgaaaatttggcgaacattgaggagactgtcgtgcgtgacaaagcggtggaatcgttgcaaaaaatagcagaaaaacacagtgcagctcaactcgaggaatatttcattccgatggttctgcgattgtcagctggtcagtaatttgcattttgttcacatttgtcttaattagttcctccactgactgcgtttgtttctccgttcaggtgattggtttacttcgcgcacctccgcttgcggattgttcagcgtggcatacgctcgtgccaatcctgctcaaaaaactgaattacgtgccgcattccggtgcctctgtcgcgacgatacaccgatggttcgccgtgctgccgcatccaaattgggcgactttgccaaagtgcaggaggaggactatttgaaaaatgaaatcacccaaatgtttgaggacttggccaaggacgaacaagtgaagaattga

SEQ ID NO: 47430 - DNA, 786 bp, Heterodera glycines
  Genomic contig location: Contig_ID=SeqID_17274; Location=2479..3264; Strand=+
  SCN-specific regions: Sequence locations=1-234,256-664,687-737,761-786
  Gene Ontology: Biological process=locomotory behavior
gtcacattttatggcgttaaataattgttttactgagaatagatatccaaatgaatgcattctttcctatggctcgatcgctgtttcggatccggtatgttctggcatttactatgctcaatctcaccctccgactaagcgattgaggattttgcttggataacaatcccccggttcatttccggtttgactttttcattcggctttagctcgatgcgttcgtttgttgtcgtttttccatccatgaacaccaggagaacatctgcgcatttggcacagaatatggcagagtagtgatttgcgatgtgacagctccgattaagggcgaggattttatcaaacatcgtgagttacttctattagtctacgacggttgaaagaaattcatcaaaattcgaaaaatttggatgcttgtaaaaagttatgattaaagttcgtgtaaactacaatataatagataaacttttgctttttttcgcacaggatttgccactggaaaaaatgctgtgttcgacttatgtttcattcctgatcgccctaatttattactttctctttgtggtgcctcaaacctagagcttttggacatcgaacggtcgtcgtccatttttttgcttggtcatcgtgacacggtccgatgtgcttccgtgtggcctgaaaatccctgtattctttgtttgttttttcctgtccaacctcttcaaatttcagtttgcgttttgactggttcaagggacggtgacattttgctttgggatttgcgtgaaaaaccatgaaaagagaaat

SEQ ID NO: 47431 - DNA, 1577 bp, Heterodera glycines
  Genomic contig location: Contig_ID=SeqID_17292; Location=209..1785; Strand=-
  SCN-specific regions: Sequence locations=1-123,155-290,312-326,370 -415,438-587,618-629,651-694,717-964,1000-1191,1213-1284,1306-1577
agcacaacaatcgttggctctgtgttcgctcgcccggttatcgatgccggcttttgctggttgctttaaaatctataaaaaaattttcctaaaaaattttctggaggaccgagaaacgatgaggagagagagagagagagagaaaagagagagattccaatccgtttggttttgccttcaagtcccaacttccatccttcatttttcgggggatataactaactaaaaaacacgcggttcatcattcattcgttctttgcagctcgtctgtaccccaaacagaccaacaaggaacaacaacagcaggggggcggaccgtccaacggttttcatgacatcacatccattggaggcggtggtggtggtggctcggcattgttccacagtagcaatggcaccgctgctgctgggctcagttcgtcgtccggctcgtcgccaaccatcctgcagcaacaacaacatcgacagttttcttcggcaatttcgcagcaaaaatcgttgacaccgccgcctctgtcggtgggcagttcgaccttcaacccgacgcttgaacaactgttgcaggcaacgcagaacatgtgagtgatacaatttgaatttttcatttgaaattttgatgggagggaaggcaaaggtatagattattggtcccgaaaattaatacgtcaataaaagattatttaaaccattttgaagtaaaaatgtaaagtttgaaaaatttaaatttttgaactattattcgaatctgggtcaggggttcgaatttggtcgaaattgatgtcagaatcggatctccgaccctgaaaacccctaaacaactttgtttctagaaaaaaaataaaacttttcaaaaaaagggtgcggggtacattcgacagtattacgaaatgttcgaatccgggttcggggttcgagactgagacaaaataaggccggattcgtgctcggcgcctaagattacccctaaaaataattttcttaaattttattaaaaaaaaactttcgggaccaataatctataccaaacgatgctcaatttgaccagggctgtaaatttctggagcgagtgcaagcgttggcccattggtacatcgatgcggtcagtgttttcgctctttcattttcccattttccactcatccatttgttccctcttttcaggtctcttacactgacaatgatgaccatcgttatttcaattattttctgtttgccgtgcgtccatcttccgatggcgatggttcttccgtccatcggttcgccggttacgtcaatttgtaccgtttttaccaccatccggacaaggaacgagtgcgcatcgcacaaattctggttccaccaacttaccggcgcattgggttgggtccgcgactattgcgtgccgtttacaatgacttatgccgtgccgaacgcgtaactggtgagttaaaaatgaaggcacataatgtttaatattattcagctgaaagtccctcagacgcttttttgtttatgcgcgactacgtcgattgtgcaaactgtgcaaaactttccgattttgctccggaaaaattacgcaaagggttctcagatgaaat

SEQ ID NO: 47432 - DNA, 1060 bp, Heterodera glycines
  Genomic contig location: Contig_ID=SeqID_17300; Location=34..1093; Strand=-
  SCN-specific regions: Sequence locations=1-158,180-348,386-398,420 -744,766-779,801-1060
atggcgaacatcattagtggtaccaattttcaaaaaaggcgaaaaaactgatccattaaattacaggccggtttcattaatcagcactgtctgtagagttcttgaacgaattttaagtagcaaaattttagaatttctgaacggtataagattttttgataaagaacaatttgggttttttaaaaataggtcgactacaacccaaatattaaaaacaatggacgatatatataattctctacaaaaggatcaacaaattgacattatctatattgattttgtcaaggcgtttgattctgtaccaattgatttattacttcaaaaaatcaaaaagattggaattgaaggaaaaatttataaatttttaactaactttttaaaaaatcggagttttaaggttaaaatttcagaatctgataatgtacgtgacttgggaattataattgactcaaaacttaatttttcagaacatattagcaaaattgtacgaaatgcatatcttagaactttccaaattttgagagtgttaaaaagcaaggaaataaagactctaacagcagcctataaaacttttgtacgacctcaattagaatatgctacagaagtttggaaccctaacttaaaaaaagatatagataaaattgaacgcgttcaaaagtttttcacgagaaaagcatttagaaaatgtggatttgtgtacaaaaaatatggggaaagactaacaatcactgatttacacaaattagaagaaagaagaaaaatcaatgatttaacaacagcttttaaaattataaaagggttcaccagcctcgatgctgggaaaagtttctttttctcggaaaggcccaggaggcctttacttttacgggtaaagcgccacacggccaaaactcaaaataattttttcaatagaatagtaaaaagctggaataaccttccagtggtagcggtgcaaattaataaggcaaaggaattcaggggtttactaaaagcaatgagttctgagtaggattttccatgttgccatatttacactatatttttatcacctgtgaataaa

SEQ ID NO: 47433 - DNA, 1805 bp, Heterodera glycines
  Genomic contig location: Contig_ID=SeqID_17314; Location=1..1805; Strand=+
  SCN-specific regions: Sequence locations=1-119,147-162,187-437,528 -945,973-1760,1782-1805
  Gene Ontology: Biological process=reproduction
ggccaaaagtgcgcttggctccgtcgactgtcctttctgttggcagtggggaattcgcgtcactccgttgctcggcttcttctgcataatcactttgctgctttttgtcaaagaaccggtcaattaattaattaattaaatggaaaacaattcaaagaaagcaattaaaatattaattaattaaatcgcaggtgaggggacaatccgaacaaagtgtggcacaactgatgccaacaaattacgaaacgtattgaaaaaggaaaatttaaaaaagagaaaaaaaatttaaaaacagcggaacgatcagtccaagttcaaggcgaacagtggcatcagcagaagcagaagcaccgaatgagaacatttggaaggagtattaccatcggatacgcactcacactaaaagttattgcgcagacattggacatttaattgcaaagtaattgaacagccaattaatttattaacagccaattaatttattaacagccaattaattcattaacagccaattaatttattaattaggccattttatgcaaaataatgggacagtcaattattattacataaattaattggactaacatttgcttccttcgtgctttagccgtacattcgtgtggtcaactttggcctacaccgccgtggtttttgtcaccggaactttgtcatggtaataatttcctaatttcttttttatttcttcttttatttttggtggggtcccaccgccatggaacacgccaaagcgatggacgaacatttgaacgacacctcaaaattgagacctgccgaaaagaatcaaattgcgctaatttttggtgcaaattattccccttcaattttacggcgtataattaactcttaatttgtcaggagtgatcacttgcgttgccggaatttttggcgtttcgttgggcagtttaattgcgcaggtggcacggattgaaaaagcagaaaaatgccaaattaaattcagcattggaagacgggcaaattttgttttgcgcaccaccgctcggaaagggccgatccgatcgtttccgcggtcggttcgttcgtcgccgctccgttgatgttcgtcgcgttctctttgatcaccactgatcagcttctgtcatgggtgccttttatgttccattcactcatctagcaaaaaaaaagtcaaagaaaaaaatttaaaggaacagtaaataattaagagggacaattacggtatcaaagaggggcaactactgtatcttatatttcgaacgcaattaattaattattcatatcattcacctaatgtttctgttcaatttccattcagttcgtcgttttcctcaccattttgtgtctctgtttgaattgggccattaacgtggacatgctaatgtaagtaactagtcagctaattagtcaattaagactaactagttattacacccagtttaaatgcttgctttcccttttttcaggagtataatcgtccccgaaaggcgtagcattgccagcgccattcagattctcttttcccatttgttcggcgatgcctccggcccctatttggtcggtgccatctccgacttcgtccgcggctcttccgatttgccaaccgatcgtttccattcactgatcgtcgctttttatctgcccaatgctttgctttttctcagcggcgcggcatttctcggcgccgcttattcacttcccgcggatttgaaacgaatggaagcggaaaaagctgcggcagagagtgagcggcgggagaggagtaaaaattaaaggggcgggggagagaggtaatgagagaaaggatg

SEQ ID NO: 47434 - DNA, 501 bp, Heterodera glycines
  Genomic contig location: Contig_ID=SeqID_17321; Location=1581..2081; Strand=-
  SCN-specific regions: Sequence locations=1-50,78-501
  Gene Ontology: Mol. function=structural constituent of ribosome; Cellular component=cytosolic large ribosomal subunit (sensu Eukarya); Biological process=ribosomal large subunit assembly and maintenance
ttaaacggtagaagtaccaataaacgaactcttttctagtatttatgttaaacgtgttaaaatatttcaaatttttaggcccaatgaagttgaatgcgacaccgttgcgccgcatcgcacaggcttttgtcatagcgaccaaaacgaaattggacatttcgacggtgaatgttccggagcatttggacgacaaatactttaaacgacaaagtggaaaagtggcggacaaatcgaagggtggaatttttgcggagggagcgaacaaggttatttattcattgccgtaaattgaaatgacaaatctatgaaaccaatgttttccataaattcacccgatttaagcagtacgctgtgaccgaccagcgcaaggaggaccaaaaaactgttgacttgcaggttatggaagtggtccgcaaacatcccgagaagaaattgctgttcgcctacctgggttcacgttttcacctcgccaagggaatgtatcctcacaaaattactttc

SEQ ID NO: 47435 - DNA, 1146 bp, Heterodera glycines
  Genomic contig location: Contig_ID=SeqID_17339; Location=303..1448; Strand=+
  SCN-specific regions: Sequence locations=1-135,159-578,600-1058,1080 -1146
atggatccggcattactacgacaacgacaagagtttatgaaacaggccatcaagtcgatgggtgttgctcagcaaattaaaaatgacagaaatgaacaacagattccgacttcctccgctgcaagcagtgccatgccgaagaaaaagaagaaaaagcctgttcagacggcagctgctggccaatttggcacagaatttgccgccaatgcgaccactgctgaggacagtgcacagaatgcgacaaattttaggtgacttttttcttcatcaatcgtcagttaagtcgaatattatttcagcataatggcgaaaatcgttgactatatgaagaaaaggcacctaaactcgcagccgtgggcactttcgctgaaagaaatattggaggagatgcaggtgaatcgaagcaattaagaattgacaaaaaaagcatttccctatttgattaggtttacgatgtcaaccgaaagtcaatgctttggctccaagaggcactcccgcggaatccgcggctgcaatccgaggcggacgacaccaaatttgtctacaaaccgttgtacaaagtgaagaaccgagtcactcttttggcacttttgaagaagtttcacacggaaggaaagggcggaattttgttgtcagatctcaacgattgtgtgaacagcgcggaattgttggtaaaagcgttgggcaaccaagtgattgccatcccaactcaggttggaccggcagatcctttctccaaatttgctggtccttcaaaaccgttattttagataaacaaacggaaggacatcgtttatttttacaatgatacggaaactgatcgcgaaattgacgacgaatttgtgcaattgtggcgaacggctggcgttgagcatttggacgagaacaaaattgaggaatatttgcagaaacatgggcttgagacggccagggatttggcgccgcggaaaccgaacgcaaatttgggaccgaagcggaaacagccgaggcaaagagtgccgcaacggttgcacaacgtccatttggagggagttttggaggactacaaaacggatgactgaatggacaatacaatgaaagtccgtttgttaaattgtgataattaaaattgtggatcgaattaaaagaaatcgtcatttatgtcca

SEQ ID NO: 47436 - DNA, 1026 bp, Heterodera glycines
  Genomic contig location: Contig_ID=SeqID_17339; Location=1563..2588; Strand=+
  SCN-specific regions: Sequence locations=1-209,231-245,268-774,796 -1026
  Gene Ontology: Mol. function=protein phosphatase inhibitor activity; Biological process=protein amino acid demethylation
atgaacgatttttcgccgctcaattgggatgaatttttcgaccgtaaagaatgtgtcaaaacaggcgatgacaagttcaacgtgtatgtgaagggttcaaatggtccgctgttctttctgttacacggtggtggctacacgggcctcacttgggctgtgctttcggttggttgggtttttattagatttgagctggaccgagagtccaagaaaaaataatttaattatttctcgagagaaataacaaaataaagttagttttttgggaaggaggtgacggtaccgaaaagcgccgctggaaatttttagaagttccgatcccgctcaattctatttttttatctcatcgaattgtttaacatttatggcacctgttaatttaaaaaaaagcataaatggccaaaacatatgttatcttaagaatgtagcagtgcaaaattggtacccacttctagtagtgatccataaatgaaaagaaaatgtattttaccgtgtcacaatgtccccaattttaggaacaactttcttccgtcatcgaatgtcgcattttggcaccggatttgagaaaccatggcgaaacggaggtgaaagatggggacgacatggcagcggagagtcaagtcaagtaaaaaaacgctttctttccgtttgcctctcgtgcctttgactgtccgttcttttcttttatagtgacctttgcaatatctatcagcatttttatggacatgacagtagtaagtatccgccgaccattctcatcgggcacaggcaagtgaagcgggagggggcgagggattcgactatggccgtactcaaaatgccacaaaatgaatttaaccccgctctgtttagcatgggtggggccatcgcaattcgagcagctgccagcggaagattgcccaacgttttggtagtcagtgccatcgatgtcgtggagggttcggcaatgagttcgctgtgcttcatgcagcagttcttgcggagtcggccccaacactttccgtccatcgaacgttcggttgaatg

SEQ ID NO: 47437 - DNA, 1096 bp, Heterodera glycines
  Genomic contig location: Contig_ID=SeqID_17341; Location=1..1096; Strand=-
  SCN-specific regions: Sequence locations=1-846,868-1096
gccgtcgaattgcctccggtcgatgccaatccctcgtggaccggtgccacgatcatttgccaagtgagcaaggcactttccatttctcgcccaattagcatttcaggccgcggtcaatggggggacaaaagactctccgccgtcggttgtcgacgtgcaatatttgaggggagtgcacgtggtcgactccaacgggcagggccccgtccacattcccaaccagggcttccgattttatgtggaatgcgtgcgcgggacggacggacagtgtcagcaaagtgcggcccgacggaagacgctccactgcgcggtgcaggcgaaccccgcggcgaactctttccgctggctgaagaacggcggaccgatcagcggcggaaatgggcccgagtttatgatcggcacggacatgatcggacactcgctgcaggtcgaatatcgcaaatgccattccaaaattgccgctttctttgtcagtgtgccgccaataatggcctttacggtgaagagctccaatcgcccgccgtttacatcgattcgtacaccgccgcccggctaattcaggacaattttcaggcaatttgaggacaagcgttccaaagtgatgaattttttccagcaagtgcagagcagcgcgcccttccaacagggaaaccgcgtcgaaatgggccagcgagttcagatgagttgcgtcgtcgaaggtcggtccctacaccgctgatcactggtcccaaagctcgattgcccccccccccctccctcaggcaatcctcgtccggcggtgttttggaagttgcgaaggagcaatggccaagtggtcgacgcgccttgtccccaggcactattctcccctgcctttctctctctctgtactgttccaatttccagggtctgaacggtcagtaccgggaagtgcctccgacccaattgccgacgggcgcagccgccgtcgcaaattcattggcggcacaacagtctaattcgttgatccgtctgcaagccatttgcgacctgcaagtggccaactattccttctccggacagtattggtgttctgcctgttcctacgtgtcccagggactgcctgagtgttctccgg

SEQ ID NO: 47438 - DNA, 3437 bp, Heterodera glycines
  Genomic contig location: Contig_ID=SeqID_2829; Location=1387..4823; Strand=+
  SCN-specific regions: Sequence locations=1-246,269-614,666-905,929 -1384,1407-1457,1480-1691,1713-2025,2047-2193,2215-2787,2809 -2878,2901-3147,3170-3266,3291-3437
  Gene Ontology: Mol. function=RNA binding; Cellular component=nucleus; Biological process=RNA processing
ttctggtgaaattatgtcccggcgaaattcgattgcgaggggtgcaccctaattaaacgtacatctccaggccgagcgggcgcaacgcttgaagattccaactgcctaatctgtttacgcaattccaatcggtaaggcgtcatagtcatgtcggccccttcgatgtatcggtcgatctcttgcaaatccgtttttgacaacagctaaaagaattatcaattgggaatcagtttctgcaaattaccatctgatctctgataatggcaaatggtctgaagtattgccaaacccgctccaatttgtctttgtcaacacgttttacggcctaaaaagaaagttaaatgaatacggagaagaatgaaacaccggatgattttgaatataatcactttgctgctcgaaaaacgactggtcgtgaggacttttgtttgagaggagctccattcgtgcacgaagaatctaaaaagacaatgaaaatgtagtaaaataaggcaaggccacaaaataacaccaattgtaaagcaatgccttaacgaattcaaaccaattttaaaagcattaataagaattaatttttggctatgaaccaaaaacctgattttgcaatatcagtgaaaaaggaagaaaatggtaaatgaaaggaaacacctcaatcgcctctctgaacatcactttattgttcttcatcttttccaaaggaagttcaaaaaatccgtattcgtgttcactgaaattctgctgaccatattgctcctttctgataccttgtctaaaaatttaatgcttacaattaggaaaggtttatacatttgttggattttaccagttcataatatttaacatttttgaattttgtatattctaacaataagggaatatgtgtccggtggcgtagcaagaaaaagtttatgtaaattattaattttaacaaaaattccaattaaagattggattgaatcaaattaagtacaattcgaaaaaaggttgaaaactggcttaactcttagttgtcattaatatgcacccaattttatgcttacctatttgctgttatcggaggatcggaagaattaatagtgattttgttaattctgtcaataaacgaattttcttttgagtttagcacctaaagcatgaatttagatcagtagataaaaaacattctgttaaacttctttgattttgttgtccttgtcaatgtctcgctgaagcttcgctgtcgttgtgtgtttgggagccaatgcctttattttccctttttctattgcgtcaattcgtttgagtgcacttttttgatttaatttgatgacagtttctgaccttaatattgggcttagcatcctttggagaaaatttttgatcattttaaatgagaatatctctaaattataaataattatcataattccgaatcattgaagtttagtttttagaatttttttacggcttttttgaactgaaaatttaaaaataattaatcttttctttttttggcgctttgttcctttataaaaagctaacctcacttccaatttctatgtacgtctacagaaattgattcaaaagtcctcaaagattaccaattgcccttgttgtttcataaaatataaccaaattcgattttccggaacctccgttttgtcttgattaaaaaaacatttgtttgttaactaaaacacatgattcttcgttttaaatattcaagatatgagtcgtcaacagagggacagcagtagttcaaggtctagtgactcatggtcaaggaaatcaagatcgagatccagagcaagctcaccttctcgttctagcagttctccgcacgaccgtgattggaggtttagaagcaggagtggagaaaggaataaacggcgatgcagacacagccgacagtcaccacctcctagaaaaagggaacgaagccgaactccggtaaattaagaacaaaaatgcattaaccttaaaaattccaaccaaatagttctcacgccgacgttctcctaacgaaactaagccttcaaataaagttatcttgacctcgttgccaaattatgctgacaaagatgcggtttgaatctttctaattgtttttttaattctaaaatattaagttgaacattttgctggcaaagcagggatttcatcccatcgatattagagttgttaggcgtaacaccgacagcggctccgttcgaatttttggttttgttgaattttcggatgttgaaacagcggaggattggatacgtcataaccaagttacaaatggtcacaaaaaaaaattcatttcatgttaagggctttctcaaaatggacgatggttttcaagtacgcttggagtattcacgtgaagagttgaaccgagaaaggccgatttataatcccctaacatcggattggacatgttccaagtgcactatcaacaacttcaaccggcgcacaaattgttttaaatgcggtacatctagaaaggactcagaagcgcttgatgcgagaggatatgggatggtcggagtatcgccttgtgacagtaaataatttcggttcgggttattactagatttgcattccatgtttagcgctgcttatccgcgagctcccctcttcggttaccgaggaaagcattcgcacttcgctatctcagttttcggggctgacaattcaacgcattcaattggcttcctctcgtctctacgcttttgttcaaatgaaatctgctgagcaagcaagttatttgttacaaactttcaacaaagttgtaccgtacgttgacaattgtgcaggtgtttcttcattaatgattttgtaatttcactttttgttaagtaataattacttattcgcgtcagtctctcaatcaaattttgatcatggagaatgtcaatttgcttaaaacacaaagcggaattagcagcgcaaacattcaagaaggtgaagattcgctttgctcccgttttttgcatttctaaaaattagacccaacaaattctgcggctcaattggctcagaatgctattcgattggcacaaatgggaaaggccgtgccgggtgctgtccctccaattgctcatatggaagggccagctcgacagagcatttctacgccttttggctatttgcctacctatagtgggtgaaattttcttcgtcatcagttaaatattttatttatagcaacgcctgataccaatctgttccaatatgaaccttcttctggatatttatgggatgttaacacgtaacacattctgagggttgttcattaatgacttttctttttagaggattttattacgaccaaaaaacaggatattattatagttccaacacctccaatgtttgtgttacttttcgttcgcttttaaaaactcagtgaattaaaattagtggatgttttggtcgtcgaaattcagcacatatatcactgcgaaggaggtgat

SEQ ID NO: 47439 - DNA, 1302 bp, Heterodera glycines
  Genomic contig location: Contig_ID=SeqID_2830; Location=1604..2905; Strand=-
  SCN-specific regions: Sequence locations=1-915,940-1086,1108 -1119,1141-1302
  Gene Ontology: Mol. function=chaperone activity; Cellular component =extrinsic to membrane; Biological process=reproduction
atgtatttgaattttggcgatatcggacaaaacatcaaaggactgatgaatgaatatcaacggaaggctaaaacacaccaacagttggaatcaattgcggatatgaaaaagtttgtggaacagtaccctcaattcaagaagatatcgggtaagcaaacctgaccgactggttctctatggagagtgctccaaaacttcaggaacggtagctaaacacgttcagttggtgggtgaacttagccgaatggtcaccgatggaaatttgttggaaatatcggagttagagcaaaacattgcggtcgcaaatggggattattcggcttgtctggattcccttcgaagacttatccagcatcccaaaacaactgatttggtgcaatatttttaagttttaaatagtggattttgtcacagaatgccctccgattagcgatgcttttttctctccgtttcgaagggaacagcggcgctttgagcttcgttcatgagctgttgagaaagcgagggatggccaacaaacagctgcaattgatctcaacactgctcgaattcgcgggacagcgaagacggcaaaacgatttattcggggatagatccgcaatggaaatgaccaaacgattcataaaaggtcgaggacttattctattattatctgaaaagttgttggtgcttttaaaatacccttaaggttgatttatagtatcgtcgtctccctcatcttttttttaaatagcttttagtcgcacgtcctttagccgtttacaaaatttaggactgaaaggcgttgaaaatatctacacacagcacgagcctttcattctccaactcattgatttggcgtcgcgtggcaaactcccagaaagtgtttatccgtctacggatttggcaaatctgaagtgagttatatttgtccccttatttcctcctcttccttcagctcccgctttgaaaatgttattttgtttgtcattggtgggacaactttcgaagagagtgctgcggtggcaaatttaaacgccaagcggtcgaactcgccctcctcccaaccttcgctttaccaggggtcgttaccccctcgtgttatactttgttccacttttgttcacaacacgaaaagttttgtttcacaacttgcccattattcattcgcaacaacaaatccaattggaagcactttcagcacgggcgacttttctgcgatactttaatcttttgggtgtatgaaatcgctgttttgtttgaactgctatgatcgctaccgatctcattgtaagaatcgaaactttcatttattataataaa

SEQ ID NO: 47440 - DNA, 2133 bp, Heterodera glycines
  Genomic contig location: Contig_ID=SeqID_2833; Location=113..2245; Strand=+
  SCN-specific regions: Sequence locations=1-108,134-240,262-614,636 -794,817-877,899-1323,1347-1537,1560-1569,1591-1862,1888-2133
  Gene Ontology: Mol. function=RNA binding; Cellular component =nucleoplasm; Biological process=mRNA splicing
cccccgccacaaagccaggaagagcaagagctgcagcaagaccccgagaagaagaatgacgcgctttcggcagctttggccgctgctgcgatggtagcccaaaaattgggaaaaggtggactcatttctggcgctggtgctgccgtggtttcttctatagatttgcttaaccgagttccacaagcgactcaaaaggcaacgccattagcagaaacagttctggccaaagaaatcggtgaatttgtatattttggttattttaccacggttgataaacatgaaacagttaaaagagaaccatcggagcaaaatgatcaattaaccgaagaacaacggcagcgcgaactgcgccgtaagtctcgttggagcacaactaaatcttttgtgcccggaatgccgacaattttgccttcggatattgatgagaatcagcgtcaagtttatttgcgtaagcactacataaaaaaacttaattcaccttcctattacctaattgaccttttacgtatttttacttctaatttagtgcaaatggaaatcgaggaaaccactcgtagattgcgtcaaagcgattttggacaaaacgttgacccggctgaaaggtcgattactcaaaaatatgttgctttaataataattgtatgtaaaaaggcaaacggtttttgtcataaacagcttaaaacgttttagaatcaattcttaatggaaaggaattgctttttcagaatcggtactcgtgggtcgatgctacacctttaatataatcctcttgtttagctgtgccaatttgtcatcaaaaattaatttaaaaattcactatacgttttagcatttagtgcggtagcggggtgatgtggtggattcagacatcctccaacaattttaatgtaaattttgaaaccattgggccattaacattgagtcaaaataaggctaggcaaattcgaaatcgcaatcagtcaaatagatttctgaagtaagaattggacttttaggagtccttctccggaacccgtttatgacgcgaccgggaagcgactgaacacgcgcgaagtcagaaaacggcaggagattgagcaaagacgacatgagaagatccaagcattattgcgtctgaatccaaattacaaaccaccggctgattaccggtaaagcaacttttatatgtttatttttccaaaatatctttaattagtccgccaaatattaaattgcacgacaaagtttggattccccaagaggaacaccccgaaataaacttcgtcggtcttttgatcggtcctcgcggcaacactcttaaggccttagaagccgaggttttttttgttgttgttgttgttgttgttaaatacattgattctttcttcttaagacaggagcaaaaataatcattcgtggcaaagggtccataaaggagggaaagctcgccaacagaacgggtcctttgcctggcgaaaatgagccgctccatgcttatgtgacatcgactgacagagaggcgattaaacggggatgtgacaaggtgggcgaattggaatttttggatattttctttttaagatacgtgagataataaatgccgctttgatgattccggacgggcaaaatgaattgagaaagttacaactgcgtgagttggcactgctcaacggaacacttcgtccggaggacgttctcagtggggcacgttgtaccaattgcggctctgaccagcataagacgtgggaatgcatggaagcgccgaatgtgactgctaacgttatttgtacggcgtgtggcggggccgggcacattgccagggactgcaaaaatccgaggcccggcttcgatggggcggtgatggatgctgaggtatgtcagctttttctgtagttttcttaatttagccttacctataccgatttcagtattctgctttgatggctgaacttggcgaaaaacctcccatttctttggaagccggcactgcaccaccgttagtcggtgggaagccgatccccgggttccccggcagtggattacgcccgcgtttcgcgctgcccgcgcccactcctattgtgcgcgttaatttggcgaagcaacaaaatacgcctcaacaacagtccgtctcgggtggcggttaccccgggtggg

SEQ ID NO: 47441 - DNA, 1297 bp, Heterodera glycines
  Genomic contig location: Contig_ID=SeqID_17393; Location=106..1402; Strand=+
  SCN-specific regions: Sequence locations=1-123,145-443,465-577,609 -847,883-1133,1155-1297
  Gene Ontology: Biological process=gametogenesis
cttggctccctggtgttcacattaccgcatttttttgccgaaccgtacacaacttcgtaccaaattgaaaatgctggactttcccgttgcatgaaaggtttgttttgggttttttttcttaccaaacttattttttattttaaggtgcgcaatcactgcggtgcgcggggccacggcaaatcacggccattggttttgacttgggcgcggtcggctgcaatttggccatcatcatttttgtgccgaatttcatgtgcggaaaatgtttgcacactgttgtgtttgggttgagcggctttgacgccaacgggtaccaagtaagttgttttattctcttttttaagaattcaaagtttgaaattttttaaagttttggcagcaaaattttgggtacatccgttttccgtctgtccaaatcagtaattgtttttttaaattcttacttttccaggtccatctctttcatatgcccaaattttgcggcttcctcaaaagtgcgctgcccgaacggaccaacgaaattgtgtggctgcagcacatgaaattcatcgtattcgacgacactgttctcataaggttctttttcccccattttttccccgattttaatgggtccgtatgtcataaatattgtccgaccgaccaaacccttttaaatttaaatagttaaaggttaaaaaaatttaagggtaagaaaaagaagaaagatttgacataatcattgattttgaaatttctggcaaaattctgactggaaattcgggaatagttcctccggtttcctaatattttgtttttggtttaaaaaaacgaatatagtaaatcttcctgatccattagactttcgaatatttgtttttttttatttcatttttttaaaatgttgccaccggttttttttctaaaatctctcacaattttccagtgccaatttgtccgaccaaaactttgtcaaccatcaagaatcgctatttgctgatcgagactgtccactgttgaccgacttcttcgtcgacctgttccgcctcgttgataatccttccggcggatgaacgcgtcgcgtcggaacagttttttggaaaaaactcagactcttggtaatttttttttaattttctattcaaaattggataacttttaaaggaattattccgccaaaaaaccaccgggctgtcgtccatttgtccctccccaccaaaaaactgggaatgtgttggcaccgaattttttttataaagctgtaaattatgcttaattggtataccatgggagcaaaaaaaaattttcaaaacgttta

SEQ ID NO: 47442 - DNA, 1004 bp, Heterodera glycines
  Genomic contig location: Contig_ID=SeqID_17409; Location=1489..2492; Strand=-
  SCN-specific regions: Sequence locations=1-521,544-604,627-640,663 -1004
  Gene Ontology: Mol. function=RNA binding; Cellular component =cytoplasm; Biological process=mRNA polyadenylation
atgcgatttggcacagccgcgaatgtgcgccgatgggtcattttattgtcatttgtgtcaggtggattatgattatgtttttcacatgaatcccttaaatttttttgtctttcagaatgaaaaagtggggtctttgaagaaaatgccatttgcctatctgccgttggttggcttggaattcgatggcattcaattcgatgttttattcgtttccattccgaccagtgattctcttccgaagaatgggccgttgagccgaaaagaagtgatggcattgatcagaaaattggcagggcaaaaggaagcggacgaaaaaatgatcaaatcattggcaggtaaagtgtttttatactttaccattttgtctttgtttttcatttccctgagaatttttttaagaataagcattggtgaataaatcttcaataaaaataacatggaaataatccattaattaattgatgataagacatatcaaaaaatttgttcattctgttttaattattcggctttaagcattcatttcaaatgagaaaataatggcgttattgggaagaaaaaacatgcaaaaattcagaaaatttcttacaattttaaagttttggtcaaaaggtaggtatattttttgaagattaaaccgattttaaataacacatttagctaattttatttatgaaccaaaactcggattttttaacggaatttcgttggcaacaatggccaccaaagtgatgttgctttatccgaatgcttcgattccctttttgttggacaaattctttcttactttcgcattatggtatctcaataatcgcttaaatgtactaattacctgccccccaagggattggccaattcctttacgtttggaagagtatgtgccggacgaactccaaaccttttcatggactccaaaagatgaggagcaaaaaaggaattcaccgctgttgatgccaatcataacgccaggcaaaggggacaaataaatttggataattaataaa

SEQ ID NO: 47443 - DNA, 698 bp, Heterodera glycines
  Genomic contig location: Contig_ID=SeqID_2844; Location=706..1403; Strand=-
  SCN-specific regions: Sequence locations=1-698
  Gene Ontology: Mol. function=ATP binding; Cellular component =mitochondrial outer membrane; Biological process=signal transduction
tgctcaatttgactttgatcgatttgcccggactgaccaaagttccggtgggcgatcagccgcccgacattgagcagcaaatccgtgacatgatcggcacgtacatttcccgcgaaacttgcctcgttttggccgttacaccggccaacagcgacttggccacttcggacgcgcttaaattggcccgggaagtggaccctcagggcctccgcaccatcggagtactgaccaagttggacttgatggacgaaggcactgacgcgcgggacatcctcgagaacaaagtgttcccactcagacggggtattctttgggcattttggatgccattttcctccttttccgagtgtttttcccttccaatgccttcgcttccccttttctgcttaggttatgtcggcgtgatcaatcgttctcagaaggacatcgtcggccgcaaggacatccgccaggcgctggacgccgagcggaaattttttctgtcacaccaacaataccggcacatggcggacagattgggcacgccgtacctgcaaaaggcactgaaccaacagctgaccaatcacatcaaagacacactgcccacgctgagggacaacctgcagaagaagctgtactccatggagaaggaggtggccgagtacaaaaacttccaattcaacgacccgtcgcgcaaaactaaggcactgatgcagtga

SEQ ID NO: 47444 - DNA, 2306 bp, Heterodera glycines
  Genomic contig location: Contig_ID=SeqID_17426; Location=260..2565; Strand=-
  SCN-specific regions: Sequence locations=1-473,505-877,899-933,975 -1668,1693-1920,1973-2035,2061-2102,2124-2174,2196-2306
  Gene Ontology: Mol. function=RNA polymerase II transcription factor activity; Cellular component=cytoplasm; Biological process=BMP receptor signaling pathway
atgagtttggagaattttggcaatggtttcatgcgacggttgggatggaagcaaggttaattaggttattatagtaatgcctatgataatcaaagaatgctttctcaggggatgaggacgagggatggtccaaaaaggcggttgacagtttgctgaaaaagttgcaaaagcagcacaacaaagagggtttaactctgttggaaaatgctttgcgtacggagggcaaagagccgagcgaatgcgtcaccattccgcgctcattggacgggcgtctgcaaatttcacatcgaaaagcacttccgcacgtcatttactgccgcgtctaccgatggcccgatttgcaatcgcatcacgaagtgatcagacaaataatgcccgatcagaaggcacaaacttttgctttagcttaaagcgtcccaatgctgccgtttttgtttcgaatccggtcaaaaagtgcgcgtttcctcactttctgtcaattttcatttatttttcttgaggatgtgtgcatcaatccttatcattacgaacgcgtggacagctccaacttgttgccgcctgttcttgtgccccgcttcagcgattcgccaccgaaacgtcagccgggcggcgaacatcgcgttcttctcggccacgaccctattccgtttgtgccatgccagcactgggccaccattagctattacgaattgagcacccgggttggtgaacaggtatattctatttttttgtcaaaaagaaaaataatccacgaaagggaaaaatccacttacttcatggacatattcaaattaaatatagtccataagcaaatggataatatcacttaattcccttgggactgttttggtgtcaccgcatttctttccactcaaaattatgttccttaaaattttatcattgaaaggcaagagtcagtgcaattgaatgtgtggttggtttataatgctttttccaaaattcttttgactttcggtcgatgggttcacagatccgagcagcggagaagccaacgaccagcacaaaatttcactcggtttattttcaaatgtgaatttactcttttagggtaaattcatttggacattaaattttaggttaatagaaattcgacggtggaaaacacgcggaggcaaattggcagaggcgtgaaactcacttatgttccttaccaaggcaataaaattggacggggggggggagaacagaaattgttgattttgaatcccaaaggaacactctatgccgaatgtttgagtgactgccccattttcattcagtcgaggaacagcaattggtttgactttctcatcattaatcgagttccgactcataatcaatcccaccacaggaccaacgacttccatccgaccaccgtttgtgagagtgcaaattcattccatttaaaaacaaaaagtgtaggcaaactctctcatggatattcgttgaaaatattcgacacagcaaaatttggagaggttggaaagtgattttacattttccctatattttattatatttttcatttgttagttgctcaatcattgcgtaaatttgggttacaacagcagttttgagctgaccaaaatgacaaccatacgaatggcttttgtgaagggttgggggaaggactaccaacgacaagagtattggaaggggaaatcattctttaatattttaattttataaaaagcataacttcaacgccatgttggatagaagtgcatttacacgccccacttatcgtaataattgaaacaaaagtactttaaacctaaatttgtttagtggttggacaaggcactccaaaacttggcgaaaattggtccgccttcggacataattcattcaaattcatagatgacaaaaaccaaaacagatggattggagatattttgacttttcttattgtctatacagtatatttttagaattttattagtaaatataattttaaaatcataaataaatactgtgttaaaaactcagaatgtgtccggtttctttgcaagataaaacattttatctggacaatataataataaataaaggaaagaaattaagcttttttatcactatttttcagggcatcgcttacgaatgtttttctttgctttgtttagaggggacattgctacttcgtctccgaaaggtgttaccgcattctgtagttcaattgtggtgccaaatttggacgaatcgactgtgatgaacgagttgaacccttccatcgaggaaacggccaacacacggccgtcgggtgtccaagccattgaagtcaacttgtcgtactggagattttcaat

SEQ ID NO: 47445 - DNA, 660 bp, Heterodera glycines
  Genomic contig location: Contig_ID=SeqID_17426; Location=2858..3517; Strand=-
  SCN-specific regions: Sequence locations=1-291,314-369,391-660
  Gene Ontology: Mol. function=ATP binding; Cellular component=nucleus; Biological process=mitotic spindle assembly
tgagtttggctccgttgaattagaaatgccaattccccccccacttgagtcagttgcaatacaccgagcggaacaacaccgctcacttttacggggccaacaaatacccgcaggcgctggagaagaagatcactctgctcaagttcttccggtcgtacatgaacgagcatctgatgaaggcgggcgccaacattaagatgcgggacggcgacgagttggcgcggctgccctgcctgaacacgtggttccggacaaagtcggcgattgtcttgcatctgagcaacggcactctgcagatcaacttcttccaggtccgcattgaataaacacatgaatggcctaatattggtgatttctgcacatttattatgggattttgtcttttcaggatcactccaaattgattgtgtgtccgctgatgagtgccgccacatacatagaccagcagaagaatgtcttcacctgcaaattccaatatttggagaaatacggatgccctaaagatttgtgtcagagactcaaatacactaaggtaattaattcgcttgatgaaaactattgaataatcacaatttaggtccatattttttgcaaattcaggtgatggttgaacgtctgattgcgcggcatgaaaatccgaatgcgatgactgcaaaaagt

SEQ ID NO: 47446 - DNA, 1316 bp, Heterodera glycines
  Genomic contig location: Contig_ID=SeqID_2855; Location=128..1443; Strand=-
  SCN-specific regions: Sequence locations=1-259,281-569,591-624,646 -738,781-816,839-1316
ccgactccgttggcatccgcagaatgagtccatcgtcctctggacaaagtcgccttcggctaaggcccgatttgttgcgattttggcccattcttcttcaccttttacttgcccatttcatttgcccttccattcatcttccaaacagtgccatttaccaaattcgagctcaacaattggtcgatttattgccacaaattggtactttgaattggaattttttttaaaatgagggccaaatcagtgccgatcagtgatcagaaacacagacactaaccatcagccaaatccattcttaattgatccccccattgatcagattccctttcccttcgacatcggcgcgccaccaccgaatcgctgttaacagtggaatgggaaggcattcaaagcggagaccacccggactcatccattcgcggattcatcgtcgaatatcgggccgagaaggagtcccaatggaatgtgcactcgggaatgatcccatacaaaggaccaaaccaccagtacagagtacaggtgaaaaggggggggggacagaagggaaagagggggggggggatatcgcatgacaaaacaaacaaaagacagtggggataaagggggacaaatggacaaggcgtggggagaaaaagtaaacaaagcattttcaatttcatgattaatcagtctgtgatgggcagtgattgctaattataattggaatgattcgttgataattagtgaatgatcactcaatggcacagattccctccccctctttcttttcagattccaaagttacccaccggcatttcctattttgtacgcatcaaagtgcttggcgataagggcgaagttctggtggagacgccggaaatccgcgcccgcaacgaaattgtcagcataaaatgcgaaccggacgaaatctctgaaccgggcgacgtggacgtgaaggaaagggcacaattcagcgtggcattggtaagccatgcctttggacgatcgatcgatcggatgatcagttctctctgatcagtagtcgtttgatcaatccgctcatttccttcccctattccattcatcccccccccccccccccttaggcttggcaaccgcctgagtgcggctccatcggcgagtaccaaatcgaacttcgtgggcttggcagtcagcagttcgacgtccatcgtcaaactgtggcacaaccatccgctagcatcaccgggcttttgtcgggaacagaatacgcgagtcaaaatcagagcgagtggacagggcacacattgtgggcccatggaatgccgaactgttcactgtctcgacgaagggcgaag

SEQ ID NO: 47447 - DNA, 1302 bp, Heterodera glycines
  Genomic contig location: Contig_ID=SeqID_312; Location=1..1302; Strand=+
  SCN-specific regions: Sequence locations=1-617,655-827,859-975,1007 -1024,1076-1209,1231-1302
gcaggtcatgcgaagtagggaacgcgaagtcagcattagtgctagttccactcgcggcaatgtttttggtattttacggcaaggcaagtcgaagaagttaattgactgcaattaagcaatgcccaaatttgaaggaaaaactcggataaatgattttcgattgcccatattgccacagccaatggtgccgagcaattccaagtctgccgcaaaacgaatggtggtgttccaactgtccaattacactctgagcagccttttcttttggatggtctgtcaaggccaaaacaatcgaaacttttccaaattaaggaccaatacaggaaattcgactatgaaatcagcaaaacaacagtgaaggacaaggaaatcgcagcttatttgaagacggagtgcgggccgaaagacatttgtgccggcactttgttcccaggcatggcacttttttcaaagtgtttaccatttaaaattcccttttaaagcattggcacagaattttcccaatgggttggtgagcatcaaaagtcggacattgacttacccgacaattttaattgaacgaaatcgcataaatgtgcaggttgagagtcggattgacgcatttgcaaatgtaatcgaattattaatttaaaattaatgttagaaaatattttagtattccgatcataacagacgctttttgaccgccacaatgcgtgcaaaattacagctgcagaacacaacatttgtgaattatgtattcagtgccgagttgagcattgacacattcgacataacaaatgttgtaagtttaggtcagtttcaaggaaatgatgaaaaattcaaagataattaaattaaataaattgttaattttaacttccaaaaacagtggatgggatcgatgcgggatcaattgaattcctggtaaatgcactcaatgagctgatcattgctgacgacatgcggcataaacttaaagaaggtacacacatgaaatattaaatttaagattataataaataatcaatgcctaatttcggccattaattaattatttaattaattagtcaaatcaatcaattccaattaactattccatttgcaggcgttcgtttgcccgttctgctcgacttcgaacagtttggcccgggtgatgttcacctcgaggacggctccctggtgctcagtgccgacctgtgctttgacgaactgtgcaaaaggacacccgcaaatgaattgggaaaacaatcgcgcgaaaatgggggcaacacaatgtccaacgtggacatggacgcgaattactacgacagtgttaaaggg

SEQ ID NO: 47448 - DNA, 3079 bp, Heterodera glycines
  Genomic contig location: Contig_ID=SeqID_315; Location=61..3139; Strand=-
  SCN-specific regions: Sequence locations=1-153,175-396,418-715,750 -1024,1047-1110,1146-1240,1262-1606,1631-1876,1913-1939,1962 -2034,2056-2637,2659-2933,2958-3079
  Gene Ontology: Mol. function=polynucleotide adenylyltransferase activity; Cellular component=nucleoplasm; Biological process =reproduction
atgtacaaaaattccattaagtcgaatggcgcagcccaactttacatttcgggctctttattgcttggcactcgcacattttcttcggacatcgatttgatttgtattgccccgggaaaaatcataaaattggccaattttttcggcgaagaaaacgttttttgcaagaaaaatgagtgcacaacggaacaaaacgattcattgttttgcaaattttgtcaagtaattttagaggataaattaaatccttaatggttcattgatccttattgactaattttcagaataaaggcgtgaaaaacttgatcaaaactccgttcgggaaagtgtttctgatcagatttcttctgaatggcatcgatttcgatttgacatttgtttcaattcctgccaaaagaattttgccatttgtgctaagtgacgaccaaattggcaaatacattaacaatttcaaatcggagagaaattttgcgcacaaaaatatgctgcgggcattgtcaagtgaaaatttatctttttttaatacaaattttgatattttaggttatcgctccattttttacttggcaaatttattccaagaaaatcatgcaaattgtgccattccattgtcagaaaataaatttaaggtggaaaaatttcaaaataaaaaggccaaaaaatttcaagcattggttttattcatgaaaatatgggcaaaaggtaacaaaataagtgatatttataagttaaaaaacttaaatttagaaaatcacatttattcgactgcttatggctttttgaatgggccaatgttggccataatggcagcaaaagtaattttgctttacccaagcgcatcattaccatttttaattgagagattctttattttctatttattgaggtaaaataattaaatcataagtagggcatccaattatatgcacataaaatcgtaaaatatgcgcataaaatatgcaccaaaaattgcaaaatatggacataaaaaatgaaaaatatgcacataaattttaatagcaaaattttgaaatttcttcaaatttgttaaatttaagcataaaatctcgaaaatagctaaatatagtatgagtaatcatttatgaaaccaaaaatacaaaataaaagtaaaatttatttattttgaagaaaattggttaaaaaatggagaattttctattttctgactatttttggcataaatttccaattttttcaaaagtgacttttttattagaaaatacccaaaaatgatatttttgaaaaattttcggtcattagaggcccaaatggccgctttaatagagggccgttttaatagaggatttattgaaaaaatgctaaaatatgtatataaaatatgcacgaaatgccaaaatatgcacaaatatgcacataaatcgcgaaatatgcacaaatatgcaaaatatgcatatgtaaatacgtcctagaagcttcaaaacaagctaaaaaaatgtttttcgtgcgtttcaggcctcccacagtccaggaaaaaaaatggatttccatataattggatgccttaatcataagcaattctattaaatctgaataaattaaattaacaaattttgatgaatttctcgttttataattgaaattttaaatttgaggccaattcgtgtgcctgtgcaactcgcaaaattaaaattggaagaaaattttgatgtcaatgaaaattgggacctgttttttgttaggaagccggatgagcaagaaatgcccgtttatacgccaatgtttccggaacaaaatgtggcatggcatttgacacattctgcagcaagagttattcggcgtgagatgaaaatcggtaatgtttttgaccattatttttatttgcaaaaaattatcgaattatttttataaaaatttttattactataaaaaagtgaaagctttcaaaattggaaatttaagcgttaaacaaaattaaagttatgaatgaagaaaatttgtatgagttattgacaaaagcgactccgttcacagaaaaggcaattgttttgtccgaatatttattaatttttttatcggcagattacatattagtagggcttcctttttagtcaaatgcctaaaattttgcgaaattgatacgcaaagataactcacgaaaaacgccttttccgcttggtttggggtgtctacgatgacttttattggggtgttgtataagttctgtcacccttcttatgctatgctaatcggaattttttgcaccgttaaccgcaagtgacagccgatcaatttctgtcctataggaaagagcagacatttttgcttcggttaaaagccatttttcgttcttccccattcaaattgatttttaaaaaaattttccaatggatgtccccaaattacaaattcgatcacttttattgtacgggtcaaaactttgctttgatcagttggaaatttattaaaagcagtttttgtggccaaatcaagtccggagaatccaaatctggcctcagatttgatctctgaattttctctggcattgtactgctccatgtcgttgacaagaagttgaagcagtacagggtcatagaacagcaactgactaaatctgaggcgatattcggattctccgggtttggtttgcccatgaaaacatcaatttcattttattaggtcctttcagaaccaatgttgtacaaagtgggtgctgaatcttggcacttttgagcacccatttcagacaggacaactttaaaaaaataacccgtcggtcttggtggctctttttcagcttgtcagatagtcccaactttgctctacaaaaccataatttgttttgtacctttagccttttcttggccaagaaatcagtggttgaatttggccacttttttaagtagaccgatcagtttatttgagtctaactatcttgaatttaatcgacagatcatttttaaaatctcaaaaatgggagaagatggtcgagaataatggtgcatattttgattaattttgagttattatttgattttttataaatttttgaatgaaatttttggtcggggtgacagaacttatacaacaccccaataaa

SEQ ID NO: 47449 - DNA, 1413 bp, Heterodera glycines
  Genomic contig location: Contig_ID=SeqID_17479; Location=562..1974; Strand=-
  SCN-specific regions: Sequence locations=1-507,530-615,646-713,735 -810,833-884,935-1001,1023-1413
  Gene Ontology: Mol. function=structural constituent of cuticle; Cellular component=extracellular; Biological process=cuticle biosynthesis (sensu Nematoda)
atgaccgagtcggacagtcgcattcgggcgtacaaattcgttgcctattcggccgtcactttctccatcgtggccgttctctctgttgtggtcactctgcccatggtgtacaattacgtagcccacgttcggcgacagatgcagcacgagctcggcttttgcaaggttgggagggaagagggaattggtgccaaatgcttttgggggttggcactggcatatttccaatggcattggaattggattgccgttggaattggcatttggcattttgacattggcattctgtgttcatttcgttttattctccagggctcagccaaggacatttacgtggaggtgaaccatatgaagtcgacgcccgacatggacatgaggtccaaccgaactgctcgtcaaactggcggtggctacggccccgtggtgaacgcggccccggcgtgcggtgactgctgtctgcccggccagcccggcccgcagggaccaccgggaagacccggcaaacccgggaagcctggagcaccaggaaaccccggcacgcccggcaaaccgccaaacgcgccatgcgagcccacgacgcctcccccatgcaagccatgcccccagggaccgcccggccctcctggaccacctggacctccaggagagcccggagaagctggaactccaggacgacctggctcagatgcgcccaatggcgagcctggaccacgcggccctcctggaccccccggagaagcgggaccacagggacctcccggcgagccgggagtgccggcgaccccagaagcaccagttcctggagagactggagagcaaggagaccaaggtgaacgcatgtcttgcccacaaaattaacccgcttttcaggtccccctggacctcccgggccccctggcgcccccggcgcggacggtcctcccggccccccgggaccgaagggaccggccggacccgacggtgcgcccggcgcagacggacagcctggccctgccgggcctcctggaccccccggcacatccggagaaaagggaatctgccccaaatactgcgccatcgacggaggagtgttcttcgaggacggcacccggcgctaagatggcagtggtgggccgatcaacgatcagacgaccccagaaacatccggcgggtcgaatggggcggaggtggcggcgatgggagaggcggagaaatgtccatccgattttgggatcgattcgattttggcattcgattcttttttccgtccgtccttctccgattgtcccttcccttcccatttcatctcttttctttgtccctttgttgtcccttttcgctttcccctcaattaggcactcttttccttctccgttcgctcagtgtcctctaatgatgacacaccaaattaattgtgcaacacaactgaataaa

SEQ ID NO: 47450 - DNA, 2369 bp, Heterodera glycines
  Genomic contig location: Contig_ID=SeqID_17499; Location=209..2577; Strand=-
  SCN-specific regions: Sequence locations=1-123,146-280,302-346,368 -965,991-1024,1048-1487,1510-1744,1766-1877,1899-1953,2119-2198,2220 -2369
  Gene Ontology: Biological process=N-linked glycosylation
atggcttttccgcctccttttccgaatccattgcttcctcgccttccgaatcagtcgggtaaaaaagcaaataaaattccatttcgtcagaatgtttcttttttagttcaattccctggacagaagtttggcttcttttctccacaacgtcaaagtattctgcccgggattccgctgctccgtccacgttttcgtccgaattttattccaagggtttgtgctttttatatgtctacatagggattgaattcgataaattattattataaaaccgcctaaatttcttttggttcatttattctcgctaaaatagtgtaagaccatactaaaaggatgataaatagcatttgtaattttcattttaggaactgcggccacccaatccattggcaagacccaccgggccaccaacgaccacaacagtttttattgggaacatttccgataaatgtccggaccgaatcatacaggaagttctaaaggtcttgtttttcgtaaaaattaattctcttaaaacctttattacttaagaagtgcggttccgtgtgcaattggaaacgtctccaagactcaggcggaaaatttaaagcgtttggattttgcgactttatgtacccagacggagcaaagaaagcactgagtgtcctcaaggacttccccatcggcgacaaacgtctgaatgttaaagtgagtttggtgctcaaagtcagcgaaatagtggccattttcaggcggacgaacaaacggagaaactgctggatgaattctccaagaataagctcatcgccgccaacgaggagagcgacgacgccgtcagagcttcgatccgaaagtttttggaggacgaggcggccgacctggtggacatgccgacggacgaaggttttcggtgagggaaggcgaattgtgaccaaacaattcaggcgaatccaaagaaaaaagcccggccgaaggaagcactaaggtttttagcttctttcattatttaaactttgctctttccgagtccgtccttcttaaatcactctctccctcccttctcactcattcttttgcataaaaacattcttaggcaccgtgttttggatctttttgtcttctttgggcaattggtggtaagtttaaattttggtcatcaactcccctttataaactttttttttgatttccttcgtttttttagaattatattttgtttacatactttcaatagtcagaattttggatttattagagggtttttgcattcattcctcgctcctaaaatttattttttgacacatgaatatgtgacatatttaaacgaatattccaaacccattcgtataatttaccacacagtaatttctctattggccgaagtattataggttcaccaaaagttgaggctgcgctgctacgatgaggattcgtaagtaggcgcaaaaatgccaaacatctcattacttatgccctattttcttttacttctcaatttgcatttattattctttctttttccttttcctcattaattgaaattcattttcgggaagccaaaacaaaataagggcgagtgaaagtgaaacaaatgccaatgttgtctttctttttaacataaaatcctttttcaattgagaaaagttgaatttcactcgcctttgaatttggcattttcctgcatttttatttttctgttttcaggcctcgaacaaggagggccgtcagtcccgttcttcttcggtcgccagtcatcgacacaagaaaaaacgttcacaaaaatcaccaaatcgcaaaaagttggccaatgggtgggcatttctaattcgcccattgcaggtcccgtcactattcttcgagttcatccgatgcgtcgtcttattccagcacatcttctacagagtcgaggagaatcaaacggaagaaaaacgccaaaaggaaaagtttgagttcggcggaggactcagatgaagcggaagagaagcgaaagctgaagaaagaggtgaaagagaaggaggagtcgtaccaggcgaggctgaagaagtgggaggagagggagaagagaatggccaaattatacgacaaagagagagaggaggaaaaacagaggcagaaaacgctgcaaaaggaggcgaagaaactgcgacagtttctggaggattacgtggacgaacgggacgacccgaagtattacaggtgggagactgccaaaacggaccaattgaaaggaaaatgacaaacaatcgttcaggggctcagcactgttccaaagaaaacgaaattacgaacgcgaaagggaggcggacgcaaaggaccgacacgaagaaagggcagaactggaggagataagaaggtccattttggaagaggaagtggtcagcaaaaaggaa

SEQ ID NO: 47451 - DNA, 2620 bp, Heterodera glycines; identical to SEQ ID NO: 17503
  misc_feature (168)..(168): n is a, c, g, or t
  Genomic contig location: Contig_ID=SeqID_17503; Location=1..2620; Strand=+
  SCN-specific regions: Sequence locations=1-711,735-1210,1232 -1540,1569-1658,1680-1717,1740-1823,1965-2046,2091-2102,2249 -2303,2325-2325,2357-2554,2576-2620

SEQ ID NO: 47452 - DNA, 613 bp, Heterodera glycines
  Genomic contig location: Contig_ID=SeqID_17514; Location=1..613; Strand=-
  SCN-specific regions: Sequence locations=1-7,29-152,174-237,259 -481,503-517,539-613
tgatgttaaattatattatacacatgaaaacgatgaccctttgaatcagttggataaagcaattgaggctatggaaaaatggtcaaaaataaatgggttagaaatttcaactgaaaaatgttttgttttatatttagggaaaaataatatgaaaaaagaatattttattaactcacaaaggatttcagaatcggataatgttcgtgacttgggaattataattgactcgaaactgaatttttcagaacacataagcaaaattatacgaaacgcatatcttagaattttctaaattttgagagtgttgaaaagcagggaaataaaaactctaacagcagcctataaaacttttgtacgacctcaattagaatacgctaccgaagtttggaaccctaatttaaaaaaagatatacacaaaattgagcgggtacaaaaattttttacaagaaaagcacttacaaaatgtggttttgtgtacaaaaatatggggaaagattaaaaatcacgggtttactcacattggaagaaagaagaaaaatcactgacttaactacagctttttaaataatcaaagggttcatcagcctcgatgctgggaaaacttctttttctc

SEQ ID NO: 47453 - DNA, 1802 bp, Heterodera glycines
  Genomic contig location: Contig_ID=SeqID_2861; Location=4244..6045; Strand=-
  SCN-specific regions: Sequence locations=1-372,395-443,465-586,608 -1061,1084-1802
  Gene Ontology: Cellular component=mitochondrion
atggtagctgtgacgctcggcacatttttacaaggcagcattggcactgcggtggtcattgagcttaaggacgaaactgcgctcgaagggtcagtggacagtgttgacccgaagtcgctgaacacgcagctgagcaacgttgtgttgtacagacgacggcagaaagggctaaaacccgcgcatttgcccagttttttttgtaaggtgtgcttttgtcattagtcaatcaactcattgaaatttccctgaatttttttgtttcaacaattttcattttagggcaaacacattcgcttcgtgcattttgagaattacgcttgtgcgctgcatttgttgaaaaagtcgttgcgcaaattgtaaaagccatgcccaaaagaagcaacaacaaacacccgtaaagctcatctccgtgtcttctgtctaattggaaatattccatagcttttgatttttctaatttattgtctttgtgcctgagttatcatttaatcatttctttatcaaatttctctacaattcaaagacaaaatttccagatttgttatttaattttattgttggtttaaaaaaaataaaccaaacaacaaaaaagttgaatatgaatgtaccaaaactattttaaccggtctctgaatattttcttccttttataattagattttttcaaaatatttctattgactttcttagtctccatgtatatgacaacaaacagaagcatggcgattggttggaagcttttgacccgagacaaatggttggccattcttgtcttttttggctgatttttccatttgattttaaaggcatctttcttctttgccctgctccctattggcattcgctgaaggaatgtgccatcgaaattctgtagtgcagaattcaagaatttggtatttatttaatcctgctatttatcaaatggaaaatattcaggtcacagaattggtgaatgccttgcggaactgtgcttcggagttgctgcctttgcctgatgaagcacagaaactaacgctgaagaatattggtgggttgattctatggtttgatgcaaaaaccaacatttccaatttgtgttaagaacatgataaattccgcatgatggatggacgaaccgccgatgaggcgatcgttgccactgtgagtaaagttggcgagaatattcaactcgcccgagcatctgtcatttcttcttcaccaggaacactttttggtcaaacccatccaaaaggtcgtcgtatggtttttatgagtgaaataatttttgtttttagaggaatttaatggcgttcaattgggacgttttatttcgttggtgtctttgggtcacaaatcggatgagagtgtttctgactttccaacagcacaacttggtcaagtgctttgtcagcacatcattggaatggcgccggaaagtttgggtgaaccaaggaaaaagggagctaaacgagcaactcaaatggaaatcgttgacaatggggagggaacggagaaggaacgctcagctaatgcggaaaatgaaagtgacggcggggaagaggaggatttgaacgcttcacaagttgaccaatccgaggtgggatggcaatttcttagagaaggcaccaatcccatttaagctgacgagaatggacggagaagaaactcagctgttgcaccagccattcatgctcaatcctgaacagactgtcaacgaatatttggaagcacatggggcaaatattgcggatttcttgcgcattgagatgggccaagaacacaccaagacaaatgacctttctgtttgttcattgttagtataa

SEQ ID NO: 47454 - DNA, 1600 bp, Heterodera glycines
  Genomic contig location: Contig_ID=SeqID_17522; Location=53..1652; Strand=-
  SCN-specific regions: Sequence locations=1-443,465-542,565-621,643 -825,847-973,996-1056,1078-1401,1457-1509,1582-1600
atgacttttttatacgaaacgctgcacactttggactcgtttaaccgcgactcgcccattggacgtcaaacaattcggaaatttgtggtgaatattgtgctgaaattggagcaggaggagggcactcacagcactcgtgccggtgccgggtaccacagcaaacttttgacccccgaatttgtacttcaccatcataatgtaatccccatattcataaattgatcactaccgttttgaattcagatgcccccaattcgtttctgtcgtgtgttggtggagcgaattgtgcaggcgagcacatacactcatcaaccgccgcaatttgttcacagagactggcgatttgctgaatatccggtcagcccctccccctccatccagctttctgcaacatttttcatattattgtacgtcttcagcctgccggacaagccttgaccagtgcatgggtggaactgcttgccagccagcacactcccgcggctattgtcgatgccctcgtcgatttggccatccgtcgaccgatatttcgtccacaagtctttggcaatgaacaaaataaattaaataaggactattttccaggacactctgaatgcgttgggtctgttgctgactgggcttccttcctccttccaagccttcttcttggatcgaattgaggagtccttcgactggccccaaattgcttctgtcgacgctgatccttcgcaattgttcgagtcgcttagccacgaagtttacctccactcggaaagtcgcattctctcgatgctggccctaatccattccttttgtcaacatggcggcaatgttcggaaacaagcaaaatattttgaaatcaaatcattttagaattcgctttcgattattcccgatttcgtgataaaccgacttgcccacaaagtggacaatgaggcgcagctggtctatttccttcgcattgtggtgccgtatttgcagagaattcacgaaaaggagcggaacaaacacatgcccgaggtgtcccatgggcacaatgttcgattagggcagctgcaaatttcagctactccctatgttaataattaaattgttttattagatttaattgccttcacttcgcttgtccttttccttgcgtttgattgtttgggtttcttcagatcatttccatttacaaagttcttggcgatttggtaaagaaggtcggccaacttcactacgaggacaccatttgcgacttgctttaccagttcaaatatatgtttgtcggctatacgctcaaagaacaaaccgagattttcattctaaattttccggtgagaaagtggtgaatttcctcaataactattgttttaattacccttttaaaggattcgatgcgtgaaaagttgaaatttttgttcacccattcgtcgacagcagcagcagcggtggaaaatcagcagcaaatgcttcagcaacaacagcagcaattggttggcattggatttgcatttggtcagcaactttcatttcccatggaatcagcaacacatcaacaacaacaacaacaagtactgcccttccaccattcacaacagcaacaacaacagcagccggcggcactgatcggaat

SEQ ID NO: 47455 - DNA, 2058 bp, Heterodera glycines; identical to SEQ ID NO: 17540
  misc_feature (1982)..(1982): n is a, c, g, or t
  Genomic contig location: Contig_ID=SeqID_17540; Location=1..2058; Strand=+
  SCN-specific regions: Sequence locations=1-158,187-234,256-737,760 -1031,1064-1236,1258-2058
  Gene Ontology: Mol. function=RNA helicase activity; Cellular component=cytoplasm; Biological process=translational initiation

SEQ ID NO: 47456 - DNA, 979 bp, Heterodera glycines
  Genomic contig location: Contig_ID=SeqID_2869; Location=1..979; Strand=-
  SCN-specific regions: Sequence locations=1-768,791-823,848-979
  Gene Ontology: Mol. function=transcriptional activator activity; Cellular component=chromatin; Biological process=establishment and/or maintenance of chromatin architecture
aaagtagtcctggctctatccaattattaaaattcatttctacaaattaaaaaataatggtcatatcaaaacagattatttttcaataaactgcataactcatgatagaattattgtgaatgaaaatttggccatttattaaattagatgaaaagaaaaaagtgcgaaaaatatgttaaaaagcaataaataaacgtaaaattcggcgtcgacccctttttccacctctttaatgtacattttgaaagttgttactttcatacttttagattgccgccgctttgcccgttcaacacgccaaaaagacggcgcctgcccaatacattcgctacacgcccagccaacagtcgggcctaaacgcgggcggcgcccaacagagaatcattcggctggtggaggagcaaaaggacccgatggaaccgccacgttttcagtaaccataacatgaagagcaatgttgttactggtgcattaaatttgtgttttaggatcaatcagaaaatccctcgggcgccgccctctccgccggcgccggtgatgcattcgccgacgagaaaagtgcgttttcagggacccattcattttgcgagatatgacttggaaatgcactcaaactggcaaactcatcctatttatttctttttgaggtaagcgcaaaggaacaggccgactggaaaattccgccttgcatttccaactggaaaaaccccaaagggtacaccgtggcattggacaagcgattggcggcggatgggcgcggattgcaacaaggtgggcaaaatgggtggagcaaagcattagccaaagcatgctaatttaagtgcacatcaatgaaaactttgccaaaatggcggaggcgttgagcatcgcggaaagaaaggcgcgggaggcggtggagacgcgcgctcagatggagcgacgcattgcgcagaacaaaaagtgtgagggaggaaaagcgaatgcgcgagtggcacagaat

SEQ ID NO: 47457 - DNA, 1353 bp, Heterodera glycines
  Genomic contig location: Contig_ID=SeqID_17568; Location=1709..3061; Strand=-
  SCN-specific regions: Sequence locations=1-1039,1061-1119,1141-1353
atgtcaactcttaagaaaattgacaaggcgagtgaggacggtctcgaggggggcctttcgctgttcgatatccccccgacgaacgttgcaattaataaatccagtattagggaattactccctctttcagcaataaatcaatctggaccatatatctttagacttttttcagataatcagttttgtgatctcaataaaacttttctttatttgtcaacttcaatagagagaaaagacaaaagcaattggattccgattaccaaggacagtgaagctgaccaacacgtcggtgtcattcaaaattttgggcacagctttgtcaaaaccttaaaggtgtcaatttccggtgtcgaatcttatgattccggcatttactatgcgtttagggcatatatgatgaatgaattgcgattttcagaagatgtcaaaaagggtctctgtgaagcatcttgctattatgtcgacgatgtcgaccaggatgattacacaaacagcggctttaaaaacagagcgtcacgttttgctgatggtgccaaatgtgaaaccatggtgaaacttaattttgatctcgctcgtcagcccaatctattgcttaataactcggatgtcatttttagcatacatcgtaataccgatgattttctaattatggcaccgccatatgtttcaggaaatgcagtcatagcgaacccgcacacatatcgtattaacatacatgatattagaatttatgtaaaaacagtcgacattacccagtcattaaataacgtaataagcaatcaactacaaaccaccccggccaaatacccggttagaaaaattgagatcaggagtcttttcatcccacggggcacttctgatctctcacacaatgtttttaccagcattgttccgagacgtttaattgtcgggtttgtttcaaccggtgcgtacaccggaaatccgaaagagtcacccttcgtctttgaacatgccaaaatacgctctatcagtgtcgaagcgaatggaaacattttccccgggtcaccctattctcttaattttgatagaaacaaatacattcgagcatttgttgacatgtatacggggctcgggatggacgacggagaaaggacaatgtcgatcaatatacaaaaatttgtaaacgggtggtgtttcttcgtcatcccgatgacctctactctagaggacacccccggttttgaattgattcgaaacggaacgaccagcatcaaggtgcaatttaatgagcctataaaggacggaggttatgagatgatcgttctgggggaatttgattcgattttgtctattaatgctaatcgtgtgctcagtagcgacggaagcatatga

SEQ ID NO: 47458 - DNA, 618 bp, Heterodera glycines
  Genomic contig location: Contig_ID=SeqID_17586; Location=1897..2514; Strand=-
  SCN-specific regions: Sequence locations=1-618
  Gene Ontology: Mol. function=dynein ATPase activity; Cellular component=fusome; Biological process=oocyte cell fate determination (sensu Insecta)
ccgtgaattaatagctgcattggtcaagagaaaacgtgtgccagacaattggctccaattttccgtgccaaaagacgtaacagcacttgaatggatgcgagactttgtgcaaaggatggaacaactaaagcgcttgtcactttctgaaaatctgagatatgaggaagtctggctgggtgggatgttctttcctgaagcgtatataacggctacgcgtcagctgatagcccaaacgaatggctggtcgctcgaacagatgtacatgcatatcacaaaaacggaggaagtacaattaaaatcaacggcattcacactgacaggtggttgatgatgatgaacttcgttttcatcgcacatttatttttagaccttcgcgcaattggcgttctttgtgaggccgacgaaattaagctgacagatgaagtgcatgttggagtgccacggcttcagttcacgtggaccttggaaggacattctccagcgagtgttgtggtgcctgtttatctgtactccaacagggccaaatttttgttcggacttaatttgttaccaattggatttgatcattctatgctaagccagcgaggggtcgcctttgtctccaattgttcgctttga

SEQ ID NO: 47459 - DNA, 1719 bp, Heterodera glycines
  Genomic contig location: Contig_ID=SeqID_2876; Location=388..2106; Strand=-
  SCN-specific regions: Sequence locations=1-462,496-604,643-679,701 -782,808-1592,1614-1638,1660-1719
  Gene Ontology: Mol. function=protein tyrosine phosphatase activity; Cellular component=cytoplasm; Biological process=protein amino acid dephosphorylation
attgccttgccctaattaattaactattataattctctctatatcgtcgtcgccgtcaacctcaatttgaggtgttttcactccattcataattttttaatctccgtttttcttacagcagtcatcacgatgtccgggagaagtggccgcagtgggaaacgccgacaggacggaccgggccgcccctcacgttcacgtcagcagcagcacacccagcgcggcgttcagtctgcatatcaaggtccacgagagccgccggagcaaccaacagtccgaggctgggaggacacgcgcgacttctgctcagccctgaaaatcttcgtcaacgagacaacgcgacgcaacgtgaaggagctggtcaacgaatacacggagctgaacgccatgccacggccggagacttcgccggaattcacacggtcagtttggctgtttcgattttcaaacacaaataaaataggtaatttctttacagccacatggactgcaaccgctaccgggacgtcatctgcgccgagcagggccgcgtgcgactcgacaacggacgatacatccacgccaactggatcacggcccttggcgaacagcgcttcatctgcacacaaggcccgctcgagacgacctgcgccgacttctggacaatgatcgtgcaggagaacatcgaaagcattgtgatgctctgcgacaccgtcgaacaaaacaagaccaagtgccaccagtactggccgacaccggacaaaaaggtgggtttttccattttttgcccttaattttctaatcattccctcccccctcttttccccttgcagcaattgcacttcgccaacaagacgatcaccgtgcacttcatcgaagagactgcgctggagccggacctctacaggacaaagctggcggtgctctttcccaacggctccatgcgcgtccatcacttccactggcgccggtgggccgaccgcggtgtgccccagaacgacttggcgcctcttcgtttgctgttccaagtgcagcagtttcggcgctcggtgatccactgttcagcgggagagtttgtgccaagttggaaaataaaaatgcaaaaaatttcccattttcaggaatcggacggactggaacactggtggcgctgcacattgcctacaatactctgcagcgtggacatcggctcaacatcctcacgttggcgcgcaacctccgtcagcatcgggcccaaagtgtgcagaccctggaccaatacctctacatatactacgtgattttgcggtgggttttttgtttgagtttgtgtgtctaaataatcatccccctcccccgcttagctatgctcaaaacaaggcggcgaagctcaacattgacgaacgcgcactgacgacattcctgcgggagatggacgagagaatgacgcgaagctgatcttctgtgtattcgtgatcgtatttgtgatctgtatttgtatgtattgtcatgtattcatctcgctgttgtcatttcattcacttgtatatttcaaactacaataatataaacaactttcattattgtattggtattgaatcgtactgttcctaaaatgcaccaaaattttttcctgggaaaatctgatttttcaaaaatgattaactcaacacttaaaatcagaaaatatattttttgtgatttcgaagtctgaaataattctcacttctattttgtccaatccgaaccccggactcgaataaa

SEQ ID NO: 47460 - DNA, 1442 bp, Heterodera glycines
  Genomic contig location: Contig_ID=SeqID_2876; Location=3660..5101; Strand=-
  SCN-specific regions: Sequence locations=1-115,137-319,341-513,539 -794,817-1244,1266-1315,1337-1361,1383-1442
  Gene Ontology: Mol. function=transmembrane receptor protein tyrosine phosphatase activity; Cellular component=integral to plasma membrane; Biological process=vasculogenesis
aattcaacgctctgcagcgcatttcaaccacaacgcacacagcaaacgcggatcacatcgccgcgcaccgtgcaggacctggtcagcgaattcaccgaactcaacgcagcgccgcagccggtgccatcgcctgagtttacacggtgggttttggcgtcgttttcattttgtatacatgtctaatcttcccagtttcaatttttcaggaacgtggagtgcaaccgctacagggatgtgatctgcacggaaatcaatcgtgtgcgactccacaccggacgatacatccacgccaactggatcacaacgttcggcgagaaccgcttcatctgcactcaaggaccgctcgagacgacctgcgacgacttctggacaatgatcgtgcaggagaacatcgaaagcattgtgatgctctgcgacaccatcgaacaaaacaagaccaagtgccaccagtactggccgacaccggacaaaaaggtgggtttttccattttttgcccttaattttctaatcattccctcccccctcttttccccttgcagcaattgcacttcgccaacaagacgatcaccgtgcacttcatcgaagagactgcgctggagccggacctctacaggacaaagctggcggtgctctttcccaacggctccatgcgcgtccatcacttccactggcgccggtggcccgaccgcggtgtgccccagaacgacttggcgcctcttcgtttgctgttccacgtgcagcagtttcggcgctcggtggtccactgttcagcgggtgagtttgtgccaagttggaaaataaaaatgcaaaaatttcccattttcaggaatcggacggactggaacactggtggcgctgcacattgcctacgatactctgcagcgtggacatcggctcaacatcctcgcgttggcgcgcaacctccgtcagcatcgggcccaaagtgtgcagaccctggaccaatacctctacatatactacgtgattttgcggtgggttttttgtttgagtttgtgtgtctaaataatcatcccctcccccgtttagctatgctcaaaacaaggcggcgaagctcaacattgacgaacgcgcactgacgacattcctgcgggagatggacgagagaatgacgcgaagctgatcttctgtgtattcgtgatcgtatttgtgatctgtatttgtatgtattgtcatgtattcatctcgctgttgtcatttcattcacttgtatatttcaaactaatataaacaacttcattattgtattggtattgaatcgtactgttcctaaaatgcaccaaaattttttcctgggaaaatctgatttttcaaaaatgattaactcaacatttaaaatcagaaaatatattttttgtgatttcgaagtctgaaacaattctcacttctattttgtccaatccgaaccccggactcgaataaa

SEQ ID NO: 47461 - DNA, 1356 bp, Heterodera glycines; identical to SEQ ID NO: 17634
  Genomic contig location: Contig_ID=SeqID_17634; Location=1..1356; Strand=+
  SCN-specific regions: Sequence locations=1-72,94-313,336-344,369 -422,473-494,520-557,618-1097,1131-1173,1206-1356
  Gene Ontology: Cellular component=mitochondrion; Biological process =growth

SEQ ID NO: 47462 - DNA, 1202 bp, Heterodera glycines
  Genomic contig location: Contig_ID=SeqID_17635; Location=43..1244; Strand=+
  SCN-specific regions: Sequence locations=1-38,61-558,584-636,661 -768,791-947,977-1202
  Gene Ontology: Mol. function=DNA-directed RNA polymerase activity; Cellular component=DNA-directed RNA polymerase I complex; Biological process=growth
atgcaattaccaaatcttttatttgttttttttgaaagtgtctcaaaaggaaagaaaaaacgcggaaaggggggaaatgtgtcgcaaaaggagggccagcagcaaattgggtcgggcagtgacagcgaagagggcgccgtaggggcaaaggcgagcggcggatgcatcagagagaggggcggcagcggaaattgggtggtttacacaagcgcattcggatggaagccgagtggcgagcagcggacgcaaattgcgaaggatccgccgcgactcgtccacggagacatcattttggccaaactcaggccgggccaggagatcgaggcgaggtgggtcggcaaaggggatggactcacccctttacgatgactttgccattttcagttgtcattgtgtcaaaggaattggcagagaccacgccaaattttcacccgtcgccaccgcaacgtacagactgctgcctcagatcaaactgaaaaaggacaactttgatgaggagcaggcggcacgactccagtcaagtttttccactggcgtaattggaagggacgaacagacggggagaggtgagagagaagggactgatgtgaacgtacaaagggaagagacgtaaaagaggtgcacgtcccccccccataaaaaatttaaaaagaaattcacgttacaagtgggtgggacgaattgtcgagtttgagggggcaggggacgcatgtcttggagaatacgacgcttttcaaaaaaacaaagaggggtcttttgaattttatcaaaaacaaaaggggggccttttgttttgcaaaatttttttatgataaaaaaacccatgaaaatttgttatccggggttttagagggtcgctgatcacgaatctgacatctaattcgaggtcatttaccccaataaccccattaaataaattttcatgactatatattaaaaaattttgtaaaccaaaagggtccccccttttgtttttactttttgataaattcaaaagactcctctttgtaactagcgccgagaatactcaaacaatgaattgtctttgtttcccagtttatgtgcgggatgctcgcgctgacacttcgagtcgcaacgtgttcatacacgacgacctgaaagatgcggtggaaatgggcaaaaagaaaacacatttcatttgtaaggcgaacaccaaactatttgcactcaaatgctcataa

SEQ ID NO: 47463 - DNA, 982 bp, Heterodera glycines
  Genomic contig location: Contig_ID=SeqID_17642; Location=373..1354; Strand=-
  SCN-specific regions: Sequence locations=1-680,702-782,825-982
  Gene Ontology: Biological process=embryogenesis and morphogenesis
atgagagtatttccatcatacgcattcattcaaatggttcttctttgcttattctcccacatcgctttagctcagagtcagttgttgggaagcgacgatctcatcgctcttttcgatctcagcggtgcgtacaaccgctactgtggtgttaagaagccgcgagaggacctcgcctcgtttttgccacatgtttgtgccggttcgcacataaacaaaaaggcggattcgcaatggtttgtttatacatatcataatgctttgttaattcagttccaaacatatttcagttctcttcggaaactgatcgaagacccgccaataatgggacgagaaataaacaatttgaatgccagccaaatggtcggatttaaattgacaccaggtcagtgcaagagttgacaagtgaatgaatataccaattcaaatctccttgacaatggaagtaaataatctcttagaggacacagttctttaggcccaattcccaacgccaatcgcttcttcgatttgccggagcaaccgacgagcagcaccaccagcacaacgacggcatttctgtcccactcagcatctgcgacacaatttgagtccgaggccaaaaccaccgacgaacgccgacagcgaaagcgcgtcaaacggtcattggacgaactgacattggatggtatctgcaattatgataatgaaagaccattgttatactgtgaatttgccgaacagaagtcgaacgaaaagcgaagaaagcaaaaagcggcggagccgaagagaacggaggacgcgaaaaggagaaaaagcggaagaaggagaagaagaaaaagaagaaggacagggaaaagcgaacggaggacgaagggaccaaacgaagcggcggagaaacaaaacgcgagacggtgatgcccttcttctgattttccaaccgcatattttcgatgctcatcaaaaaaggtggtcgccattttatgggagtcaatttaccaataaa

SEQ ID NO: 47464 - DNA, 1313 bp, Heterodera glycines
  Genomic contig location: Contig_ID=SeqID_17644; Location=917..2229; Strand=+
  SCN-specific regions: Sequence locations=1-344,366-693,739-815,837 -957,979-1022,1046-1313
  Gene Ontology: Mol. function=6-phosphofructokinase activity; Cellular component=6-phosphofructokinase complex; Biological process=glycolysis
atgccatctgcccaaatggtggacaacattaaacaatccgccaatgggtccaaacggcgtgtttttctcatcgagacgatgggagggcactgcggctatttggccacggtgtcggccatcgccacgggggcggacaatgcgtacattttcgaggagaaattcacggtggacggtgggtaatccgtgaattctttttggtcaattttgtattttacagacattaaagaggacgtcaaagtgatcagtcagaaaatgcaaaagggggtgcaacgttatttgatagtgcagtcggagggcgccagccataattacgacaccacttttgtacaaaagttattcagcgaagagggcaagggagaggcaagtgctattaatgtaattttgttttttgagggcaaccagggcctttccaacggaggctacagtcggtggtgtccccccccccccctcgaaagccgaaaatataattaagaaatgtaccagaatttccttaaaccataaaattgccatttttggcaaatcttttaataaatcacacagtcgttcgttgggtgttttcgacttctattgcgtttgtatgtaaaaaataggataggaaggagttggtgagaaaattttttccaacccccccccccccaaacattgtcaaaattcgaccctccgttcgtcctctgccgcgatttgcccctcaatgggaaaaggaaattttaaaaattttgaagaatgaagacagatttgaaattttaggttaaaaaaattgaattctgagattttaggcgaagaagggaaatgaaaatttcgagaattacgaaaggttggaaactggaaaatttttctaaaacagacgggataaaaacttgtaattttgtctataaatatattttcttattttaaccaggaaaaattatcaaaagccagcattgtggttgcaacggccgatagccttgagaaatacaaagcggtgactaaagaattttctttgcgcacgcaaatgcatgttctgggattcaacaaaaatgttagcttttttaaaagttaaaattagctaataatttgtatttcaagtcgaccggactcctttcaagcattcttgatgggaaagcggaacttaccgaacaacaacaagagatttcccgttcaatcaacgccattacggcggatgaagttctcgtgaaggaattcctggagttgatgaatgaggtcgaaaaaaagaaatgccgccgatccaactccgaaacgccacttgtgacctagacggtattattgggtaatctcgtaagcaagggcgtatctaggcccccccccccccgaaa

SEQ ID NO: 47465 - DNA, 2526 bp, Heterodera glycines
  Genomic contig location: Contig_ID=SeqID_2883; Location=1604..4129; Strand=+
  SCN-specific regions: Sequence locations=1-49,71-333,355-397,419 -737,759-785,808-1681,1703-2526
  Gene Ontology: Cellular component=synaptonemal complex; Biological process=embryogenesis and morphogenesis
atgaaactctcttcttcaattgttgatgttgtcgttgaacttgtcgaattaaaagacaaaaatgccattcaaattgatactgaaaaagcgaggattgtccacggaaccacaaatgaacgtttagaacgccttttgcaagcaaaaaatgaggtaaatgccgttggtcgaattcggaattcgaaataattttgtctcattttcagttggacaataaaattgacgaactttcttcgatgctccaatacattttcaaatgtgtttttgttcatcgatacaggtcaagctttcgatatgcaaccattctttccttttttcagggaccaggttgccgatttcaggattatttgcatctctgaacttggagtatggatccgaatctacccggctttgtttttggacgattcttacttaaaatacatcggttggagtctttttgacaaggtagtttttgccggtttacgagtttctgaatgagcaaattaaggttcccgaagtgcgccaaaagtgcatttatgctttgcttcctctttacgaaaataatgatttgattgcaaaattggagttgttcacgcacaaattcaaagatcgtttggtgagtatggtgttggacacggacgtggaagtggcaacgaaaacatgccaactgatgacgcacatttacaggtgccaatgattgggacttattgccctctccgattttaaaatgacggtccttttcattttcagggcgttccccgctcttctcgacccgggtgcttgcgtgccgctttatgagttggtctattgcaacaatcgccagttggccacggctgctggagaatttgtcaatgcaaaattattttcgacggcggccgatgtttgcttgactaaattcattccgcttctgaattattgccttttcttcagaattccctgctcacttcctccacttctctgctcactccgccagctgaaaatcgccagctgattaaggatttggtcacatttttcatagacggcgctgtccatcgtcacccggcctatttggttgattcgctgatcgacatttgccccatgctcaaggattggtccacaatggtcgacattttactttcggatgaatgtaataattctttattttcaaaaggattatgtacctataaaaatttagtcgaccaatttgacactcagctgatttcgattatgtgtgctgctgtcaagcatgctgcgacgggcgaacacccgccaaatcgcattgtcgtctcaattcggcgaggcccgggcgcggggacggaaaaagtccgtgaatagggggcaaccttttcggaacactttaaatggggtacttagtttttggtgaggtgttaccattttcagttatgtaaataaacgacattcaaggctcctagatgtgtattttccatatgtgtaaaaggtgttggggtcaaccaaaactttgctgggtattgggggtaggagcggccaaattttctaacaaacgttcaaattggttcaaggtttcaataaattttctttcctccgccagtgaccaccctcaccccgcaaatttttttaccattcccttcataaaaatgccattaatagaggtgtaaaacctaaattatgttttgttcagaaggaccttcgaatgctgcatgacggacgagtacatctttcggaagtgttcattcccaaattgccaagattgctacaaaaggttcaaaggattcctttcgtctttaaattcatttttcagtttatcgcagaccaagaaaaagtgcgtgatcttatcggactctttttgtacttcgaacttgaaatttactctgtttcccgtcatgatcaagttgttctttcgggttcaaaaaagcatttgaattgtttggtttcagcctctttatgatctgatgatgcttctcgagcgcattgttgaacaatactccaatgatgagattgcctcaaacattgcctccgtttttcaatttatttcgactaatatgacattggcacgatccaccgaaacaaacagatgccgaattgtggacggagttgtgcaaaatttgcggcaacaattgcaagtgtttctggccaatgaagaggacgaggaccaacagcttgacgaggaggacgaagccgcacttttgtccgccttcagaaaaatggttgcgttcgccaggtgcagcaaaatacatttctacagagctcaatttaaataaatattgtactattgcaattttcagcacaatcgacgtgcctgtaaatgtcgaattttgggacatgtgcatggctttgtttcaaaattcgcatcgatttcggtcggctgatttggttgaaaaggcgatgcttttgtgctttcttcttctcagctgggaaatgaaacgatttgtggcggcacaagaacatggagaggtaaactctgcacggttttattcatttctctttattctcactgataaggagactatcgaaacattgaagaaaaaacgcgaccaatttttgaggacgacaaagtccattctgcgcgacttcgctattggtgttgagact

SEQ ID NO: 47466 - DNA, 2638 bp, Heterodera glycines
  Genomic contig location: Contig_ID=SeqID_2885; Location=1..2638; Strand=-
  SCN-specific regions: Sequence locations=1-31,213-228,400-921,945 -1101,1221-1291,1313-1403,1428-1439,1476-1509,1532-1811,1833 -1889,1912-2080,2102-2145,2168-2583,2605-2638
cattttctgttcccctttctgtcctcttccactttctgttcctcttctatttctttttctgttcctctttttgtttctctttctcttcctcttcccctttctgttcctcttccactttctcttccactttctcttccactttctgtttctctttctgttcgtcttacacttcctcttccactttctgtttctcttccactttgtcttcctctttctgttcgtcttccacttcctcttccactttctgtttctcttccactttctgttcctcttctatttctttttctgttcctctttttgtttctcttcctcttcctcttccactttctgttcctctttcatatttttttgttctaaattttgtttgttttatttaaatttttatcgatttttaattttccgtaagccataaatcaaaatttattctgttaaattggatcagaaacattttttttgtcaatttttatactgttaattcttggtcatccaaagccaacaatgttacattgttggtattatttgaaatcttaacatgtttaaaagctttgtctaagctattgctttatgattagacaattgctaaagaagttatacatgaaaattgcgaaaaaaatgaaattttgaagtttttcttaataaaattttttcgaggcttgaaaatcttttcgttttttgtaaagctaatagagcatgtgaagagctttcgtatgataccaacaatgttggatttggatgataaagaaaaaaggtataatggaaaagcatgctggggccgaatcgtgagggctgaactgagcgagtccggtctggctgatgataggcgctccaaggatagtttaaattaattttcaatttgttacaagttttgtccaaaaaaggatcaaatttttacttttgagttcattcggtatgcataaaaaacatattatttcactctttatgtaaattttttttaatttcctaaacgtacttatcaaaaaaaaaattaaaaagtttgataatcagaattaatgggaatcgaaccctatacactacaccaacaaagaaaggcatactaaccacttgttcaccggattgcttgtcttgtacttgtaaatacttatttatcttaaatattatttagatttatttattatattattttttttattattatttacctattttatttgattttaaattcagttttaaatttgtttttaaataaatcttatttcattaatttaaaataactaatattttatttccataaagttaattaaataaaaaaacaaaacaaaaagtagaattatatataatattttttcaaattactctgaagcagtgggacccgaacccactataaaaggcaggcacactaaccgcctgaccatctggccgcttgccacttcacctttcaatgcccattttccttcctttcttttattgcaaaaagctcgaccttgcctccacccttttaatttcctttaaacaaacatcacaatgggactcgaaccacagagaccacgccaccaaaagcaagcacagtaaccacttgaccatcggctggcttgcctccacccttttaatttccttttctttttccttctttttgggaaaaataccgaccaaaagtgcttgagctccctttttagggcacttcccggacccggacccaaacaaccctggtatcattcgaaagccaagagtttgtagatgtgcacaaaactcgcgcatttatattgattttcagaaagcttttgactcagtgccccataacttacttttatacaaattggaaaaaattggtatacggggcaaacttttaatgtggataaaaagctttttgagtaataggacttttcatgttaaaattggggatgctttatcctcaaataaaaaagttggctctggtgtcccccagggctctgtcctgggccctttattatttttggtctatattaacgatcttcctgatgctttgccatcaggagtgaaaataaaattatatgctgatgatgttaaattatatatttgttataaagcaagagccgacacggaaattatgcataaagcattgcataatttattcgaatgggcaaataaatggcaaataaaagtttcaattcaaaaaacttttgtattatatttgggttcaaaaaacccaaaagaaacatataaatttgatggaaatacaataaatgctgtggatacaattagggatttaggagtaaacattgataataaattacaattttccgatcatattaaccaaataacaaggaatgcgtatttacgtatgcgttccttgtttcgaataattaaatccaaatcatctaagatttggattacgttatataaaacttatattaggcctttattggaatacgctccggaggtttggaatccgtctcttcaaaaaaatattaaaaaaatagaaaagtgtcaaaaatatttcaccaaacgggtattttttaaatgcagccttccaccaattccataccaaaatcgattagaatacctgcaactgccgacacttgagaataggcgaaagctatttgatctgttcatggcgcataaaattgtttatggccgaacagatctgaaactattttcaatatttaatccatcgacacgctttaacatccccttttacaga

SEQ ID NO: 47467 - DNA, 2280 bp, Heterodera glycines
  Genomic contig location: Contig_ID=SeqID_17650; Location=178..2457; Strand=+
  SCN-specific regions: Sequence locations=1-362,384-488,510-617,647 -875,897-1405,1427-2280
atggacaacgcactgattgtgcaagcgctgaccgacaaaagttattttacgcgcaatgatttggacgacgaagcgatgggagacgacggaccattgacgacggaagttgcgagagacaaatccaacgaccaattagtggagaaaggtgctaccaattctcatcttttcgttggggctaattttccccgaaaacccattttcaaggaatgcccctctttcgtcatatcgtactcacttatttgcgcgcccattggcctttggctcccgaggtaaacatttagattaaaaaatctcatttgatttgggctccaagtacaaataagtttattatttataatcagaacgccaaaactttgcaaaacttaaattttcttgggattttcccttgtaaaaatggaagagccgatctcgagttaaaaacttaagtttcataaaataaacttggaatcgttagagggggtcaaaaaactagcctaggcaaaatttcaagaaaatctgacccgaggaaaatttttttgaccctagtgaaaatttcaataaatttaactcttttttagccaagtgcgctatttaaagccaaatcaaataaaacttacaatattctccagaattttctctttaaaatgaatataaaattattatatttggcctattattgtccgagttataagtctggaaaatttcataaaattgtcgatgttgtacgtaaccaacgctttttgaatatgattttttattgacacgaaaacttctattaatgcaaaaataattcttcctttcttctttaaacgaagaaattgaaattaacacacaacataaggaggactcgaacctgagaccccccttttggtgactaacgcacagaccactaagacgaaaaaaccaacttaattgtacttggagcccaaaattgactcgccgtgtagaaatgagaaatttatacatttccgaaaatggattttaacaattttgtggaaaacataagcaatttgtaaattattttcagttcattcgggatcaaaaaatcagatttttaacaatttttttgcagcatgctttttcaaaaaaaattttgaggaatgggcgacgggatgaggtcgaggcggtgccgataagatcgtttttattataaatgcaaaattaaagggaaagcaaacagattgtttttattgaatgaatgctttcaaaccagaaattaaaacagaccctcaaaataaatagtcttccgagcctcgttgaaaactaattttcaccttttgatcgaaaaccccatccgtttagctcttaacaccaatttctctctccggtttcattatggcccctttccaggaattcatcattgccgtggccacccgaatcgcccccacttcggcgctggccgagttggccacccaattaggcctccaccacgtggtcagaaccgcggagtttcctcccactcagcaaacgctccagtcgacactgttggcccttatcggtgccatggacgtggcaaaagcgcgcgacttcgtccgccgttttgtgctgccgcgactgtacgaagtgccgttggaggatgtgctgccgttccggcatcccttcgccgtgttgggcgattatttgcgcaaatggcaaggggtgcggcgaagagacttgcattctgtcttgaatttgatttgtggtttgcttgcaggcaactgacatcgaaccgcgtacaattgggtcgggtgctgttatgacagcaacgcctttttacgaagtcgcgatttacgtggacaaacagcaaattgttggacaatgtgggttttcttagctccatgattcaatgttaaatccgttgattaaagcgggcggtgaattcccttgggttgcgttggatttggccgctcagaatggactgcttcgcctgtggcgagtggctgaccatccgcgcgtgttcccattcaaatttgaggaagtgtacgcgacccgatttgagcaggcccagcagagaaaccatcggctgagcgacgtttgcggagaaaagtgagtgggcgagggagaggcggcaaaaacagagccattggtcgcgatgatgcgaatgaaccttactgtttcagcaccgacttgagtctgtacacgcccgaagaactggccagagacccaattgacatggtcgacatgtgcaaccagtactacacgaagatacggcccgatgtgggcattcccctgcggcgaaggcaacggcataagttctcccgtgggacgatcagtcggctgagtaggcgatttttggtcaagcccaccattttcaatatctga

SEQ ID NO: 47468 - DNA, 1366 bp, Heterodera glycines
  Genomic contig location: Contig_ID=SeqID_2888; Location=1520..2885; Strand=-
  SCN-specific regions: Sequence locations=1-218,247-711,733-825,848 -890,915-956,1033-1090,1113-1134,1157-1157,1179-1366
  Gene Ontology: Mol. function=lysine-tRNA ligase activity; Cellular component=cytoplasm; Biological process=protein biosynthesis
atgacccttggtactcgaatgtcatgttttttttgccgcttatttattaatgtaacattttgttttcccaatttgaatttccattttttttttgcacagaggcacgcgacttttttgaccgtatcgccactgaacacggcgtggactgtacacagccgcgcagctgtgctcgcctgttggacaagctgatcggcgagttcatcgaggtgagtagttggtaattttaaaaaaaattatttaaattttgtaacttttttagcccaaactgatcaaccccacctttttgactgggcatcctcaaattatgtctccgttggccaaatggcatcgctctcggcccggcctcaccgagcgctttgagctgttcgcatgcaccaaagaattgtgcaacgcttacaccgaactgaatgacccgctgcgtcagcgtgaactgtttgaacagcaggcgaaagtgggcacagaattttttttactgaaaaatttcccccgtcgctcttttagtattttcttgccgtttttcaagagtctcacgattctcgagtagagatagtaagcggaaatttgctttccgcttctttattgacgatagatgggttctaatgggtcctaaaaattagagttgtatcaaaaaaaacaattttttttcatattttccgtgttacatattaatctttccttttcctactgttgcgtacaaaatttttttttacaaatctattttccatttttatagcaaaattaattggcttatttgtaaactttttcattcttcccaccaattgtaagtttgtaattttttttttttaggctcgtgaggctggcgatgacgaggcccaggcggtggatgagaatttctgcaccgcgttggagtacgggttgccaccaaccgccggctggggcatgggcattgaccggctgaccatgatgctcaccgacagtcacaacatcaaagaggcaaaaattatttttgaaaatgaaaaatttgtcaaaaaaaattttatagaaattttgcaaaaaaaaaaaaaaaattatgtaggctttgaattttaattttttgtacaatttattgcctcctccaccgtttcgttcgggatttaaaatgtcaaaattatgatttttttaaagttgtagaaatatttaaaaattccaaaaaacataatttttcttttgaaagatttatcttctcgtaagcaacctcttttgtttgttattattagggttataagttgtatgattttgcatattttttctgcgcatatgcaatgaagaaaggggctcaaaaatagcatttctgcgttaaaattttttgatttggtgaaggtttttagtgcatataaaagcatattttggggttttcgagaataaa

SEQ ID NO: 47469 - DNA, 1172 bp, Heterodera glycines
  Genomic contig location: Contig_ID=SeqID_17677; Location=2234..3405; Strand=-
  SCN-specific regions: Sequence locations=1-83,106-306,341-707,730 -992,1016-1172
  Gene Ontology: Mol. function=protein phosphatase type 1 intrinsic catalyst activity; Cellular component=bud neck; Biological process =protein amino acid dephosphorylation
atggcagtgcccttcagccttcaagtggacggccttatctacagagtcagaaactccacttacgggcaatttcccttagatgtaattgttttttgcttttcaaaatcgtcattattcttcccttccctttttacaggtgacggagcacgacttacgccagctttgcgatgccacgatggacgtcttccggcagcagcagacactcgtcaggattcaaccgcccgtcaacgtctgcggcgacatccatggccaattcacggacctgctgcggatcttctcgacgctgggccccccgccggagaaaaaatacctcttcctcggtgactacgtggacagaggcccccaatcgctggaaacggtggtgctcctcttctgttataaggtgaatttggaaaggcaaagaattacggggcagtaatctcattttttaaggtcaaatatccggagagtgtgacgctgttgcgcgggaaccacgagtgcagtaacatcaacagagttgtgagtcgagcaacgtttaattggcaacggatggcactaattcagccttgttttagatatggcttctactcggagatcgagcagcgctaccaccaagcggacactcgacggctcttcgacatgttcaaccaaacttttgcctggatgccgtacgtgggcctgatcggggacaggattctgtgtgagatcgacttgttgtttcattgctcaaattaatttttctcttcatttcaggcatgcatggcggcatttctgacaggatcaccagcttgcagcagctcaacgaattacgccgcccgctgctcaccctgccgagcccgtcgttggagatggatcttctgtgggccgatccaatgctcgacatccgcggtgtggagccgagcccgcgcggggccggcgtcgtctttggcgaggacgtggtcttccggatctgcgagctgctcaacctcaactacataattcgggcgcatgaggtaggcagggtggacagatttattttcttcaaaagtttcccattttttcagctggtgcatgagggcattgaatatttcgccgacgaacgtcttgtcactgtgttctcggtgccgcgctaccacaatcaaatgaacaccggagcagcactaacaatcgcggaggacctgagccacgacgtcacattcttcccgccaaattga

SEQ ID NO: 47470 - DNA, 962 bp, Heterodera glycines
  Genomic contig location: Contig_ID=SeqID_17684; Location=598..1559; Strand=+
  SCN-specific regions: Sequence locations=1-189,326-411,512-547,701-962
  Gene Ontology: Cellular component=nucleus; Biological process =regulation of protein activity, epigenetic
atgccgggggcaccttttcacaaagtgacaaaggagaactatgtgatcgaacaggtgcactcggtaatgatgcaattaagcgtaattaacataaagcaggtggtcgagtcgggccccaaattggttaccacgacgcgcattgtttaccctccggcacagcaacaacccctgggggcacagcctcaaacgcaacaaataccacggcaacaacaaaatcagccaaagggacaatggcaagcgaaaccggaacaacagcaacaacaacaacagcgaaaaatacaaccacagcaggacggacaagcgcaacagcagcagcagcgacaaccgccgccgcaagtgccgttcaaaacgcagcatcagaaaatggcacaacccacgcaacccccgcaacggcaggaacaatatgcggtgcaacagcagccacaacaacatgaacaatatccgatgcagcagcaaccaaaacaacagcaacaagcgcaacaatattcgattcaaccgcaactacaacaacctgttcagcaagtgcagaaacctcaaaattttgccaaacaacatcaatacgttcatcagcaagtgcaatttcaacagccgcagccgcaacaacaatatgaacatccacaacacgcaacagaacgggaacaacatcaacaagcgcaacaatatgtgatgaagcaacagcagcagacacagcaaaagcagccccagagagtgcaaattgttggacaaatgcaactcggacaaattgaacaacaacagcaaaggggcggaggaggacaacaaccagagcaacaacaaaagcaagcagtagtaggacaacaacaacagcagaaggagaatggccaagccaaacagcagccgaagcagggacaatttggacaagaagaagagcagcagtacaacaagcaaaagagcaacagaaatggaacaacagcacagcaaatgaacaaccctatcagatccat

SEQ ID NO: 47471 - DNA, 1195 bp, Heterodera glycines
  Genomic contig location: Contig_ID=SeqID_17688; Location=1358..2552; Strand=-
  SCN-specific regions: Sequence locations=1-460,484-499,521-579,602 -618,645-771,799-1195
  Gene Ontology: Mol. function=structural constituent of ribosome; Cellular component=mitochondrial ribosome; Biological process =protein biosynthesis
tgtatgtaattgcattcttgtttttttaatttaatggaaatgacgctttaaaccacgaaactgtcccatgtttaaaggcttcttcctccgcctcgggtggccctccgcccccgtccctcgagggcgcggcggccgaatttccgtccgcctcggacgaaacggaggagccgctgcaggccgaacggaagcgctacgattacaacagcgaaactttgagggaattggggtaatgaaagcgcgacaaatatactaaaattggcctgccaattgtcagttatgacaaatacccctattacgtggagagagcgtggtggaaggagggccatcgcatgacattttggccccattggcggcaactcgcggacatcaaacggcgccgattggtggccgagtggggcccaatgaggtaaaattgccaatggaaatgttgccgtacgatttttggaccataatttctttcattttaaataaaataaaaaaattccgagcacatttctattaaaaattaaaattgaaaccatttaaaaaaatgttttgtgacaaaatactcaaaaaccgatctttcctggccattcttatgaaactttaaatttttacaaaacagtaacaataccaaaaatgcttatttgatttaaaaaatttttggaccgtaaatttccattttataaaagcccaacatttttgctattatttaaaaaaataagctaaatgaagcgcaaaaaagaaaataaacgttccaaaaaattaataatggaaaaataaggtgattttttattaattttacttttctttccttcacaaatttcactgctaatccccccccccccccatttaatgtttcatattttcataacaatgaaattccaaaacttaatttgcacagaatgcgctacaaggccatgaagacgaacaacattttgccacgtgtgataatcgacgagtttcaggttatccccgagggaaaatgaatattggcatgggggcggagattattgcaatttttggagcaattaaacccaattttcaggaacggatggataatatgccgcgtcgtgcgcaccccgttctgatcatccaaatgtgccaattcacttccaagcggcgtggcaaactcaacaaattccgtgtcagtcggcactgtttcagagacattgcggacagaggaggactcagcggcattcagaggggcatttgg

SEQ ID NO: 47472 - DNA, 960 bp, Heterodera glycines
  Genomic contig location: Contig_ID=SeqID_17705; Location=39..998; Strand=+
  SCN-specific regions: Sequence locations=1-38,62-534,559-960
  Gene Ontology: Mol. function=isoleucine-tRNA ligase activity; Cellular component=mitochondrion; Biological process=isoleucyl-tRNA aminoacylation
atggcctccgtccgttggattggccctccggcggtgtccacgcgcgcgcgccccgtccacgtgtacgccatggtgtggaccacgacgccgtggacattgcccatgaacaacgcggtggcggtgaacagagccgtggaacactatgcattggtggactttcccaaggaccgaaggtgggcgccaaacccatgagagcggttcgcttcccctcccttgaatttttttaagaagattttcagtaatagaaatttttcaaaaaatttcaagaagtaattcatcataaaattttgaaaattgctacataacatagccgaggcaaaaattttcaaagtaagaaatttttcaagaaaaaatctttaaaaaaatttttcttagaaaattcgtagaaaaaaaatttctaaaattttacagcgattttttcaaaaatttttgaaaaacaataattcatcattaaattttgtaaaaaaatcgccggttttttgaattttttttcttcgacttttctcagaaattttttttaataagattctaagcttaaatttattttttaaaattattcccggctctgtttcggcggctgtgttttgtcctgttaaaaaactatgtttttttttaaaaatgtaattttcatgcagattccgcatcattcgcgacctgtacattgtggcagttgaaatggtgccgcacattgccgccgaatttggccatgaaattgccgtgctcggcacagtgtccggcgcgcagctggcggacagcggactgttctacagcaacgcgtgggccaacaacatacaggcgctgcccgtcctcgccgcgccgttcgtcagcccatccgccggcacggggctggtccatgtggcgtatgcgcatggccaagacgattttgaggcaataattttctcattattcggcggggaatggaggaaaattcaagcccctcccctcgaaattgaaaaatga

SEQ ID NO: 47473 - DNA, 1307 bp, Heterodera glycines
  misc_feature (30)..(30): n is a, c, g, or t
  Genomic contig location: Contig_ID=SeqID_17706; Location=1..1307; Strand=+
  SCN-specific regions: Sequence locations=1-273,306-640,662-736,764 -901,924-1307
  Gene Ontology: Mol. function=isoleucine-tRNA ligase activity; Cellular component=mitochondrion; Biological process=tRNA modification
cggacagcggactgttctacagcaacgcgntgggccaacaacatacaggcgctgcccgtcctcgccgcgccgttcgtcagcccatccgccggcacggggctggtccatgtggcgtatgcgcatggccaagacgattttgaggcaataattttctcattattcggcggggaatggaggaaaattcaagccccccccccctcgaaattgaaaaatgaaagaatttttaacgaaactgaaaatttttgaaaaagtaaaccgtttttcttaaccgttgggcccaaaacccttaattttctttaaaaattagaaaagcgatatgcaaaaaagaaaaaagggtctctgtcggtgaaaagtcttttttaccaatatccgctcaaaaatctcactccaaacttttttcaaaatgcccctggcaacactttttttttttacctttctccctctctctaccgtccagcttggtcgaacgcaggagggcaagcagtacattcagtgctttgtggacgagcggggccgctacacgcgcgagatgggccacgaactgtgctggaaggaagtgctgggcgacggacagcgggccgcgctgaagcgcttacagttcagtacgctcgctataagaatttcgactaaatttcttgcatttttaaaatttgggccaaaatttatgaccgatttttttaatgtttagtcgaattctgaggcacaaaatttctgctgggttgaaattgtcacgtaatttttaaacagtttaaaaaataaattcgctgtttttcagattcgacgttttgcatcagtccgaatatgtgcactcttacccttacgattggcgaaccaaccaggttatcaatgaactaacaataagtgagcattgatggctgagattttactttggcatatcgattatatatatatatatatatataccggtctgaaaattggcacaaattttatacaaaaaaaaacaaacaaacaaaaatcaaatgttaaggcgttcaagtttttcattggtgacctttttagaaacaaaaataaaaaatgcaaatttttatgatttcctcggccagagcggtactgtttaaaaaaaagtaaaacaaaaaaataagggacagcttttgtcggagcagggtcgtcccccccccccccccccccgaaattttttaaattttcaaactttacttcttccccagcccgtcatcatccgttgctgcccccagtggttcatcgacgtgaaggaggtgaacaagcggtgcctcgctgccaccgaaggcgatgcgccggcggtgcaaatcgcgtcgggatgccaaggt

SEQ ID NO: 47474 - DNA, 961 bp, Heterodera glycines
  Genomic contig location: Contig_ID=SeqID_17724; Location=513..1473; Strand=-
  SCN-specific regions: Sequence locations=1-611,634-801,823-961
atggctaatagggctgattggacatcaccggatttctgctctttgctcatttatgtataaatgctttcattatcaaatttttagcaggtaaaatggcctccaaatttgtattcagtcttcgcttttcctacccaaggctcttaaccagcagtgccctcaacaacaaaaaattggtgccaaatctcattcagtctcggtcaattgtgaccaaatttgacctggaattgcctgacgattacccggagccttggccctacaaacaatgggggtaaaatttttgcaaaaaaattcattgtattactagtataaccattaaatgttgttgttattggtttgctgtcctccctcgtcagcttcaaccaattcatgcaacatcttgacaaaacgctgaagcgctggcacatcaactcgaaacttatcgttttcgaaagcaacattggcgtgggccgggtctgttttttgggggtattcaaacggcaattttttcgaaattcaatcaaacaattgatttgatgtctccccataaaatgattttataaaatttcggtttgccatacctaaataagttccgcagtcttaaacatcgcgttttgtggacctttcaaaatttatgagttcttggttcaaaaaatttattttagtcgtcgatcgcaaaggaattggccgatgcgttgggcttttattatatgccggcctttaaaatggacgacattttggttgaccgttacaacaatgacatgcgcgactattatcatttggtctgacaattggcacacacctaaatttttggcatttctccggttatgttcccctaaaattcattcacatattttttcaaaaaaatgcttaaaagccattccggtccggtttcggtgttaatgacgcattgaaatggatgccaaaatcgcattttctccaaatcgaaaagccaacaatttttttacggaatttataaaataaa

SEQ ID NO: 47475 - DNA, 1819 bp, Heterodera glycines
  Genomic contig location: Contig_ID=SeqID_17734; Location=1..1819; Strand=-
  SCN-specific regions: Sequence locations=1-343,365-373,395-434,458 -466,489-589,611-1226,1248-1819
caaaataataatctcctccttctgcagattttgacgctattcttcactgttttatgtctgatttgcgctttctttcatttcttttccttttacaatttgtttcccaaagtaagctttccattctcagtgaaattaaagccattttttcccttgctaattaggcattttcgagtcgggatttcctccaggagagggcgattaccggcatttatacccgcgattatgtgtcaccataaaaatcaatgaccataagcatgtgctgtcctattttatgggcatggtggaggattttcgctggccaaaggtgcgtttatcggaatttgaaatacatttacgcatttactaattgtcaattgtttttaggatcggatgcacattcttttctttgaagaaaaaccaattttaatttcggagttcgttctgctaaagtccataacttttcttttttaattttcagatggatggaaaaattccctcgcggtttttatcgactgattttgcacaaagacaaattcgataattggcgggaggagtctcttctctttggccggtccaattcctgtacttttcttctcattttggacaccgactgtttccttctgcgcgactccattcgccaattgatttcgcttgacaaattggtggtttcgccccttctcatctctccattcggtggccaatcgaatgcccacggtttactcggggagaaatttgtgcagggacagaacagagaaaacgtacaggttggcaaaacgaacagagaaaataagggtattttggcaattaatgctaatgaaggctttggtttcccactaatattttaggcttactattcaagcggcccaactttgatcaatttgaataagatggactcttcttatctgacctttgaccagggaaacattgtcaattatcacggcaatggccacccaatcgatgtctttgccttttccgcttacgcaatgaacattccgatattcttctcaaatttgcacaattatggctattttatcagcccaaactcactgagtaaaagcgaacaaatggccgttgtatgtcacttttcatgtgccgaatgaaaattgttttagttcggcacttttttggctgattgggtttcgaatgtcggcccaatgcccttcccggtctcttccgttttacagccgtggtacccagtgccgattaaggtaattgataattcccttttaaattattcctctttaattcagtttggttttgaccaagtttatcttattaaccttcgacggagaccgcaaaaattagaaaaaatgcgggaagttcttcatctcgtcggcttggatttcactcacttcgaagcagttgatggacaaaatttaactgaacacgaactttcagcaattcattttttgcccggattcgaagacccctattacaaaagaccgatgaaaaggggcgaaattggctgttttttgagtcattttaaaatatgggaggaaatcgtgagaaatgggcaccaacgagcagttgttttggaggacgacgtgcgattttcgccgaatggcacattaatgtgagaagagaagaatggaaacgccaaaattgaattttagtcttcaaaaaacaatggaagatttgacaaagactcgacttgattgggacctgatttatttgggcaggaagcgaattggcaccgacgaaacatttgtgccgggtaagcacaattaggggctaaaatggggacggaaacccaaagacttttattttcaatgtatgcttttctaatcattttctcatctccaatggtcttagaaaatcgctttctgagcacagtcgctta

SEQ ID NO: 47476 - DNA, 315 bp, Heterodera glycines
  Genomic contig location: Contig_ID=SeqID_17747; Location=1..315; Strand=+
  SCN-specific regions: Sequence locations=1-315
tccgtgttgagcatgtgaaaccgtccggctcccggcttgagtttctgcagcgatgcaaagcgaatgacttgcagaagaagcagcacaaggagggcaacgcaccgtttgtggcgctgaagcggaagccgaaggagccccggggggcgcacttggtcaaagtgaagagcaccaaagttgagcggctggctcccgtcaaattcgaaattgtcgcttgaggcattatgggggcaaacgaatgcacgagcacagaaaaccaaccgacaattgttatttttaatttgttgatccgtttcgtgttaaagaaaaagttttgaa

SEQ ID NO: 47477 - DNA, 286 bp, Heterodera glycines
  Genomic contig location: Contig_ID=SeqID_17747; Location=1510..1795; Strand=-
  SCN-specific regions: Sequence locations=1-72,97-108,146-286
  Gene Ontology: Mol. function=DNA binding; Cellular component =nucleosome; Biological process=nucleosome assembly
cgcctgtctatctggcagcggtgttggagtacctggcgtcggatgtgctcgagttggccggcaacgcatcgcgggacaacaagaagacgcggatcaacccacgccacttgcagttggctgtgcgcaacgacgaggagttgaacaaggtccgacagcagccgatttttgtttttttttgaaaattgtgatttttcagcttctctcgggcgtcaccatctcgcagggcggtgtgttgccgaacattcaggcggtccttctgcccaagaagacgcagcacggcgaaagt

SEQ ID NO: 47478 - DNA, 1361 bp, Heterodera glycines
  Genomic contig location: Contig_ID=SeqID_2904; Location=473..1833; Strand=+
  SCN-specific regions: Sequence locations=1-366,389-447,469-1361
  Gene Ontology: Biological process=embryogenesis and morphogenesis
atgactattgttgggaaaaggggatctgctgtcaatgccattagtaggtctccttttggcgacgacaaagactcgcgccgttcggtgtcgccgccgggcacaaagcgtgtacggaacggcggtggcggtggagacgatgacagcgcacgacgcaatgacagggacagcaagcggagcggtgggcgaagggaacgtaagttggaagctgggtgcaattttcaccggaaacttattcaaaccaaaaaaaaatgtttgaattttttttttgggtagggggaacagcgactccattaaatttttcatttttttaatcaaaaagaaaatccaggcaccgctcgtcatgacgaggaggagcgagaccggagcgacagggaccgggagcgggaccaccaagagcgggaacggcgacgcattggactgccgggcaagccgaagtcggaccatgtgctgagtgagtggaaatggaattcaggggggagggggtcaacagccaaatccgctataattgggtggaaccccgacatttgcggcccaacttttgtggcgccgagatttgcgccaatgtccaaaatcggattctaaattgaatttttttttaagccctgatagcataaacagcattaaaattaagaaaaaactctcttctaatttattaggaacattaattctgttgtttaaaaattgtgttatttttcaaaaattcattgaagatcacaaatgatcagatacaatcactttcaatcgcttatttaaatttccccgtattgaacccttttgtggtggacttaaaaatatgtttttgcagttggctcgcgcaccctttggttcggccgtattccctcgggcgccaccgagtcggacatcattgactcggtgaaggaaattggtcttcctgaaaaggtgtcgttggtgtttggccgtggttgtgcatgtgagtgatgaagcggttgctgatgcaaaaatttttgcttgaaaatttcagacgtaaccatgccagaccggaagttggccttcaaaattttggatcggctcgctaaaaacatccgtgtgcagagcaaaaatgttaaagtaagtctcatccattggaacagtttcattgtcagggacataccccacccaaaaatgcgtaaaattttaggtcgattgggccaccatcccgtatctgaaggacaatatgcaattgatggatgcttattgggacctgaagcagggctacgcgcaaattccgttctccaaattgccggacggcaccgtcgactcgctgatggacggcgcgtggttggagctggatacactgccggcacatttgaggggtgagaattttcaagtgtaaaactgtagatttcaatttctcctggtaa

SEQ ID NO: 47479 - DNA, 1703 bp, Heterodera glycines
  Genomic contig location: Contig_ID=SeqID_324; Location=4655..6357; Strand=+
  SCN-specific regions: Sequence locations=1-285,307-365,387-493,515 -1703
atgagtattatcaaaaaaattgacaaagatagtgttgaaggtcttgaaggtagtctatcattgtttaaccttccaccgacaaatgtggctattaataaaacgagcgttcgggagcttttaccattgtccgctctcaaccagacaggaccctatctttttcgtctgttttccgatagtcaatattgtgatcttagcaaaacgtacatgtatctgctcacttcgatagagcgtaagaatgccgccggagaatgggtgccgaccgacgatgcgattgaagaggacaaacatgtaggtgttattcaaaattttggaagcagttttgttcgatcattgaaagtcaacatttctggtgtcgaagtgtttgatagctcaatatactatcactatcgtgcgtacataatgcaggagcttggctattcacatgagattcgcaaagcatttcacgaggctggctgctattatccggatgaaaacagtcaggatagctactcaaacaaaggttttaccagccgagcacagcgattctcaaacggaaaacagtgcgaaacaatggtaaaactcaactttgatttggctcgtcaaaacacacttttgctgaacaatcaggatgttgtgttcacaatccatcggaacagcgatcctttccttctgcttacaccaaaatggaaaaccgttacagatgcggtcaaagatgcacaaggtaatataattacagcagcgcgtgtgacatggcatgataacacagccgaataccgtatccgtctacatgatataagactttacgtacgcactgtagacgtaacttcaagccttaatattgcgattagtagacagttggaaagcacgccggccaaatatgcgcttcgtaaggtagagatgcgttccatcttcttaggcatgggtcgtactgagctgtcacacaacgtgttcacctcaacccttccgcgtcgtctgatttgtgcgtttgtgtcaacggatgcatactcgggcgcccggcatctgtcacccttcaattttgagcacgcgaacgtacggtcaatcagtgccgaagcaaatggtttgacattcccaagcacaccatatctgttatcgtttggcaatcagaaaaaatttgtgcgcgcatttgtggacatgtatgcagggcttggccttgacgattcggacaacaaaacggtgtccatttcaatggcacgatttctcagcggatgggccttttttgtaatcccgatgacatccacactggatgacacgcctggctttgagctgatccggcaaggcacttgcaccgtcaaagtccaatttgagcagcctataaaagcggacggttatgaaatgctcatattaggtgaattcgattcagtcctttccattaacgctgatcgtgtgttgagcactgacggaagtgtatgaaagaaaaataataatgaattcggttcagctgaaaacaattctaaagggcgtgcaggctaccagaactaagtttattggcgtcttcccatcggataaaattccacaaccaaagtggagaagaaaatacccttattgtatgatcataaatacagacaagtcaggaacacggggcgaacattgggttgcctgtttcgttcctaatgcatcaagggttgaatattttgacagtttaggcaaagcgcccaacaaagacttaggcgcgtatttaaacacttttagtgacataaaaatca

SEQ ID NO: 47480 - DNA, 899 bp, Heterodera glycines
  Genomic contig location: Contig_ID=SeqID_17766; Location=189..1087; Strand=-
  SCN-specific regions: Sequence locations=1-39,62-899
  Gene Ontology: Biological process=signal transduction
atgaattcctcttccgttggttatattccgctgctctaccgagacaggccagaatggcgagacgtgaccccaatttacaacagtgctgaggagaatgccgttgtccgaattgccaccagcgaggaatgtccgtgccaataaaaataaatttgcgaaaattttttttgatttagttgacgatgcctttgcgtatttgcgtgccgtaatgaatgccaatgagctcagtgagcggacactcgaactcacacagacatgcattgcacaaaaccccgcaaattattcagtttggtaagaaaattggattttccaaaatattgtatttttttttttttgcaaaatttccttttttcggttatatcgccgtgccattctgcgcgctttgaacaaggatgtgagcgaagaactgcgctactgtgaggagatcatcattgaaaatccgaagaactaccaagtttggtccgtttttaaatccaaaaaattaccaagttatcctctttttcaagtcctggtaattaccatggtccgtttttttaaaccccaaatataccaaatcgattcgtttaatcaggaaaataccaaatttacccatttttagccggataattacaatgaaatgatagaaaactaccaactagcccattttaaacccaaaggaatgccaagttttgtcaattttgttttttaccaagttttgattcgtttttaactctaaaatattgccaaattggtccgttttaagttcgaagaactttctttcgtaattgtctcactaaaattgccgcttttaggcacaatcgtaaaacattggtggacgagtcgggcatttacgctgctgaactgccattcattgcccagcaattgcatgacgagccgaagaattaccacgcatggcaacacag

SEQ ID NO: 47481 - DNA, 1012 bp, Heterodera glycines
  Genomic contig location: Contig_ID=SeqID_17782; Location=1..1012; Strand=+
  SCN-specific regions: Sequence locations=1-159,192-220,246-951,973 -1012
aaaaaattgatataatttatttagatcttcaaaaagcctttgatcaagtaccgcatgatcttttaatatacaaactcaaaaaaactggaataactggcaacttattaaattggcttcaggattttcttcttggaagaacctttaaagtaagaataaatcaaaaattttcaaatgaatttcctgccaaatcaggagtcccacaagggtcagttctaggacctattttatttttaatttttattaatgatttgcctgaaaaaattccaaaagaaatctcaattaaactttttgcagatgatacaaaaatttaccattgctattcaaatgaatcccaacgtaaagttttagaaacagctctaatttcagtctttaattgggctgaaacatggggcttatatttttcagtaaaaaaatcttccgtcttatatttaggaaaaaataacaaaaaaaataccgtacacaattaaacatgcaactattcctgaatcaaaaattattcgtgatttaggcattttaattgacaacaaactcaaattcaacgaacagttttcaataattctccaaaaagcttatctcaaaagcagaattctttttaaaaaaattaaaaccaagtcaaccaagacttggattacagtttataaaagttttattcgaccccttttagaatacgcaaccgaaatttggaatcctcgaaccaaaaaagaaataaatcgcctggaaaattttcagaaaaactttacaaaaaatgttttcagaaaatgctgtctcccctacatctcatacagcgaaaggctaaaatttctaaaactttccaagcttgaaaccaggagaaaatatcttgatatcataacagcctttaaaattatcaaaaatactactcaccttaacccaaaaaacctttataatttttcaaataggaagatcaccttttcctattttggtaactaaacgaaaaattaccaaaacagagcactcctttactaacagaaccacaaaacatctacaagaaatc

SEQ ID NO: 47482 - DNA, 392 bp, Heterodera glycines
  Genomic contig location: Contig_ID=SeqID_17795; Location=2345..2736; Strand=+
  SCN-specific regions: Sequence locations=1-392
atggcacttcccatttacagtcatggccttaaccgcctttgcatttacattgaggacgtcgcctcgggcgtaaaaggcgacggtcagagaataaaaagggaaaagccaaaaaagaaaagagttttcaggtgaaccgaaggtgctcaagcaggtccatttgaaacagaattgaaatgccaaaacaaaaagcaattacgctgaatttacagaagggtgccaccgcttgggtggacgggtgcgatttgcttggcgccgtcgtcggtaatttctgcacagaattggccataaagttggccaaagagcacggcatcggctgggtggtgtgcaagcggtcgaatcattacggcatttgccaacattatgccaaaaagatagcaaatgccggcttgttg

SEQ ID NO: 47483 - DNA, 991 bp, Heterodera glycines
  Genomic contig location: Contig_ID=SeqID_17830; Location=624..1614; Strand=+
  SCN-specific regions: Sequence locations=1-205,228-235,258-678,745-991
atgaaacgaccattcgcctcccaattcagaattggaactcgcccgagccttccgcactcccttccttttgcgcctctccaaaatcgaatggcgtgccgaatttggcgatctgtcgagcggagcggcacggaagttgcaagagcaaatccgagcagatgtaaggcgattaaaccttcattttaactcccgccggaataaatccttcccatttctcagctccattccgcactctccgccgccattggtcccggctttttggactatcaaatcgaagcattgcaccaaggctcagtgattgtggaggggcaattgttgagccgagaagagataagcgatgcccaaagtgtggccatggccttggaacaggtgccattgagaagaatttgaaaataaatccgagtttatttggttacttcgcttaggcaattgtctcccgaggcggcgaattgggcggaaatgcggtggacacggaagggatcagtgtggcgggtaaccaactagcgatcatctgctgatcagcttatgattttcaaaattcacattttcaggccttcccgcccacgggccaaatggtaacggagtggcagcgaaccaaaggcagcaggaggaggaggcaagccaattcggaagcaaatgctcatttctcggctttgaaattcaggccgagagtaccggctacatcatcggtggtgccgtcgtcgtcggcgttctcatcgtcgtttttgccatttttgccattgtcgtttttggggtaagccatgggaagaacggaaatactactgatggtaatctctgcaattccttcaaaggatgagaaaaaacaatacaaattcataagtttatccccataaaattatgccatattttatttaggtttacgatgtgaccaaatttctggacgaacaccccggcggaatggaagttttaatggaaaaagcgggcgaagatcgaaccgaggcattcgaagacatcggtaaatgacaatgtttta

SEQ ID NO: 47484 - DNA, 521 bp, Heterodera glycines
  Genomic contig location: Contig_ID=SeqID_17877; Location=1199..1719; Strand=+
  SCN-specific regions: Sequence locations=1-183,207-521
  Gene Ontology: Mol. function=DNA binding; Cellular component=delta -DNA polymerase cofactor complex; Biological process=DNA replication
atgtttgaagctaaatttacaaatgccgcccttctgaagaaaattgtggaagcgatcaaagagttggtcagcgaagcgccatttgactgtacagaaaattcaatgtgtctacaggttttgcagccttatctaagaaaatattgcaattaaaaaaaccctgagtttaggcaatggatgggtctcacgtggcactgatttccctcaaattggacattggccttttcgaagtgttccgatgcgaccgcaccattgcacttggactgagtatgggcgagctcagcaaagtttgtttgggtggacgattagggcattcagaactatggcacagtctttaaaaggtgctcaaatgttccaaatcggaggacactttgatgattcgctttgaggacagtgagcaggacatggtcacgttcacttttgaggacaccaaaggacggaagcaggacatggggggaaattcgtccgctgtttcgcccattcttttggcggcggtttaccacacgtttcatcaacaaaaatga

SEQ ID NO: 47485 - DNA, 633 bp, Heterodera glycines
  Genomic contig location: Contig_ID=SeqID_17877; Location=121..753; Strand=-
  SCN-specific regions: Sequence locations=1-87,138-374,396-453,475 -520,542-603,625-633
attaaatatatatatttattgagcaaaccacaggcacattagtgctcttatgtggcgcataaaaaaaatcaaaatgaataatgtcaaaaaatacaacaatatgaaatgtaaagtaaaataaaataaaatggaatgaatgtcaatgcaaatgtcaataaatcccttagaactcatacatagcttttagcaatgccctgaattgatttgccttatctgcctgaattggaacaattggtaatttgttccaattcttggctatacggttaaaaaaattattcttactttttgtggttgtgcgccgcattctcaaaagtaatggcctacgaatggggtcgatcagaaaaagtaaaaagtttactagcatcaagactcgtaaaacccttcataattttaaaagcggtagttaagtcagcaatatttcttcgcttggctaattctataagctgacaaatttcaagtctttctgaatatgatctatgtaaaagtccgcattttttaaaggcttttctcgtgaaaaatttctggactttttctattctttctatatctttttttaagttagggttccaaatttcaacagcatattctaattgaggtctgacataagtcttatacattcttataatagttttt

SEQ ID NO: 47486 - DNA, 1093 bp, Heterodera glycines
  misc_feature (1088)..(1088): n is a, c, g, or t
  Genomic contig location: Contig_ID=SeqID_17908; Location=66..1158; Strand=+
  SCN-specific regions: Sequence locations=1-162,185-311,333-725,748 -785,808-850,872-1093
  Gene Ontology: Mol. function=protein transporter activity; Cellular component=integral to plasma membrane; Biological process =mitochondrial translocation
acttcttaacatcgctcgagaggttcggatgcgcagtccggtgacgggctctcaattcgccgcgtggggtgggatgttctctgtgatcgactgcggcctcgtttatatgcgtcgaaaggtaaatttccatggcatttgaagaaattggacaaacattaaaatcatattttttctgcattttatgtgacttattggaaggaattttctgataattaacaaatttttcctgggtcacaccttaaatagggggggggggggcggggtcgacccgctgactgttcgtatgagtggccgaaaaatgggggggggggacttcatattttgtggacaacgacctgaaccttgaaatcctgattttccccggacttaggtttgcatctcatgaaaacccaggtaaatctggaaatcaaaacccattcatgaaagtatggattttaacattttatcgtgaaaatccctgaaattggcgcgagaaattgtgattaatttttttgaatgatcaattttatagggatgataaaaagttaattaattggcaaggcaccagggatggcattccgaggccccaaaaattttcggaattctggggtcaaaaaaatttcggaaatcggaattccgactccaaaaatgtcggaattccgtgccatccctgattggcaccacatttacgggctggcgccaaaatgaattgttcccaggttttatgtgcatttttttaaacaatcaatgtttctgaatctacaatttttcttggccgggtttggcatggaattcatttacaggctttttcaaaaatatttgtttataatatattcaaatacacacactaattatgcaatgccttataatgttaaaaattaagaacagtgacaaacacccaaaaataatgatcaaacagcaattattaatcgtattctcatgactcggactttccgtttaggaagaccctctaaattcgatcgctgctggcggtctgaccggcggtttgctctgtgcacgaatgggttggaaaacggcgctggtgtcggctggtttcggtgcagtcattctgacgatgatcgaaggggtgggcattttgatgaaccgangtgat

SEQ ID NO: 47487 - DNA, 945 bp, Heterodera glycines
  Genomic contig location: Contig_ID=SeqID_17926; Location=679..1623; Strand=+
  SCN-specific regions: Sequence locations=1-468,510-746,768-945
atgccgtgcgctttcagaggcgggcgtcgcattgtgtgccatgacgaccgttacattctgaagacggccgccgagaaacaggcggtgatcgtgtccaacgacgagtaccgcgacttggtacgcgagaatccacggtggcgcgcggtggtcgagaatttgttgctgatgtacagctttgtggacggaaagtgagtagggagagagaagtcgggaaattttttggctaaaattgccaaaaatcggaaattttgctgaaaattgggtaaaaattaattgggatgttatttatttgaaggtttatgccgcccgatgatcccctggggcgacgtgggcccaaattggaccaatttctgacctttgcgcacactccgctgaatgctcagctgtgcccttacgcaaaaaagtgcacatatggcaacaaatgcaagtgagtgaatggcacggcatggacaaaggcgtaattatgccaaaaaaaataaatgaataaataatttaaatatatttttaaagatatttccatccggaaagagtaaacggcgtttggatcagtgcaaccgagcggttggccagcagaatagcaaacggaattggcatcgaaaattcaaaacagctgttggccgcaagtgagttattaggggggggggcaattaaaaaggcgggttattaagggtaattaaaatttaattaccgttttaatgtttgccttcagggccctcaatgatcgctgaacactcgcagagacaaaatgcttcttcttcgtcttcatcgctgttgccgacgacagtacggcacaacaacgtgggacggacgcggtcattaaactgcggcggaggcgtaactgttgcgccgccactgttggtcggattggcatcaccaacgacggcacaaatggaggacgagcagcgaagcaaacagcgggaagagaaccaacaaacatcgattacg

SEQ ID NO: 47488 - DNA, 1180 bp, Heterodera glycines
  Genomic contig location: Contig_ID=SeqID_17939; Location=139..1318; Strand=+
  SCN-specific regions: Sequence locations=1-208,231-281,304-1103,1125 -1180
  Gene Ontology: Mol. function=v-SNARE activity; Cellular component =vacuolar membrane; Biological process=growth
atgtgcaggtatttaaattctacacgagtaaaagattgcattttcacttacacttaaattaaggaatttatgcaatttactgccaaattaattgcggagagatcggcgacaccaagccgaagttcagtgaaagagggcgaatatttcatccactgtatggtgcgacaagacaatttagtcggtgtttgtataacggacgaacagtgcgtgaattggtttttaattgaaaatttaccattaattatattcattcaactttataccaacctaaaaacaagataatgagatagaaaatggttacaatcggagtcgaattttgcaaactgaaatttgccctggggcgggaaaggtgtcccaatcggaggggttatatcatttatattaagcctcaatctgtacaactccaggtatcaatctcgggtcgctttcactctgctcaacaaagtgttgtctgactttgccgaacgaattctcgaattggaatggaaacggatgagcggcgagtccgactgttcttatagcgaattgcctggatttctcacccggtggcagaacccacgtgaggcggacgcactcacccgagttcaggtgaaaacatttaaatagaggcggggcaaataattaaatcgaacgtataacaggacgaagtggaggagacgaaggcggtgctgcacacgacgatgcaagcggtgctggagagaggcgagaagttggacgatctgatcaaagccagcgaaaatctgtcggatcagagcaaaatgttctacacgcaagcgaggaaaatgaacaaatgttgcagctacacctagccaagacagagcattccgtgattttatacctatattcaggcctgtatagtgaacacaattgttggttgaggttgggcgccatcataattttttaaaatttgtaaaaaaaacggtgggcatttttaaaggcatcgaagtgtttattttgaagtcctcatttctccccggatatgggcctgtcaaaattcgaaccaacacaaatgtttccatgagattcctttccattatgtctcttctatttgctatttatattttctacctttggtcacattcccgggatttcttcaaattgaataagggcaaaacgtgtgaccctttcatatttatagaaatctccttgtaatttagtgacacatttttcccaattatca

SEQ ID NO: 47489 - DNA, 540 bp, Heterodera glycines
  Genomic contig location: Contig_ID=SeqID_17960; Location=157..696; Strand=+
  SCN-specific regions: Sequence locations=1-330,352-502,524-540
  Gene Ontology: Biological process=regulation of cell cycle
atgtcaaacgagttttattattcgaacaaatacgaagacgacgaatacgagtgagcgaattggagttcacaaactcattctttgacatttgctcctttgcaggtatcgacatgtccacgtcaccaaggaggtcgccaagcaggtgcctcacaatcggctcatgtccgagtctgagtggcgaagccttggcatccaacagagtccgggttggttctggagtcacctttgactccatttgttctgcttcaggatgggttcactatttgatttggccagctgagcgtcacattttgctctttcgccgtcccaagccgaaggtgaacggcgctcagaagacgatgatgaagacgactgccaatccgagtcaagtccgagttggctgattttgggatgccgatcgatcgagagcagatgaaaaagtaccgcaatcaattccaatactcccactcatcacaccattcctacgtatcgccgtcgacagtctttctatccgatcaaacaccaaccaatgtgctcttaattacctgctgctgacttaaa

SEQ ID NO: 47490 - DNA, 1174 bp, Heterodera glycines
  Genomic contig location: Contig_ID=SeqID_17972; Location=29..1202; Strand=-
  SCN-specific regions: Sequence locations=1-174,196-734,756-951,1092 -1100,1123-1174
  Gene Ontology: Mol. function=translation initiation factor activity; Cellular component=alpha-glucosidase complex; Biological process =regulation of translational initiation
atgatttttcttttagttaaatgtgatgaaatgctgtacagaagcataattgacgaaatgtgggcaaaattggaggaactgaagcggaatgaccggcgcgggattcaggacgtcactttgatttggccatttgtgaaggagttcgttgaagagattggcgcgtggagaggtgaactttcaataaaacaaaacaaatttccaattcgtttttagagcgacagcagcaatcgaaaaaggacttctttattcgtcgagcatttcaggaggtgagttattcaatccattgtccgtcacttaattttaccggactaaaaacggaatttctcagactaaaaacgcgagtccccccgttctggttaccatcgcgagtcctgacctggtcgatgacgagcccaagtcattgacagcattgcgcaaaaggcgttcggtagaagcacaacagtcgccgaattcttcggtgctttttgtcggatcggttggcggatgcacgccgaaaatgctaaattggacattgaagagggaagaaaaacggtgtgaaaatgaacagtcaaaaaagagacggaccgaagacgaaacggaacagcggaagaacaaaacggaaaaggcggtgaaacaggaggtgatcgaagtggacgagcagaacaaggaggaaacggccaccaaagaggcggcgggaaaagaactgacgagtgccacgcacagtcagctgaatgttggcatggcatcaaaggcggtgactttggacatggacaaatggacggaaaaagcaacgcgaggggaggaaattgaaaagggaggcatagaggaggaggacgactcggacgtgtacacactgtcatttggggacaaaacgatgttcgaaattgtcgaggattctccgcaaaacgaaccgaaaacggatgaaacgcagccgctgaaggaggtcaagcgggagccggaagaaagtggcagaaaagaagatgagaatagaactgaagatgaaccggggagaggggaggaagaggaggaaatgaactcggaagaggaggacgaggaagagggggaagaacaaagcgacgaagaggaaggcgaagggacggggagcgaaaggacgggcgcttctccccctccccctccaaccccagcggacaagacattggcaaggccgtattcgcccatcaaatcccccgggtaa

SEQ ID NO: 47491 - DNA, 1919 bp, Heterodera glycines
  Genomic contig location: Contig_ID=SeqID_17996; Location=85..2003; Strand=+
  SCN-specific regions: Sequence locations=1-441,506-517,539-607,629 -1143,1172-1354,1396-1427,1459-1483,1505-1534,1557-1563,1590 -1689,1712-1852,1914-1919
  Gene Ontology: Biological process=salinity response
atgctcaaagagtgcgaagagaacatcaaagcggcggaggaagcgatggaaaagcaacggttgtatgaggaaaatgtgcggctgggccgagtgaagaaaaagggcaggagaagcctggtgcgttttttaaaagcggcgagggtcacggcacaaaaattgatggcacttcctcatcaaaattcggcctttttcggcaaacccaaatttacaataatttttggtttgccaatttggcataaattcggaacgcatcaagctaaaggaagcaaatccccgaaaaaatccatttgaaacactcggtgggttgcagaaaaaaacggggatttgtggcttgctgtttgtttcccgctgagaggagaattcttcttaaaaaactaggaacttgaaaaaaaagttagaaaaattatttttacggttttttcaaaattatatatgatgtactaatattactaattaaaaaaaaatttcaaaaaggaaattttgtaaaaaatttttttttaaaaatctcctttaaatttcaacaacacccgatgaatcattttgaaaattggaaaaattgaacttgcttttaatttttagaaaaaatcttttaattttttccatttataaattcttcatttgtgcaaaacaatttttgccccattttaattttgcaattttatctcgcaaaatgcaaaattgaaaatatgtcaattgggaacaccaagaaaaaggccctcctccgtatctcggtgaacagtgaacacctcaaaattcatgttttttttttcttatttacaatttatgaccggagggaaggggggggggggcgaattcattccgtaattttccatttttccatcaaaaaattgcgattttgggcctcccaaaagcgttgtaatttctttgataaaatgccactttttttcttttttggtaatgaatgccatggtgccatttttgtttttggaaatgcagcaatttatcatccgtcattttgtcattgtgtttgattttttttggcaattgggccagaaaaaagcattagttggccgtcgctccccccgtcccccaaatttcatatttttgtgtttacaattagcgtaaaattggaaggaaattattattacatattgccattagcattactgtaccgtaaaatgatgaaaaacatgtacaaaaataactaacattccttccttcccacggcattttgcgcattcgatggcatttaagtggtgaccgtttccgaaataaaattatccatttttgggtttcacttcattcacagctcatgaagaagtgagaaattgctgcgcgcttttcttcatttacataaattagcattagtaataaagaataatttttttttgttgaaaaattcctaagatttcaaaattttttctcaaaaaacttagtaattcctcatcaaattctaaaaaaatcgcaaatttttaaatttcattataaattttttaagttttttgagaaatttccgcgtttgaaaatttttaaaaaatattttcggggtggggagcctagtgcacccatattccttcttcccctcttttccgtttccaacgcattttttaaattaaatttataaaattgaaatcgcttgcttcttcaaggcggagctgaagcgggacaagaaggaggccaagaagcgggcgcgccagcagcaaaaagagcagcggaaaagggagcgggaggagcggcgccagcagcgcaaattggcggcggcgacgacggcacaaaacggcgtcggcacaggcgcggaaacagaggaaatggcggagcgcagacggcagcgcaaggagcagcgccgggaggcaaagctggcggaaagggaggagcggcgacggcacaaaatgcagcagcagcaacaaaaacaacggcacaaggaggagaagcagcagcaccaacaacaacggaccaag

SEQ ID NO: 47492 - DNA, 879 bp, Heterodera glycines
  Genomic contig location: Contig_ID=SeqID_18010; Location=1349..2227; Strand=+
  SCN-specific regions: Sequence locations=1-205,253-299,325-609,631 -793,825-856,878-879
atgtttggatgtattaatggaggaaagagacgcggaaagggaggcgtgaaaggcttttgtaaagtgagcaaaaatagaataattgcaaaaaaactttatgtacttaatttacggcttctattccaaaccacgttcatttaaaacaatttaagagaaaattttatgaactttaaattttgtttcgagggccactaatgcatttgtgataaagttttaattgtttaaatgtgtaaatttttgttgtttttccaaatagtgcatatataattattacctattcatattttagacagggcgtcataacatccaaggcatcaccaagccggtcatccgccgattggcgcgttgtggaggggcaaaacgcattcccggcatgaactacgatgaaattcatacggtaccaaaaaatgggcaggaatacttttttcttttgttcaacaaaaatgactatttttgacaatatttgttattcttttcgacacactttccatttttcgtaattttttcaaaaattatccatattcagtcaattttcaggtttcgttatatttcacaattattaaaaacgattagttattttctaaaattaaagcaatgattaactaaacgcattaaattttttcaggcagactatgacaacatccaaggtatcaccaacatgaccatcaaaaattttgctcgtcttgatggagccaacgacatcttcaacatgatcgatgagcaaatttggccaaacgattccaattttggaacggtgaatatttcttggttttcagaatcaaaaaactgaatgattataattaattaacaaaaaatatattaatgtggcaaattttaacaaatccatgtagacacaacaggtcaaatctcaaaatggta

SEQ ID NO: 47493 - DNA, 504 bp, Heterodera glycines
  Genomic contig location: Contig_ID=SeqID_18011; Location=956..1459; Strand=+
  SCN-specific regions: Sequence locations=1-215,240-475,497-504
  Gene Ontology: Cellular component=nucleus; Biological process =negative regulation of transcription of homeotic gene (Polycomb group)
atggacggatgggaggcgcgagaactaacattggccagctcgggcaccgatcgccgtctgcacatttgggacctgagcaaaattggcgacgaacagtcgccagaggacgcggaggacggaccaccgggtgagtggaggcaaaacggactaaaatggatccttttaaagaactgttgttcatccatggcgggcacacagccaaaatcagtgacttttcctggaaccccaacgagccgtggtctggaacaaatttcaatttttgtaattttttgtgtctttttcacagatttggcagatggcggacaacatttacaacgaggaggagttggacccggcgatggtggaaagtgttgcggccgcaagcggcgccggtccgatgggccaacaacattgaacacaccagaacatattcaaacaaattctgaagctaattgatgatgatggtctctgtttcctcaacaacactaaatatttattttctgtcatccatttttatgtttttga

SEQ ID NO: 47494 - DNA, 981 bp, Heterodera glycines
  Genomic contig location: Contig_ID=SeqID_18020; Location=184..1164; Strand=+
  SCN-specific regions: Sequence locations=1-256,278-981
  Gene Ontology: Mol. function=phosphoribosylaminoimidazole-carboxamide formyltransferase activity; Cellular component=cytosol; Biological process=nucleobase, nucleoside, nucleotide and nucleic acid metabolism
atctctcccctcgcccctcaaggcgttcgatcaaaatcatcaccgccacccctcgcgcggttcggccatcgcctgctgccagcactcacactttgatgacagcatttgcggccgctttatgcgccgcaatcgctacctcgcgccccattccgccgaaacggcaaacggaacctttggtggcgcattgcacgcggacagaaacgggggcggcaaactgaacggactgagcggcgcactgagcgggtgggacatcagtgaggaaaactgctgggagcagttggaggccaactcggaactgtactcatcgctacagatggacatgccaataaaaggtgccaaaaatggacaaaagagcgaaaaatgccaaaaagacagagtggcctttttcactggttgtatctttcagtgctcaacggttcgccggggtatataaacattttggacggactgaacgcgtggcaattggtgtcggagttggcggatgcgaccggacaaccggcagccgcctccttcaaacagttcagcccggcaggggcagccattggcgtgccactgaacgatgccgaggcgcaagcgcttatggtatttatgggagagagataaatccgtaaaatcctaaatcattgctttccacccaaaaggtctccgatttgcctttggactttcggcggcactctttggcagttgctttggcacgtgcgcgaggtcaattcctttttttatgtgttgattttctatattttctacacatttatttttccgtttccttttcctgtatatttcttttccaaatttcaattcagaacaaaattggccattccaaacgccaaattcaaacaaattaaagcaaatcgtcggtacagtaccctcctctgtctttaccgtatcctgtccttatctgttctgtcctgtcattcttttttattttgcttttcgcaaagattagatatcttttgtttagccggagtttgtttgttttat

SEQ ID NO: 47495 - DNA, 1325 bp, Heterodera glycines
  misc_feature (80)..(80): n is a, c, g, or t
  misc_feature (111)..(111): n is a, c, g, or t
  Genomic contig location: Contig_ID=SeqID_18057; Location=1..1325; Strand=-
  SCN-specific regions: Sequence locations=1-35,57-370,392-419,441-1325
gctcaccgttcgaatggtcataaaaaataggatgatgtaaaataaaaatatttcatgcatgatgactgataatacccctnttcattcgattgttgcattatctttccattntaagatcatcgatgtgagcaaggctgttgcactgctctccaacggcactctgatcaaactgctgcgcagcaaagagctgtctcaccgcgtcaacgccaaggcatggcccaccattttggacattgaggacgccccgtcgctgtccgtggcgcgcagcaaagtgcggaaggcgggcagctctaccgctgctgttgagccgtccatcgcacgacagcccgacgacattttctatttggttggcatttcatcaattcaattttaaattgcctttgtaaaactgctactaatgcgtccccttttttaggactttgctgtcagcaccactggacaactctcgggcattgttgttactgctgttggtgccgcgaaacagtgcaaaagtctgaaaatggcctgcgaactatacccttcccggactgtcaccgtctgcctggacccttactccggactcggcttcactttgtggtgtctttgcaggtgctttttattggcattttccaatgtgcgttcgtttcgttccccgtttaattgtaccttcgttcagtgtctattccggtcatcagagcattctgatccctccgctggagttggagcagaacccactggtgtggatgcagacgctgagtcagcaccgaagcagggacactttttgcacgtattccgtcctggaactttgcctgaaggagctggcgacccaagtgggacagctgagggagaaaagcgtcaatctgtcaaggtgtggtggggagacagaaaaatgataaaacatcaaatagggcgaggggcggggttatttcaatttgttcggtttgttcattgcctattgttctgttctcctcgtacagtctgcgcaattgcgttgttgtggcagaggagcgtccccgcgtgcagttgtgcaacgcgttcatcaaagtgttcgcgccgctcggtctgtcgccccgggcggtgagcacttcgtttggctgtcgcgtgaacccggccgtgggcatgcaaggcgcggccagccccgaccccaccgttgtctatgtggacgctcgtgcgttgcgcaacgaccgcgtgacgctggtggaaaagggtgcgccgcatagcatcgcattgatggagagcggaaaactgttgcccggcgtaaaagtggagggtggaaaggaacaaaatgctgacaaaataacacggttagaaggccacagactctgatcagtttgctcttgaacaaa

SEQ ID NO: 47496 - DNA, 1108 bp, Heterodera glycines
  Genomic contig location: Contig_ID=SeqID_18137; Location=551..1658; Strand=+
  SCN-specific regions: Sequence locations=1-84,106-193,221-345,367 -760,782-830,855-1022,1045-1108
  Gene Ontology: Mol. function=structural constituent of cuticle; Cellular component=extracellular; Biological process=cuticle biosynthesis (sensu Nematoda)
atgcaagaaactcacattgtcctcggcattgcctcgctgtgctctctgctggcaattatcgccaccgtagtcactttgccatcgctgtactcggagatgagccaactgaacaacaaagtgcgcgacggcgttcaagtaaaaaacaattttaaagaataccgtaatttattaccgtattcccaaggccttccgtgtcaacaccgactcggcctggactgacctgatggatgtgcaagtcgtcgtggcaccgccgtcaaaggcccgtgacaaccccttcagctccatcttccgtgccaagcgtcaattgcctggccactgcaattgcggtcccccacaacggccaaactgccctcctggcccacctggtccggccggaccgcctggccaacccggacagccgggaggcgcaggactgcaaggacagccgggagcacctggccaacctggtaagcatcgctacacataattgccataactcgtctcacatagctcctccgtgcccgccccagaacatcccttgtccacgctgcccggctggcccacccggcagccccggagggcagggaccgcccggacagcaaggagcccccggccagcctggtgcgcccgctccgggcggaggacagggaccgcctggcccatccggaccccaaggacagcctggacagcccggacgcagcggaacacccggccaacccggacagcctggaaataatgctgttattttgtaagcattttgatgggctaacttagtttaaatatcattttcaatgtttagcaacaccattcctggcccgagaggagctcccggagcgcctggccaacccggaagccccggcagccaaggccaacctggccagtccggaggccaaggaccgcctgggccccctggtgcgcctgggctgcccggcctgtctggcaacagcggtcagcctggacagcccggggcacccggccaacccggcaaggacagcggctactgcccgtgcccgccccgctcttccgcgatggcactcaaaaagaaaatggcggcggtcaaaaaagcataagcgaaaagtgcaggggaaaagcgaagaaacgagaagaagacataaagcgattctgttga

SEQ ID NO: 47497 - DNA, 2075 bp, Heterodera glycines
  Genomic contig location: Contig_ID=SeqID_3006; Location=178..2252; Strand=-
  SCN-specific regions: Sequence locations=1-18,40-131,201-383,414 -459,487-519,562-823,845-876,898-972,998-1154,1251-1384,1416 -1567,1634-1806,1874-2075
  Gene Ontology: Mol. function=glutathione synthase activity; Cellular component=intracellular; Biological process=neurogenesis
ttacggaaaaaaataaatgaaattttaggagtgatgttgccgaaattacgccattttcactcttcccgactccatttccgcgaaatttgttccgattagcagaaaaagtgcaaaaggtcattaaagcaaaatcatttatttatttgttttttatttagctaattactttattttaaataattgttttccttatttgtttaggctttcaatttgctttactttcgcatttcaaatgattttgactttttgtcggaaacattcgaacctgtcgcgaaaacaaacgaaaatgtgagacgaatgcttaacattctgaaacaggtccatgacgaaggcatcaaacaaacgaaaacagtggttttggcacgatcggtgggagttttggcaaaaatattttatttaattaatttttttttgggtatcgaattatatttttcttaaggattatatgtgccatgtgataacagacaaagaaacaaatgaacagaagtacgagctaaaacaggtaaatgatgggctaactaaaaattagtttaaaaataaataaaaattatttttatttttcagattgaaatgaatgccggccaaattggtgggctttccgtttcgagtcgaatcacagaaatgcatcggcggacattgtggagggcgggcattgacgcgacaaaggaccaagtgccggacaatgaggcgggccttggtgcggcagaagtgttgtacaaagcgtggtgggagaaattttctttaattaatttaatttttcgttttttatttaggaaagctttcgccgacccaaatgccatcattttgttcgttgcgagccgaacaagcaaaaaccgttatggccagcgtcacattgagtacgacattacgaatttggcagaagaagaaggagaagcactgcaaattgtacgcttgtctttgcccgaatgcgctaaaatgtacaaagatggaaagtaaaatgctaattaatggtttttaattaaaatatttaatttttcttttcgattgactcttaacgccgacgaccattctttgcaattggagggactgacagtgggagttgtttacaaattgaatgagcctccgaaatacagtgaacatgattgggaaactcttttgttgttcgaacgttcaacaacaattgtatgcatttgaaaaataaatatttatattatttttattttatttttaattaacaattaaataacaaagcaaatgaaattaattaatttcatatatattaattaaatgggcatggaatttggaagaaatgccaaaaaatcagtatacattctcctctgataatttactctttttagatgtctccaacaattgctcttgatttagccacacaaaagaaagtgcaacaggtggcagacaaaacaattttaagattatttaaaaaataaatatttccaaagattttggcgaagcccggcatggtggagcattatttggaggaccaattggaaattgtgccgttggtaagaagcactttcgcgggcctgtggagtttgactgacaaagacgaagacacgcaaaaagccataaacgtataaaacaaatgaaataataatttaatttgaataaataaaaataaatattttagcaataaatgattatttttttatttgataggatgccattgttcatcccgaaaactatgtgataaagccgaacctggaggggggtggccacaacttcttcgacgaaaaactcagggagaaactgcagcaatttaccgacgaagaacgggaggcacacattttgatgcaaaaactcagcgcaatgcgcgtaaaggcgaggaaaaaataaataaaaactgaatttacaataattcattttaaaaaattattattttttagaattttatgatccgaggtcataagaagccccagttcggtgaaatgaccacggaattgggcatttttggctttttgttgggcgacagaagtgagggaaaagtgttgcacaatgtccaaagagggcactttatgcgcacaaagttggcagaggttaatgagggaggcgtttctcatggcaccggcgtgttcgactcggcatttcttgtgccg

SEQ ID NO: 47498 - DNA, 1845 bp, Heterodera glycines
  misc_feature (1742)..(1742): n is a, c, g, or t
  Genomic contig location: Contig_ID=SeqID_18143; Location=31..1875; Strand=-
  SCN-specific regions: Sequence locations=1-122,144-155,177-1320,1342 -1845
atggttcatattgtgttcgacccaaacattatcggatatgatgagtacatgcaatacggaagtggcatagaaagcgaggattacttccgagggtccagccccttccaacgagggtatggacaacgaggcgcaggggtgggggatgtgtttcgcggactttggcgctttttccttcctattcttcgtcgtgttggcactacagtaggatcggaggcactgagcacggggcagcgagtgctggagagagtgggaaacgaaggagtgccatttaaggaggcatttgtcagcgagggaaagaaaggaattgatacggtgcttgagaagggcggcctgccaaaacagtttggcggtggtcgaatgaagagtataaaaagaaaaaaatctcatgcaccaagccatcagaccataattggacggacaatcagcaaaccaggaaacaaacgtattcgttcagacgcatttggactttactaaataaatggctttccataaaattgataatgacagtgcaaactcaatcaccaatgccttagacttttttcgtattccacccaccaatgtgagcgtctcttcatcaaaagtgtttgagctgcttcccagtaacccactgacggacactccctaccacttcaagcttcattccagtcaaaactttattgatttgtccaaatgctacttacaaagtgaattccgaattcgcaaagaaaatgagcatggtcagctggttgacctcacagcagatgaagttgctccgatccagatgatcggtcagactttcatccgaaacatcaaaatgagcataaatggacgtgaagttttcaactccaattccctgatggcctacaaaacatacttctcacatgagctgtcctattccaatacggcaaaggactcgcatttgaatgcggcgggctattaccgtgacatcggcggctcgcttgagaccggggatggatgcattgcgcgacgcaacctgtttgcaggaagcagaacagcgcaattcattgccaaaattgacgccgatttgttcaaccaacctctctacttgatcaacttctgtgagctggacattgaaattttacccaacgacaacgagtttgtcctaatcactacgcccgctgttgcccagggtgctgcagctgctcctcgttaccgcttcgaggttgtcagtttgaaaatgtatgtgaaaaaagtctcattgatggatggactggcgttggacattgcgcgaaaacttgaagtgaaaccggcacgatatgctgtgaggaaaacgctgatgaaatcaatgttcattagtcatggacgtttcgagtttacagccaatttgttcatggatcaaattccccgtcgtatcacaatggggttagtggctaattctgactatattggaacaatttcgcgcagtccgtttaacttttaaccgtttaatgtgcgcgaaatctcaattattgctaatggccgctcctttccccaagcgccatacgacttggactacccaaattggaaatatgttcgccctttcaatgacatgaacgaagcagtgggattcgccaactcattggaaagcaatggcattagctatgaacagttcggaaaaacccactgcatttatgtgttcaatttgaccagcagtggagatgatcaagctgcgctgtttgacctgataaagaacgggacaacagcggtgagcatcaaattcaaccaggcagtacccaccggggggataatgctggtggtgatgngcgaatgcgactctcttgtgatgttagacaaaaatcgatcaattagcacagacattactatttaaggctgtcattttttgtatgccactatcatttgaataaa

SEQ ID NO: 47499 - DNA, 1437 bp, Heterodera glycines
  Genomic contig location: Contig_ID=SeqID_18160; Location=185..1621; Strand=+
  SCN-specific regions: Sequence locations=1-222,244-869,891-946,968 -1251,1273-1437
  Gene Ontology: Biological process=embryogenesis and morphogenesis
atgacttgcgggttggctgtgaaacgtccgttggaccttggacaggacggcagtttggtggacgtcaagcggccgcgccatggcggcgcatcgccacagtgttcaccgtttcgaccacagctcggcattctggccacttcattgatgcaatccgtgccaccaaaggtttttcgcgctccccaaaatcatggattctcatggcaattttttcaataccaaataaggaggacccttttgggttccaattttttttttgtctcataaaactcggggaaaccatatttctgggagttttcggggtcgctaattattttaagacgtacaacaactgattgctcttcccgtccaatttaagggcttttctagcaattcgcatccattcggcccgggctcggcattttgagtccccgaaagcgctgtcgggtagttgacagtatgtgccaaaatccggttttttctaaaatgccggtccggatactggcgcaaatctggctagtcctgcgctctaataaaattattgtgtctgcataaccgccgccctctcatttttaggtgcctagtcctcctgctttcactggtactgcttccgccggcgttggccccatcggcaatccgtcctcaccatttgcggacgtgtccggccgttgtcgcttgtccagcacccagctggactcgtacttgcgtgccgaaatccaggcgctgaaacggcgccggctgatcccgcgccgtcagggcaattttccggaggaagggttcccgttgagcaccaccaacgttgtcgtcaatgccaacaaaggcactgccaccgctgtggcggcgtccaccggtggcattgttggcacgccggtgagcagcaccagtggcaacgcgtttcgcaaggcgacatctccgtcttcatcaaatgtaagcggtgccattgtaaaaacgggtttttagtgtgttcgatattccgagaattaaacagagcaatggaatttattggaatctcggcactcgcatagatatagtggccccgaaaaatgttgaagttgggcgtacatttttggtttgcaaaattcctttctcttaaaaaaattaaaccaaaaacgcaaaatttggtcattttggacggttaaaaattaaaagattttttcgcggcttattgacgtagctccggcgcagcaccatttgcgcatgtattaaccaatttcgaatccttaacatattaaaaaaaccgaaatttgaaatgaacttttgacctagcatcccagcaaaaaaataaaaataaattttcagtcctcaggactcggagggtgaagcaatgcggaccggcaacgctgatgaggagaagcgtgccatgctcgaagcgctctaccagaatccccaattttcgctgcgtcaggtgaagctgatctgtgaacgcctgctcaaggagcaggaaatgcggctgcgctacga

SEQ ID NO: 47500 - DNA, 1436 bp, Heterodera glycines
  Genomic contig location: Contig_ID=SeqID_18162; Location=1..1436; Strand=+
  SCN-specific regions: Sequence locations=1-14,36-323,367-896,918 -923,957-1063,1085-1141,1169-1320,1342-1436
cctatcaattccctgcaatttgcattttattgttttcagctggtagtcggccgaatccgcagttgtcccgattggtcgggtggggaggacgaggacgtgctcagtttgggccttttcccgggcacttacctcgaattctccatggacgacaggtggatttttaatcatattaaatagattaggtaattaattacaatttcctttttctttcgcagggttttcttccaatttgaggccgcttgggactcttcgctgcacaattcgccgcttctcaaccgcgtctcgggctacggcgaaaacgtttacatgacaatttcggtacacaattcaattcaatttaataattcaattaatttattcattttattaattgtttaggcgtatatggaaattgaaaattgtgcgcagtcggcaattatcaccaaagatttgggtctgattgtgtacgcacgggactcgaagatcagtgcggccagcagattttgccggtcactgatcggcggaatctcaaaaagcgcgggtaaatgggcgacaaaaatggcaacaattggcctaccaagcatttgaaatttttgggtttttttgacgtgccgtcatcgcccccttttttgtcggactttccaatgccaaaaatgcctatttttaacattttgccttcttctgcttgcaatgcaccgcttttcgatgccttcagaaatgaaccgtgtgcccggcgtttaccttctcaccgtaatggaggacagtgaggcgaacaacagtcccggcacggcacggagaaagcggcgaattttggacacatcgtcaacatgtgggaagacagctaacaaaaaagagccatcggttcattctttcattttccacagatgtgcgaggcgaagaaaatcttggcacttggaggttggcggaggaaaagcgaaaattccaattaaaaataataattaaattaaaattatttaggccccgaggggactcaatcattttggagcaccaattggagttggagaagctgagcaaacttcagcaagtggagcgaatgcgactgttccttatggtcagtgcttcgcatttggaaaaatatttttaatttagctgagaaagtcgcgcaaaacgggcaaaggcgacacaccggtgggaaaagtcgaaaaataaatatttaattattatttttggaagatttcaccatgtttgcccaaatttcccattccgaattctgtgaaaatgagtgaaaaggaacgaaaattggccacaaaagtgttggaattgatccgactgaaaatcccagtgaacaaagacccaccgacgggcaaaaaagtgggaaataaatgcaaatggaaaaatacatattcaattgatcgtcagacttttctcggagggatgattcgaacacttttattcataacaaacggcaaaaatcgaaggagaatgatgaacttatt

SEQ ID NO: 47501 - DNA, 1692 bp, Heterodera glycines
  Genomic contig location: Contig_ID=SeqID_332; Location=774..2465; Strand=-
  SCN-specific regions: Sequence locations=1-229,251-1664
atgcatgttgattttgatcctctacaagtggattggtccacattctcgtccgagtatgtgcaatttggtggatacaacatttaccggggattaccctatcagcgtggagcgggagttggcgcagtgttcaggagccttatgagatacttgctgccgataggaaagcaaattggctctgcaattggacgtcagggaatggaaagtggaaaccgcgtcctcaccaatgtgttggagggaaaagacctcaaagattcgctcgttagtgagagtaaatcaagactaaaaaaccttcttgaaaaagcagccaacaacataaacactcagaagggccaaggttttgattttaagcgatacaaaaaagactcgactccaaaaattgtaaaaattaggcgaaaaaatataaataaactgcagtcatcaatcgggccacctatggttgctaaaaccaaaaataaacgtctgcgtattgactcattaggaacctactaaaaaaacgacttgcccacaaaaaatcagtgacagcagtccactagcaattaacagtggtctgaatattttctcagttccacctaccaatgtgtatgttgttcgttcattctttcgtcaggtgcttccgctcgcaacaatcacgcaagaatcgccttacctatttcggctttacagtgacaatttgtggactgatttatctcggatatatctttatctcgaactgtacattgaaaaaccgggagcaaacgataaatgggttgcgatagaggacgcggatactagtgtctctgccattcaagggattggtcaaacatttgtccagcaactaaaagttacggttggcaacacggaagtatacgatagcggaaacctatacccattcaaggcctatatcaccaatgagttaagctttccaataaatgccaagaaaaattttcttggttcaacagggtattatcacaccttaaaccaagatgactcaacagacgaggggttcaaagagcgttgtaaaatttttaagagtggtaaaaatgcgcaattcctctcccgtctcgactttgatttgggaaaccaagagctttatctcttaaataatttggacttgctcttcacaatttacaaggccaaagatgtctttcttttgcaaacattaaaagcaaatgatgcaacgaaatatcgtttggccgttcatgatgtcaagatttatgctaaaatggttgaggtacaaccctcactaaatatgagcctttacaaaacacttgaaaaacaacccgccacgtacgctgtacgcaagacggaaatcaagtcttcattcatcagtgttggtcgatacgaatttgagtacaatgtattcagcgcgaccattcctcgacgcgtaataactgcgttggttggcaattcagcatttcatggtgactacaaactgagtcccttcatgtttgagccgtttgatttgcgttaaatttcgatacatgctggagggattgtctacccagctgttccttataaactaaatttttcaaaagatcactatgtctacgcctttgttgacatgtatgaggcactgggtatggctaattcggagcgttcatttgacatctcattgtcatgggagaatttgatcaaatgattatggttgattacaaccggcacattgtgaccgattcaaagcttggataaattataaataactttattattaaa

SEQ ID NO: 47502 - DNA, 1320 bp, Heterodera glycines
  Genomic contig location: Contig_ID=SeqID_332; Location=3224..4543; Strand=-
  SCN-specific regions: Sequence locations=1-505,528-1320
atgacttgcccacaaaaaatcagtgacagcagtccactagcaattaacagtggtctgaatattttctcagttccacctaccaatgtgtctgttgttcgttcattctttcgtcaggtgcttccgctcgcaacaatcacgcaagaatcgccttacctatttcggctttacagtgacaatttgtggactgatttatctcggatatatctttatctcgaactgtccattgaaaaaccgggagcaaacgataaatgggttgcgatagaggacgcggatactagtgtctctgccattcaagggattggtcaaacatttgtccagcaactaaaagttacggttggcaacacggaagtatacgatagcggaaacctatacccattcaaggcctatatcaccaatgagttaagctttccaataaatgccaagaaaaattttcttggttcaacagggtattatcacaccttaaaccaagatgactcaacagacgaggggttcaaagagcgttgtaaaatttttaagggtggtaaaaatgcgcaattcctctcccgtctcgactttgatttgggaaaccaagagctttatctcttaaataatttggacttgctcttcacaatttacaaggccaaagatgtctttcttttgcaaacattaaaagcaaatgatgcaacgaaatatcgtttggccgttcatgatgtcaagatttatgctaaaatggttgaggtacaaccctcactaaatatgagcctttacaaaacacttgaaaaacaacccgccacgtacgctgtacgcaagacggaaatcaagtcttcattcatcagtgttggtcgatacgaatttgagtacaatgtattcagcgcgaccattcctcgacgcgtaataactgcgttggttggcaattcagcatttcatggtgactacaaactgagtcacttcatttttgagccgtttgatttgcgttaaatttcgatacatgctggagggattgtctacccagctgttccttataaactaaatttttcaaaagatcactatgtctacgcctttgttgacatgtatgaggcactgggtatggctaattcggagcgttcatttgacatctcaatgacccagttcaaaaaagggtgggccttttttgtcatgacatccacacttgacgacagctgtggatttgagctgttgagaagcggcacaacaaacgtacgagccacatttaattcaccaattccagttggtggtgtggagatgattgtcatgggagaatttgatcaaatgattatggttgattacaaccggcacattgtgaccgattcaaagcttggataa

SEQ ID NO: 47503 - DNA, 1399 bp, Heterodera glycines; identical to SEQ ID NO: 18212
  misc_feature (421)..(421): n is a, c, g, or t
  misc_feature (1350)..(1350): n is a, c, g, or t
  misc_feature (1364)..(1364): n is a, c, g, or t
  Genomic contig location: Contig_ID=SeqID_18212; Location=1..1399; Strand=+
  SCN-specific regions: Sequence locations=1-237,259-265,288-1399
  Gene Ontology: Mol. function=protein binding; Cellular component =nucleus; Biological process=establishment and/or maintenance of cell polarity

SEQ ID NO: 47504 - DNA, 679 bp, Heterodera glycines; identical to SEQ ID NO: 3019
  misc_feature (584)..(585): n is a, c, g, or t
  misc_feature (638)..(638): n is a, c, g, or t
  misc_feature (650)..(650): n is a, c, g, or t
  misc_feature (670)..(670): n is a, c, g, or t
  Genomic contig location: Contig_ID=SeqID_3019; Location=1..679; Strand=+
  SCN-specific regions: Sequence locations=1-207,235-525,553-679
  Gene Ontology: Mol. function=RNA helicase activity; Cellular component=cytoplasm; Biological process=intracellular signaling cascade

SEQ ID NO: 47505 - DNA, 3551 bp, Heterodera glycines
  Genomic contig location: Contig_ID=SeqID_3024; Location=202..3752; Strand=+
  SCN-specific regions: Sequence locations=1-158,265-269,327-495,559 -601,625-718,769-990,1012-1225,1284-1417,1446-1496,1518-1895,1941 -2036,2058-2058,2086-2218,2240-2255,2278-2578,2601-2648,2670 -2828,2859-2914,2937-2982,...
  SCN-specific regions: Sequence locations=...3016-3023,3045-3149,3181 -3388,3410-3551
cgaactgtggacggcacgcgtgccatcattgacctgttttgggacgagccaaaggaatggaacggtgaccagctggggtatacggtaaactgcactattgtagctactgtgccagccggccaacagcaaggcaccagtgatgtgcaatcaggtaagatatttaatttaatttaatttaatttaatttaataatttaataagtaaatttttaaattaaattaaattaattttattttaattttaatttaattatatttaatttaacaaagttttaaaataatttgtttttttaattaaattccaataatgatttttaaataatatttgcgcttttcccagtcaatgcaacgcttcgtcgcggcacaaatcgtgcttacaccttctcagtccgatccggcaaaatttcatgcctgatttttgcgatgaatgatcaacgccttgttggccctccatcatcgccagcggccgaaattgatggaagcggttggttaggagaattaatattttaattaagagttaatatattttaactaaaagatatttaagtaattttaatatccaatattttgctaatcaaaaataaatatttcaattaagagatatttatttatccaatattttgctaattgacaataaatatttcaattacgagatatataattagcaaaaaacttccttgctaatggagccaataacaacacaaaactgagaaatgtgcaaattttaataaactttttgtataatttctattaaaaaaaaaaatattatggtccgttggcattccaatgctaaatatgttgccaaatatgttttatataacattttgccagagttcaagccgttgatccgtttgttcgccatcgattccactgacaatcttgtggccatccaaaattggaccattgagtcggtggtaaagccgtctggcggcagcaaagcacgctttttggccaagaacagaaagcgacgacaaattgcgcatacggtaacaaaaaaaaaattttaaaaaatgcttggcattttgtattgaataccaattttaaaaaaatacacaaaatgacaattttttttttacactagattcaatatcaagctatgacctatgtgggaggtgaactgtatgcaattcggaaggagcctgaaatgtctcagttggccttggttaagctggacatcaatcaagtggataccgtaatcttcaaggtccacatgagtgtagtacatgatttttttgaatattcttttaaaatatatttttatttatttatttaataatttattttgactaactaaggcttcattattgggcgaattttctcaaattgatgcaatggcagctgattgggtagcaaatcggcttctgttagtgagcaaacgtgaactgatgacagtaaattttatacacataaatgaaggctaattaattttgtaaatttattaaatttgaattccgataaatttcaataatattttcactatgctgtgttgtagatacaccttgatcagctgcaagattcgcccagcactgtgctgttgaagaagctgttccaactgtcactgggcgctcaggatgccaaacagctcgtttttgacccattcacgaagttggaaaaccttatatttgaagacatttttgaaattttaaagtcttaaaattttgcctaactctgatcagcaaagactatataataagtagggcagcaacttttagtgaaaaaactctttttttgctcaattgttttgaagaaaggagctcaaaaaacgcatttctgcgttaaaattttttcatttggacgtcacttttcgtcactagaaatcactatttttggggttttgtcactaaaatagttaaaaatcactatttttggcgttttgtcactatttcgacattttttggaaaattccttaacaaaaatgcaataaaaccaaaaaatacacccctaagaatcgacctaaaaaaatttcaaaaaaatacacccctaagaatcaaactaaaaatttttcaaaatatactcctatgaaatgaaaaaaattttctcaaaaatttactttcttggcaaaaattttaattttaaaaattttttaggaactatttttgggtttttggtctaaaaatcccagtcctactcatttgcactgcaatcagtgaataaaaattattttggcttattttttggctgaaaattatgtcactattcgtcactattttggactttttgtcactatttcttcactattttgggatttttactcactattttagttaactatttcgggatttttcgtcactaaaagttgctgcgctaataataagatagaaaaaaaccatttaagtgatcagctcgattaaataatagaccctgatcctatcattttctctttcctagtgatcagaattagttcaatgctaattaatcaatccctgataaatccaagagtaatcaatcagttacaattaattcttgatcattttcccattagcacagcctatttgttgaccaagaatggttcactgttttcgcttgatctgaacaaaggcatcgagagcaacttagaactgacaaccggttgcctcaggcaaaaggtaattattttaatgaatgatttgatgaaggcacaacacacaacactcactaattagcctaattacataaatttgttcgcttaattaagacgatcacttcaattgtgggcgaattcatatggaacaaagcaacatctccacaactgtacgcactgacatggaatgggctgatcgagctgaagctgaactcggacaacaattgccctgacatcaacgtcaattggtcactttttgggggtgaggcattttaaaataattaaagattttataatttgttaactctaaaccaactaattatcaaatagcttaaaaaaagtataatttaaaaatctaaaccaattaaatgacaaattcccgatcagttttattcgaaaaattttttttgataaaataaacagtcaaataataatttttgagagtaaaaataacatagaaaagcaaaagcaacaaacatacaaaattgtaaactgaactgacacgggaaaatatccctgccatggatttggcctgttgataaagataatctgatcttgggagattattcggccataattttcgactaccgataatattgataaaaatatttaattaatattcggcatttaccgctcaacccaaacagaaagtggcctgaaagcaatttcgttgttcactgttgcggacaaagtgttggtgtttgccaccccaactgatctgctggtgtacgatcggcaagcggctgcggtgtcccaattccccagtccaagcccaccaattcgtcaactgttggccgtctcacagtcatcccaaccattccctgatcgctactgtttccagctgccacccacaaatcagatcaacttcaatgtgaaaaatgaaggtataaatgtgccatttatcaggaaaatgcgtcagtcagtgctactataatccaagaataatgtagtccacaaaaaacaaaaaagcgtggtttggtgcctccggcggg

SEQ ID NO: 47506 - DNA, 877 bp, Heterodera glycines
  Genomic contig location: Contig_ID=SeqID_18256; Location=123..999; Strand=-
  SCN-specific regions: Sequence locations=1-149,172-605,629-646,668-877
  Gene Ontology: Mol. function=proteasome endopeptidase activity; Cellular component=proteasome regulatory particle (sensu Eukarya); Biological process=proteolysis and peptidolysis
cccgagtcggcttccaacagcgattgggcccggtggttttattatttgggacgcatcgaagcgttgaagggcaccgacgccgagacgtacaaagcggcagagaaacattttgaggttttggcacgagccaatttttaagggttgtacacaaaatttgaaaaagtaaaattatttttgtaacatctaaaatttgggtcaaacaattcgctttgaaattgcattgttttcccttccaaatatttctcaggtcgcacttcgaaaggccccacaaaacggcgccgtcggcttcaaacaggaagtgaacacaagcagaaatgccacattcaattgggctttaatttccccaaatcgttcgcaggtgaacaaatgggtcgtgctggtcaaattgctcatcggcgaaatccccgagcgcagtctcttccacacggccgaacttcgccacgtgttggcgccgtatttgctgctgacccaaagttggttttatgcgcggcgaatggaaacgcacatttggacatttgagtccgggttgtctctaattgtcatccattcccgacgaaaatttagagtccgatgtttccaagggcaacaattttttagataaatttcccccccccccccccccccctcctaaaaagaaaaggtgtggtttcttttttaaaatgtacaaaaattgctgagccctcatcagctgtacgccttggcgacgtggccggctttgaccagacgaagcgcgagcacgggcccatctttgtgaaggaccgcaccgctgcgcttgtcgagcgcatccatcagagcgtcattcggaccgcaattcgcaaaatttcgacgacatattcgcgcatttacgtgtccgacgtggccaccaaattgaatgttg

SEQ ID NO: 47507 - DNA, 1317 bp, Heterodera glycines
  Genomic contig location: Contig_ID=SeqID_3034; Location=2198..3514; Strand=-
  SCN-specific regions: Sequence locations=1-246,268-1317
atggcattccataaaattgacaatgacagtgtgaactccatcaccaacgccttggactttttccgcatcccgccaaccaacgtcagcgtctcatcctccaaagtgtttgaactgctcccaagtaaccctctgaccgacaccccctaccacttcaagcttcactccagtcaaaattatattgatctctccaaatgctatttgttatccgagtttcgaattcgcaaagaaaatgcaaatggtcaactggttgaccttgcagctgatgaggttgctccgattcaactgattggacacacattcatccgtaacatcaaaatgagcatcaatggccgtgaagtgttcaacgcaaattctctgatggcctataaatcgtatttttcacacgaactctcctattcaacagcggccaaggactcgcatttgaatgctgccggttactatcgtgacactggtggtgtgcttgaggtgggagacggatgcactgcacgacgcaacctgtttgtaggcagcagaacagcacaattcattgccaaaattgacgccgatttgtttaaccagcctctctacttgatcaacttttgtgagctggacattgaaattttgcccaacgacaacgactttgtcctaatcacaccacccggtgttgctgcagccactcgctaccatttcgaagttgtcggtttgaaaatgtatgtgaagaaggtgtccctgatggacggattggcgttggacattgcgcgaaagcttgagttgaagccggcacgatatgcagtgaggaaaacgctgatgaagtcgctgttcatcagtcatgggcgttttgaatttacgtctaatttgttcatggatcaaattccccggcgtatcacaatgggattggtggccaatgctgactatgttggcacagtttcacgcagccccttcaactttcagccatttaatgtgcgtgaaatttctataattgccaatgggcgctcctaccctcaagcagcctacgacttggactacccaaacggaaagtatgtgcgtcccttcaacgacatgaacgaagcggtgggattcgccaactcatcggaaagcaacgggattactctcgcacaattcggtactacacattgcatttacgtgttcaacttgacaagcagcggggacgaccaagcggcgctttttgatttgataaagaacgggacgacagcggtgagcatcaaatttaatcaggcggtgccagctggaggaataatgttggtggtgatgggcgagtgcgactcgctggtgatgttggataaaaatcgatcgatcagcactgacatcactatttaa

SEQ ID NO: 47508 - DNA, 1435 bp, Heterodera glycines
  Genomic contig location: Contig_ID=SeqID_18297; Location=659..2093; Strand=-
  SCN-specific regions: Sequence locations=1-42,65-762,784-1435
  Gene Ontology: Mol. function=glycine-tRNA ligase activity; Cellular component=mitochondrion; Biological process=tRNA modification
gtgaaagacaaacaaacgggtgcttgttttagagccgatcacttggttaaaaatcaagtggaaactttgattcgggtatattgcaaaataagccatcattgctaaaaatttatttaaggacaaaaaaactgatgaaaaagcaaagtccgaacttatgaatgtgcttgttatgcttgatgggatgagctgtgatgacttgcacgaagtcattaagaaattcaatttcaaatctccgttaaccggcggtgacttgtccgaacccgtttctttcaatctgatgtttcccactgaaattggacctacctgtgatcagcgagcctttctgagacccgagacggctcaaggaatctttatcaacttcaaacgccttttagaatttaaccaggtattttggtgtttgatgtaattttttattttttctgttaagggacgacttccttttgctgcagcccaagtcggttctggctttagaaacgaaatttcgcctcgacaaggacttatccgcgtccgggagtttacaatgtgtgaaattgaacactttgttgacccgaccgacaagagacatcccaaattcgagaaaattgcacatttggaacttactttgtttcctgcttgcaatcaaatggaatcaaaaaatccccaaaaggttttctaatacaataccaattttaagtttttactaatttttcagatttcaattggaaacgcagtcaaattgggtatcgtaaacaatgaaactttgggttattacatggcgcgaactcatttgtttcttctttctgttggcatttcgcccgataaactacgctttcggcaacatctttccaatgaaatggcccattacgctcaagttgttaatcatattgtttcatttatctgtccgtgtttcctcaaggactgttgggacgcggagtgttttacctcttacggatggatcgaatgtgttggaaatgcggacagagcttgctatgacttgcaccagcaccaaaaggcatcgggagtgaagctcgtagcggagaagaaactcggcgcgccgaagcaaatcgaagtggtcgaagcagtgccaaacaaacagttgctgggcaaagaattcaaatccgattcaaaacaggttcacattagcattcagtttaaaggaaggtcaaaggaataggcacttctttcgtgcttagattcttgcagctttggacgatttaactgaagcacagatcgaggaattggaacgggaaatcaaaagcaatgggtttgtttactcaaatcagatcaaatttaaacaacataatattttttaattgactcaaccaataataatcaaatccctttcagtaaatatcgcttgtctttgcgcgagggaaaaacttttgagctgaactcgtcaatggtggaagttaagcgtttcgagaagactgtccatgttgaagaagtgactccttcg

SEQ ID NO: 47509 - DNA, 868 bp, Heterodera glycines
  Genomic contig location: Contig_ID=SeqID_3039; Location=1853..2720; Strand=-
  SCN-specific regions: Sequence locations=1-868
  Gene Ontology: Biological process=gametogenesis
atgactttctcggcttcggggctcactgatcgaggcgctaacgagatcacttttatgatggaaagtcagcaaaccaatttggtgcagtattacgaccagaagtacaacagacggctgcgctacccacgccttcagtgcgtcattcatcgcagggggagtcaggaatcgttctttccgatggaagttttgcagattatgtgagtgatggaactatcctgttttggtaaatccatttaaaagtcaattatttgatcaaaggccaatcatcccatcttttgtttagcgatgggcagcgtgtttcgctcgacaaacaaacgccgaaactcactgagcaaatgatccgaaaatgccaagttctgcccatcgatttgccgcgtggcattgagacacagcgcgacaaagggatgattcagaatgccaacccattttttcgtgctcacgaagttcgtgttgagacgaacatgatgcaagcggaggcgcaacacctttaccctccggcactcggtttctcggcacaaaatgaacaaatcgaaccgaacaatcgtggcggtcagtttcagattcaaatctggcacttattgttgggctgtcgtttttagtgttggacttccgtttggctgaccgtggacaaccgttgccccgtcgctattcgcttccgtgtgaatttccgaaggtttgggctgttgtcatcgtgcaaagcgccgttcgaaaggatcagtgcaggtggtttaacgaattcaaaaggaaaacggtttcccgttcgttgtccagacagttctgtgagagtttggtccgatgtgcgcaggcgcgtggcgttcagatgggaatgccaccacgagtcgaccattttgaggacacatcgctgtga

SEQ ID NO: 47510 - DNA, 2000 bp, Heterodera glycines
  Genomic contig location: Contig_ID=SeqID_3040; Location=2211..4210; Strand=-
  SCN-specific regions: Sequence locations=1-475,503-978,1000-1501,1526- 1808,1833-2000
  Gene Ontology: Mol. function=extracellular ligand-gated ion channel activity; Cellular component=integral to membrane; Biological process=cell surface receptor linked signal transduction
gaagggcagccaaaggcattcattggcgccgattggaggaaattgcttatgggaccattttctgagcagccatcaagtgctcgagaagctgtggacgccaaactcgtgcttcatcaactccaaagttgcccaaatacacaactcgccctttcagtcagtcgctttaccacgctcaatggcacgcaccaaaagcggcccatttcaggaacatctttttgatgctttatccgaatgggaccatttgggttaattatgtgggttgcttgttgcttcttccattcttcgttgtcttcttcatttttagcgtgtccgtgtgaagggtccgtgtgccatggatttgtaagtgccgacaaacgcaagggaaggccaaatcggtctctgactgaaggacaaactttccaatggacatccaaatgtgccatctgatctacgaaagcttcaactacaacaatcaggaagttcggatgcggtggaactcgctgaacccaacccccgtgtacccaatcaacaccattctgttgcccgacttcaacctggtcaacattcaggcgtaccttgtcgtcgaggtatgggcgcgaaagtgccgtcaaatccccgaatttcagccgtaccccgcggggatgtgggtaagaaagaggggaaggcgaaaagagagcaccaattgaggacgaattgcacgtgaaactgtccttcgagcggcgttatgtgtggtacttcatgcaggcttatgtgcccacctatttgaccatcttcataaggtagtccaactttcgttcgttttgttttgtgattgccccccccccccattttcagttgggtgtccttcagtttgggctccaaagccatccccgcacggacaatgctcggagtgaacgcacttttggtcggttgggaacagtgacaaatgctgctaactcgcattgtcactttgaattcaggcgatgatctttcaatttggaaacattatgaggtaattaactcactgatcgtttttttatacaaataaaaaaaaacaatgggggaaaagaagcaaaaaacggccaaaagtcacgcacaatttggcgattttggagaataaaaaattggaaaaaaggaaaaggaaagtacataatcgaaatggacaattaatttattatgtttgctttaaataagaagatttctccgttgttttgtggccaattacatatttgtttgtgttctgtgttaggaatctcccccgcgtttcctatgtcaaagcaatcgatgtttggatgcttggcgcgatgttcttcatcttctgcagtttgcccgtcccttcggtcgttgctgctcacttagctcaattcccttaaggccttctcgagttggccatcgtcggcttcaaagtgcgcgaaatgcccccgccgcacccgcgcaacaaaaggacgccccccgcggggctaattaaatgcaaaaagagatgggaagagaacggcggggggccactggaaaaagcggagcagcagcggcgccggaacagtgcggacggggcggggcggggcgaggatttatcgccaaagttcggcggaatccgacagagcggcgaaaggcgttttatgctcccgtgggctctttttaagttcctttctaagtttattttaaaggatggatggcgatttcgtagtgcgacttcaccaacgaacgccgcctttgcgcttccgatttttcaatttgctcagtgtgccttcacaagtccaagccgaatccatagacaaagtcaattaacagggagccaatagagctgagaatcgggaacaacgaaaggccggccctcgccttccaatttgcccaaattaattttgttttcttcaaaaggtctctcggattgctttccccacaatgttcgcccttttcaatgtgagttttgctgaccaacaaactccattctgatcaatcccttctcatagattgtctattggtcttattatggacgaaaagcggctgagacaagcgccgaattgcattcgagcggaggaatgatg

SEQ ID NO: 47511 - DNA, 1115 bp, Heterodera glycines
  Genomic contig location: Contig_ID=SeqID_18326; Location=822..1936; Strand=+
  SCN-specific regions: Sequence locations=1-54,76-191,215-1115
  Gene Ontology: Mol. function=translation elongation factor activity; Biological process=protein biosynthesis
atggaccgtgcgctgctcgaacttcagcttggccaggagaagttgttccagactttccagcgcattgtggagaacatcaacgtgatcatcgccacctacgaagatgatgatggaccgatgggtccgatccaagtggacccgtccattggcaatgtcggctttggctctggacttcatggctgggctttcacaaagcagtttgcggagatgtacgctgacaaatttaaagtacatgtttgccacatcgtgctattttgttgtctcttttcgggttcatacacttacacctttttagattgacaaattgatgaaaaatctgtggggcgatcgcttcttcaacatgaaaaccaagaaatgaaccaagagcccgagaccaagcgaggcttctgccaatttgtgttggacccgatcttcaaaatgttcgacgtttcggttttgacttttgtcaccagtgaacaaattaatttttataaattcaggtcgtgtgtttgctggcagagtcgccactgggatgaaagcgcgtatccaagggccgaattatgtggtcggcaagaaggaggacctctacgagaagaccatccaacggtatacaacaatacatttccgacttagttcaatccctgtttctagcacaatttgataaaaatcaggtagcgctatacgcgcgacggatagttttgctatggccggaattaagagagcccacatgccacgacaacattccagaaatacatttgcactgcgaactcaacttgatcacacacaactgcaattcggtgacgaccacatgcttgtagtcatagtcaatcatcgacctgcatgctaatatattataaaatgatggccggagatttgcgtgcctcgcacgatcaaaccggtcacacagcgaaaaaagcgacctaacgtccgcactgaggtctgaagccttcacgatgaggaagtcctataagtaattaatttcatcggccaagaatgacagagacaaaccgcgctctccagaatgtcaagtctatcaggtctgttatcttcaaacaccactctcactagattcttgtaagactcaattttcatcgcacaaatttgtgactgctcttccgccaaactattcattagca

SEQ ID NO: 47512 - DNA, 1247 bp, Heterodera glycines
  Genomic contig location: Contig_ID=SeqID_18346; Location=597..1843; Strand=+
  SCN-specific regions: Sequence locations=1-71,111-1247
  Gene Ontology: Mol. function=DNA-directed RNA polymerase activity; Cellular component=DNA-directed RNA polymerase III complex; Biological process=transcription from Pol III promoter
atggccgctccgctggacatcgtacgacacatgcgccaagtgggaaagcaataaatcccgacaaaaaaaacaaattttgtgtccttggttttaaggatttgataacaaatggtcttgtcaatgctcttgccactgggaattggacaattaggcgttttaagtgagcgatgaatgccggaaattactgaaaaattaaccgttttgttgttcagaatggaacggcatggcgtcacgcaagttttgtcacggctgtcttacatcagtgtgttgggaatgatgacgaggatcaattcgacgttcgaaaagacacgcaaagtgtcagggccacgttccctgcagtcttcgcaatgggtctgtttcatgccttgcccatttttgtaaatagtccctttctactccttttagggaatgatttgtcccgccgatacgcccgagggcgaatcttgcggtttggtcaagaatttatcgttgctcagtcacataaccacggacagcgacgaagcggtccattgtttttaaatgactttttggaaccaatatcatttttagcccattttgcaacttctctacaatttcggtgtccaagacgttcgtccgttgaaatttagcgtcgttcatgaaaggtaaatttgattgttaatgcctttaaaagggaattgattaaagacgttatcacatcgttttcctcaatggttccattgtcggaattactgatgacgttgaaaaaatcattggcacggtgcgactgatgcgccgaagagggcatttgggtgcctttgtctcggtcagtttcaacacgtccacaaatgcgctgtatttggccagcgacgggggccgactctgtcgtccgtatgtcatcgttgaaaatggtcgtccatgtctcacgcagtcccaaattcaggtaaaaatgggtgtcactttttgttcatctacaattatttcggttgcaggaagtccgagacggtcagaaaacctttgaccatcttttggcggagggatgcatcgagtttttggacgtgaacgagttgaacagtacgcgcatcgctgtctatgagcaccaaattttgccgcagaccacccacttggagatcgaacccttttcgttgctcggcgtcgtctcgggactgatcccttacccacaccacaatcagagtccccgcaacacttaccaatgcgcaatgggcaaacaggcgatgggcaccatcggatacaatcagcagaagcgaattgattcggtccatctttag

SEQ ID NO: 47513 - DNA, 1891 bp, Heterodera glycines
  Genomic contig location: Contig_ID=SeqID_3059; Location=1962..3852; Strand=-
  SCN-specific regions: Sequence locations=1-276,300-1027,1049 -1330,1352-1795,1817-1834,1862-1891
  Gene Ontology: Mol. function=protein binding; Cellular component =intracellular; Biological process=positive regulation of body size
atgtcagcgcagaggatcgccagcaattcggagtggaagaaaacggtgggtttcgggggactgacttggccagaaaaaaaacttggcttaaattcatttttcagcccctcggacaaactggcctcttcaatatgggaaatacgtgcttcatgaacgccactcttcagccactgttccatacgcccggattttctcaactgttccaagaaaagagcgcgcagcgattcgtcaatgggtgcgtcaggaggggggagccgagcgccgtcttcgaattttcataaaattcattttttgtttcccttttcaggaacaactcgtttggcacgaatgggatgatctccggctcattctctgcgctcatcgacctgatctggtctggcaagttcaacgcacttcggcccaccaccttcctggtgagtgactctgtgcctttgaacaatccattctaatcaaatgtttcctttttttccccaggaattcttcgctcgccgtgtcaacaccgaaatggccgaccgacggcagcacgacgcccaagaatttcaactctatctgctggacgcgcttcacgaggacaccaaccgggtgagttttgccattttatgttccatttttcaccctcccccctccccattttcaggtcaacaagcgacaatcgtttgaacagaactacgacgacaccgatttgggcgccagcgcttcggatttcaatgagaggtcgaaactgttctcttcgtcgccggtcaacgatctgttcaacgtgagtttggagccatattcattttgtttgtccgccgccaatttctaatcattttcccttttgttcagctgacaaacatctccatggtccaatgcagcacgtgcaatacgacgagtgttcgcttcgaggtcgtcaaccaactaaggtgagtttttcacagacccaaaaaaaatccctaatttgaatttccctttgaatttttcagcctcgaattgccgaccaacaccgacgacctgacgctcaaggactgcctggaggcgcacttttcatcagcagtgagcagcacctcagcctgaatttgtgtctgatcccatttcccctccctttttcagagtctcgaggataaatgggattgtccgaagtgcaaaagcaaacagccggcgacacggagcacaaaaatttgggagatcccgaaggtgctgatcgtccatttgaagagattttcgctgaatgatggacactacgtcaaaaataacgtaagtttccgtcggggttttttttgagcgtaattttcactgattttttaaacaattttcaggtcgaagtaacgtttgatgtggccgagttggacctggcgccctttctccacgagaagtctccgcatcacaacacagcactcagtctctacggcataacggtgagtgatcaaatttggttaaaattgtcactaatcacactaactatgtttcaccattcccccttcaggatcacagcggtcggctgaacagtggccattacacatcgtccgtgatcaatttgatcagcactgatcgggagtggctgagtttcgacgacgaagcatgcattccgtgcggcaccgctccttcgcccgttgtgagaatttcgttcccgaccattcaaatgaaaaaaataataatttgttttcccctttttagagcaagcacgcattccttctgtactacaagcggatgaactcgaaagccgagcgcgacaacaatgccaatgcgaatccttcggtgctgagcgacgaagagaataacggatgatattattgtgtgtctacaagcggatgaactcgaaatccaattgatattattgtgtgtgtatgctctgtacaatatgtattgtatttgtattgcattgtatgttcatattagtcgtcttgtaaataaa

SEQ ID NO: 47514 - DNA, 2286 bp, Heterodera glycines
  Genomic contig location: Contig_ID=SeqID_18425; Location=169..2454; Strand=-
  SCN-specific regions: Sequence locations=1-252,284-411,434-1134,1157 -1841,1863-2100,2122-2286
  Gene Ontology: Mol. function=chaperone activity; Cellular component =actin filament; Biological process=protein folding
atggcttccatcgcatgtttgaacccaaaagcggagttggcccggcacgcggccgcactggagatgaacatcagcggtgctaaagggttgcaggaagtgatgaagaccaacctcgggccgaagggcacgctgaaaatgtgagaaagtttcgagaacaattaatctggccaaactttctgcttttctttttttaaggcttgtctccggttcgggtgaccttaaagtgactaaggacggcaatgttttactccatgaaatggtgtgttttttgttttgctttggcaaacgtaaatttgccgagtaaatttctcattttttgcatttttctacgatttctcgaccaattttctcttgcatgtaaaataattctctaaaaatgaaaacatgtacatgaatttaataccgccttcattttaaaatggtcaaatgtttcagcaaatccaacatccgactgcttcactgatcgccaaggcgtgcaccgcgcaaaacgacgtcaccggcgacgggaccacgtcgaccgttctgctgattggcgaactgctcaaacaggccgagaattacgtcagcgaggtatgtggcagggattgtttcggataatgttgggtattccggtgcccaataaactccggaatccggtccaaccctggtttagtgacaaaacgcgacggcacaccccgtcttttggcattttccttttatttttcggacggcgaaatacagtttcgccttaactttgtagtctttttagtgactcgcttaaataacgattaattggtgtcactgatatttttttgatttttcattctttttcaccgcagggtgtccacccccatttggtcaccgagggtttccaattggcccatgaccatttgctccaactgttggccgcctccaaaaagacgttgcctatcgaccggccgctgctcatcgaagtggccaggacgacgttgcgcacaaaattggaccaaaagttggccgaccacgtcacgggttggtctcttaaacagcaaacgaacctcataaaacccttacaaaattctcagaaaatttgattagacgttgtgtaattaacgagtttttgctttgttccgacacttaaatcaaaaaaaagtcggaaactgctttcaatactcattgtttccccatttctcagaatgtgttgtggacgccgttttggcaattcgtcgggatgaaaacgacacggagcccgacttgcatatgattgaaattcaggtgcaaaaatgggtttattctgtttcatattggtcgattttctttcatttccaaaaaattcagatgaaaaagtactgaatttgtaaaaaagtcctccacctttagcaaatggaacacgagatggagacggacacgcagctgatccgtggcctcgtgcttgaccacggcggccgacacccggacatgccgaagagtgtgcgaaacgtgcacattttgacatgcaatgtttcgttggagtttgagaaaacgtacattttatttatttaatccgtcgaaagagttgaagaaccctagaaatgccaagcgacttgggacaaaaattttgtttaccatggaaatgccaaatcctggatttttatttgttttttaattgaatccctcattttcagtgaggtcaattcgggccttttctacaagacggcggctgagcgtgaacgtttgctgcaagcggagcgtgaatacatcacgcgacgagtgctgaaaattgtggaactgaaggagacggtctgtgccggcggagaccaaggctttgtggtgattaaccaaaaggtgtgtgcttgttttatttgggaatgctctcgaatttaaaaaaaaataactaatccccgcttcccccaagggcattgatccgccgtcgttggatttgttggcgcagcacggcattttggccctgcgacgtgccaagcgccggaacatggaacggctgcagttggcctgcggcggcgaggcggtcaattcggtggacgacctgacgcccgatgtgctcggctgggcaggcagtgtttatgagcatgtggtggtgagttaagggggagcagtgccgttgttgcttggccggggtttgtcacagtatttgtcccattggtgtactgtaacatacaacatggattaccgtacagctttagggcgaggacaaatacacttttgtggaggagtgcaaaagtcccaagtcggtcactttgctgctcaaagggcccaacaggcacagcatcatgcagctgaaggacgccatttacgacggacagcgggcggttgccaatgcgttgaaagacg

SEQ ID NO: 47515 - DNA, 1083 bp, Heterodera glycines
  misc_feature (9)..(9): n is a, c, g, or t
  Genomic contig location: Contig_ID=SeqID_18429; Location=1..1083; Strand=+
  SCN-specific regions: Sequence locations=1-369,391-433,456-1083
tatttatanttgattttcaaaaagcatttgactcagtgccctatgaattacttttatacaaattggaaaaaattggtataaagggcaaacttttaatgtggataaagggctttttgagtaataggacttttcgagttaaaattggggatactttatcctcaagtaaaaaagttacctctggcgtcccccagggctctgtcctgggccctttattatttttgatttatattaacgatcttcctgatgccttgccatcaggagtgaaaataaaattatatgctgatgatgttaaattatatatttgttataaagcaagagccgacacggaaattatgcataaagcattgcataatttattcgaatgggcaaataattggcaaataaaagtttcaattcaaaaaacttttgtattatatttgggttccaaaaacccaaaagaaacatataaatttgatgggaatacaataaatgctgtgaatgcaattagggacttaggaataaatattgataataaattacaattttccgatcatgttaaccaaataacaaggaatgcctatttacgtatgcgttccttgttttgaataattaaatccaaatcatctaagatttggattacgttatataaaacctatattaggcatttattggaatacgctccggaggtttgaaatccgtctcttcaaaaaaatattataaaaattgaaaagtgtcaaaaaaattcaccaaaagggtttttttaaatgcagccttccgccaattccataccaaaatcgattagaatacctgcaactgccaacacttgagaataggcgaaagctgtttgatctgttcatggcgcataaaattgcttatggccgaacagatctgaaactattttctatttttaatccctcaacgcgctttaacatccccttttacagatttaactcaaaatataaactgggcaaaaaattcattccctttgctgggagggtaacaaaattgtggaatcaactcgataaagaactaataaaaacaaattctttaaatcaatttaaaataaaacttaaaagttcactagggtaatctgtaagaccggga

SEQ ID NO: 47516 - DNA, 1129 bp, Heterodera glycines
  Genomic contig location: Contig_ID=SeqID_18430; Location=1..1129; Strand=-
  SCN-specific regions: Sequence locations=1-204,226-241,264-453,475 -626,650-930,969-1129
  Gene Ontology: Mol. function=ATP binding; Cellular component=Golgi apparatus; Biological process=embryogenesis and morphogenesis
atgagtgatcgacgcaaagtgttgctgaaaatcattttgttaggtttctgtccaaaatagagtagagcgggaccgggaattgaattttgggcaaagccaggaccgggatcttttggggttgaaaaccgggaatttttggctgggaaaaccgggactagtcccggtcaaaaccgggactcaggtactcagttgtcccgttttttcagtactcagttgtcctggtcccgctctactctagtccaaaacaatgaattgttcaaatgaattgcctctgatctgtttaggcgaggctggagttggcaaatcatcacttatgaaccaatatgtgaatcgacagtttgtcagtgcgtacaaagcgacggtaatttattctttttaaaaactgctcttcggtgcaaatgtttaagtgcagtacgaatgactgggacctccccgaagtccgggcgaattcgatttttattagtattcatttatctttgtctttttccgacgcaaacccggataaaaactgccactaattcagtcccgatttgtctggaattgttggtgttttgctcaactgatcttccctcttttagcatggttttaaccctccaacccatttttaaaccttttcctggtccggcattctttcaaatcctggttttattgccatttccacttaaatacaaaatcgtttccttctttctggttcaggttggctgcgatttcctgaccaaaaccatcaccgtggacggcaccgaagtaaaaatgcaaatttgggacacgtgcggccaggagcgcttccaatcgttgggcaacgctttctaccggggctcggacgcgtgcattttggtgggccagtcaaataaatgccataaactcattttgtagcatcgaatctctgggaaaaaaaatgttgacaatttttttttagattttctgtcacacaatttattaaaaatttaattcaataataatcaaaaaaacagaaagttgaattttatgtgtgtgccatttttctggaggttatgcgcttcaaaaaatgctttcttcattgtcatgtcatcacgttttttgcaggtgttcgatgtgaccaatgcaacatcgtggggggccggagagttggcttgatgaatttctcgtttag

SEQ ID NO: 47517 - DNA, 1376 bp, Heterodera glycines
  Genomic contig location: Contig_ID=SeqID_18447; Location=135..1510; Strand=-
  SCN-specific regions: Sequence locations=1-15,45-214,242-377,411 -704,726-728,751-773,797-817,839-850,872-936,958-1122,1144-1145,1167 -1182,1204-1212,1234-1243,1267-1331,1353-1376
  Gene Ontology: Mol. function=signal transducer activity; Cellular component=heterotrimeric G-protein complex; Biological process=G -protein coupled receptor protein signaling pathway
atgagcgaattggatcagctgaggcaggaggcggagcagctcaaaagccaaatcagggtgggacgacggagtgatcggagtcactgatcagtgcttaatcgggttcaggaagcgcggaaacaagccaatgacaccacgttggcatcagtggccgctaatttggagccaaacgggcgcattcagctgcggaaccggcgaactctcagaggacatttggccaaaatctatgccatgcattgggcgtccgactcgcggaatttggtttcggcttctcaggacggcaaattaattgtgtgggactcgtacaccacgaataaagtgagtccgagttcaagcagtacatgctgatttgccaatttccttcaggtacatgccattccgctgcgctcctcctgggtgatgacttgcgcgtacgcccccagcggatcgttcgtcgcatgcggcggattggacaacatttgcagcatttactcgctgaagacgcgcgagggaaatgtgcgagtgtcgcgcgagttgcctggtcacaccgggtatttgtcctgctgccgcttcttggacgacaaccaaatcgtcacctcctccggcgacatgacttggtcagtcagtcagcagacggccaattgagtcccctcgggccatttgccaaattgaaaaacgatcattttggcatttcccattgaattcactcaaaaaccaattaattcgtccatttcctttgccccattttagtgccctttgggacattgaaacgggacagcaagtgaccgcgttcaccggccacaccggtgacgtcatgtctctatcgctttcgcccgacatgcgcacgttcatctccggcgcgtgcgacgcatccgccaaactgtgggacatccgcgaagggatgtgcaagcagacattccccgggcacgagtcggacataaacgccgtttcggtacgggcaattagcaatgaaaatgcagtcgattgggaaacatgaaaatgggaggtttcaattccggcaagatcccattcccgaccctttttccatctttttaatcccgtttctcgacttgtttcctctgatggcgttgctcatccccaaaagtccggtagccgttttttacaatgtttcgtgtttaagtatttaaaaaggttttttgaatttgaaaatataaataatttaaaatgcactacgatgatcaaaatatttttagtttggtctctgcacccatctcattgcattggctgtggacagtaagccaaattaaaaaattttaaacaaatttacatttccagttggacagccccctgttccaaacaacatcattcagtgctcaagaaacgaatactcgtgctgcatttgtggcccaaaaagccaaggaaatgtgccatgattg

SEQ ID NO: 47518 - DNA, 482 bp, Heterodera glycines
  misc_feature (438)..(438): n is a, c, g, or t
  Genomic contig location: Contig_ID=SeqID_18468; Location=843..1324; Strand=+
  SCN-specific regions: Sequence locations=1-32,54-209,231-482
  Gene Ontology: Mol. function=v-SNARE activity; Biological process=ER to Golgi transport
gcaatctgccgctcagctcgacggcctcgatcgtttggtgaataaagagccttctgggaagcgtcacacttcgaaatatcggtttgaacagctgcgacatgattataatgcccttgaaatggcaattaattcactgcaaaatcgactcacaacgaaatggagaacggctgcggaaagggaggagttgctgaccatgaggtgataatgcaacgatttgcttctattggaaattcacgaaacttggcttataatttgatgcaatttatttgattggctttttgacggtttattttagatttaaaccaaacgaaacgcatttggactttgaggggacggaattgctcgtcaacgaccgactgaaacagtcgcacaacgccgtggacgatctgattgcgcatgggaattcagtgctcacttcgcttcgtcatcaacatttgnggctaaaggacgttaaacggaaaatgctcgatattggtcaagtg

SEQ ID NO: 47519 - DNA, 630 bp, Heterodera glycines
  Genomic contig location: Contig_ID=SeqID_18493; Location=1403..2032; Strand=-
  SCN-specific regions: Sequence locations=1-150,172-336,366-630
  Gene Ontology: Mol. function=pre-mRNA splicing factor activity; Cellular component=small nuclear ribonucleoprotein complex; Biological process=mRNA splicing
gaactgctctaccaggaggggcacagcaaatccgtctttgatctcgatttccatgccgatggctctctgatgttgaccgggtgagaaaccaatcacccgcacatttgaataattattgctcaaataagcaaaaatcaatttttttttttgaaaacttaaagcaattttttaaacaaattctattaaaaatagcaaagaaaattctgacgaaaatttttcgcttccccccccctccgaatttttttttcattctagctacgggcatggttacatttaaaaaaaagtgatggccagaaaaataattttgtttttttttcaaatatttttggtgattactttttttttgtaaaaattattttttaaaacagttttgcgcatttttttagtcgattaatcaattttttttttttttgatcaatcgatcagtgaatgagtgattgatttatcggttgttgataattcctggttttttccaggggcctcgactgctacggccgcgtgtgggacttgcgcaccggccgatgcatcatgtttttggagggccatcagaagggcattcacacggtgtgctggcaccagaatggtttcctgatggtcaccggcagtgcggacaacacgtgcaaggtataa

SEQ ID NO: 47520 - DNA, 558 bp, Heterodera glycines
  Genomic contig location: Contig_ID=SeqID_18507; Location=1505..2062; Strand=+
  SCN-specific regions: Sequence locations=1-141,163-558
agttggccgtgccggcggcggttattcctccggcttttaccgtttggaattcgtcttcgactgcgacgtgtcctgctttgtccaaattcacttctgtgcccgggaacaaattgacgaacagcagccacaacttctccagtaataaaaataataattcaaaggctttatcccttttctctctcccttttactacctttgcctttcggcgatatttcgttactttttttaatcttttggcaaaaccgttgatctgaccctggtccacccattcggagtgttcttcctaatttgtgaattaaaggctttacctcccctcgtcaaactttcaaaatttccctttttttcctggtcaaaatggtaactccccttccctcaaaggattgtctctcgtcagccccaatttgaacactccgaacgtttccatttccccgtgggcgccaaccaacacttcagccatttcaccttcaaaccgcaccgatacgacatgaaaatgatgcattgggacggcggcccagttttcccggtggtcatcgaaattcgatcggtgtccgaccaatt

SEQ ID NO: 47521 - DNA, 2216 bp, Heterodera glycines
  Genomic contig location: Contig_ID=SeqID_3084; Location=1080..3295; Strand=-
  SCN-specific regions: Sequence locations=1-235,257-772,801-1287,1310 -1485,1508-1743,1769-2119,2142-2216
  Gene Ontology: Mol. function=structural molecule activity; Cellular component=Arp2/3 protein complex; Biological process=actin cytoskeleton organization and biogenesis
atgaattcaaccgaatttttatggcatgacaaagaaacgacacatgttgtgggctcacacatgcttcgaagctttcactggattcgaacctgtgaccccccaacttcggtatcgcaatcatcgggactcaattctccgacattccaatcaatgggactcaatctcagcagcattccaatcactgggactcaattctattcaattctccatcattcccattcccgggactcaatttcaccagcattccaatcactgggaccaattcttcactattcaaaaaactggaactcaatttcacggattcttcggcatcgcaaccaccgagactcaattctcctgcattccaatcactgggactcaaatcttcggcattccaatcactgggacctaacctcacctggtccttcggcatcgcaatcatcgggactcaattctgcgacattccaatcaccgggactcaattctactcaattctccatcattccaattaccgggactcaactcacctgcattccaatcgccgggactcaacttaccagcattccaatcgccgggactcaattctccggcattccaatcaccggaactcaattctccggcattccaatcaacgggactcaattatccggcattccaatcaacgggactcaattatccggcattccaatcaccgggactcaatccttcactattccaaacaatgaactcaattttatggattcatccacatgtcaatcaccgggacttaattcagacctgttcggcataattttggaattttaaaaatgtatttcaattatcaaatacaatttgcgtagaaaatccttttcattataaatacttgttctcttacattttaataatttcttttgcataaacatctgcatacaaaaaaagaacaaataaactgatcttatatcgttaaaagtaacttctttttgtcaaaacaaacaataagtgcgataaatccatccaattaaaaccatatccattaaaagaggcataattgacatccgctttaattacaaaaacaaaaaaactccatttcaaagtcaaaacaatttctcgaaccaaaactttttcaatacaataccaaaactaattgtaagatcatttccattgactttgcatatacaaaaacaattattttttacaaaaattaagagcattcatttccatatgcactttgctaatatacagggttcccagatctgaggatttatcacagggctcccagatctgaggctttagcctcattttgtggttttttgataggtcaatgaggctaaattttccatatttttggcatccctgtttatgactagttggcgaaatttggtgaggtacaagtattcttgaattttacctttctattttgcttttccgcttgactgattcccatttattataacttaattaaagtcaatttgttgtaaattactgattttcaaaaactgatatggtaagggccactcattttaagtccaattgtttttacccattcatttctgtttagagcaccactttgcaaccataccttgatgcggttcgtcggtccctggaggcggcactctgtcttcagcagtttggttcacaagttgttgaacggcacaacaaaccagaggcaagaaagtggttaccgtcgttgtgaatttacaatttatttgtttatatagccatgggcaaaggttttccgctgacatttctccaaacaattattcatttagttttgagtcaatttcattgttttgctcttttggttttgttcaatcatttttttaggttgaagttcggaccagcaaagagctgctgttgacgccggtgatggtgtgtcgcaataaacaggaagccgttctgattgagccgtccataaattcggtccggatgagcatcagagtcaaacaggcggatgaaattgagaaaattctgtgcaacaaattcacgagggtgagacaaaaaaagggaaaacccattgcaaatctatttctaggtaaaggtaaaaatttaaaatcaacagtttttgatcgaagttatccatcgccaatcagtgctttttttagtttatgtgccaacgcgctgacaatttcatcattttgaggcgcaaaccaatgcccggctttgacatcagttttctgatcaccgcaacacatacccaagtcatgtacaagcacaagttgatcgactttctcatccattttatgcaagagattgacaag

SEQ ID NO: 47522 - DNA, 853 bp, Heterodera glycines
  Genomic contig location: Contig_ID=SeqID_18514; Location=668..1520; Strand=+
  SCN-specific regions: Sequence locations=1-176,198-249,271-853
  Gene Ontology: Mol. function=protein domain specific binding; Cellular component=nucleus; Biological process=protein targeting
atgagcgtcgaactcaccgaagaagagcgcactttgctgtccgctgcgtaccgaagggcgatcagcactcgtcgttccgcgtggcgtgtcatcgaatcccatgtgaaaaagtcgaccatcatggacaaacagaagcaaggtgtcaaggtgctgcagaagaaggtggagagcgaggcggaggagaagggccgtgaaattttggtcagtgcgtccgtccgtgcggcgttttcccggaaagagtttaactccaaaaaattttttgaaattttacagactctgttggacaaccagctcatcccaaaggctgccgacccggaggccaaagtgttctacatgcggatgaagggcgacttccaccgctacttggccgagatcaaaccgtcggaagcggatggtaaaagggcttcgaaaatgctaaaattcaacaaattcccccctccccaattttcagatcttcgcaaggcacagaaggcgtaccaggaggcgtacagcattgctcaggaaaaacttcgaccatcgcatcccatccgtcttggtgtggcgctgaacttttccgttttctacgaggaattactgaaatcgacggaggaggctcgccgaatcgcacaaaaggtggttggaaggatttcattgttttagagaggctgctgttcatttcatttttgcgcaggcttacgacgatgcaaatgcggttatattgacggactcgagcggcaacgaaacgctgatggaggcactcgcaatcattgagaagctgcacgacaatctggcggagtggaaccagcgcaaaggtggagctgaatagaacgccgctgctgtgaatggagatgaatcgcgcaattgatatgggtga

SEQ ID NO: 47523 - DNA, 1548 bp, Heterodera glycines
  Genomic contig location: Contig_ID=SeqID_3087; Location=43..1590; Strand=-
  SCN-specific regions: Sequence locations=1-21,43-570,592-919,941 -1515,1542-1548
atggaagaaagaatcgttctgaaaaagaatatttggcttatccttgaagggaaatctttgctcgtgtgcaacaaattccacgaggattcgtgctctgagtgttgcattgaagagaacaaccttttgccggacaacaacagcgaattccaaagcaattactccattaatgagctccccgccggtgcccctcccctcccttttgcttttcatttccctaattaaggctatcttctgaagggcgacctcatcatcaaccaattgccaactcctcccgacggtgtttttgcctctttttccgctttaagccttttcttcaggcggcttcggctgggtcattgttgctgctgctttcgtctgtaactttgttgtggacggcgtttccaattcgttcggctcttttatgagtgcctatcaggcggcatttcataccacaaaggctgccacttcggtgatcggttctttgctcattggagtttatttactcgcgggtgattcctcccttcgcttgccaaaattggcactttcacttgtctttggcactttctctatttgccttaaggtccactctccggtgcccttttaaacaatttcgaggcgcgcaaggtggtcatcgcgggcactgtgctgtcctccgtggcattcgctttgtccgcattttcaccgaatattttcgtccattatttgctttacggcgtttttggcggtgggcgccttttcattttttttgttttggtaacaatttgctcttctccatctccaggcattggtttcagcttcatctatctgccagcaattgtcatcgtcagccaatacttcgagtccaaacgggcacttgccactggcatttccgtggcgggcagcggattcggcacttttttgattccgctcattttgaagtttttcctcgaaggtgcttttcctttgctttagctgaactgttcacataaactgccaatttgtgaagcattcggctggcaaatggccctttacgtcaccgcccttctcactctttcctgtgccttttgcggcattctcttccgtccgttgccaatgcccacgtttgacttggagaaacagaataaactcaacgaggaactgaagcaacaagcactgatcgctgctttacagcaagttgaggtgatgagaaaaaagacggacgatttgagacgaccgattgaaagactttttgtagggcaaatcatccacataaaaaaccaattttagtccgagtcgaatgtatcggaagaggaggaggaagcgaacaacgggggcatttcgccaccgcgtcggtcgggcgccactcggacgagttcggagtgtacggacggacaaccgttgctaatggccaacggagtggaacttggcgccgtaggggagcacgcggaggaggccaacgaggcggactcttcgcccattactccacacaatcgccctccgctgtcgcccattttggaaagagtggtgcgccgactgagcaaaaagaggggcggctcccagcatcacaacccgcaccaccagcagcagcagcagcagcagcagcaatccggg

SEQ ID NO: 47524 - DNA, 1085 bp, Heterodera glycines
  Genomic contig location: Contig_ID=SeqID_3090; Location=1..1085; Strand=-
  SCN-specific regions: Sequence locations=1-15,37-336,358-699,721 -773,795-1085
  Gene Ontology: Mol. function=cystine transporter activity; Cellular component=integral to plasma membrane; Biological process=transport
ggaaaagctgactcaaacaaactcaaaaaagaattttccaaatcaactgaagaggaatttgagaattcgggaagaataagtcatttgtccaataattaaacatgtaattaacatgtgtcatttaaggtgtattattggctccggcatctttttgtcaccaacgggtgtccaaaaaggtgcacattccgttgtttaacttgcgattggaaatcaacgctttagatgctggaagtatcggcctttccctgctcatttggctcttttgcggcctcttcgttgggctcggttcctattgctatgccgaacttggcactctcatcaaaaagtcgggtggcgactatgcctacataatggaggcgtttggtccttttttggcattcgtacgactttgggtcgaagcattcgtcgtcaggtggacggctgctaaaattttgtccatttgaatttaaacgcgaatttatgacatctttagaccgtgcacttgcacaattgtcgctttaacttttgccaaatacattttgcacccgttcttctcaaattgcaaaacccctgatggttctgctcaaataattgcggctgccctgataagttggcactttcaaatgccgctttcatttgcaaatgcttccgtttagtttttctgactgctctcaattgtctttccgtcaaattggccactttcatccaagacacttttacacttgctaaaatttttgccctcatttttattataatcaccggcttttaccttctgatccaaggtgtaatttaatagtctttctcattttttattactttttaaggcgatccgcaatatcgagtcaattttcgaaatgttttcgaaaattccgagacaaacgttggcaaagtttccattgctttttattccggactcttcgcttaccaaggctggaactacctcaatttcatcgttgaagaattgcaaaatccaaaacggtctttatatttttgcaccgttggcattttaccaattcaggaatttgccgttggccattttgatttccactgtttctgtaactgtcatttacgtgctcactaacatcgccctttacgtggtcatcagt

SEQ ID NO: 47525 - DNA, 1434 bp, Heterodera glycines
  Genomic contig location: Contig_ID=SeqID_18553; Location=1..1434; Strand=-
  SCN-specific regions: Sequence locations=1-174,196-214,236-357,381 -945,969-1280,1310-1331,1354-1434
  Gene Ontology: Mol. function=casein kinase activity; Cellular component=nucleus; Biological process=signal transduction
ctcgccacccgcagcttctctacgagagcaaggtgtccttccttctgcaaggaggggttggcattccgcacattcgttactacggcatcgagcgcgactaccactgcctggtgatggatttgctgggtccttctctcgaagacttgttcaacttttgttgccggcgcttcacgatgaaggtttatttatttttcctttgttagtaaacaaaagtggtattcattcatcatttttaaacattgtggagtaaaaattccaaagtcttatctccttcggtttagactgttctgatgcttgccgaccaaatgatcggacggattgagtacatgcatgtgaagaactttattcatcgggacatcaagttagcattgaaattgctttacatgcaccactgacatcccattttctgttagacctgacaattttctgatgggtatcggtcggcattgcaacaaactcttcatcatcgattttggattggcaaaaaaataccgtgactcgcgcacgcgcatacacattccttaccgagacaacaaaaatctgacgggcaccgctcgctatgcgtccatcaatgctcacatgggtaagcaggatggcatgttaattcattttttggttgctagtgtactgtttagtaatttaaaatactctaaaaaacattttcctcgtggtgtttggaatcgcctgaccttcatgtgtatgtgtgataaattttggcaataggattaataagtatcttaaattgaagtccagagtttcttttactcaatctatccatatatcagttttaggaccaacggtttgaattatcccccccccccccctcaattaggtaaataaatgtgcctctttaacaaaacctctgtctctcaatcagcatcaaatttttgaatttcgtaatgtttaggtatcgagcagtcgcgaagggacgatatggagtcgctcggctatgtgctcatgtatttcaatcgtggaaatttgccgtgagagattaatctgattgaaaagcattcttcattccattatgcgtttcagatggcaaggcctgaaagcggctaacaaaaagcagaaatatgagaaaatcagtgaaaaggtgatcattatacagacttaaatttatttgaaaaagccgatgccttaaatctaataatactttggctgtgcattctttcattttgtcttattgttagaaaatgtcaaccccggtggaaatgctgtgcaagggattcccttccgagttttcaatgtatttgaattactgccgtggtttacgctttgacgaggcacccgactacatgtatttgcgtcaacttttccattatgatattcgcacggcaaaacaaaaaagaacaattggaagatatttttgacataaaccctcaaaattcgctaaatagcacaattcttactccaagaaatcagcccatcaaaaga

SEQ ID NO: 47526 - DNA, 261 bp, Heterodera glycines
  Genomic contig location: Contig_ID=SeqID_18554; Location=20..280; Strand=-
  SCN-specific regions: Sequence locations=1-104,126-261
atggctgctgtagtcacaaacaatagcaaggtgtgtgcccgtttttaactttgataatattgttctaaaagtttttagactataaattcacaattttttatttccgaaaatgattataaaaatgtcttgaggcattctctgaaaatttcgcttaaggaattcatcgttggtgtgaaatacaagctcaagcgcaaaatcggtagcggatcttttggcgacatttacctcgccatcaatattcagaatggtgaagaagtggcg

SEQ ID NO: 47527 - DNA, 2081 bp, Heterodera glycines
  Genomic contig location: Contig_ID=SeqID_18568; Location=43..2123; Strand=+
  SCN-specific regions: Sequence locations=1-287,309-612,634-1081,1104 -1139,1164-2081
  Gene Ontology: Mol. function=ubiquitin activating enzyme activity; Cellular component=cytoplasm; Biological process=reproduction
atgttcatctcggcagacgcgcgcggacttttctcttatgcatttgtggacttgggcgacgaattcgttgtgaacgattccgacggggagacgtgcaaagaggtggaaattggaataattaatttaattgcgaattgaatggttccgattttcaggtgctcgttgagtacatcgactgcgaaagcggcgacatgatgacactcgaaggcgcatttcaccagttggaggacggggaccacgttgtgttcaccgactttgagcacgccgaactgaacgaacttccaccagtgccagtcactttgaagggaagtgagtgccaccactgaacatttgttggttcatctacagtcctcccatttttaggcaatgtcttcaacattggaaatgctctcgcggccttttctggcgcagttcaaggccccgtttcgcgtggacgtgttcagcaagtcaaagtgcccaagaaaatgtccttcaagccattgtctctcgcactcgccgagcccgactttatgatttgggactttgccaagttcgacgaacctgcacaacttcacgccctttggcaggctttgtacagttttgaggcgacggttcgtcattctggccactttccatttgtttgggttttcctttcagaaaaactacagccctttgccccgttccgatgccgacgcaaaattgttaaaggaaatgctgccaaaagatgcgcccgaaatgccggactcactgctcttcaacttctcttaccaggtcccttttgtgcctttttcaacttcgaattcctcccccgtcttaaggcgtgcggaaatctccaacccatcgcttcgctcatcggcggtttggtggcccaagaggcgatgaaggcagtgacgcaccacacgacgcccctcaagcagtttctgtacaccgattctcttgaggcgttgccgggcgccgattcgacctttgacgccgccaagttggagaagaacgattgtgcaccggtgagtttttggacggacaactaattgctgttggagtgttcaaaaactgtccatttgcagcgcaacaatcgctacgacggacaggcggccgttttcgggtgggcctttcaggaggcgctgcagcaacagaaatggttcattgttggcgccggagcgattggctgtgagctgctgaagaacatggtcagtcatttgctgccaattgtaataaaagtacgttttgccaggcgatgatgggcttgggctgtggcaacaatggctcgctgaccatcaccgaccccgacaccatcgaagtgtccaatttgaaccgccagtttctgtttcgtcgtcctgatgttggggtcagttgcgagtcttaaatgttaccaaattcttgtcatcgcctttctgtagaaaaagaagtccgaagtcgccgcccgttccgtcaaagcgtttaactcgaccattcacatcaatccgatgtctgagatcgtcgccgagtcgaccgagcacatcttcggcgacgacttcttcgcccgtctgaacggcgtcagtaatgcgctggacaatgtcgaagcacgtaagaaattaggagaagggggggggcagactcaaattggcacttttgcccattttgccaggccgttacgttgaccgccgctgcgtgtactatcagcttccgctgctcgagtccggcacaatgggcgcaaagggcaacacgcaagtggtcttcccgcacttgacggagtcttacggctccacgtccgacccgcccgagaaggagacgcccatctgcacgctgcgcaatttcccctaccaaatccatcacaccattcaatgggcgcgagctgtgaaatttattgacctaatttcagttgtaggaaaagtcccgtttaagaagttcaccgactatttcacttcggttgcggagacggtcaaccaatacttggacaatgtgaacgactttttgcaccgagtgaaccaaatgactttttctcagcgggtcctttctttttccatcttttatctttttttatccgagttcttttgcagatcgaagtgctcagtacgcttgagcgtgcgttggtcgtcgaatacccgaaaaatgcggaagaatgt

SEQ ID NO: 47528 - DNA, 2667 bp, Heterodera glycines; identical to SEQ ID NO: 18631
  Genomic contig location: Contig_ID=SeqID_18631; Location=1..2667; Strand=+
  SCN-specific regions: Sequence locations=1-162,184-200,222-282,305 -335,357-720,749-819,841-908,932-1151,1174-1399,1423-1633,1655 -1657,1688-2067,2090-2229,2251-2667
  Gene Ontology: Mol. function=protein tyrosine phosphatase activity; Cellular component=integral to membrane; Biological process=motor axon guidance

SEQ ID NO: 47529 - DNA, 1624 bp, Heterodera glycines
  Genomic contig location: Contig_ID=SeqID_18640; Location=512..2135; Strand=+
  SCN-specific regions: Sequence locations=1-184,207-674,698-701,723 -1275,1298-1624
  Gene Ontology: Mol. function=chaperone activity; Cellular component =nucleolus; Biological process=nucleobase, nucleoside, nucleotide and nucleic acid metabolism
atgtccgaaaagaagtccgaaggttgtgctgaaaagaagagcggtggattcaacacgcagaagtttatgttggacctcgcatccggcggaactgctgctgccgcctcaaaagatcgaacggtatcgcaacgagaaaaagtggcgcagaaattgtttacgcaattcgttttccaatttcctttccgtctgtccattgtcagatttactttctattcggtgttgtggctcggttggttgtttcgttgatgttcgcccttttccttgtccatgtctatccaaaaatcctgagcattatcagtgattattgcttattacttttcattttaagtcctttagactgatcggaagcaaaagtcggcggacacaaagcacgcaaaacggagaaaggtttgcatttgcgtgtgtttggcagttggactgcttgagagttaaggtttttgagtcccggaaatcccgaggggatttgcatgggaaacccattttggaaaagtatttaaacagctaagacttcctcaaatggatttatgccaatgggaaacgaaacatttctggcgccctgtgttggttttaaaaaattcaaatctaggccataaaacggaaaagtacccattttcgaatgaattcttagatttgtcactatccgctaatatataaaacccggacttacccatgattgctgcttctttcattttttctgccaatttgcctttctttcagactgatcggaagcgaaagtcggcggaagagacggaaactgcgctggaggccaactatccgtcggcacagttggtggcagaaaagcgtgccaaaatggaggcggacattcgccgcgtggcggtgccgccccatcgctaccaaaatctgaagcgccaatgggcaaaagtgacggcaccgattgtcaacgaactgaagctgcaaatccggtcagttttgccggaatcggtgtccattccccgcgcgttgtctttaattaatgccatttttgaccttctaattgtaggtttattttcaggttcaacttgaggacccgttgtgtcgagatccgttgtccggacgaaaaagcggccggtaggtaaaacaaaaagtattaaccaaacaataggcagatgatcatttttcaatgatttctgattaatattattttgttttaatcaattttagacagttttcaactttttgttctattcgcgtttgggattcggaattaataggaatggatgtcagattcatattcaacgacctcgaaaacttcctagaagacgaattttacacgacatttttaaatttttattattttcgaaaaatgggagagacaaagaaagcactattaccgacaacaacaaagtagtttactggtcaaaaattttacttacaattaactcacgtaaagcgtatgagctaaaaatgaacgtaataattgtattcagcgcataaaattaccctagaaaaattatgttaattttcaaagggatcacaaaaaggataagtagcagcattgaaataattgggtcactaatgtttcagatttttgtgcacgcttttctgctcggatttgaggtggacgatgccattgcgctgattcgccttgaccatttattcttggaaagcttcgaagtcaatgacg

SEQ ID NO: 47530 - DNA, 291 bp, Heterodera glycines
  Genomic contig location: Contig_ID=SeqID_18640; Location=2741..3031; Strand=-
  SCN-specific regions: Sequence locations=1-232,260-291
agacgcttcaattgccgattccgtttgaaaatggttcacgaaaacatccactggtcccggccgcgcaaatttgggcccggctcgcgttcgtgtcgcgtctgcttcaaccaccatggactgattcgtaaatattcactgaacgtttgtcgtcgctgcttccgtgaatatgcctccgacattggattcaaaaaactcgactgaatggcgaagaggaatttacgagcagtcattggagggttgttttttgtttgttctgttcgttattttatgttgataaaaaattgcgttaat

SEQ ID NO: 47531 - DNA, 797 bp, Heterodera glycines
  Genomic contig location: Contig_ID=SeqID_18647; Location=26..822; Strand=-
  SCN-specific regions: Sequence locations=1-153,175-611,650-797
  Gene Ontology: Biological process=hermaphrodite genital morphogenesis
atggaagtcaatgaacacgcttccacactttctcagcagcaatgcatctcttcactgaagcgaaagttgaagcgcaagttggaagatgggcaagagttagaccagtacgactgcaaatttggcgtaagcacacaatcgaagcaaaaagagcccaatttcttaacccattcatttggtacagatacgtctcgaccccgaaggcgacgtggtaatgatgtcggacgaaagtgaaatttcgtcgctgaacgaagcggacgttaccgatttgagggaacgttacgaaaatgtgtgtttcgtgtggtacgttttaaattttcatccacactattacagacacaaagacaagaagtacccaaagaagtgatggtacagcgcgaaatgcaaatccgcgagttggagtcaatccttcggttggaggaggccaagctgatgatgttgaagaagttgcagcagagtcagcagaaggctgcgcagaaaacggtgagttaaagccgaacaacgaaaaaattcggggacatggactaattgcaacaattgttttaccgacttccgccgcttaatgcgctttttatgaccgagtcattttcattaattaagaaacatttacatttagcagcaacaacagaatcagcagcaacaacaacaacaggaaaatgtgcgaaggttagccccaggcgttgtgcagaattcaacgggacaagcgtataagccgaaagtggccgtggtaaacccatcacaacatcagacgggaaacaccagcaaaacgaacggcacgacgccgcagcacgggaagaagg

SEQ ID NO: 47532 - DNA, 1817 bp, Heterodera glycines
  Genomic contig location: Contig_ID=SeqID_3127; Location=2037..3853; Strand=+
  SCN-specific regions: Sequence locations=1-586,608-724,768-979,1003 -1296,1324-1476,1513-1606,1636-1817
  Gene Ontology: Mol. function=rRNA primary transcript binding; Cellular component=nucleolus; Biological process=ribosome biogenesis
gatgcgcaggggcgcatcgccacgtttgacgcggtcgagttgcgcttgccgcaaaatgaacaaaagcacatcggtgttgagctgacaaaaaggagagaggtcaaaaatggggtaatttgacataaaataaaataggtgccatttgtatggtaaattcaatgaatgaatgccttacggaacgctcgtgtacttcgtccacaatgacggcggagtaggcgttgagccgacaattgtgcagcaattcgcgcaagagaatgccctcggtcatgtaaacgagtcgagtccgttcgctggtctgatcttcaaagcggaatttgtagccgacctaaaacaaatgaagtctcaatttctgccggataggttcaaaatgcggtactcattgcgtttgtatccacatttttggtcaaattttttcaaaattttttttttcttttttattgtcagaattgcttttagattaatggaaacacttaaaaaacttcaaggatcctgtcactggtcagcatacaaacacaattgaatcgacgtggcagaagttcaagcagcaacacaaagcgagatttggcagtcacagatcacttttttccacatacatttctgattttttgtggcgtaagcaatttggaggaccggacattttttataatttgtggacccaaatcgcggaattgtacccaataagcacgtaaatctccttttatttgttatttaaagcaattgcgacaataaaaaagaaaaaaaaaattgaaaaatttgaaaaaaaaaaagggggatacaaactgaattagtacccctgattgtgcctttctatatatttttttgtcttttaggcatctgaaattttttgcgcctaaaccttagctgttaaactattttaaaatgccatcagaaaaattggtaaaacacaagaaaaggtcacttgagatccgaattgagaaagacaaggtaagcttttattttattaccgaataatttttttaatcaaatgtaaataattctaggccaaaaaggagagacgtgaagaaaggaatcggacacgaaaagacaaaggagaggacgcagtgccaaagcaagtcccaagaacaattgagaacacgcaagaagctgacgacacctttgtcggatcagacgatgaagaggtaatttgacaatgaggaattaaggcaagtgaaatattcaatgcatttaaaggtattggaagacatggacaatgatgcgatggcacatttttttgaagggtctgcgaatccgaaggttcttatcaccacttcgccgagagcaaaactcgtaagaatgatattatttaaaaaaataaaaaattttctcagaaaaccttcaaactctgtttcgagttaaaaaaggtcattccgaatgcagaaattgtgtctaggaaaaacgttgccataaaacgtgttgtgcggcaggcaattgagcgtggtttttctgacctaatggtggtgcacgaagatcgcaaaaaaccaagtttttattcctttttaccattatttccaattattaattcagatggaatcgttttttgccatcttccgaatggtcccactgcgttttttaagataaattcacttcaatactccaaacagatcaaagtgtattttgttttgtttttctcattttcgatattgaatttgcaggacgtcggtgaggcaacggaacattaccctgaacttattctgaccaacttcaacacaaggctggccaaaacggtgagccgaatgttcgcctgtctcttcccgcaaaaagctgattatggcggcagacgagtagtgaccttccacatcagcgcgactacgtctttt

SEQ ID NO: 47533 - DNA, 1447 bp, Heterodera glycines
  Genomic contig location: Contig_ID=SeqID_18667; Location=328..1774; Strand=-
  SCN-specific regions: Sequence locations=1-350,374-756,778-900,927 -1098,1129-1333,1355-1447
  Gene Ontology: Mol. function=ARF guanyl-nucleotide exchange factor activity; Cellular component=Golgi apparatus; Biological process =retrograde (Golgi to ER) transport
atggccgcggagaacgctttggcggaaatgtgccgttatctcttcgcctccatccaaacgtttgagcaggacatccgacccgggctcaaagaattgatgaagtaatttagacagacacaaaagaattaattgatttgttcttttcgtacattattcccaaggttttttaaaatcagcataacggctttggaattcaaaaatttcttgcatgaggaataaagggtcagtgctgcgttttggcatcgatgaaaaaattcggagaatttgagtcgtgtttattaatattagaacgttgcataatattgcctccttagagtgtagtggcataccttttgaattctcataagatctaaaaaattcaattcttaaatattagaccatattttagaactgggtactttcgcagattaggtggccgatgaaagaccatacaaaaggatcccatctatggttttaccgggccacataaactgtaaaagtgccaaacaactgatttttttacgttagaattgtaaccaaatttttacaatatctttttcaggtttttgattgcattgtgcaatccccatgatgacaccaacaagtccagcatgattcttatgggtcttcacttgctgaccgtcgcctttgagacgggggatgattttctgcgcaccaccgcatcacttcacgcattgctcaaggacgaactcagccacacactgctccaacttttgagcactcaaaaattaccaattttcgcagcagcgaatcgcgtctgttttttgttgttgcaaacattgcgtcctcaactgaagttggctcgttcacttaattggttagctcacaactgaactattgcaggttccaaatggagtcgtacttcctcaagttgggtcagctcatctccaccgaacaattggccgagtctgtgtccatttcatccgcgggttcacctctcgcggctaaggccgccgtttgttacgaattgcgcgaactcgcgctggaggcattggtcgacatgtggcgtttgcctggccttgtcgctgaattgtacctcaactatgactgctctctgtactgctcgaatctctttgaggatttggttggttgattttgtatctatatatatatatatatatattatattttacaaatatttttaagattcggactttgctctataatgcctttccaaatggtccgcttctcttttccactcacattttatccctcgacactgttttggctgtcgttgaactgatagagaccaattgtgctgccaagcaacttaaagggttcactggaaagggtcaaattggcattgaggaggaggtgtataattatccgcttttttgaattttcttaaaaaattaatttttttgaaaaattctgtttggaattttttttttttaattttcagggggagaaacgatgtgggtgtgggaaacgacctgctccgatttaa

SEQ ID NO: 47534 - DNA, 1955 bp, Heterodera glycines
  Genomic contig location: Contig_ID=SeqID_3131; Location=254..2208; Strand=+
  SCN-specific regions: Sequence locations=1-445,483-486,521-700,729 -774,802-914,936-1164,1187-1201,1223-1524,1546-1955
  Gene Ontology: Mol. function=DNA-directed RNA polymerase activity; Cellular component=DNA-directed RNA polymerase III complex; Biological process=transcription from Pol III promoter
atgtttgttcttagtattctcaaacacacggttaaaattgagcctactgcccttggtagagattttactgaggcgttggtggagcgtttaaatcgtcaatttgctaattacgtatgtactttgaatttaaatgtatcatgttacaggtcaaagagtattcaggttataccaaatgtcgggctgtgcattactttttacgactttaaaaaatacggcgcttcttacatattggtttttgtttcttgctttattaagttaaacaattttattttatagcccggtgacgcatcaacgcatacgcctgtcctattccgttatgttgtttttcaaccaatgataaatgaaattcttgagggcaacatactgcgctcgaaccaggaagggatcacaatcagtatgcagtttttcagcgacataacagttgcgccagacaaattgcctgcaatttctaaattgtatttattttattttaaacattattgtctaatgttctaacttcttttttattttagtgatgagtctgttcaagtttggagatgggagtatcaaaatgaaaatggtgatatcacgccattctatatggatccgggaaaacgcgtaaggtttgttattgttttttggtatagcaatgatttgaatttttctatattttcccgcgtgtgctaggcattcattttttccctgcccgtctattagctccgccgggaccctcccccaccccttctcccggtctcaaattttaagaaattatccaatgctttaaaaaattttggtgtaaaatcaacaacaacaaaaaatatgcgcggcacattcaacataaagaaatagtccggcggtgcagataagctattgacaagaataattctgtaagatggctggctatgtatggccttaccttttttgctttttgggtcttatttttcttacagatttaaggtgataagcgttaagtatcaaaatgtcgaaccgggcgctcctccagaagccaccaaagctatgacgattgaggttaataccttctgctttttgtattatccaaatttttcaggcatcgatgttcgatatgggcttgggttgtgtggcatggtgggaaccgcagtgcgcaagtgaattgaaacaggaagcaaatgatccaagcgaagatgaatagtaacaaacgaattgaagattttgttattgttttatttgttctaacggattcttttttaaaaatttaccatggtgaatgaatggatgcatttatgttaattaactcatttcatatttcaatttttttttcatttacttaatgtctttgatttagtcaagaaactattaaaagtatggctgcaattgagaagcctcagattgttcaacaacccgtgcaagtttttggtaggaaaaagacagcgactgccgttgcattcgcgaagaagggcaaaggcctgataaaggttattctttgccgaagttgggtattgtactttttcggctagttttagaattgtttaatggggtagtaaagactcatttattgagacaattcttttacaagctagaaactagtcaagactttttaaccagtgtattaccgaatttgttaccgcttttctacatttatacattctcccatgcagttttctcaattaaacattcaggtcaatggacgtcctttggagtttattcagccagaaattctgcgcatcaaacttcaagagccaattctaattgtgggcaaagacaaatttgcaggcattgacatacgaattcgcgtcaaaggcggtggacacgttgcacaaatttatgctgttcgtcaagcacttgccaaatcggtggtggctttctaccagaagaatgtcgatgaacaaagcaaaaaggagctgaaagagcaatttgtcgcctacgaccgcaatttgttggtggccgaccctcggcgccacgagccgaagaagtttggaggacctggagctcgtgct

SEQ ID NO: 47535 - DNA, 438 bp, Heterodera glycines
  Genomic contig location: Contig_ID=SeqID_18673; Location=60..497; Strand=-
  SCN-specific regions: Sequence locations=1-12,41-438
  Gene Ontology: Cellular component=mitochondrion; Biological process =growth
taaaaatttaaaaaatctgatttttcaataaaatgtttaaatttcgtgctgttctatccaatttgtctctgtgctgttcctcctctttgctccaaatccaacgacattttgtgactgcctccattttgcgaaaatatccttcgtccactaagcaatttgcaaatgcacaccgttgcatcagcaggacacggagttgggccatttttcaaaaacattcaattatactaatttcaaatgctaggtctcttcatgttcatccaagttcaagtaatgcaatttttccaaataaaatcatttttacttttttctcaaattgaggagacgccaaacccattgagtctcaaatttttgccaggccaaaaagtgttgtccgagccgggtcgcacttacgagttcacttccgcccgcgatgcggcaaaaagtagtccgttgggcagg

SEQ ID NO: 47536 - DNA, 1404 bp, Heterodera glycines
  Genomic contig location: Contig_ID=SeqID_18681; Location=1248..2651; Strand=+
  SCN-specific regions: Sequence locations=1-1328,1350-1404
atgacctttcacaaaattgacgcgagtagcatcgattcgattaccaatgccgttgattttttcagtatacccccgacaaatgttaccgtatcatcgtcaaaggttttcgagattttgccgagtaatccactcaccgacactccttatcattttaaaatacactcgagccaaaattacattgacctgtcaaagtgttaccttttgaccgaatttcgaatacgaaaattgacaccaccaaatggtgaatggggacatttggatgcttcagatcaggttgtaccgatacaattgatcgggcacaccttcatgcgggacttgaaaattgcaataaacggtcgtgaaattttcaattctaattcactgatggcatacaaaacttatctttctcatgaactttcgcaatcacttgaagctaaagtttcgcatttaactgctgctggatacgaccgtgaagatgctagtaatctacaaaacgcaaattccgaagggttcaaaagtagaagacaacggtatttgggaggtcgaacagcacaatacattgcaaaaattgatgccgatcttttcaatgtaccccaatatttgattaatcattgtgaaattgacataacgatacaaccccatgacgacaattttttgttaattgacaccttagacccacccggtcagccatatagtattgagcttgttggattgaaactctactgcaaaaaagtcagtcttatggatggcttggctcttgagttggcgaaaaaattggaaatgaaaccagcacggtatgctgtacggaagacaatgatgaaagcactgttcataagcccgggacgctatgaatttaatgcaaacttgttcatggaccaagttccacgccgcgtaacaatgggacttgtcgcaaattcagattatgtggggaacaccaaaaggagcccgttcaactttcaacactttaatgtacgggagttgagtgttgtggccaatggtcgctcttatccccaggccccgtatgacattgactatgaaaattggaaatttgttcgtccctacaatgacatgcaggaggcgcttggttttgccaactctacatatggaaatggaattgattatttttcatttttgcacactcactgtatttatgtgtttaatatgacaaacagcggagacgatcatggcggtttattcgatctgatcaaaaagggatgtacagctgtaaacataaaattcaaaaaaccagtacccgatggtggaattacgctaattgtgatgggtgaagcggactctatttactttttggataaaaacagaacgattgcaaccgatacaaccatttgaatcatttttaaaatgttgaaaattttattggcttccctatttttccagtcaattgttgcacttgttgtagaagaagga

SEQ ID NO: 47537 - DNA, 720 bp, Heterodera glycines
  Genomic contig location: Contig_ID=SeqID_18683; Location=42..761; Strand=-
  SCN-specific regions: Sequence locations=1-294,317-720
  Gene Ontology: Biological process=growth
atggcttcttcaattcgactcgctggcggtgctttgcgagaactccgaattcatctttgccagacaaccgcagcaagcaatggagttcgggaattcatccagaaagattatgtggacctgaagcagaacaatcgggatttccccattcttgtaagagaatgctccggaattacgccacgaatttgggcaaggtcggtgttgtgttttgtttattttgtaagtttttggtaatttttttccaaaaggcgtcacttttcagtttgtaggtggcccgataaaaataccaaagggtcccaaaaaggcttaaaatttagcgagcgttttacctcctttttcatgcggtgtgtttatcaaatattttttccaatcgaactctagtaactgtaagaatagaattttgctaaaaaaaaatttttttttgctgatcgactcgtacgcgttgagttttcacccttaatccacactatttttcacaaaaataatctacctaactcgaaaattacaagaaatgcatttttgtgactttaaaattttgaattttttttcccgtaaaaaggggtaccaaccatctaaattacccaattctgaattgttgaattgttttatttatttttttctagatatgagcatggagttgagacaagcgtttcggttgagaatcagccgcgtcagaagataatggaagtgatcaaagaaatggcaacgaaaaaaattgattga

SEQ ID NO: 47538 - DNA, 1142 bp, Heterodera glycines
  Genomic contig location: Contig_ID=SeqID_18711; Location=46..1187; Strand=-
  SCN-specific regions: Sequence locations=1-353,382-396,418-430,453 -658,689-789,836-952,988-1042,1075-1142
  Gene Ontology: Mol. function=adenine transporter activity; Cellular component=integral to plasma membrane; Biological process =embryogenesis and morphogenesis
atgtccgaaaataagtccgaaggtggcgctgaaaagaagaagagcggtggattcaacacgaagaagtttttgttggacctcgcatccggcggaactgctgctgcagtctcaaaaaccgctgttgcacccatcgagcgtgtcaagctgttgttgcaggtttgaaagaaatttgtcagtaggtagtgccggcctttatggcatgggattactaacctttactaatactaaaacaattctcgggtttcctttatgtatcacagttttcaactattgtattgcttaggtgcaagatgcttccattcacatcaccgcggacaaacgctacaaaggcatcatcgacgtcctcgtccgtgttcccaaggagcagggctttctgtcgttgtggcgtggtaacctggccaacgtcatccgttactttccgactcaggcgctgaacttcgccttcaaggacacttataagcgagtcttcacgcaagggtatgttcaacattgaatggttaaatgaaagttaaatctagagtggacaaggagaagcagttcttgaagttcttcgccatgaatttggcttcgggcggtgccgctggcgccacttcgctgtgttttgtgtaccctttggactttgcgcgaacgcgtttggcagcggatgttggaaagtgagattaaaattttaaaaaatacttaaataaaacgtccctttagggccgatgcccgtgagttcaaaggtttggcggactgcatcatgaaaatcctcaagtcggacggtcccatcggtctctaccgcggcttcttcgtctctgtccagggcatcatcatttaccgcgccgcttacttcggctgcttcgacaccgccaaaatgctcttctccccggagggcaagcagatgaacttcttcgtcaactgggccattgcgcaggtcgtcaccgtgtcgtccggcgttctctcctacccgtgggacaccgtccgtcgtcgtatgatgatgcagtcgggccgcaaggacatcatgtacaagagtgcgtttccctcactttcccacaattgattgttctgatttttgttttgttttagacactttggactgtgccatcaaaatcatcaaaaacgagggactgctcaagggcatgttcaagggtgctttatccaat

SEQ ID NO: 47539 - DNA, 1076 bp, Heterodera glycines
  Genomic contig location: Contig_ID=SeqID_18716; Location=10..1085; Strand=-
  SCN-specific regions: Sequence locations=1-581,607-863,885-1076
  Gene Ontology: Mol. function=RNA binding; Cellular component =cytoskeleton; Biological process=mRNA-nucleus export
atgtatcttgggttttttaactcgtgcgaactgcttttacacttgctgcaattggctcgattgagtttgttttctaaggttccacaagctcccgatgacactgtgcaggcaatgaaattcaatccgctggtggccgggtctcccatttttttggctgctggttcctgggacaacacctgtcgcatttggcaggtcaatgaaaatggaatggttgaaccgaaggcaatgcaaaatgttggagcgcccattctttcgctggattggtcggaggtcgtaattttttgttttgtaatcagacttgaaaattttccaaaaaatgtactctttccaggacggctcaaaaatattcatcgctggtgcagacaaacaagcgttcgcctgggatttaggctcaaaccaaatggctgttgttggcacgcacaatgagccagtgcgaagttgccattggatagcgacaccccaatattcggtattggcggtggaggggctgtaaccactatagaatttgaatgtaatgttcaacattttcagtgtctaatgacgggaagttgggaccggacgctgcgtttttgggacatgcgccaattgcccacccaaaactccctggcaaccatccaactgcctgaacgcgtgtactgctccgacatggttttcccgctgatggtcgttgctttggccgacagacacatcaaaatgtataagttggacggaacaccgtgagtttttcagagagctttctagcattcattcttttttccatttagctctgaaattcaagacgtggaatctcagttgaagtttcaggtgcatgcaaaaccttttactctctcgaatttcgttttcattttagagtcgttgcattgcgattttcaaagacaaaatgacgggacagcccaatggattcgctcttggctccaccgaaggcaaattactaatctaatcgtaattttcccatgtttcgctttttaggacgagtggcgattcaatgtttgcagccaaaggacccgaaggacaatttcactttcaaatgccatcggtcagccgaactcatcaacaattaccaggagatttacccg

SEQ ID NO: 47540 - DNA, 987 bp, Heterodera glycines
  Genomic contig location: Contig_ID=SeqID_18741; Location=1522..2508; Strand=+
  SCN-specific regions: Sequence locations=1-45,68-193,359-361,409 -725,755-776,798-987
atggacaagcccggactggtcggctcggtgctgttccacgcgctgtttttcggttttggcgacctcgagtccaatgtgctcaattatttgtctgtgccattgcgcgagttcttcgccgactcattgcaacggcactacgcaattgagcctgacagtgaacagtttgagctggcatattcggcaatagccagcgtaaatttgattaaaaaatatttaaaattataattaaacaaacaattaatatgaaattacaataaataaaaataaagataaatgaactttaaaaaaatttaattacaaatattcaaatataaaatagtttaattattatttaattcttattaaatttaaattaaataacaaatatttatatattaaaattcgacttaaattattaaaattaaattacaaaaaacattttagtctttctttgttggcgcgatcattgcgagtttgatgatggcgtggtgtatggaccgttacgggcgcaagggtactgcagtgtatatacggtaaagattgaaatttacttaagcaacttaattgcccatttcagctcttctcttggcattattgcagcactggccatgctgatggccaaatggcttggaatggccgaattgtttgtgctcggacaccttttagccggtgccatctctgcgctgaaaacggtcgtgttcatttatgtggcggaatgtgctccggaccaggcgagaggtgggcacaatttaattttgtttttgaaagttcctggttttgtttttgagctagctaacacaaaattcgaataacaaaaaagcattcgctaattgattgttgctaatttttagttcgactgggaattattcgttttgagactgcaagagtcttagacgattttctcaactcgagaatttgactcccgaaacatcccaactcattcattaccgcatttcctataatatagcccgccccccccccccataaattagagccctaccccttgaa

SEQ ID NO: 47541 - DNA, 1235 bp, Heterodera glycines
  Genomic contig location: Contig_ID=SeqID_3152; Location=2502..3736; Strand=-
  SCN-specific regions: Sequence locations=1-198,239-359,381-403,492 -517,694-1025,1047-1187,1209-1235
  Gene Ontology: Mol. function=glutathione transferase activity; Biological process=glutathione conjugation reaction
atggaagaatgggagaaaacgtacaaacccagtgagtaattaaaacgtgtggcataatgccatagaaataaatgccaaattaaaaaaaaaactaagttattcagaatttttctacggaaaggccccagttttggaggttgacggaaagccattggcacaaagttcggcaattttgcgctaccttgccgaaaaatttggtaataatatttattttaatttatttaattttataatttaagacttggccggcaaagatgaatgggaaaaggcgaaggctaacgaaatcattgactttctgaaggatgctaccactgatttgctcccgtatttgatggtcaaaatgggacgccaagaaggcgatttggtgaagaaaatgaagcaaaatttaattatttctaattttattaattaataattaagcaattcattaatttattcattcattaaattaaattattaatttaattttaatttaatatttttataaaaatcaattcaaaaatcacccaaatttgccaaattttttaaaaatttttggcaattaatttcatataaaaaatattttaatttgtaattttaataaataaatatgtatatttaaaccattttaaaagaaaaaatttcattctttttaatgaattaaaattctttttatatattatttaatagaaactttttttcttttaaatttttccattttccaaggacaaattgcacggcgaagtgttcgagccgggagtcaagcgcatttttccactttttgagaaacttttgaaggagtccgggtcagggtacatgcttaagtctggcctctcaatggtggactttcaagtaaaattttttttgaaaaaattggaaaattttctcgacggcagtcatcgaaaccgtcggagttgaaattttcaaattttttgaatttttaggtaattttttaaattttaagccgttttatgagtccttaaaaattgatttataaattagatttaattcttttgctgatacgaaaataatatgctatttacggtgaattgcttaaaaaatttttgttacagtaccgtaccataaataccgtaacaatcgctggttttcaacaggtggccaactttctgtacatgtttacaaagttggagccggacaccatcaatgcgtacccggagctgatcaaatacgttgaccgtgtccatgcgctgccccaacttcagaagtatttgaagcagcgcccgcaggaccgctga

SEQ ID NO: 47542 - DNA, 1104 bp, Heterodera glycines; identical to SEQ ID NO: 18790
  Genomic contig location: Contig_ID=SeqID_18790; Location=1..1104; Strand=+
  SCN-specific regions: Sequence locations=1-493,528-805,827-857,879 -1104
  Gene Ontology: Cellular component=nucleus; Biological process =cystoblast cell division

SEQ ID NO: 47543 - DNA, 159 bp, Heterodera glycines
  Genomic contig location: Contig_ID=SeqID_3161; Location=1515..1673; Strand=-
  SCN-specific regions: Sequence locations=1-159
gtacaatttggatttggtggaattgtccggtcagatgaagcacggcctggcactgtacaaggagaagcagtcgcacattgttgccacaatgatgggcacccggtcaacagatccgattggcaaatacatgaaaagcaacatccaatggaccgacggagg

SEQ ID NO: 47544 - DNA, 1651 bp, Heterodera glycines
  Genomic contig location: Contig_ID=SeqID_18808; Location=1..1651; Strand=+
  SCN-specific regions: Sequence locations=1-84,107-215,237-423,446 -974,997-1080,1104-1651
  Gene Ontology: Mol. function=RNA binding; Cellular component =extracellular space
cattaaaagtcggtgggagggggagagacgggagggaattgggcgaaggtcaatttgactgactgaatatttgatcagttacaaaattataatgcatattagaaaattgaccaattgaacttctaggcatttgtggttttgggcttcagttcgttcgcttgtgcgaagaaggggaggggattttattgagaattcccttgggagtggggcactaattccaattgccctcattccacaacgagacccaccattcccggccatatgaacatttcggttaaaatcgaccaaattatctctgttcccgcttcgcagatgtcttcacatgatccgacttcgttttccgccgtgtcgctttcccgacctgaacttgaagccggtgttcccgcctccgcttgctgcccccaccaaaccaaccaccgcttcaacagacaacagcagcagcactgttcaaggcactcctaccgttgtatgttgagcatataatcacactaatgactttgtcttggtttattcgccttttgcttttttagctcgctctgcccgttggggtgccgtgcgaggtttacgtttcggcacacgttgacgctgggcatttctttgtccaattgcccacccatccttctttttcatcactcgctttgctcgactcgtacatgctcagcgtttacactcagccgggcggagctccggatttgccgaagccgtgcaacagtaattttcaacatcgcatctttttaaatcgtttatctggctgtttcctttcagtcggcgtgctttgcgctgccccggcgtacaacggatggttccgcgccattactttggcatacgaccaggtggaaagcgttctccaatcattcccattttaataatattttacctgttcattgtcaggaccaggatgagatgttggtccgtttcgtcgattacggcggcttcgcccgtttgccccgggccgatttgcgccaaattcggtcatttcccccgggggttttccagctaatgtcatcatctcttcccatttcagtactgactttgtgacccttcccctgcagggcatcgaatgctatttggccaatgtgcagccagctggtaattaattgtccctaattgggccaattatttcttagggcattttacctttcctttccgttcagatggctctttgcattggagtgacaaggccaacgagttgttccagcagttgtgcgtgtccaaaatcattcaggcggcgctggtgggctattgcaaaacggacggaattccgtgcgttgagcttttcgtgatggacagcgccaacaaaaaggtgggatcagagggcaattgttgtttattgctcaacgaattgagtccgttactcctcaaaaatccaggggattctcgggcgaaaaccctggactctagcaaatccctagtgctaatggactgtgggtccgttccgttctcaacggtgccaatgcctttttcatgccgtttcagactgtgcgcattgaccaaattctgttggagcgtggccttgccaaacagatggatccgactttgatagtgcgaacgccgatgctggtgtaagaaggggacctccgagaccagcacaacaacaacgaaaccaacctccggtcgacaattgaaattcacaaaggaataaatgatatgt

SEQ ID NO: 47545 - DNA, 1269 bp, Heterodera glycines
  Genomic contig location: Contig_ID=SeqID_18860; Location=1..1269; Strand=+
  SCN-specific regions: Sequence locations=1-115,137-959,982-1269
ggttccttccgacaaagggaatcgcctcattttcgttcgacttatggtccaacggattacccaatcattggcgggagtttgtctctcccttcctttttgaacaaaccgcccaaatctttaaaaaggtaagtaatcaaaggcatttctgctccgttcatcctaaataaatttggtttgcgtcattttcagtcgaaagattgccaataaaagaaagccatgcaattgcacaaaatcaatgtgtctgaaattgtactgcgattgcttttccaatggcgagttctgtttggactgcaactgtaaggactgtcacaacaatttggagcacgacgcggaacgcagccgagcgatcaaacaatcgctggagagaaatccgagcgcattcaaaccgaaaatcggtcacccatcgaacagctcatagttagcaattacggattttctacgctttaaggagttgctgcaaaaaatatcggaaaagcaattgacatggagcgtttgcatcagcgcgggtgccattgcaaacggtcgaattgtctgaagaattactgcgagtgttatgaggtgggaggagcagcgaaattgtcataaaaatagaaaaacatggacaaacaatggtttaacgccctgtaagccaaaacatagactttcttaattatttcgcctattttctatgccgacaattggttggcattctgtgcctaatttggcttttcttttaggcaaaagttccgtgcaccgaccgttgcaagtgccaatcgtgtcggaacactgaacatgaccggcataataagttcaaggacaagttcactaccaccgcgggtggcctcgcccaactcgcggcagcagcggccgccgagtcgcacgcgcgcgcgggcacgccattgagcgaggacgacaccagcgacatttgtgtaggcgaagacgaaacgacgagacaggcaaacccaaaaacgtgcgaatcgaatgtttggcattgtccattttgagatttgtgattcagtcagccgtggttttatatgacagaggacgtaatcgaagcgacgacaatgtgtttggtatcacaagcacaggaacttgtaaatgaaaaacaaaagatgtcaacgccaacaggcactttattttcaggagcaaagtctttcggaggaggcgttggaaaaaagcgttttgcgggagtttggccgttgtctcgagcaaatcatcgaaagtgccaattcgtgcctacctcagaaaagtaatggcgctccgcaacattttcaccttacacccattgaa

SEQ ID NO: 47546 - DNA, 1279 bp, Heterodera glycines
  Genomic contig location: Contig_ID=SeqID_3181; Location=879..2157; Strand=-
  SCN-specific regions: Sequence locations=1-8,34-42,70-315,337-909,932- 1279
atggcccgtggtcaccaaaaggcgctgtctcagcaaaagaaccagcaaaaacaacagcagcagaagaagggtcagggcaacgatcagagagcggctgccgccaaagcactgacattcaaatgctccgtttgcatggtaaaaaaactaaaatggctttgggtgttgtacggttgatgtccggaccaaaaaaggcttcttgaactggccttccgtggtaacgaataaatccatttttcttttatctgaactgtttgtagttatttacactgaattaattcagttacgtttttgttttcagtcattgatgcccgacccgaagacgtacaagcagcactttgagtcaaaacatcccaaggtaaacaaaaccaaatgaatttctgtttttgttatatgttttagaacgaactaccgcctgaattggtcggtgttgaggcatgacaattgtggaattttgtggactacgatgttttgggggaccattggaaatcatcgaatgtatttgtttggcgtacggattgttttcattgcattttctttattttttcaaacaattttattttctggtgatggtgtatttttgaatttccaaaagcaacgtgttttgcggtgggtgcttttgttatttccccgttcgttatttaaattgctggtgattttgtagggcgtcgcttcgctcggaaattagcaaaaaaaaacgaacacaaaatagcctggaattgttcattcctttttttaatattataaaatgaaacgaattaggaaggaaagaacaattcagacggagtcagtggaatagtcaaaatcggacgcacttttaaagagaaaagtccgattcgaatgtccaaaagggcgtcgtttgctcagattcaattcccaatgtaacaatggataaaaccgttattgtcattgataaatcagtgttcaaaggagaatgtgcctgtttttcttaagttgtgtttatttttgagaaattttctgaaaactttattatgaaattggctctaatgcagtttacgcgtccaatcgacttttgcgcgtccaatcaatgaccaacctcggtttcttaagccataacttttttcttacttggtcaaaacttacattcttggtattaatcgagagcttaaagttcactgaagtttttgtatagaaaaatgcctggataaaagcatagacaaaaattactgttgaatatacgcgaaaaatgatgaattcaggttttttttcattgcaatttttttcttaatgcaagtatttgctcttttcttgtattaataaa

SEQ ID NO: 47547 - DNA, 204 bp, Heterodera glycines
  Genomic contig location: Contig_ID=SeqID_3181; Location=2352..2555; Strand=-
  SCN-specific regions: Sequence locations=1-204
  Gene Ontology: Mol. function=structural constituent of ribosome; Cellular component=mitochondrial large ribosomal subunit; Biological process=growth
gtcagattggccaaatttgacgatgctaaaaaaattgcactgatcaaagaggtgcgaagtgtgatccccggcatgaatttggtacagaccaaaaaactgatcgaatcggcgccggtggaaatcaaaggggacatgggcaaaacggaggcggacgaactgaaggcgctgttggagaagcacggggcggaatgcgaagtgatctga

SEQ ID NO: 47548 - DNA, 647 bp, Heterodera glycines
  Genomic contig location: Contig_ID=SeqID_3185; Location=74..720; Strand=-
  SCN-specific regions: Sequence locations=1-24,132-168,193-242,264 -500,524-647
  Gene Ontology: Mol. function=DNA binding; Cellular component=nucleus; Biological process=body morphogenesis (sensu Nematoda)
atgggaggaacggaagcaaacggtggaaacagtgaaggagaggagggcggagaagaagcgagagaatgtggagaagagaaagagacagcagacggaaaagaacagagggaagagaaagagaaagtgagagacacagacaaaccaaccgaattgagtcgaattcttttttatgtttataaaagtgttaaaaataaacattttcaatatataaatattactatcttcccacaagttgaagacgcattaattaattaaatatgaatttggccagtgattcatttgttttgcaaaaacaaaggaagtttattggttcatctgctcagaatgccgaaacacgagaagggaacgccgaaagaaattgccaaccgtgcaaaggtgacaattcatattttcaaaaatgggagtggggacaatgatttgttgttttgtctttagtcatgtcatatttaaattcctcttttcaggccaaagggctgcaaaagctcaaatggttctgccaaatgtgccagaaacagtgccgggatcagaacggcttcaagtgtcacatgatgagcgaaagtcaccagcgacaactgttgctttttgctgagaaccaaaactcgtatctgcgccagttcagccgcgaatttgaggccaattttatgcac

SEQ ID NO: 47549 - DNA, 1491 bp, Heterodera glycines
  misc_feature (749)..(749): n is a, c, g, or t
  Genomic contig location: Contig_ID=SeqID_3188; Location=903..2393; Strand=+
  SCN-specific regions: Sequence locations=1-309,339-697,719-749,772 -991,1013-1491
  Gene Ontology: Mol. function=structural constituent of ribosome; Cellular component=cytosolic small ribosomal subunit (sensu Eukarya); Biological process=protein biosynthesis
atggaaagtaatgcccgtgggtgcgaaattgtggtcagcggcaagttgcgcggtcagcgtgccaaggcgatgaagtttgtggacggagtgatgatccattcgggtaacccggtcaccgagtacatccaagaggcggttcgccacgtgcaaatgcgacagggtttgtgttttaaaatatggaaaaatattttgggatctatttgaaagatcgattaaaagggttttcgggtaccaaaaatacttttgagttagtttccaatgccatgcgatcccatttttctatttttttcgcctctttgttcaggcgttttgggcatcaaagtgaagatcatgttgccgcacgaccccaagggacagatgggaccgcgcaatccgttgcccgaccacatccaggtacaatattctacaaaaactgacacacggaaccgcataactcgggatggatacaaacccgaggatttatttttagaaaaaaaaactccatacctttagattagagaaggacggagaatttgctattaaaaatctaaaattctgggtttcctagacaaaaataaagttttgatactttttcctaaaattgttccttttccatgacaggtcaaagagccaccgattgacgtcgcgccgaccacgccgtactcggagcaccgcgaaccgatgaccactggcatgccgccccagacacaaatgccgcccgcccatcagcagcagcagccgatggttggccaagtgccgtccccggcacnagttttattgtgagaaagaaccgctgatgaatggtcatgatggaggaaggggagatgttcaattaaaattgttatttgttttttttacttttttttttttgctgttgaaacgcatcgtaaatggaattgctaatgaattttggaacaaaacctttggggttaaaaagtaattaattgtgcccgtgatttagcgtcttttgcccatgattagcaaataataaagtagatttagaaatatttacttcaaacaaaaaataaacaggcagtgaaacaaaaaggcatttttcagttaaagtggtcaaaaaaagatttaaaaatgtttttagcaacctacccatatacacgttgcatgagacatgtacacattcataagttacatatttgtacaatatgtaacccattatgtgtacatgtgccatgcaacgtgtacacaggcaaaaccaccaaaagaaatttcgatttttgaccaccctaactgaaaatttcacaactttttttcgtgctattagaaaataacaattttagtttatgttctgtttcagccactcataaacagattccattgaatatctttcgctgctcctcacgctccaaacgttatttcatcagagttgccaaatcgaacacgaattcgggtccaaagttcgcctcaatttcgtcaccagattcaagcaaagtaacgaatggaaagaggaacgcacaatcagcagatagagaaatcgaaaatgcagttgaatcttaa

SEQ ID NO: 47550 - DNA, 1511 bp, Heterodera glycines
  Genomic contig location: Contig_ID=SeqID_18895; Location=398..1908; Strand=+
  SCN-specific regions: Sequence locations=24-219,243-362,384-836,858 -1511
  Gene Ontology: Mol. function=structural constituent of ribosome; Cellular component=cytosolic large ribosomal subunit (sensu Eukarya); Biological process=protein biosynthesis
atgtgtcgtggtggccgtatgttcgcaccgaccaaagtgtaccgtcgttggcaccgccgggttaatgtggcgcaacgtcgttacgccattgtgtccgcaattgccgcttcggcggttcccgcactggtccaagcgcgtggccatgtgattgaccagctcaacgaaattccgctcgtcatttcggacaaaattgagtcgttcacgaagaccaaggaagcggttggctttctccagcgagcgcatttgtgggacgatgttgagaaggtttcatttaatacattttcgagataagtattaaggaatgctttttaagtaaaacgaaaaatatcagttggagaaataaggcatctacaggaaggaacaggcataaatagtattatttccaataaattgttagcattcctctcgaaaatgggttcagataaaggcgttgcttttctgtgcgtggtttttgttaatctctgcacaaattatatcttttctttaggtttacaaatcgaaacgcttccgcgccgggaaaggaaagcgacgcaaccgtcgctacaaacagaaattgggcccgctggtcatctacaacaacgacggtggcattgtgcgcgcatttcgcaacgtccccggcgtcacattgctctccgtcagccacctcaacttgttgaagattgcgcccggtggtcacttgggtcgtctcgttgtgtggacagagtccgccttccgccagttggaccccctttttggcacatggactcggcagagcaatgtcaagaagggctttacgttgcctcgtgccaaggtatagtatttaacaacaaaccctttgttggtaatcatgttccttcgtaattttatttgtctgttttttaagatgaccaattcggactttgcgcgaatcattcgctcggaggaaatcaccaaagtgttgcgaccgacgatggcgcgaaaagtgcgccgggtggccaagattcatggcaacccgctgaagaaaccctcgctgatggccaagctgaacccgtacgccgctgttctgcgccgtgccgcggtgttggcatcgtcaaaagttaaaaaggcggaggcaaatgaatcggagggcaaacagaagcagccaaaacagcagaagtaagcggttgggctggttatgttaccatagatttttatgactatttgttgaatctacgtagtttttaaaaaattgttaagaacactgcatattgagtcgagtcaattctattacaatattagtaaacccttgggataagaacaattctctctctgggtttgtttgcgactaaaaaagtgattaccattcaaaccgacaaattatctatcttccctttaattttagagcaactgcctaattgaacgaaaacaacatggaacaactgattggcgatgctgactttggcaacacacatttatttttgttgggcgataattgtttttgttgagtggataaatgttgattttgtttcgttgggacttcttataattggttttttgaatggtaattccgtaaa

SEQ ID NO: 47551 - DNA, 2370 bp, Heterodera glycines
  Genomic contig location: Contig_ID=SeqID_18904; Location=1..2370; Strand=+
  SCN-specific regions: Sequence locations=1-261,283-364,386-410,433 -508,530-1127,1150-1710,1732-1771,1842-2370
ttactgggtttttgagttccttctggccataacttttttgaaacttaaccaaaatttttgagattttgcaaattaataataaacacatagactatcgaacaacaccaacaattcttaatttgattgacagtgaacaaagttatggttcaaaaagtcttccgacgacgtttcggccgacgacgttttggggtgcaccgctaaaaatcccatccctacacatgacccaaaatttggtggtggttttgggtgttggtgacagaatggggtcaccaggacagacaacccatcggtgctatataagacattagtaaaaaacaatcagatgaaaaaatttttggtataaatttactcaaaagcaaccaaattttaaaagcttaatatcattcgatagtcctaaatgttttctattaacttacaaaatttcaaaaaattttgttaaggttcaagaaagttataaaaactaggcttgattttttagttttctcaggtcaaaacttttttgaaattttgcagaatgataaaaaatgtttagagctatcaactaaaatttaattcatttttaacgaagttgtgagtaatttctgtcaaaaattttccataacgaatgcggaatcactgaacatttgaatcctggggatgtccatcgccatccatggacagttgtgggttccgatcaatcgaacaaaaagcgccgcagtgtcaaaattccattcactgaacgcaaataccgtgatattttcataaaaaattttcgcaaaacacttaaaaaacaccaaaattttccgcaaaatatcacggtccggcggggtctgacccgctcggaactgcgagccttgtaccagcttaggactcaagcatatgaaatgaataagtccgaaggactgttcaaatatactgtcgttgacctttccattatcacattgaaaaacccacaccctctcaaaacatgagaaaataatgcataggggtcatcgaacaaaccactacaaaatacgaaaatggcaaaaaaccaaaatctctcctgtatactcattaatgcaaggtcaataagcaataaggtacaggaaataatttatttaatggaaaccaagaaccgggactaatctttataaccgaaacatggctgaaagaaaaaatacaattatttctgaattctcaaatatggggaaatataacccaatttttgcaaaccgtccaacaaaagggggtggatgtgccataatagtctcaaataaaataaagggggattaatagagactggactataattagagcatatacatatattgataattctaaagcttttgatagtgttccaattgaattacttctacaaaagcttaaaaatatcggtattaatggtaagattcataaatttatcgaaaatttcttaaatgaccgttcattcagagttaaaatctctgagcgtattcaaattcaaaaaacatttatagtggggtgccacaaggtagtgtcttaggccctttgctttttcttatttttattaatgatccccccgaacaatttgcctaaaaatgttggtattaaaatgtttgccgatgatattaaaatttatattgagcataaaaatgataaaaatagagagaatttatcttccgcgcttgaggcaataaataaatggtcaaaaaataatggaataaaaatatcaatagaaaaaacaatggtcctttactttggtgaaaataacacaaaatttatttattttcttgatggcgaaccattgcccgaaacaaaatgtgtaagggatttgggcattttaatcgatcaaaaactatccttttctaaccatattaataaaattttaaaaaattcatatttttcttgttttcagcttctccgggcgttaaaaactcggaagcttgaaacattaattttggcatataaaagctatatcagaccagtgttagaatacgccacagaaatttggaatccattgaaaaaagaaaatgtccacaaaattgaagcagtccaaaaattctttacaagaaaagccttcaataaatgtgggcttgtccctatgccgtatgaaaaaagattaatgttttgcggaattaagacattggaaattaggcgcaaaattaatgatattacaactacttttaaaataataaaaaaacatacacatcttaaaccatctaacttttttgctgttgctaaacgggctattcgcaaaccctttttactacaaaataggatatatattacaaaaacaaaaaataatttctttaatagggttattaattcatggaatttattaccgaaaaatattatggaaataaatgaccccaaaaaattcagagaaattgcagaaggaataattaagcaataatgcatattttccctattgag

SEQ ID NO: 47552 - DNA, 1760 bp, Heterodera glycines
  Genomic contig location: Contig_ID=SeqID_18910; Location=379..2138; Strand=-
  SCN-specific regions: Sequence locations=1-40,62-215,240-288,311 -543,565-1086,1109-1302,1324-1379,1434-1760
aatgggccaaattccctttccaattacagtttcagacataaatgagaaatactgcatatttaccactgaattaaaaaagcgttttgataaaaatgtacccatgaaattgcttaaaacaactattaagaaaaaacatgatgaaaaaataaaaactttagtaagggaaaaagcccgaacccatagcatgctaaaaggaaaagctgagtgccgtgagcttaaaattaaatataaaatattatgcagggagtacaaaaaacatatccacaaattatactgtgaaaatgaagctaaatttatttcaaatggaagaaattctctctataaatttgttagaaatcggcttaaaactaacaccggaataccaacacttattgatgaacgagggcaaattatttttcggaataaacaaaaatgtattttattggctgatgtctttcaaaagtcatttttgtacaaggaaaataacaatgacttactcagccatgaaaaccctaatcagatcacagacattgaatttaatgtctataatatttggaatttattgaaaaaactccctagaagaaattcgacatcgcctgatggcatcccttacatattattaaaagaatgcgcattacctttggcacccatactaactgaactctttagaataattttagattcatctaaaatccctgaaatatggaaaacgtccatatgcagagtaatggaaaaaataataaagctagaaatacttaaatttttgaataaaaatcaattttttagtccatttcagtttggattccgaagacaaagatccaccacaacacaacttctatcaactttaaatgatttttatatatcgattgaaaataaaagttgtgttgatgtaatatatattgatatttctaaagcttttgatagtgttccaattgaattacttctacaaaagcttaaaaatatcggtattaatggtaagattcataaatttatcaaaaatttcttaaataaccgttcattcagagttaaaatctctgaacagtattccaactcaaaaaacatttatagtggggtgccacaaggtagtgtcttaggccctttgctttttcttatttttattaatgatcttccgaataatttgcctaaaaatgttggtattaaaatgtttgccgatgatattaaaatttatattgagcataaaaatgataaaaatagagagaatttatcttccgcgcttgaggcaataaataaatggtcaaaaaataatggactaaaaatatcaatagaaaaaacaatggtcctttacttgggtgaaaataacacaaaatttatttattttcttgatggcgaaccattgccagaaacaaaatgtgtaagggatttgggcattttaattgatcaaaaactatccttttctaaccatattaataaaattttaaaaaattcatatttttcttgttatcagcttctccgagcgttaaaaactcggaggcttgaaacattaattttggcatataaaagctatatcagaccacagttagaatacgccacagaaatttggaatccattgaaaaaagaaaatgtccacaaaattgaagcagtccaaaaattttttacaagaaaagccttcaaaaaatgtgggcttgtcgccatgccgtatgaaaaaagattaaagttctgcggaattaagacattggaaattaggcgcaaaattaatgatattacaactacttttaaaataataaaaaaacatacacatcttaaaccatctaacttttttg

SEQ ID NO: 47553 - DNA, 1378 bp, Heterodera glycines
  Genomic contig location: Contig_ID=SeqID_18936; Location=1536..2913; Strand=-
  SCN-specific regions: Sequence locations=1-452,474-1143,1165 -1288,1310-1378
  Gene Ontology: Mol. function=transmembrane receptor activity; Cellular component=membrane fraction; Biological process =agglutination during conjugation with cellular fusion
atgatttcgaattgtcgccactgctcacgggattggttgggattttctgttttggttagcattgatcagagtgacctgaattttatcgggaatattcgggatttgttggatttcgctttatttcttaatcatgttctaccccagtggactgatcagtgatatttaatctcgacgccaattcattgcagagtggcgagctgtacttgcgcgaagtacccgaccaattgttcggccggcaacgagccgaattccgtgcccatttgaccgccctggacggccactgggccgacgcggttgtggtagtcgatttgaatttaccgccaaaatccggcagcgttggcaccggtgccggtgtcggtggtggtgatgaaagtgttccaaaggcggctaccattggccacaaaaaacaccatcaacaacagctcgcaaccccatcgggtattgaaattgccgaaagttctgatcaggtgaggcccaaaagtggacggaatgccaaggaattggtttaaaaattgaaaatcaaaaatcattttttaaacatagacaatgggtgccgttagcaagcattagctataattatcctcactaagtttggtgaagtttaaagatttatggttgcaaaaattataaaaaacgtgtatttattgtaatttagggaaccgtaattattttttgtaattcagatacggtatttttatcgtatctactattttggtacatttttgatacggtatttgctcactccgtaacgcctttttgtatatttcgtatacgttatttcctcacccataaatttttattttttgtacattttggataccatatatattttccgataatgtctatttcgggtacggtatctttaactttttctttttaggcgagtcgaacagttgccccaacagagacaaaaattggttcgcttaagccagcagcagcagcttcatctccacgatcaacaccagtcacaagctcacgttcaacatttgcgacacgtcgtaaaactgcaactacagtatcaccaactacagtatctacatcgtcacaacagccgaaccgattcagcagtacgatgtcgacaagagcaacaacaacagtggctaacgtattctcttcaacgcctccgtctacaacaagcagtagcaccaccagcagaactgctgcttctgctgatcattcctccaacgccaaatcgacgaacatcagtgatcagtcatcttctgttgatcagtctgatcagtcttcgtcgtccagcagcagaagccgagcaccggttgttggtgttgatcaacaacagcaacaaaacgaagtgcactttgcgtccgatcagtaccgggccatgttgccagaggcaattaaatttaaattttttgactaa

SEQ ID NO: 47554 - DNA, 1060 bp, Heterodera glycines
  Genomic contig location: Contig_ID=SeqID_18951; Location=1088..2147; Strand=+
  SCN-specific regions: Sequence locations=1-543,568-910,970-1060
  Gene Ontology: Mol. function=protein transporter activity; Cellular component=AP-1 adaptor complex; Biological process=neurotransmitter secretion
atgatcaattacatgctgctgttctcgcgccagggcaaactccgtctgcagaagtggtacgtcgcatatccggacaaggtgggcaacacacacagcgggagcagaccattgacagtggggtcgggagcggttaattgcttagatggctgctctcacattggattgactacttattgtttgtgatggcaaaattgcgctagcccgttgtgattaattatctgattgtttagtttaatttttgtcccggtttatttagagattaaacaagtggtgagcggcacggtaaaatttaccggccttttttgtgaccggtagatttaccgaccgactatctctgaaaaaccggttgtttttaccgttatgcatttgccgttcactattagctcttacaaaattgtttaaaaaagactgcattttcaggcaaaaaagaaaatcacccgcgagttggtaaccaccattttgtcacggaagcccaaaatgtgcgcattcctcgagtataaggacacgaaagttgtgtacaaacggtgtgccatattgaaaaccaatttaaaataaataatttaatttctcagttacgcttcgctttacttttgctgcgccattgagcagacggacaatgaggtgaatgaattgaaatttatgatgaattactaagatttttcaagaaaaaaatttccaaaaaaacgctgaaacattttttttcttgtaattttcttataaaaaacttaataagattttttcttgaaaaagtttctaagtttgtaattatcacttggttccatgcttattccgaagtttgtttttgaaattcgactcgatttttacggtaattttttccgaattcgccccgaacttcgttcagttgctttgtctggaggtcatccaccgttatgtggagctgttggaccgttattttggcagtgtgtgcgagttggacatcatcttcaacttcgagaaggcctacttcattttggacgagtttttgttggccggcgaaattcaggagaccagcaaaaagcaagtgctgaaggcgatcagtgcgcaggatttgctgcaggat

SEQ ID NO: 47555 - DNA, 1467 bp, Heterodera glycines
  Genomic contig location: Contig_ID=SeqID_18955; Location=312..1778; Strand=+
  SCN-specific regions: Sequence locations=1-236,259-750,776-1002,1024 -1303,1332-1467
  Gene Ontology: Mol. function=glutathione transferase activity; Biological process=glutathione conjugation reaction
atggtggaggtttttaggaaagtgataagtatgttaaattttaaatattattgatgaatctgtttttttcagaatttatctacggaccagtgccagttttggaggtggatggaaaacaattggcacaaccagcagccattatgcaatatttggccgaaaaattcggtgggtttaataccatttagcgggataaatgtaaaaaaaaaaattatcaactacacattcattcatccatagaaaatatttgtaaaatgttttctcaaaatcccattgatcaagctttatttatatctttagctgattctcactatttatgtaatcatgtctgggagttagaagtcataatatcatttttccactttaaaatcacattttgatttttatttttgcatttattttattattgttgaagaattggccggtcaaaacgcgtgggaaacggctaaagcattggagatcacgtgttatgtgaatgacatcatcactgagttggtaccctatcttggcgcaacgatcggcttccttcccggggacgaggtaaaaaaaatggaaaatctaatctgatcatgatcatagtacaatgatcttttgattgagattagtgattatcagcaaatagaattgcttattgtttttttggttatatggctaatcaatccaacgaatgaatgagagaatgaggccatgttccttttttgcaaagcagatttagtccgatttttttccatcaattaactaaaaagaattgacaaaaaaataaaataataaataaattgcagtcattaccgaattaaattaatataagaattcttttatcactaattgtatttttgaatgtgtttaatctgctctaatagcactgaacattgaatttatcagtccggtgattaaacagtgattgttcatttttcttttctacatgctgaatatttcacaataaagtacaaaaagatttgaatttgggtattagttgtcctaattactctcctaatagcttgtattgctctaatttgttcattttaaccaacattttccactttaggccgcccttcgttcggatgttttcctccggtgcgtgaaaaaagcatttcctcttctgatcgctcagcttgatcaatcaaagtccggcttcatgcttccgtccggcttgtcctatgccgattttgtggtcagttgcgccttcgaaatgctgtgccaactcgacgcggctgccgactttttgccgaatgagtacccgtcgttggccaaactgacggaacgggtcaaagcacttccccaactccaaaaatacttcagcactggcaagaatcagaagcacaaaatgtgaccatagagaaggattgattgatagtcttgtcaattggacgaaaaatcattgtgaaatttgtcactaaatttgttaattaaatacgctttttgtgcggttattttgtacagatttttcatgccgcttcctcacccctccca

SEQ ID NO: 47556 - DNA, 2045 bp, Heterodera glycines
  Genomic contig location: Contig_ID=SeqID_18990; Location=52..2096; Strand=-
  SCN-specific regions: Sequence locations=1-495,517-519,542-737,759 -790,812-1570,1592-2045
  Gene Ontology: Mol. function=transcriptional repressor activity; Cellular component=spindle microtubule; Biological process =regulation of transcription, DNA-dependent
atgatctccaacatgtcggcccctgcacccgcgtctctctcagtcagtgataatgtcacaccgaattcccaacaacatcaccagttcacagaaacttctgtcccgaattcttctatcaaaatagaaacaataagctcttctccaacaacacaaaacataacgagctgtacaaataacggaacaaagtcatccgtcgttctctctccaagtgccagcgtaaatgtcacagtgtgtgctgctacatcgagcaatgacgacaatattctgcagcaaaacaccaccgagcacattgcaactggagaaaccatcgtcaacaacggaagaattgagcctttgccgcagctccaccaacggaataccggcagaacattcttccgcgcgccgggcttggaagcgccggatgagaacagtggcgacttccccacaaatgcgttggtctgtcctgattgtggcttcagttgttcttcgaaattccattacaactcacaccgcaacacgcacaggtggccccgttgggcgagcaatgacaaaactgaacaaatgattttcagcacgcaccaatgcccaatttgcaagtttgagactcgcacggaagggcgtctaaagaagcacatgttgcagtcgcacaagcgagagcaaaggcttgctgcaggcattaacatccaatcgccgcccccgacaccaacgacactcaagcagaattcgccaccttctaacggcgatttaagtggcgataaatgtttgagtcagaaaatacttgccagtcaaggaatgcccccggatggcataagcatattaaacaggtggcaattggatgataatgagaatggcaaaaaacgaagttttctgatttagcatgttgtcggcgggagacaattccaacgggacactcgccttagagtccattcagtctatgctcaccaataccaattctgttgccttctccaactccaccgacgccctccttaagatatgcactgatgttattgcgaacaatggtcccaacaaaaaaatgctcaattcgtcgccgcaggtgggggacttcggccacattccgcttgaacagctgagggccctgacggaaaggcacaccgccctgctgaatacatcgacagcaggcacactgaacatcgcagagttacagattgggccagaagcggtaagcagcgcaaagcaaaccgaaaaagagacacgcaaaagcgccatttcagtcgcttatcggaagtgatgccattcaccaacaaaacgcagcacagaacggcagcgatgagaagcaggacacgccacgaagatcggggaagccgaagcagtacaaatgcaagacatgtcagaacatcagccgcagtaaagaggagcaatgggcacacgcacgcctgcatatacccaagcaaaagcagttgacttgcgaactttgtgactttgtgacagaatacaagcaccacttggagtaccactaccgtaaccacaacggacagaaaccttttaagtgctccatttgtgattacagtaagaaaaggacggactacaattaaacaccgcttctgtcgttcagcttgtgtcaacaagtcaatgctgaattcccacatgaagtcgcacactcctgtctaccagttccgctgccaggactgcacttatcagaccaaatattgccatagtctgaagatgcatctgaagaagtacagccacaaaagagcgcctgggcccagcggatttgtggacagcagtgacagtcacggggagggtttgtcggggaatcccttacaattagcactttgattcctcttcctctgttcaatcgtctgaatccccttcttgttacagatcggcctgaaaatgcgtccagttcttcgattggacgtgaagacacggcctcttttgagaatggtgctccaattgggactctccaatcggatgggcactcggaaggaacggaattaatcggagcgctggcaacaacaattcatcagcaccatctcaacgggcctccgcctggcgataccgccgagatggagctgacttctcatcgattactactacaacaacag

SEQ ID NO: 47557 - DNA, 3789 bp, Heterodera glycines
  Genomic contig location: Contig_ID=SeqID_3215; Location=100..3888; Strand=-
  SCN-specific regions: Sequence locations=1-38,66-469,493-629,651 -1748,1770-2234,2256-2390,2412-2417,2441-2529,2554-2644,2666 -2863,2887-2894,2916-2961,2983-3789
  Gene Ontology: Mol. function=phospholipase C activity; Cellular component=mitochondrion; Biological process=protein-nucleus import
atgaatagtgttttatcgatctccattttattcctgctcagccaggttctttccactgtctcctctagcgatgtgttggaatacacggatgctagctttgactcgggaatgcagcagcacgacatcgcattggcagaattctatgccccctggttggttacttcattcctcacttttttattgcacatatttatcgattacccttcaaatgaaagcgaagcatttttctattttgaataatattacctgtgctgtttccccaaaaaatgctttttaggtgtggacattgcaaaaaactcgctccggaatacgaaaaagcggccactaaactgaagaacaacgacccaccaattccactcatcaaagttcgttttgtgaacggtattataaatcaattggattagacaagttcaggtcgattgtactgcggaaaaagagacttgcgataaatttggagttagcggttttccaacattgaaaatcttcaggaaggggcatgtttcttcggaatatgatggaccaagagatgcagaaggaatcgttaaggtaaatcacgaaatcgtaatgcgtttattcctcaagaaacattgctttttctttaccaccccccctcccccctccaaaagaataataaaaatgaacaaatcaataaattcgttaatattttaattcctctttattaatgacttaatccctgcgacagttatttgaaaacccgattaatccgaacgttgcctgatatatgagcataagtggacaagccagcgcagttaaaattcaaagtttaaccgcatagtttctcgttggtccatacctaagcaattgagccttttgtaatttcgtaaaatggattatatcatctttacctacaacagatacgaacatattatcaatcattttctcactgttttaaactctaatgggttacatgaacttactcccatccattttcactcagctcatcaaatggatggatggattatatatatatatgttctattttttcgtcaccagaagtttgctatttttttcgtctcctctacggtctatccgtttcattattttctcattcttctttctttcttcttttgcacacacacttctgcatcaggaagtaacactcgtggtaggctgcgcgcgagcaggcccggacttgggatggtctgtactccgtgctaggccttatctatgagtgtcagctgagcttttttttggttatgttggaaacatttttttgccacgtttcaatgttttgcgaacgaagtgaccaataaagaaaggatgttaatccaaacacctgctaccaaaggggaaagaattcgtgattaaattcaactaaaataaaatactaacaaagataaataaaacaaaaacattattaagactactagtcttaagtcaacatgttatttttgaacacataaattggccgaattcggcatccgaatggtgggcttataacataaacggctgttttccaccagttattcgtgtgcatctttgtgaagttcatcactctccacaaattatattcaccattcctggtgaaaattctaatgtccttttccttcctcaaatttctcaaaaataaagttgttggcttatctgttgtgatagttaatcattcgattgaagaattgcatctagttgaatgaacatctggttgtcagcaaactcctgcatacacaaaaaccgtctctgccataaacatgtaaaactcaatcttttaaaaattaaaaaaaaagatttctgaaagatctgcctaaaagattaaaagtaatgcttttgagcatatatattctgatgaaaaaattattttcttaaaaatctttaatttttggacaaatttgtttaacaaaaatcaataaaaattggattttccctcgcggcgcctatagataccacggatgcaagttataaaatggtcgtttaattctgcgccgtaattgcgaggactccacaaatatcggtaccgaaaatccattctaactgggcgccgcaaggtcgctttgactgtgcgcgcaataacaataacataaaaacaatgactcgcaagtaggacctcaacactatataatacctaattttattggataaaaattatggcgcattgcgataaaatacacaaggattgaagaacataactttgttccgcttagtgaaatgctggaaaaattccaattactacaacgattgatcgaagcgttggtttctagtgaatatgaaacaatttaataatgcacaagttacttttaagcccgaaactggttgattacaatactttttactaatgtttattggataagaaaaacaaatcggattttgaaagtatccagaagccgctccacggcacgaattcatgaaatttaatttactaaagattccaagcttaatatttacattttttaacagttgaaactaataattggggttataattaaagaaaaaaaagtcctgtaaaatcactttcaacaaaaactaaaaaaaacttagtctattttttggattgttacttgacatttgcacctaggtttaaaattgatttaaaaatttttcgggtgtcacaaaaaattgcatccaaaaaacggctgacaattctttttttaacgtcgctggtgaaaataataattttcgacttttaattttacatacaacttttgtttttgtcgaattgtaacaaaaacaagaaatgcattcctaagattagagaagtcggaatttctgacaaaaaattccaacagtatttcaaaaagaattcttcatttagctaattgctaagattctgtcaaactcacaattattttttcgttattttggtatttctctgtaaatcgcatttttgactgcttatggctcataattttgtctctatttcataagtttttaacctatgctgttttgatttgaaaaatcgggtttaagcataggatcaatgtctcttggaggaattaaaataataacaaattcaaaatattcagtacatgcgaggacaagccggacccagctcgaaagaactcaaaagcatcagtgactttgacaaatttgtggatggcgatgacgttagcgttattgggctgtttgaaggagaaagcaagctgaaggactcctttcataaagtggccgacaccgagcgtgaccgtttccgctttgcgcattcctctaacccggatttgctgaagaaaaccggatacaccgagtaggattttaacatctttaattccctttatcattaaattattatttcacttaagcgacattgtggtgtttgtctcgaagaagttgcacaacaaattcgaaccgaacgaatttcattacgatggcaattatgacacggacaaaatcaaaaacttcctcctctacgaaacgtacgttaaaataattactgttgtttttttgtcgaaatgtgattgcattcaaattatatatttttagcaatgggttggctggaattcggacccaaggaaatctcttccaatttacgcatcgtccattggttgttgtttactacaccgtggactacttgaaggacccgaagggttctaactactggcgaaaccgtgtgctcaaagttgcgcaggattacaagcgcaaagtgcactttgccgtcagcgacaaggaggaattcgctcaggtgttttctaattacattattaataagagtttgtacacacagacaaattttccttaggaagttgaacaaaatggccttgcggaccgtaaggaaagcgacaaaccgttggtggcggcaatcactgtcgatggaaagtacccaatgaacaaggaattcag

SEQ ID NO: 47558 - DNA, 702 bp, Heterodera glycines
  Genomic contig location: Contig_ID=SeqID_19051; Location=469..1170; Strand=-
  SCN-specific regions: Sequence locations=1-188,210-364,388-702
  Gene Ontology: Mol. function=proteasome endopeptidase activity; Cellular component=proteasome regulatory particle (sensu Eukarya); Biological process=protein deubiquitination
ctgagcaacagcgaagatttcggaagttgcacaactcgttcacccgggaacactttgtggagttggacgtcgtcagttttttttctccattttttataatttttttgcccttcattcctttgaaaaaatcatagtttttagatagaatactgattattacactagaaattcccagtttttaaaacggattttttaaacattttgaaaaatctaatttcgttaccgtcattctttagcttttgccgtaaatctcttgaaaaattttctgttttcattcaaattttgaaaattaaaaatgtcaaaaatcccaagaaaaaatgccattgcaattcctgacaaagcaaattatgataattatgcataaaattcagccaaaagccaaggcggaggacaatttccactttatcacttacgtgccggtggacggaaagatttacgaattggacggaatgcgcgaggcgcccatttgcctggcggacattgagccgggaaaagaaagttgggtggacacgctgcgcccattcatccaacggcgcattcaaaagttggctaattcaaaatgccaaaattggcaaaaaaaaaaacaattttttttgttggttttaaggtacacagagggcgaaattcacttcaatttgatggcgctggtgccgaatttgaagaccaaatacgagcagcgggttgccgagctgagcgcggtat

SEQ ID NO: 47559 - DNA, 1171 bp, Heterodera glycines
  Genomic contig location: Contig_ID=SeqID_19055; Location=438..1608; Strand=-
  SCN-specific regions: Sequence locations=1-43,117-178,200-283,308 -356,444-508,554-749,772-833,877-964,986-1104,1129-1171
  Gene Ontology: Cellular component=endosome; Biological process =intracellular protein transport
attaaagcattacaaaataatttttcaaggtccgagagcttctacgtaagctaaggcttgaaaattcaagactcaaccgacaaattgggggccatccaacgcgaggaagaaaaagtaaaatatgaagcagggctctacctttattcttgaatttactcgaaaaaccttgaattttaagtttcagtgtatttttcctttactgccagtatttgctcgtttcttgtatttttcttgtatttataaggtcccgagactaattatgtattgaccaaataagaaagatttattgtcttattttaagaaactgaggatggcattgattggatgcgtaaactgtagagtttcataaatttaaggtgaaacgggaaatcaaaacagcagcgaaaaagggggacagagaagtgtgcattctgttggcgaagtcaatagtcaactcgagaaaggtgaatttcaatcatcatattttaatcaaactgtttttgctagtagaacgtttaattttcaagtcagtgagcaaactccacggaacaatcgcacaaatcaattccataaacatgaacatgcagcatcaattggccactattcgtatggccggcacactaaaacagtcgacggaagtgatgaaggtcatgcaacaattgttgaaggtagcccatttggaattgcacttttcgcattttgcccaaggtgcccgaagttatgcaagtgatgcgagacatgtcgaaggaaatgactaaggtaacagcgacggaatttttaattcgattttgacattttctttagatgggaatcatcgaggaaatcatcgaggagacaatggagtccaccgaacctgacaatatggaagaattagcacaggtaaactgtttttatcaagggaagattttacttaggcgaactcggtaacccccaatatttcccaatctttttgtccttttttatgggactagtaaatttactattaacaattgccagaaaacaacctatagtaattacctaatttatcatattgcggttttttaaggaggaagtggacaaaattctttgggaagtcactgccggcgaattgggcaaagcgccagcggcggtgcgggacgaactcggagaaaagaaaaggcaaaaagaagcagcgattgccacggcgaatgcattcattgctgaacaaatgggc

SEQ ID NO: 47560 - DNA, 1641 bp, Heterodera glycines
  Genomic contig location: Contig_ID=SeqID_19057; Location=915..2555; Strand=-
  SCN-specific regions: Sequence locations=1-365,388-522,544-1059,1081 -1206,1228-1498,1520-1641
  Gene Ontology: Cellular component=nucleus; Biological process =ribosome nucleus export
tttttggatgcgttgcgcgagtgggcgaaggaaaaggccaattgaaattggaggagacggaatttgccgtggagaaagaaaaaggtaaaaatggacaaaattcgtatggatttaatccctccaattttggtgttcgacggcattattcgactttgcttcaaaagtgtaggcaaatgtttgttcaaattgttgcatccaatcgacgggaaaaagggacgaccatcgaacagagtgagtagtttactaacccaataagaagtctaaaaaaaaatttcaccattttttttgaaattttatgaagaattatgtactaacatcttcatttttaacactttccttaataagccctctcagtgtttcgagttgagtttatctgaaagctttgcagagaggcccgaagaagagggaatcaactcactttaaacattggcacaaatacggcgcattgacaaagtcttttctgtcggcagtgcaaattgtaagacccatcttcgaactttcccgggtttcttctttgaatctctccccctttccccccattttcagtttctcatggaagtcgattctgtccaagttttgctgtcgacccttcgcgtggtcactgatctcgtcgacttgttccttcatttccccaagctttgcaaatccctcataaaggtcctttccgattttgaccatttgatagagatttgatttttcaaggttttgacccatttttggagtcgcaaaacggaagaaatccgttgcattgccttcgtggcgttgtgcaaaattgccaggctcgactccgagtgtttccccgccgtttacaaagtccgaatttccttggcactcacttatttttcttaatgcttttaatgttcagaattgttacacggcgtatgtcgccaattgcaaaaccattgacgatgaaacattgcctttcattcactttatgcaggtgccgccttaattccgccgaaactttgccgactttttcgcttcctttccctttgtcagtgttctctcgccgaactgacttttgtccatccttcccaagcttaccaatacgcattcgtttacatccgccagttcgccattcaccttcgaaatgcaatgattgccaaacgaaaggtgcaaaaagacattcacatttatatttatcgttttggttggctcttcaggatttgatccaaaccgtgtacaattggcagttcgtcaagggccttcaactttgggttttggtcatttgcgaaggctctaaacgctttcggccgtcgtccgacaaaagtgccagttggttctatgagttggtccatccgctcgtggaagtgatcaattccctttggaggtgcttttattgctctgcattaatttcccattttctgtccaattttaaggcttttcccttccactaaattcttcccattgcgaattcattcgattcaaatgcttttggacatccaaagagagtccgaagtgttcgtcccgagtttggcctttgctgttgaggtgcctttgtcttcctttggcttccattttcccatttctttgtcagcttttggatgagttggcacagatcgacgccaaaaggccaacggcgggcaaaggtcgaacacgcgaaccgaacgccgaacgaatgctccgattgtcgggcgaaca

SEQ ID NO: 47561 - DNA, 2921 bp, Heterodera glycines
  Genomic contig location: Contig_ID=SeqID_3230; Location=418..3338; Strand=+
  SCN-specific regions: Sequence locations=1-33,82-151,185-415,437 -466,499-1002,1024-1193,1354-1388,1439-1521,1544-1767,1789-1820,1871 -2346,2368-2372,2439-2552,2595-2647,2669-2763,2802-2805,2829-2921
  Gene Ontology: Mol. function=heterotrimeric G-protein GTPase activity; Cellular component=membrane fraction; Biological process=G- protein signaling, adenylate cyclase activating pathway
atgttcgacgtcggtggtcagcgtgacgagcgtcgcaaatggatccaatgcttcaacgatgtgactgccatcatctttgtgtgcgcttcttcttcatacaatctggtcagtgcaccacactctttttgccatgatttctttggcatttttctaaaatattaaacaattattaaatttaatttttctgttagccaacgattaattcccatatgattttgcaaatccactttggcatgcgatttttttggcatttttccatttggcactcctatcttttttgaatttggcgcttccattggcattcctttttggcattcctttttcattattttggcattctattttctccccccccccttttaaggtgctttgggaggacaacacacagaatcggttgcgcgagtcgttggcactgttcaagaacatttggaacaaccgctggctgaagagcatttcggtgattcttttcctcaacaagcaggacatgctggcggagaagatcaaggagggccggcaccggctggagacgtacttccccgactttgccaactaccaattgccgcaggacgagcgcgtgccgccggacgaggacatcggcgtgtacagggccaagtgctacatccgcggcgagttcctggtcagtccttttggtgctaattgggctagttataggggagggtaattagcggtgatagaacaaagttttttttgatcaatcctagtgctaattgtttaattaggggaggatacttagcggtgacagaactaagtttttgtttgtataatggctttcaaacccctttgatgaccagattgatcaacttgggtaattaaggattaatttcttttgaaatgcgacggttttcaaactaatttaaatgacatattttgctaattagttcctaacccattcccttccccaccaatcactcatttccccccccctttttttcacattccttctcccccccccccccgggggatgcgattggaatttgcaatgaatgagagagtgagtgagtggtgccgaaaagcgccgccgccgtcgtcggaggggccgggcgatgggggaggggtgctttgtgtttggcttggaagaagcatagcaaaatgtgtgagtgagagtgagtgctctcacacttttattgctttaactgcttgggtgagtgcctaaaatgctttttgtgtctcggctctccccctccccgtccaaggcttttcccctctcttccccccattcatcttgttttctctctaccctctccatttttctctttatccctctatatctcctctccctcccctctgccctttctctctatcttgctttttgtgtctcggctctcccccttctccaacaaggcttttccctcacttttcccgtgcattctctctctctctctcccccctctctctctctgtctctctctctctctcttgtcccctccaattttccctgtatctctccatccccccctcctcctctccaattattgtctctcttatcgctccgtcgcaaatccccccccccccccgggggggctgccaccgctcctccgtcctctctcccttctcccctctctccgtttctaaaaatagcttttctccgtctctcaaattgcgtttgtgccccctatttttggctccccccccccctcactttatggtgcacttttctcttcttttattacacttttcctctgctgctgctatggcgacaaaagaaaatggaaaaaagggaaaaatttgggggatttttttatttgcaaaaattggccaataaaaatttgcgtcgtttcgcggggggccaaccgagcgataagagaagaagaaaatggagaaatggtgatgatgatgatgatgatgatgagataaaattggcaaaacattggccaaaaatagaacagaaaaaagcgagaggagacgaaacgaagaaaaatggcaaaacacggacgggaaaatttacagaaaaatgccgcatttggaagtgccaatttgggaaatcagcaaacagagattactgattttaacatttgattggatgtgatatcgaagtgtcgagattgaactgtttcgggagtgaatttattggaatttattaaacgcattataattttgatttaattgtatagttaattaatgtgtttggctttttgacatttttggcacactgccagagggcaccaataccgtacttctgtttttttggagtgtgatcagaaaattcattttggcctctgctgtcgcttccgtctcttctgataaatctctctgattggtcatcactttttggcagattctcgttttaatttcttttagtttccccacttaaaaatttcacttccaattttatgtccttctcaaaaagaaggtaaaaaaattatttaattatatttttataaaatccaaaaattaattattttgttaataaaatattacatttaacgaccctacaaaataaaattgatcactctctccccccccccaaagtaatcaacttgaaatatttcttacaaattcccaaaaataaacgccccatcccttaattacccttaattatttttttaaattcgataaaataaattaaaaattttgaattacttttcttctttttacaatttccaatctctgtccctttaattacctctaattaattaattaattaattttccccctcccccaacttagaaaatctcttcagccggcgtgaccagcaaggacaacagccacacgcacacctgctacccgcacttcacttgcgcggtggacacggagaacatccgccgggtgttcaacgactgtcgcgacatcattcagcgcattcacctgaaacagtacgagttactgtagcattagcaacgcccacccgcctaccgtatgcggcaccaatgggaccgaccgtatgcgccgcgacggattaa

SEQ ID NO: 47562 - DNA, 1603 bp, Heterodera glycines
  Genomic contig location: Contig_ID=SeqID_19140; Location=942..2544; Strand=+
  SCN-specific regions: Sequence locations=1-8,30-116,169-334,357 -374,396-591,656-1134,1157-1191,1274-1603
  Gene Ontology: Mol. function=transcription factor activity; Biological process=male gonad development
cagcactcgccgccctcgttgtcctccgcttcgtacgcgtcgtccaccgcttcgtcctgctcggagcacccggagaagaaatacttttgccagcgatgcctaaaccacggcgaagtgagagacagagggagaaaggagcagggggagagaggggaaagagagagagaggaaaattttaaaaaatgcgaaaattaacatgaaaaactaagggggaagtaatgaagaggaaattgaaaaaagccgcgtttcctctccaggaacatcctcggaaaggccacaaaccgttttgccgctacagagagtgccaatgcattgagtgccaaatggttgaacaggtgggagaagaggaggggcgaggggaagtcggaaagaacattttacacacattttgttgccattttcagcgtcgggtactgaataacgcgctgaacccgaggaagacgaacggcgaaagtgccaaaaagggtgccaatcagcaggggccaaagccgcgcgacccgaagtgcgcacgatgttcagcccacggggaacaggcaataaaaattatggaaataaattgaaaataatttatttgttgggagcatcgcttttgagaggagagaaagagagagagagagagagagagagggagggagggagagaaacaagagggagaaaaggacagaaggggaagaaaagggagttatttcgagaattaaatgtctgacgccgaaaattggcagtcaacttgctgctgatcactgaccactttcttactgatcattctgttcagagtgcgttgcgtggacacaaaaaggcgctgtgtccgtttttggagtgcgcttgtgccaaggtgggcacaagccgacatttaaatttttataacaaccgcaattagccaaaaaaatcccggccataaaattaattagggcacaataaaattgctaaatttttccgttagtgcgctttggtggagcagcgacggcgtctgatggccgaccaaatcaaactgagaagacagcagaagaaggcgcgagtgcacaccacacaccatcatcatcagaatggccaatcgcagaacggcggcgccgggggggacgaagagggacaaaggacgccgcaggggacaaacgccgggggcaaaagtccgtcgccgaaccatcagcagcaacagcaggtgggcaaaagtgtggaaaatagtggacagaaggaagagacacagagaaagagagagagagacagagaatgtagagactgggaaagagagagagagagagagagagcgacaaagagacacagacaaggaccattgacaaatgtgaacaataattgaacccgagaggcgagtccaagacccctagaaaccagagaaacttctggatgatctcatagttttctcggttaccttccgaaaatcggttgctgatcagccaatatctgatcaattaaactgttaccttttttgaataatggtcgaatatgatgcttattgatcagtgattgaacaacgccctcccaccccctcaaaagttaatgaattcgaattcagcttcggattccgatggcaatgctgctgaagaaggcgtacgagaagaagccgacctatccgtccacaatttcctcg

SEQ ID NO: 47563 - DNA, 811 bp, Heterodera glycines
  Genomic contig location: Contig_ID=SeqID_19141; Location=1..811; Strand=-
  SCN-specific regions: Sequence locations=1-61,90-147,171-181,459 -523,669-692
  Gene Ontology: Mol. function=transcription factor activity; Cellular component=nucleus; Biological process=sex comb development
gggactgcgcgaggcgaaaagcgccaaaggactgcatacacgcggaaccaagtgctggagttggagaaggagttccatttcaacaagtatttgtcacggaaacggcgcattgaaattgcccattcactgattctgacagagcgacaagtgaaaatatggtttcagaacaggtcgggggaacagagaaataaagaaaaaaagaaaaagagagaggagaagagagaaaagagagggggagggggagaaggtagagaaaagagagaaagaggggcaagaggagggagagagagaatgagagggactaggaaataaagatagagataaagggatagagagcagagggataggagagcggaaagagagggggagggagagaagagagcagacagagggataggatagaggaaagagagacagagagagaaggagagggacgagggggacgagggggagagagatgataaggactaggaaataagatggagagaaagggagataacgagaacagagggataggagagcggaaagagaggggggagggagagaagagagcagacagagggataggagagaggaaagagagggggaggagggagagaagagagcagacagaggaaaggatagaggaaagagaacagagagaaggagagggacgagggggagagagatgataaggactaggaaataagatggagagaaagggagataacgagaacagagggataggagagaggaaagagaggggaggagggagagaagagagcagacagaggaaaggatagaggaaagagaacagagagagaaggagagg

SEQ ID NO: 47564 - DNA, 589 bp, Heterodera glycines
  Genomic contig location: Contig_ID=SeqID_19148; Location=129..717; Strand=+
  SCN-specific regions: Sequence locations=1-589
atgaaattggacgaattctgtgaatatttcggggaggatttcacatatttaattgacgcaggtgttttaatttgtgttgcattgcccaattaatcatttctcatttagcaaaaatgggaaacatcggacgctttctcaaccgtatgctttttccttttatcatcactaaccttaaaatttgcaaagttcagactcttgcgatccgaattgtcatgtccaacattgtctcgtcgacactcatgaccttcggatgccgtggtgtgcgtttttcaccaaaaagttagtcaaggccggggaggagctctgctgggattacgcgtacgaaattggttccgtggagaggcaagtgaactgcaaatgcggcacgacggtgtgccggggccgacttctctgaggaaaagtgatggcaattgatagatattaattacactttgtcagcaattacctcactttgtttgtttgttatttgatggaatgggaatgaacagtcatttcgcttgctttgttttcacctttttggctaacttttcgtctgtccgtgggaaattgtcttcctttggcttgtccccgccattccccgcacaaatta

SEQ ID NO: 47565 - DNA, 1305 bp, Heterodera glycines
  Genomic contig location: Contig_ID=SeqID_19164; Location=575..1879; Strand=-
  SCN-specific regions: Sequence locations=1-216,252-349,371-427,451 -573,602-805,834-1305
  Gene Ontology: Mol. function=protein phosphatase type 1 intrinsic catalyst activity; Cellular component=bud neck; Biological process =cellular morphogenesis during vegetative growth
atggcaagagaggactactgcttcgatgcaacggcagcggcggagcagtctcggccttcgacgacatcttcaacacttgtacacgcgccgactggaacgacggctcgctgggagggagatggcctgtcaagcagcttcgtggacgcgatcatcaggaaggtcaggcagtcgcctgtccaacgcttcacggatgaggtgggatttttttgacatgacatttcaacaattaaaaaatttcattttttccacagatcaccgacttggagctcaaccaactctgcatggcggccacgaacatcttcagaatgcaaccgccactcgtcaggattcagccgcggtcgtcgtcgtgggcgacatccatggacaattcacggacctgcagaggatcttccacacgcacggcaaccctccagagcagcagtacgtcttcctgggcgactacgtcgaccgaggcccccagtcactggaaacaattgttcttctcttctgctacaaggtgtggttttgtgaatctttaacagaccaaattacaccccaaaaccattgcaggtcaaatacccagcgaacttcatgctgctgcgcgggaaccacgagtgcgccaacatcaacagagtgtaagtgaaaaagttttttgtgtgtttttttgtgattaatcattccccccccccattttcagttatggcttcttcgatgaggtcaaccgccgctaccagcgtccgggtccccgccgcctctacgacctcttcaatcagacgttcgcctggatgccctacgtcggcctgatcggcgacaaaatcctgtgtgagtcacattttttgttgttgttgtccattcatactaattcattatttttcaggtatgcacggcggcctctccgaccagatcaacagcctggagcagctcagccacctgaatcgtccgcaaatcgacccgccgcttcggacgctggagatcgatcttttgtgggcggaccctgcgcgcggagttcgtggcgtcatcccgaacaccagaggagcgggcatcgcattcggcgaggacgtggtggagcgggtgtgcgacatgctctgcctcgactacatcattcgggcgcatcaagtgagtttttttcttttttttcatttgcttctggactaaattcccacttcccctttccaggtcgtgatggacggagtggaatatttcgccggccgccggctcatcacccttttctcggcgccgcgctacactggccgcaacaacacgggagcaacgctgacaatcgcgccgaacctgagccacagcatcacccgcttcccgccggcctga

SEQ ID NO: 47566 - DNA, 3066 bp, Heterodera glycines
  Genomic contig location: Contig_ID=SeqID_3253; Location=304..3369; Strand=-
  SCN-specific regions: Sequence locations=1-247,270-270,294-442,464 -468,491-530,552-657,680-797,825-1411,1433-1436,1459-1702,1724 -2972,2994-3066
  Gene Ontology: Mol. function=NADH dehydrogenase (ubiquinone) activity; Cellular component=mitochondrial matrix; Biological process=sodium ion transport
atgattatcagcagcaaagccgtccaacttttgacttgctacagaaataggatcaccagaaaactacaatattcgactacggagaatgtgccggtgaatgtgcctgagccggtcatttcctcctccaacatggcacagttccgcaagggagcgggcggtcgttccagcttctcgggcaatgtcattacaggtcccctcattcttattatattactcgtagcaattgggaagttttgtggtttcttcgaaaaataaatttaaaaattaaagaaacacattttctagactaaaaaatacgctgatcaggaatctgagctcagattttgcaaatttttgtctatgatttttcaataataaaaaaataaactgcagccaagcgggctcgaaccccacccccatctcatatgacccttaagagctagtaattaaatttcaaaaaatcgtaaataactaaaaatatgacttttccagacattcaatagctcattcaaatgctcattttgatgtgtgtgtgtcgtttacgcccgactaattacttaaaattttggaaaaaacaagtacttgataaaaaaaatcatagataaaagcaatgattttgcaaaatccaagactcagattcgtaatcagcgcattttttcagcctagaaaatctgcttcttaaatttttaaatttatttttgaagaaaccacaaaaacttttaccattgccactcgttatgtgtttcctttaaatgtctcgtttctctgtaaatttgattttttggaatctgaaaaaccgaaatgagaaatttagaattttcgatttctgttcaagttctggttaagaattagaaatttgttaaattagatgtgcggtttgtgatcagaaacccaaaaccccccgaaactggttttcacacaaaaaattttacaaactaaaagaaaatactctttttttcttagtttttggcaataccggatttaccggccgaagggtggtcaatcggttggccagacacgcaaatcagctaattttgccgtaccgctgcgattcgtattttctcagagaattgaaagtgccttgtgaccttggtcaagttctgttttttcctttccaattggacgacgatgaaagcattcggaaggcagtcaaatacagcaacgttgtgatcaatatgatcggcacatatgtcgacacaccgtacggttttaaataaaattaatggccgggaaaatgagacaaaagacacaatttatttttaaggaattattccatttatgacgccaatgtggagggtgcgtggagaattgcgcgcatttgtcgggaaatgggcgtggaacggctgatccatgtgagcgcattgaacgcggacccatcgtacaaaacacaattcatcaaaaatgtatgtgaaatttggataatcgctcactctttcccccatttttgaaaagggcgcctttctgaaaagcaaaggcatggccgagcaggcggtccgtgccgaattcccaagtgccaccatcattcggccctctgtgatgtacggcgacattgaccgtctcatttataatctgatcacccgttggcgcgttgacccgttcggcaatgtgtacactttcaatgcgggcgaaggcatttacaaaatgccactttttgtgagcattccgtttttaaataatgcatatacaatattttctttttaaaagtaaaaggtttaaaacctccttttttgaggtcaatgactttgccgacggagtgaacagagtggcgatggactcctcaacagcgggcaaaacctacgaatttgtcgggccgcactgctacgaaatgtgcgagttggtaagtgaatcgaaacgtattttcatgtccatgggagtcgaacaaatgacgggattgaaatttaatgaaaaggaattttcattatgtggttaacgaacaagaaagacatttgtcgtttattaggtaaatggagctgaattgtatgtcataaatggacgggggggtcagaaattgcctttaccaaataagaaatatcccccatcagaggccaaaattgaaaaaaaggctcaacattttttttaacctttttttttgcgtggcgcgctttttccaaaaaatttgcggaaggggggcggggggggggtccggcggtgcgaatagacgccgccggaaaaatgctgcaatttattaacagatttattttcactaaataatccaaattccataaaaaaaaatatacgaaattgaaaatgaaatccaatttcgttaaaaaattttgagtttgcaaaattcttttttccaattttcgtaaaaattttatcatttttaccagtgctttttcgactttcatcgccaatttctttccattttctaatgcccccttccccgtttagttcgacttcatcttcatcaaaggcggcctcgtcgctgacataactagcagataccgtcgtgttggtattccgatttggttccttttcacgtcttttctctgtcattcgtatacgaaaatatatcgtcgtcctggcgttattaattgggagtggttcgatttcatggtgcgctacagatttccaatttcaaattttaagggatttatttgttggaaagcaaaagataggcatttaaataaaacgaaagcttaagttttgatcagtcttttgcattttttgaaaaaatattcaactaaaaaactcattgtcaggaagcgacgagtgatgtgctgtcggctggggacacttatcttctgaaggatttgggcgtttcgttgaccgattttgaggatatgggcggctattacgccatgcaaatttcttttcagaggtgaaccaaatgcgtttagtttaaaaaaaaatacattttaatggggtaacaaattttttaacggaaaaataatttatacatcaaaccagcgaggctcaggcttattcgactaattctaacaatttcttccagaccataccagccaagaatggctgactatccgcagtgtccgctcccccttcgttcgccgcctctttacaaacggaagccgatcacttttaagaagcaaaatatagtcactgagcaaagggcgttcggactttgag

SEQ ID NO: 47567 - DNA, 518 bp, Heterodera glycines
  Genomic contig location: Contig_ID=SeqID_19181; Location=1695..2212; Strand=+
  SCN-specific regions: Sequence locations=1-107,129-260,318-370,409 -409,445-445,481-481,516-518
gctcgttcaaacagcgcccggtattcgttggtcagaaaaggcgagtcgtaatcttcaacgccaaccatttgctgaaataatggaagtttggcatttatttccgaaacaatgacattatggaagaacacaatttgatttgattaaacttacgctccacattggtggggcgcattgatcgatcgtcagaatgcctcggaaagccttttgtttcccggttaaactgtgccgataccacgtttctgggtcattggcggaaaggacatgattgacgggcacgtggatgagagtacaaagacagcgagtgccatctttgagcctgaaatgttgaaaatggatccaaaaatatcaaagtggaaggatggaccactgaagagtcatgccaattttgcgaccaatcagaccaattcgcttggaagcttcaaacgaatattgattttgggtacaatccggcggattcgaaacgccgggaatcaaatggaacgtttcgtagggggagagagacaatttgcgtgaattta

SEQ ID NO: 47568 - DNA, 1292 bp, Heterodera glycines
  Genomic contig location: Contig_ID=SeqID_19181; Location=819..2110; Strand=-
  SCN-specific regions: Sequence locations=1-8,47-99,157-288,310 -473,496-999,1035-1270
  Gene Ontology: Mol. function=ATP binding; Cellular component =extracellular space; Biological process=protein biosynthesis
cttccaagcgaattggtctgattggtcgcaaaattggcatgactcttcagtggtccatccttccactttgatatttttggatccattttcaacatttcaggctcaaagatggcactcgctgtctttgtactctcatccacgtgcccgtcaatcatgtcctttccgccaatgacccagaaacgtggtatcggcacagtttaaccgggaaacaaaaggctttccgaggcattctgacgatcgatcaatgcgccccaccaatgtggagcgtaagtttaatcaaatcaaattgtgttcttccataatgtcattgtttcggaaataaatgccaaacttccattatttcagcaaatggttggcgttgaagattacgactcgccttttctgaccaacgaataccgggcgctgtttgaacgagccggtgtcccgtgcaaaaagttcttggccgggtttatggtgtccagcgatgccgtcgtcaaaccgggcacaaggatggacgtccgacatttcaaggtcgtttgcgctactttacaacccggattgaacttgtctttatgcatcattgtcagcctggacaatggattactgcctcgggccgaaccatcgattggggctttcaaggcgtaatgcaccgatggggcatgaagggccaaatgagactccagtaagtgtccacccttcgtaagggatttagtcgcttaattgtcgtgtcattttcccctaacagtaagggaccgacaaaagcgcatcgtcgagtgggggccatagggacgaaaggcgaggcaaaggtttggccgggtcggtgtctgcccggtcacatgggttacgaatggcggaaaatggttggaattaaagtgcttcggatcaatccgataaagcaggtcagtcactctttggttgttgagtttattggcctttcatttttgttttcatccgctttttcaggttatttatgtgcgtggcaatgtgccgggcgatattaacgagtggattctgctgaaggattgttttgcaaagaaaaaacgggtggaagagccaccgtttccgaccttttacccgacggaggaggacgaagaagagatgcaaatgttgtcgggacaggacaatttgttcacgatggtctccaaggacatgtacgattccacggcgcaccaggtcagactttgctgggagtgtttcgtttggagttattttaatttcagttttcacaaccgtccgtcctttacactgaagcggacgaaaccaaacgaacggagagggacagatcgagagcgaagacggccaaagtgaagaag

SEQ ID NO: 47569 - DNA, 1378 bp, Heterodera glycines
  Genomic contig location: Contig_ID=SeqID_19194; Location=109..1486; Strand=-
  SCN-specific regions: Sequence locations=1-90,115-543,566-717,739 -757,786-1051,1074-1378
  Gene Ontology: Biological process=regulation of protein activity, epigenetic
atggatcacaactactggcaagcacatccgaacaacccggttttgctgctgcttttatcaaataaaatgatcaactatgtgcttggcatgttattttttcttttctcttcagcttgtgaatcgacctgaacggaatggaacgaccgaacagaatggggcgatgagttcatgttcccatccccaaagagcttctggagagcctaaccaactcaatgttgtgctcgtggatgggactgaagttgttgttaaggtgaccattctgctgatggtaaaatgttgttccatcatgcaaattgttcagatccacaatgttttgtgctgctatgaattgcccatgcacattgacttacgacaggtcgcatatggcagcataaatgtggactataacagagcaaaaggggtcagtggcatttcaatttcgacttgttttgttcatgctttgttcagattttgcacaaacagttgcgcaagccgtcctgttcaattcgaattgcaaacagtggcaaagtggtgattcacggctgcaaaaggtggcaaaaggaaacaaaacattcaaactgcacatttaagcgaagaagattgcaagagagtcgcacgcgcaattggccgaatgatccaacggagcacgggacggttggaccagcggatttgcatccgtaactacagggtaaagcgaagatgaacatccatccttagcactcagtagtctttttgaggccaaaatgcttttaccaaaaattatttaaaaagcgagttcaaagaaattaattaaaaaatttaggtttctaacatattggctacttgtcgaatgccttttgatattcgtattcaagaattgggtcgaaagcacagggaagccctttatgagccggaattgatggtcggtcttcaatggaatttgaaagagccaaaggcaaatttgcgaattcacaccactggcactgtcacagtcactggaggtgaaccgtcaaaaatgaattttgttaattacagtcagtgaaacattgcagcaacttccgaggcgaatgttgtcgcttctatccgcaaaatttatccgtttctcaaagagttttcttcccaacgcgcttctgtcgacgttgtgaatttggacagtatcgactcggcatggttcagcgacacattgcgaaaccgacgccggagacggccgccgcagacaaatcgcgactacgcactgcccaatgacacggacaatcgctcgaggccaattccggcgaagcgatctcgttaccagcaaatccagggcagcggcttttacaacaacgccattcacaactcggacgaagaagatctcgactttgcgggtgattatgaagacgacgactacgaggaggagagggaggaggaggacgacgagtag

SEQ ID NO: 47570 - DNA, 207 bp, Heterodera glycines
  Genomic contig location: Contig_ID=SeqID_3262; Location=503..709; Strand=-
  SCN-specific regions: Sequence locations=1-108,138-207
  Gene Ontology: Mol. function=protein binding; Cellular component =alpha-glucosidase complex; Biological process=protein modification
ttgttcggcatcgcctaccatcaatgccgttggaattacaatgatcaggacgatctgctgagcgtgaatcgtgctttcgacgaacatgacattcccgtcgacgtgctttggctggatattgagcacacggacggcaaaaagtacttcacctgggacccggtgaagttccccaactccttggagatgattcaagaaattgagtcgaag

SEQ ID NO: 47571 - DNA, 1149 bp, Heterodera glycines
  Genomic contig location: Contig_ID=SeqID_19207; Location=416..1564; Strand=+
  SCN-specific regions: Sequence locations=1-704,726-1149
  Gene Ontology: Mol. function=nuclear localization sequence binding; Cellular component=nucleoplasm; Biological process=protein-nucleus import
atgtcgtctgaaaacctcgcgaaactctacaaaaacaccggaaagtcggaagtattgaagtgtttctctgcttcattaaaaatattctcattttaggactcgcgtcgacgtcgaacagaagtaagtcaaaatgatgttcagggattagtcattgattatgagatttaacggatattatccatgaattccttctattgcagaccagcgttgagttgcgcaagaagaagtgcaatgaggagatgatgaaacggcggaacatcaacttggagtgtgcggacgactctgccacatccgccgaagaagtcgtaaccgatggggaaattggcgaaccgacgggccgtttgtcgcccgaaatgctatcgttggaagacgcagttgaagttttgcaaaaagaacaaaatgcggagagattccgattggcttttgagtcggtcaggcgcggtcagtggataaaaaattgatacaatttctgtgctcctaccgaggtttccgtttttagttttgagtcgcagcaaatgccctccaattgacaaagtgatcactcttggctttccttgtgctctcgtccaggcgctccattatgacgtttgtgttttttatttgctttctccacacttggctcattttcaggatgacaaagtgaagtttgaggcagcttggtgcatcaccaacatcggtattttgaatttgatgacggcataaggtttaaaatattaattttccagtttctgggacttcggaacagaccatgaccatggtcaacgcgggtgcggttggtccgctgcttaaactgtgctcctctccttcgctcaaattgagtgaacaggtccagttgtcttcgtggatatgttttgtttcgtcggcagtgtccaaaatatttttttgttcccttaggctgtttggtgcattgccaatatggccggagatggcgttcaacttcgcgacctgctgatttccgagggtattctgccgttgcttgtcgggttggctgaccgcgcggatactttgggcatttcgttcgtgcgcattctcacctgggccttctccaacttgtgccgccacaagaagccgcaagtgccattgcaaatgttagccgtaatggcaccgtcaatttccaaactgatcaaatatgaggttgacatatctgat

SEQ ID NO: 47572 - DNA, 1233 bp, Heterodera glycines
  Genomic contig location: Contig_ID=SeqID_19222; Location=802..2034; Strand=+
  SCN-specific regions: Sequence locations=1-4,26-166,191-373,425 -809,884-925,954-981,1013-1027,1055-1204
atggaagtgttcttctttgaaccggtcgaatatgagcgcttgtacaactgcagctcctacaacattgaccaaatcccattggaaaaacgccaaaatttggtgatcggcgcaatatttatgcctatttcaataattttggaggtaatatacacaaaaaaaaatatgcaaaataattaaattatttttaaaagatactgtatgtaccgtgtatgatcgccatacggaagcacatggacaacacatgttacatggtgattagtcgggatatatttaaagaaaaaatacgaaaaaatagatatgaaaaattggttaaaaatgaaattataaaatcttttaaatttttggcaaattcaaaaattaaattttagaggagaaattttaattatttaaattttaataaaaaaaattgttgtttattttaattcaaaatgttcagctgatgttttacatttccataacggacatgatgtgtttgttgatgtgcggcattgtgacaggatatttggccattgttggcgccgtgttttgctcggcaccaagcttcatctacattttcggggcttatgggtttggtgagcacacaactaaatgcaataattatcaaatttttgagttatgctttttcaaaattagattttttcataaaattgcaaattttttaatttgtagctttatgggccaccgaaacaactgctgaaatgtttttggcgatcaatcgctgcgttgaattatgctcaacttggcttgcggagctgttgttctatgggaaaagaatttacctgtggatggtgagtaaattattgaattggaaaaaataaaaaattttctttaaaaattaatatttttttttattacatttttaattactaaatagtaaattaaacaaatgagaccaaattcatacaaaattgcttaggatgaactggaaaaattctttatttaaaataccaaaagagtttttactaaaataggctgcatgaaattatttcaaaatattgagaaaggccaaaatcgtttaatcaaattgttaataataaaaattaaattaaaaaatgtaaccaaattcttagaaaattacttaaggtgttcccaactgtgtacgggttgtacgccttcatcttcactgaaccaattctgttcagcggtttgcacatcacctggtttttgaacccgcacattggttatctcaatgatggaacaattgtaaaaaaaattttattatttttaatttaa

SEQ ID NO: 47573 - DNA, 1139 bp, Heterodera glycines
  Genomic contig location: Contig_ID=SeqID_3269; Location=2737..3875; Strand=+
  SCN-specific regions: Sequence locations=1-240,308-392,459-513,597 -648,683-740,764-779,801-879,901-929,951-1139
  Gene Ontology: Mol. function=extracellular matrix structural constituent; Cellular component=collagen; Biological process =skeletal development
atgcaattaattgttccgattttattgcttctgacattcgtcgtcagtttgccaatttgccatggaatgaacggacttccgggcgaaaagggcgagccgggctacccggggatgccggggatgaaaggcgaaaaaggccagacgggcgagccgggcgcgccgagctatccgggccttcccggatggccaggcgaaaaaggcgacccgggctatccagggcttccaggtaaaaaatccgactttttttaaattttctttttatttattacaaaaaatttagaaataaaatttatatttgttttattttcaggtcttcctgggccgattggagaaccaggtccaaattcaatgaaacgaacacaattaatttttggtttttcaatacttgcaggatattaaattaacaattatttttgaaaatgaaaataatttattttcttgaaatatctgaaaatattctcgagtcgaaggaatggcgacataaaattcgggcactgggaagtttaggcactcttataataaaagaattgaaaaaagtaaaaaatagttatagtaaaaatgaattaaattaaaataaaaaacaaataaattttaatcaagttcgcaatttagttttaaggagtttcctgcccatttaattaaccattcttttttttgttttaaatttttattttataaaataggtaactatgatgcccaaattcgggtgccgaaaagcttccccctgcgactgctacccgaattaatataaataaaattttttggatagaagaagccttaaaccaagtaggaaattatataatacaattatccagagtaaaaatttaattgataaattctttcgttctaattctccctgatttatatgaattgaagacaatacaatacatatatatgtacctagtaaaataaatgaataacagaaattataaactggaagaaaacaatttccatttttgccatttttaggagtttgtgccgaaaattgtgaccgaacaaaacgccaaggcgcggagaaccaatgggccggcattgcagggacaatcagcgaacggagcgcaaaattggaagcggaactaagccaaataaaagaacgattatcaaagcttgaaaaagcggaggaaattccaaatgagtga

SEQ ID NO: 47574 - DNA, 753 bp, Heterodera glycines
  Genomic contig location: Contig_ID=SeqID_19255; Location=842..1594; Strand=-
  SCN-specific regions: Sequence locations=1-175,197-468,490-550,572-753
  Gene Ontology: Mol. function=pre-mRNA splicing factor activity; Cellular component=nucleus; Biological process=mRNA splicing
atgacagtgcgtggacgagagcaaatcagtttggacacactctccatcagaggttagtttattcgctcaaaacccaaacactatacaaacttgagataacatttttatgggttttctgggtcgtagaattcgattctgatatctatttcggcaatcctgaagaatgtgaagaatgggggtccctaatttttatgggctaaaacaagtttttaggggttttcaaaggtgctgattacgaatttgacttcggatttgcccaattccgaactcctgacccgctttcgaacaaaaattgaaaaaaaaaaatttttcctagtgatttcatactcccttttcaggaaacaacattcgctatattgttcttccggattctttgccattggacactttgctcatcgatgacgagccgcgcaagaagcccactcaacgccgatttggtggccgtggaggacgcggtgggccgcgcggacgtggacgaggccgcggagggcctccacgcggcggcggcgggggacgacgctgatgatggaccacaatgggagaagggatcagtgtctattgttgttgttcatttcaaaccactggctgaacatctcatttatttttctgatataaaatggggttactcgacgcaatgcataaatcggaacggcaagactaattatcgaaaatctatataagcgtagtgctggttcagtcggaattcactgttcagttattaacgcactagaatttcgtattttttagattaaa

SEQ ID NO: 47575 - DNA, 2467 bp, Heterodera glycines
  Genomic contig location: Contig_ID=SeqID_3279; Location=44..2510; Strand=-
  SCN-specific regions: Sequence locations=1-49,71-282,304-502,576 -1356,1378-1848,1870-2467
atggatattggtaactctgagaataaatgtcgaaattgggctgttcggctggaagaagtgctgaatgactttgacgctttgcaggtgaagcggggcatttcacagataaagccacccaagcaaaagctaacaatcgatgcaaatcactgccaatgcaaatttcagtgcttccaatcgtggctcggcgtcgatgatgacagcactgagcaccctttgcgccttcacttcgcaataattgcctttcgcgaaatgagcgcctccggggacgcgcggtccttccaattggccaaggaaatcttcaccaaatttttgctgccgcgagttggcctttgcgattttatcggtgcgtccatccgcgagcgaattgggcaacggctgaaaagagagcaggcggacgaggaccttttcgacgagtgtttggccccgctggacacttttctaaggagacagcacgcagtctttggtacatttgagggaatgccttggcaaagaatttcttttatcgccctctctcttcccattgtctctccattgttttttctcattgtctttctccttttccctgtttctctctccgtttaatctttccaattcagtccaatctcaagaatttctcgacttcttcaacgaattttgcttccgcaaccagcagaaaccgtccacctctgctgatgagcaaatgatgccaatgctttcttcgccccttcccgcgaccatttggcaccaaaattcgatcagaaggagccgacgaagggatagcgccggcaaagcgccacagccgttgacagccgattcgctgttgcgctcgcaatgggagcgcgaggcaatcattccggtgggaggggccgggtaagagaaggaatagcgatggactgacgacgaattggcatttcattgctcttttttaggttgtttaagccggtcagcaagttcccctatatgggacagaccaatgccagcaaaaaggactccgccgtgtcctcttccttttccagcgaagccaaccgacgaggggtcgccgctggcgcaaatgtccccggagggggagggacccattcgatgcggcaattgcgcgaaggccaacgacgcgcgaaccaacagcaaaaaacgcatttactcagtgcatttccggtcggtcttacttaccgatgcaaatcaaagcatttcgccattttcagaagcctgacattttcctgagagaaaactccgccggaatgccgcccaattgccatgaaacagcgcagggaaggcgcgaatttgccgaaaagttggcccaaaaattacgccatgttgagttacagcatcagcaagatgagtctgtcaaccgacaaattgatcggataaattcggcacgacaaagagacacaaaaacatcgacgagggaactgatcattgccggcgttgcggctgatccgcttctgttggacgccaccgcggcggatgacgcggacgacgacgtggagaattatttccgacggcgaatgatggactcgtcatccaacaattcggcacaacagagtccgccgccattgattctcagcgcgcggaaaacacgtcgaaagtcgcgcgggtcatgttcaccgacagcggcggacaacagaacggggccccctgctgagcagcaaagacactgttcacaagtcggggacatgccgctatcatccgccgaattagggacgagtcagccggggatgagtcggccggggatgagtcagctggggatgagtcagccggggatgagtcggactgggatgagtcagtcctgctaccacccgtccctaaaccagcagcagcacttcgacttgcatttcgcacctcctcaaaatggagtacaaaaaggtcgccagttttctttggcattgcctttctcatcgccaaccttttcagtcccaccactcgccccttgtcagctccgctcgcccttcgctgctttacccggaatgccgtcgtcctcgtccccccgactgctcccctcttctcatcaccacaattccgtcccgcctcctcctcattcttccgctcttagtcagtccgtccatctcgcgggtccgtcggcctttccggcgcccgctttgcccaagaagtcgtccccagtcaatccgacgaagcagatgacaaggcaggcaggcacaagccgaagggtgcccctcccgtgggagttactcagtgacttcctttgcttttcgcttttccctccgggcatttaaattgcaatggctatataaattaatctcagtgtttattgtgataacgacggagacacttcgggaatcggctcaatgaccacgacacattcgggcaattcggccaggggcgacaacgacagacaaagggcggcgatgttccgcagggcacgggaactgtcctcggggggacgaagcgaaaggagtggtgcacatcaacagcagggactgactcggacggcgcgcagggagcagccgcaaatggccgatggcaaaccaagcga

SEQ ID NO: 47576 - DNA, 1647 bp, Heterodera glycines
  Genomic contig location: Contig_ID=SeqID_19293; Location=470..2116; Strand=+
  SCN-specific regions: Sequence locations=1-528,550-571,600-1053,1075 -1399,1421-1647
  Gene Ontology: Mol. function=signal transducer activity; Cellular component=actin cytoskeleton; Biological process=signal transduction
atgacagttgcgatggaccatcaggcgttgattgacgagctgccggaggtggagaaaatgccagcccaacagcgcatcgctttggcccgtgaacgacgtgaacaacaattgcggttgtgtcagcagcgcgaaggacatttgccgcagcccgccccgcgtcggccgcggctgcggttcagttccgacatcgctctgctggagacaaccgtccgtggcgacgcgcaggaaggtgctttgtcgtacaatatttcaatagtgttgtacaataattggcgagattctccctttatagctcatttcctttccgcttttactattgtatttaagttctttgagcgatttttcgaatccgttcataccttttttgaggggctgggaatcggggttcgtagcgaagggaaaaatgaggaaaatctcaaaaactggctattcttcttaaatggctgattttacgaaacgatccagcacaattccaatttagttgagctgatgctgatggatggtgtcaacccaaactcacacaatgaagatggcctgactccccttcaccaggttcgtctaaaaaatgatcaaattttaattgtaaattttattttttagtgtgctattgacaataatgaaagaattgtgcgacttttgcttaggttcggcgccgatgtaaacgccaaagacacggagaatgtataattgtttttttttattcaaaaattgcgattcagaaaattttgcgatttttgatttttgagtttatttataatatagtataacaaatatgcctgaaaaattggttttttctatatattgacaaatttaatttttgtcaactttttagtggacacctttgcatgccgccgcttgttgtggttacattgaaattgtcagacttttaatcaaacagtaagaatcgtttaaacattaccgtactaatagtattattcagcagtgccgatctgttggcggtcaatgcagacggaaacatgccttatgacatatgtgacgacgaacagactttggatcttattgaatccgaaatggcgggtcaggggtaattaattgaatcctcaattttctttataaaattcgaattttctttttaagcatcacccaggaaatgatcgacgaacgacgtcagttgccggagcgggaaatgctcagcgacatgaaactgctccaccagcaaggcattccactggaccaacggatgccggacgaatccacttacgtgagttcagtgtcacatcgctttttgattgctgacaccgtttagctccatattgccgctgccaacggcttttacgacgtcgccgccttcctcttgcgctgcggtgtgtcgcccgcctcgcgggacaaagactcgtggatgccaatccacgcggttggtcatatattagccggataattatttagatttttctatttatatattggaatcttctaggcagcctcttggaatcagcctgatttgatcgaattgctctgtgaatatggggctgacatcagtgcgaagacgcgcaacggggagacgccgctggacctaacggaggacccgcaaacgcaattagtcattcggaccattgcacagacggaggcacgaaggaagcgaatcggacactttggagtgcgagatagtcgacgacagtcgagaaa

SEQ ID NO: 47577 - DNA, 1739 bp, Heterodera glycines
  Genomic contig location: Contig_ID=SeqID_19311; Location=109..1847; Strand=-
  SCN-specific regions: Sequence locations=136-292,314-427,473-521,543 -676,699-850,872-1131,1156-1557,1581-1597,1622-1739
  Gene Ontology: Mol. function=DNA primase activity; Cellular component= alpha DNA polymerase:primase complex; Biological process =embryogenesis and morphogenesis
atggaatccggcgattttgagcaattgatcatggaacagggatggttggactcggctgaccaatggaactccacaatccttgcccattgggctgaccaaagtttggctgaactgctcgacaaaagcttttcaaggtgtgcattttttgtttgggatttgttcgaaattattgggattttagttgagtctccgccaatttcctaccaagattttgggttttggttcacaattttcgtttttatgtcgaatttgcgctcattgtttaacaagaaatccaatttttggactgtgtctcatctattttggatttgtttttcaattttgttccgaattctctttaatttcttacaattagcaaaatctcgagagtttcggctcgctccgttttcttactaaggcccaacaattaatttggttttccattttcaggcttcaaacgccaaaattgcgttgggaatcaatgaaactccgatttgatgatgcaacacgaatcaatgcgcgagggatcaaattgccaccggttttcaataaaaattttgggtaaatatgtaaaaaaaatgcaattttttagacaccttccgatgaagcgaaacgctgtttcatttcattggtcatgaaatttgcttatccgcaactcgacgcaaatgtcactgttgggtgagtcagttaaagacaaattaaaatggaaaaaatttaaaagcatcttcggagcattccgaatcccgaacctgaattcgaacaaagagttgaaattttcgatcttttctttaatgatggcggttgatgcaattctaatacatttagtttgaattcgaaagtaaatcttttctaacaataagcataaatttaaatttacaaatttgaattatccattgtatttagttcaaatccagtttaggggttcgtaattgcacgaaaagaatgcccattcgagatgagagacccttcaaaaattttttcaaaaaaaattccaggctcaaccatttgctgaaatcgcccttctctgtgcatccagaaaatggaaatattgccgttccgttgagtgccaaggaaatccgtgcctttgatccgaatgtggtgccacgaattgataaattgttggcacaacttgcctcattgcgagaatccagccaagaaaacaaggagaatcaacgttcaattggtaaaaaattatcggcaaataaccaaaaattgcttttattagagagagaccgggattttggggttaccgggccagagttcgagcttctaattagccaatttggccgatcccgggccgcctggttcaaaaaaggccgtttaatcgctcgggcccgagtttttttttaaattttaccgggctagggcagcctgggctggtttttttaaggttcatcgagcccaggctaggggcggtctcaagaattagacaaaattaaaatttacatttcattatatgagtgtcaaaatttttgaagcaaaaaagtcctcgtcgatttgtgggtttatggattcatttttccctcccgttttccccttttaaaacttttcaggtgtttttttggaaaattttttgacaaaaacttacaatagtattataattcaacataaattttcgaaaaaaaaaaaaatttttttttttcttacaaattgtctatttcttttatgttttagtctatcgtcaaacttcattggctccacacattgctgtgtttgaacaatggaccgcacaaattctcaattctgaagcgcaaaactga

SEQ ID NO: 47578 - DNA, 111 bp, Heterodera glycines
  Genomic contig location: Contig_ID=SeqID_19321; Location=722..832; Strand=+
  SCN-specific regions: Sequence locations=1-111
atgggtatttcccaagacagatggcacaagcggcgaaagactggggggaagcgaaaccccattcacaaaaaacgaaagttcgaaatgggacggccggcagcaaatactaag

SEQ ID NO: 47579 - DNA, 832 bp, Heterodera glycines
  Genomic contig location: Contig_ID=SeqID_3292; Location=334..1165; Strand=+
  SCN-specific regions: Sequence locations=1-11,33-408,431-591,613-832
  Gene Ontology: Mol. function=structural constituent of ribosome; Cellular component=small nucleolar ribonucleoprotein complex; Biological process=protein biosynthesis
atggtaattttaaacaaaataaaagacaaaattctccgcttttagccaggcaatgaaacaattcgaggccatttggaaaaacggaaggattggatccgacggacgagggaccatcaggaaaagtcggcggatatcaaaaagttgaagagaagcgcacgggaacggaaccccgacgaattccattttcatatgttgcggagtcaaatcggagtgagttggccattaaaaaaatgccaaaggatttggaaattgaatttccattttggcatcccttttttgttagtttgttatgttaataatagggttgggctcccgaccgtcggggttggaaaagtcggggtcagcaagttcgggggcccaaccctagttaataattcaaattgagtttgatggaacacatcgcgacttagagacggaagaggaggagaaaagcgaagcgcaacgccttttgagcgatgtcagcgatattaatttcgtacaattcaaattgggcatggaacgaaaagttagcaaagataaatttgtagtaaaaattttgttttttagaaaattgaaaaattgaaagcggtgctccacttttgtgatgagacggaaaaaccacagaacaaacacataatattcgcggaggacgaagaagaaggtaaagggaaaagggaggaaccgaaggggcggaaggacgaacaaattcagcacgcaatttcgaccctcggcaatatttcaacacttccgaacaattcttggcacggactttcaatagaccaatcgaaggcgacgcgcggaaaagcctcagcgtaacggagaaacgaaaattaaaagttagcgcgggtgggga

SEQ ID NO: 47580 - DNA, 1345 bp, Heterodera glycines
  Genomic contig location: Contig_ID=SeqID_3298; Location=1009..2353; Strand=+
  SCN-specific regions: Sequence locations=1-505,528-1345
atgacttgcccacaaaaaatcagtgacaacagtccactagcaattaacagtggtctgaatattttctcagttccacctaccaatgtgtctgttgttcgttcattctttcgtcaggtgcttccgctcgcaacaatcacgcaagaatcgccttacctatttcggctttacagtgacaatttgtggactgatttatctcggatatatctttatctcgaactgtccattgaaaaaccgggagcaaacgataaatgggttgcgatagaggacgcggatactagtgtctctgccattcaagggattggtcaaacatttgtccagcaactaaaagttacggttggcaacaccgaagtatacgatagcgggaacctatacccattcaaggcctatatcaccaatgagttaagctttccaataaatgccaagaaaaattttcttggttcaacagggtattatcacaccttaaaccaagatgacttaacagacgaggggttcaaagagcgttgtaaaatttttaagggtggtaaaaatgcgcaattcctctcccgtctcgactttgatttgggaaaccaagagctttatctcttaaataatttggacttgctcttcacaatttacaaggccaaagatgtctttcttttgcaaacattaaaagcaaatgatgcaacgaaatatcgtttggccgttcatgatgtcaagatttatgctaaaatggttgagttacaaccctcactaaatatgagcctttacaaaacacttgaaaaacaacccgccacgtacgctgtacgcaagacggaaatcaagtcttcattcatcagtgttggtcgatacgaatttgagtacaatgtattcagcgcgaccattcctcgacgcgtaataattgcgttggttggcaattcagcatttcatggtgactacaaactgagtcccttcatgtttgagccgtttgatttacgtgaaatttcaatacatgctggagggattgtctacccagctgttccttataaactaaatttttcaaaagatcactatgtctacgcctttgttgacatgtatgaggcactgggtatggctaattcggagcgttcatttgacatctcaatgacccagttcaaaaaagggtgggccttttttgtcatcccattgacatccacacttgacgacagctgtggatttgagctgttgagaagcggcacaacaaacgtacgagccacatttaattcaccaattccagttggtggtgtggagatgattgtcatgggagaatttgatcaaatgattatggttgattacaaccggcacattgtgaccgattcaaagcttggataaattataaataactttatta

SEQ ID NO: 47581 - DNA, 1015 bp, Heterodera glycines
  Genomic contig location: Contig_ID=SeqID_19402; Location=598..1612; Strand=-
  SCN-specific regions: Sequence locations=1-13,45-506,528-648,671-1015
atgcctacagaagaccaacaacaacagcagcagcaacagcgtactgtacccgacaacaataattacccggcactccctttgcacggtcagtacggtgtgttgttactgtactgtatgtgttgtgccatatgtctgttcgagaatactgagtcgagaaaactctcgtgattttggcatatcggcactggatctcaagcatcggcacatttaaaatgtacaactccaaggttgtgccgtacaattgcggcactatttcaagtcgattggtgtcttacagagtcgtgggcactgaggacttaatttgatcgattttttttttttttgcaattttcccgtcaaatcccagccccaattggctctctgttagaacttctttgaaatttccctatttacggaatccaggccccacttggttggactttctctcccacggcccgtttctcccaatttttattttcaggatccccccgagacttttttttaatcccgaacctccctatttttcaaattttggcataccatttccagcttgcttttgttagaccaaattgcccacttggccacccattggccaaatttcaatcgctctctgaccgtctcgccactgctctcggagctggacgttcgggcactgcttgagcactttgtgcacgtccaaattggccaattggatgccgaaattgagggcatcgagcgccaacttgaagccgaatttgacgaggccgagcgcggctggcccattggctttgtaggcaccgccggtcaccagcccgtgccgaaccgcttccaagcgcctgtgtggcaactgttcaacgccgacggcacacatttatttggcaatgatccggaccgcaatgttgagcgcgctgatcaggcgctgcgcgacgagttggcattggtcattgaactggccaagcagaaggcggaagaagcaaacggtggcggtgccgccggtgatttgctgatcagcggcggccacttcaaagcgggccgagttcgccagggctatcggtga

SEQ ID NO: 47582 - DNA, 2474 bp, Heterodera glycines
  misc_feature (1291)..(1291): n is a, c, g, or t
  Genomic contig location: Contig_ID=SeqID_19403; Location=122..2595; Strand=+
  SCN-specific regions: Sequence locations=1-198,220-964,986-1189,1212 -1678,1701-1756,1778-1837,1860-2099,2121-2269,2291-2367,2389-2474
  Gene Ontology: Biological process=embryogenesis and morphogenesis
atgttcttccgtggattgagttcaagaagtgagttttctgatcaaatttctgcgcttaattttctgttcttcgaagatgtctttcctcaaagtgttcgcccgtcgtctctttttgcatgtcacttttcttcgggtaccaacgatgatgttttatttgaacgggtcaatcaaaaattggtcatcacgctgaacaggcccaaggcattgaatgctcttaacttgccgatgattcgcaaaatttacccccagcttagggtaaatcatttccggataaatctactaacaatgagtcgctttttcagaattcttccttcgatttggcacttgtcaaaggtacgggtggcaaagccttttgtgccggtggcgatgtcctcggtttgtcagtttgttgaatgcttatgtattttttttctttttagctgtctcaaaatcctataaggcgaatgatccggaccgaatttttcagcaatttttcctagaagaataccaactcaatcatttaattggatcactcagccgaccctacgttgccttcatcgatggcattacaatgggcggggttggtgtgttttgctaaataggtttgagtgcgaagaattaggcatttttgtcattgtccgattacaaaatctgtcctgggttttagggatgtggcctctcattgcacggggcttttcgtgtggctactgaacgaacaatattggctatgccagaaacggcacttggcctttttccggatgttggcggaacgtactttctgccgcgactcagcggtcaactcggcatgtttttggcactgacaggtggcaatattcatgtattatttccagacattgatcatttttcctcgtaggttttcgtctccatggtgcggatgtgttccatgccgggctggcgacgcattatgtcccttttacttttttacaattatattttcctttttcaggtcgagtcagccaaacttcaacaagtacaagatgaacttttggcccttccatctccaacaaaaaaagacattgaacaattgctccgttcccatgggccgtccgatgtcgcttcctttgttttggacccgcatttggaactgatcgacgaatgtttcgcggcggaaagtgtcgaaacgattatcgaacgacttatgcgcagaaacgacagtgattttgcgcgggaacaatgcgaaatcttggcaaaaatggtggggttttgttgtacagaaatattggactaattcttcggtttttttacattcttaacgattttcatatttctttaacagagtccaacttccttngaagtgacatttcgccaaattcggatgggtgctaaattaaaattcgatgaggtttttatttttcatctttccggcctcaaatgttatattttttaggtttttcctattgaatatcgccttactcagcgttttatggcagcaaatgacttccatgagggctgcagagcgagtgagaatataaaattgccttttatgagtaattatttaagcataaccgattttttagctcggcaacaaaaataaaaggcttataagaatgcccaagttttttttctttccctgatatagcaaattagcatttaaccatttgagaattattttttaaatatcagcaaacaactttgctttattcaactaattgtaaaaattttgttttttttataaaattgcaaaattttgggaaaacttttcattttcagttctgatagacaaagaccgaaacccaaagtggcgcccttcggcattgtccgatgtcaacaatgccattgtcgatgcctatttcgcaccttttgacactccccaaaacgagcttcaattagagcgcattccttctaatatttaatgaaaatattgtatcttttttaagcattcaaatgttgcaaaaagaggaaactatcggatttctatatatttataaatgctttgttattttgtgccttactttttctaattatgagtattttcgttaataattacttttcgtttatgctttgggttttcccaatttttgtttttcaaattcttttctcattgcttttcctttctttttcgaatgtcttcccatccctccgaatttccgtcctcgtcttctgccccctctgttcacaatcaacaagcagctgaattcgttctgatcgagtacccgggagtgataaaaaatgttcaagcagcactcgacactttgggtggactgcgtgcaatttccaatgtctgttgttttttttttgttggttttttgcccaattgaatgatttttaaaatttaatttgcattattttaggcacatttcaacaacagtcaattggaattgcaattccaaccccaaaatccgtttaattcggcattgacgggcgagcggcgaagccaagcggcggttttctcgggccaagccaatttggtgttgcgcattcgaagacgaaaacggaggcaaacggctggaggaggcgagtaaaaaaacaaacaa

SEQ ID NO: 47583 - DNA, 1238 bp, Heterodera glycines
  Genomic contig location: Contig_ID=SeqID_19415; Location=250..1487; Strand=+
  SCN-specific regions: Sequence locations=1-177,220-482,505-540,562 -613,644-770,794-879,901-1238
  Gene Ontology: Mol. function=pre-mRNA splicing factor activity; Cellular component=spliceosome complex; Biological process=mRNA splicing
atgaccgcgttgattagactcgtgtaagtcaattgggcgggttattcaattaagatttattttttctactcaaatttttagtttttttgccagcattgtctgcgctatggaaactgctgccctgggacggcgctctgtcaactcgagcgcagcggagccgacgaacgaacaaccgggtaaataagaattaaattaatttatttaaaattaaattaatatggagacgggggattatttttcgctgatttattcgtgaaaaatttttgaaatttttttgaacgtcgccaaaaaatgtaatcgtgtcaaaaaaatcaatttatattttttagtgaacaaatcctctgcgaatgagaagaacatggacgtcggagcgaatttgtttgtgggcaatttggacccggaggtggacgagaagttgctgttcgacacgttcagcgcgttcggtgtcattttgcaggtgtggggacagccaccaagaaaacaattattttttaaaaataatttccaataattttagcctcccaaaatcgtgcgcgacgtggagacgggcagcagcaagggccacgcgttcatcaattttgcatcgtttgaagcgtccgatgcaggtcgtctcatttatttttcaattaaaatttgacatttgttccccggacatttgcctatgtccaacgggtttaaatttgagtgatgtttaggcaatcagggatttaaaaaacttatttgaaccctattttggacatagccacaaatgtatggggcgaaaatatctgcagacggaaaacagagagttgcaacgaactccgtcaaattagaatacaaaattttgggaaagttttccgaaatttttctttcagcgctcgaggcgatgaacggccaattcctgtgcaaccggcccatcacgtgttcgtacgcgttcaaaagggacaccaaaggggagcggcacggcacaaccgcggaacggctgctggctgcgcaaaatccgctgttaccgcaagaccggccgcatcagtgcgtttgtttttgcatattacggcacaaatttttttgtgagaggggggggggggggatttcactaaattgtttaatctctaaattaaagacaatttagaatttgtgccctaattgcacaaatattgaaagcgttcgtcccacttccctcccctcccacattaaatttaattttaaattctccactcaagtcttcggactatctctagcaaaattaccttttgcaatta

SEQ ID NO: 47584 - DNA, 3281 bp, Heterodera glycines
  Genomic contig location: Contig_ID=SeqID_3301; Location=1..3281; Strand=-
  SCN-specific regions: Sequence locations=1-344,367-486,508-565,587 -904,926-999,1022-1373,1396-1672,1694-1996,2030-2440,2464-2530,2552 -3166,3198-3204,3226-3281
  Gene Ontology: Mol. function=transporter activity; Cellular component= cytoplasm; Biological process=negative regulation of locomotion
ttcacccattgtttgttcctcccaaaggaagaaggcatggattccatccatcgaagtgaagaaatgtgagagacattcgccgattgggcaccacacaatttgagcatttaaattcgtttaggtgcttgacacaactttttctgcaaaaagaggctgcttactcatgcgttgccgagttgggcgaacttggacttgtgcaatttcgtgatgtgatttttagcaaatcttttggcaaattatttgaatctcaatttagctcaatgaaaaagtgaacatttttcaacgaaaatttgtgacggaagtgcgtcgttgtgatgaaatggagcgcaaattgagtaattttgaatcagttgtgttcctggatttgcctaatttcactttgccaagggtttcttgagacggagatcaaaaaggatggtattccgatgctcgacacaggggaaaacccggaagcgccggcaccgcgagaaatgttcgacttggaggcacactttttcaaataactccgggaaaacaccggtcataaaattaaatttccaggcaatttttgagaaactcgaaaacgaactcagagaagtgaaccaaaacgaggaaatgttgaagaagaattttgccgagttgacggagctgaaacacattctcagaaagacgcagcaattcttcgacgaggtaccgttcaaacggcctctaatcattgggaggggcttttggctttaaaagtttgtcttcttcaaggttttatagcagtaatttttcccattttttggcttttggggttgtctttttttctggttcgctgtttctgttctaatccttccccccttggcaatgcttctttgcttatatttctactttaattagctgtctcaatgctttcgtcctatgtaattaaatattttcgactcttcccctgtttattccctttgttccgcttctgactttcacggtgtttgttgttgtcgggctttgtgcctcctcttgatgtccgatatttcgttgcttttcctttcccatcccctaaatcgtttttctttttttcgctaaaaattacaattaaattcaaaaaagaacctttcgggggagggtaatggaaaattgccgaaatttcgtgtcataaaacccggccgtgtaatttatttgtcgtccctcctccgctgaccatgttgcgtttgttcctttttctgttctccctctgttcaatgacctcctcctctcctccgtctcgtcacattcgcttgcccaaggtcgagtccgagcgtcgttcctggttgtattccacgtcggtccacaaacggtcgaccgccgtccaggaaacgcgcgtggacttcgacgcggaacagccgctgctcggccctgccgaattcgtggacaccggtggttcccgtttgcgttttcggttggtcccaattattttttgtcgatttatttttcacttattaaacgttgtggcgtgacagtgtggtgatttatgctcaaagtgaattgtccatttcttgttaaagtgtcggagtgttaattaccccccccctcgattttgtttaattttgtcttaattaattaattgcctcgggaaattcttttttttattgcttccctttctttttttgtctttgattaattagtacagttgtttgtttctttttatgctcttctaatttctttataatcagcctttttaacaacacattttttgaattagaggggttttctaatttcgcaatttgaatttgtgtcaaattttgattgtgtctgttccccacggacagaatgaaggcgaacagcaggccctaaataccctcgcccaagaagaactgtttacggatgacggctctagcctaatcccgaccgaaggccgggccaccgaacccatcccaacaaagggccatttgaagtgagtgaatgactgggatagatagagagttagtaaatgaaacaacacacgcacacttgagcacctttcaccgcactgtcacgagaaataggacaaatcactgtcatttgaaaatggaatttttaattgaattagcaaatagccgaatttatatttaattgaattgaaagaacaacatttaatttgagattcatcgccggcgtgattctccgtgaacgtctgccaacatttgaacgtttgctgtggcgcgcgtgccgtggcaatgtgttcttgagacaggcggagatcaccgaggcactcagtgacactgtgacggtagggagcagttcatttcccctggccgtttcagattagttatttaattgttggccatgaggaacccgagactctgattattgtactacctaaatctttcataaaatgacccttttacaaaaaaaaaacaattacaacagagaatttgttttagaaattacgaaaacgttttgtcccgaaagtggccaattgaccatgattgtatcaattcagggccttgctgtccaaaaggcggtgttcatcattttcttccaaggggatcagttgaaaagtcggattaaaaaaatttgcgaagggtacgacaccaacattttccatccggtcaaattttgcaaattcagctttcgtgcctccatttatccatgcccagaaacgccgcaggaacgtcgggagatgtccatcggagtgatgacacggattgaggacctgaagacggtgctgggacaaacgcaggaccacaggcaccgagtgctggtattttacccaacgacggccgggcgggtggaactggacaccagggtttacttcactaaaacccataggtttctgcggcgaagaatgtgcgcatgtggttggcaaaggtcaccaaaatcaaggccatttaccacacgctgaacctgttcaacctggaccagaaatgctttgtcgccgagtgttggtgccccgtttcggaacttgaccgaatccaacgggcgctgaagacaggaagtgtacgcttttgagaacttaatccaatcatgtggtttttggtgtgtacttttgcattttcaggatgaaagcggcagcacagtgccgtcaattttgaacagaatggacaccgccgagtcgccgcccacttacaaccggacaaacaaattcaaccagggcttccagtccatcgtcgatgcgtacggcatagccaactaccgggagattaatccaggcaattacatttaaatgccaaaaataggaattaagacgaaataaaaaaatagttataaattatttaaaagataaatctatgtccgggaaacagccaccttgtttcaatttcatacttctatggacattcgtttccttcagccccctacacaat

SEQ ID NO: 47585 - DNA, 1179 bp, Heterodera glycines
  Genomic contig location: Contig_ID=SeqID_3302; Location=540..1718; Strand=+
  SCN-specific regions: Sequence locations=1-268,290-819,842-1179
  Gene Ontology: Mol. function=3'-5' exoribonuclease activity; Cellular component=cytoplasm; Biological process=regulation of transcription, DNA-dependent
atggagaaaatgaacgaagcaaacagcgacaatcaacgagagaaattccaggacgacctgaaaaaggagataaagaagctccaaaggttaagggatcagatcaaaggatggcaaaactcttcggagatcaaggttttcaagtatttctttcacttaaatttgattacccttttctctgttattgaaggacaaggactctctgtcaaagtttcgaaaactgattgaacaaaggatggaaatattcaaggacgtggagcgagaaaataagacgaagccgcacagcaaacagggactgtcagcggaggacaagttggacccgagggagaaggaaaagtgcgagaccattgaatggctgaatgtgaggagagcgaaaacgcgagccataccgacatcatctcccgtcctttatagtgccaaattcggagaatacaggacgaaattgacaggacggagtctaaactggaaacaatgtcatccatggccgactcaaataggaaacggggcaagaaggacgaagcgaaaaagaatgagaaagaggtgtgcggaagagggtgatggccgactgtttttgaatatagtaaagttatatttttcaaaaaatttagaagtcggaagagctgaggaaacatctggagagggtaaaattccatctgcttaacttggaagtgtgcatgagaatgatcaacaatgaaaagctcgagatcaaggttgtgcttggaaagttgaaggagccgttggagatgtacatagatgcgctggacccggagaatgacgacgatcccgagagtttggaccctgaaggttgcttgaatcacggcagcttttgtacacacacactgctggttttcagacatttacgaggaacttaactttggcacatacctctcgcaacttggcggaatcattacgacgacgagtgtggacgaagagaaggggccattgccaaatgacaacggctgttcttccggatctccccaaatttccggcaaggagaagcagccacagttgaacctgtcttcgcctaccatcgctgctgcgccgattgtaacctctccggaatcggctagtgccgacataacaacatcagtgggcaccgcatcggcaacgaccgcgcaggaagacgtgttccttttcaatggaaccgaggcacaaccgcgtaaaagcaaggaaccgcaagag

SEQ ID NO: 47586 - DNA, 747 bp, Heterodera glycines
  Genomic contig location: Contig_ID=SeqID_19431; Location=358..1104; Strand=+
  SCN-specific regions: Sequence locations=1-54,85-114,136-747
atggacgtcctgttcaccatctatcgggcaaaggatgcgttcctgttacaaagtctagcggcggcggcagcagcagcggcgggccaacattacgcgctgtatctacacgacataaagctgtacgtgaagatggttgaggtgcaaccgtcgctgaacctgtccatctacaagacgctggaaaagcagccggccacctacgcggtacggaagacggaggtgaagtccgtgtttctgaccgccggccgtaccgagatggaccacaacatattttccgccgccatcccgcgtcggctgaccattgcattggtggcgaacggagcattcaacggccagctggcactgtcaccgttcaacttcaagccctacgcaattcgtgagatcagcgtgcacgctgccggtcatgtgtatccggcagtgccacaccgcatggacttctccggctgtgcctacattcgaccatttgttgacatgtacgaggcgctgggcatggccaactcggagcgctctatggacatcacgctggagcagttccacgacggatggaccatcttcgtggtgccaatgacatcgacgctggacgacagttgcggctttgaactgctccgctccggcaccaccagcattcggctcgcgttcaacgaagcgataccggcaggcggcgttgagatggtcgtgctcggggaattcgatcagttgatcatgattgactacaaccgccatattgtatccgactcaaaaattgcataa

SEQ ID NO: 47587 - DNA, 1703 bp, Heterodera glycines
  Genomic contig location: Contig_ID=SeqID_19470; Location=764..2466; Strand=-
  SCN-specific regions: Sequence locations=1-272,342-359,382-665,687 -894,933-972,994-1160,1183-1464,1487-1703
  Gene Ontology: Mol. function=catalytic activity; Cellular component =endoplasmic reticulum membrane; Biological process=lipid metabolism
caaggagaacactgtgctgcgggcgggcgtcgcaccccagcgcgttttcgtcattccgaacgccattgactcggcactgttcacgcccgatccggcccttttcgcgtgccaaaagcgcacaactgtggtggtgctcagccgactcgtctaccggaagggcgccgatttgttggtggaagtgatcccggacatttgtgaacggcacccaaccggtgattataattaattagtaaattaatggggttttgttttcaatcttttcaaaatttcccaataatttttagaaattattatttgttattttgcaaaaataatttaaaatcaaacaatatttttattttcgatggaaccattcgataacggatatcaggaatggcattttgagacccaaaattttatcggaaatcgggattccaagaatactttcaataatgctttatcaccgtcctttgcatttcagtccaatttctgatcggtggcgatggtccaaaacgagtggacattgaggaaatgcgagaacggtgtcggttgcacgaacgcgtcaaaacgttgggcacaattccccatgatacggtaggtgtacggtggtgtacttattcaaatcattgttttttggaattaatttgttgctgccttctttttaggtccgtgatgcgcttgtccaaggccaaatctttctcaacacatcgctcaccgaggcattttgcatggccattgttgaagcggcgagttgcgggtactgttccaacccatagatcaaacctgatcatttctccctgattccggaattttattgcttcagaacattgaaaaatggagaattttacaacatttagaatcttataaaaaaattcctaagcgtcgctgggcccttcggtcatcagaaaaaattgctaaaaaaataattaaattttgatgattaaaaattttttgggcctctgatcaaacttttggtgcatttcgttcttgaattcaatttttattcattttttgtgttaagtcttcatgtggtgtctactcgcgttggaggaattcccgaagttttgccgccggaattcatctctttggtcgacccaaatccgaaaggcattgtccaattattttatgaaattacagtaccaaaatcaatagtagattggggccattaccgtagccaaatttaaaactttaaattaggttgattcccattgaatttaacaataatttttggttgttcgatcattatttgactcatttataatccaaatactttatacagcaattgcaattggtcttttggatgccatccgtcggcgcgagaatggcgaattgccctgcccgttgaagaagcatcgacaggtggccgaaatgtacaattgggcggacattgcgcagcggacagaactcgtttatggcaattcgatggaagagccggaggacagcattgaccacaaattgcgaaagtgaggcgaaaattcaaattttaatgcttgtgaaataaatttcaacctcttttatcattgatcaaaattcgaaaatcggagtaaaaaatcatttaaaatttccccgtttattcttccagtcagttgaatgccggtttctggttcgggctgatctgggcatgggtaacagcagtgaatgtccttttcgcctcgctgttggattgggtggacccccgggatggcattgagacggttgacaacaaggcgaaggcgaacaactga

SEQ ID NO: 47588 - DNA, 1928 bp, Heterodera glycines
  Genomic contig location: Contig_ID=SeqID_3330; Location=533..2460; Strand=-
  SCN-specific regions: Sequence locations=1-203,226-308,330-645,667 -1048,1070-1124,1149-1163,1185-1291,1313-1575,1603-1633,1655 -1729,1751-1803,1825-1928
  Gene Ontology: Mol. function=transporter activity; Cellular component= actin cytoskeleton; Biological process=intracellular protein transport
ttgaacggctatttcgagtacatccgccgggatttgctgatcaaccacatcatgccacaggacgaaatccaactgctgctcaacctgaccatcgtgtcggacaccatcaccaagaacagtcagaacaccatcaaccaggccatgcccgagccacggccatgcgaagtaaaaggacgggagggagaacttgaaaaaacaccacaatttttgggaattggaagaaaaaatcattatttatcccttttgtgacccacgctcaaaaaaaaattttttttcatttttccagggtatttttagacgctgaaaacaaaaatttaaatttaaaaaaagccatgtgggcgagagtctagcgaaccatgggtttttttttgtctttattaattactttttcattgttcagctggccaaggacttggaagtgatgtttggccagaacaggtaatgatgattaatttactaattactcataattaaccatcggaaatgatttttcaaaaaaaaaaaatttccccattttccaggcatacagacttcaagatcgtctgtcgtggcgaaggcaaggagatgcatgagctgagtgcgcacaaggtggtgctggcggcacgttctcccgtgttcagtgccatgttggaaccgcacacggaggaggcacagaagtcggaggtgttctatgaagacatcgactttgaggtgggtggtgccgggtggtggacttgtgggtaaatcccaaaacgtcaccgcaaaaaaattttcaaggaaaaaaaaaagattttttagtgggcttggaccattggccatagggtggggccgaattccggcggagcagcagtctttgagcccgaatttcgcggagcgggtcgtttcccctccacatcgccccccccccctaaaaaactaacagaaattttccagaaaaaattcttaggaaatttcttagcaagaagatttcaagaaaaaaatgaaaaattttgcgggcgattttttgatgaactactaagtttttcaaaaaattttaatcgctgaaaatctttcaataattttttttcttgaaaagaaatttaaaaattttagacggaggagaaacgacggagggaaatgaagtgcatcccgtatttcgggccgttcattttattttatttttgccttttattcgcccctccccgaaaatattttaaaaaaattaagaaagattttcctagcgattttcaaaattttactgttaattactgcgttttttcaaaaaatcattccaaaaatcgcccggaaattctgatgaaaatttttttcttcttgaaatttacttgtaaattgaatcctttttttaaattttccctcacgcttttaggttatgcgcgaaatgctcttctatatgtacagcggtcgttcgccgttgctgcagcaaatggcgctcgatttgctggcggttgccgaccgttttcaactgatcggactcaaggagatggctgatcaggttggcaatggacattatttaacgccaaaccatttttttcaaattttgtcgtcaaaaactacagaaaattttagttttttaattttttctatgaaaatttggggaaattttttttttatttaaatttttaagctaatgaggttcatacgcacaatgggttttcaagaaattaaataactttttcaaagtcccttttacagtttatcaatttcttacaaagatttgagaataacactatcaaagggggttttaaacaacaaaaaaaaatatttatattttggttgattgactattttttggcatatgctccttttacccatttccccaggtgctccgtgccggactgtccactgacaatgtgtgccgtaaccttgtgttggccgacatgcacaacgcgctcgacttgaaggcggacgcgctgcgcttcatcgcgcaatactccaacaatgtcatcatg

SEQ ID NO: 47589 - DNA, 505 bp, Heterodera glycines
  Genomic contig location: Contig_ID=SeqID_19520; Location=517..1021; Strand=+
  SCN-specific regions: Sequence locations=1-505
  Gene Ontology: Mol. function=signal transducer activity; Cellular component=actin cytoskeleton; Biological process=regulation of muscle contraction
atgaaatttgctcttttgggagccgccagggcgggctatttggaagtgtgtcggctgctggtgaacggatgggcagcggatgtcaaccagcaaacaattgacggcaccacagctctgatgcgcgcgagcggtcggggacacgtggacgttggtgagaaaaattgtgccaaattttgacaatttttcttcattttcagtgaattttctcgtcgaacatggcgccgaccttgaccacaccgactttgatggatacaacgcgttgatgtgcgcagtgaagaacagaaggacggaaacggcacttcatttggtgacgatcggcgcgaacactgaccaaattggcattgatggtgagcagaaaaagtggttaaaccgcacggcttttatatgtaatttgctcccatttacaggcaaacgggcgcgcgacttggctgaagaaagcggacttgccgaaatgattgacattttccgtgccgcggctgagcagcgggaaaacgccgatgggtaa

SEQ ID NO: 47590 - DNA, 951 bp, Heterodera glycines
  Genomic contig location: Contig_ID=SeqID_3335; Location=100..1050; Strand=+
  SCN-specific regions: Sequence locations=22-179,208-215,237-446,468 -496,531-595,617-618,640-951
  Gene Ontology: Cellular component=nucleus
atgcctttcaatttatgtgttggtaattcgttttttacagtggcggcgagcatcaaagcgaaattcactacaaatattgacgaacaagaagagaaattcaaagaacgaacggttggattggtaacacttgacgaagtgaaggagagacagaacgaaatattttacaggtgaaaaccattctttttatttaattttaggaaatttagtgggccatctttaaaattttcaaacgaagaccgacccaaatttgagaaagccattcaaaaaagagtgctttcgtttggcgcttttgacgacgacgacgacgaggaggacgaggcactgattccaatcaccaaaaagagacacggaatggacccaacggtggacacttcttttctgcctgaccgcgaaagggacgaacaattgcaacggtaatgaataggaaggctcattattaattgtatgaaattaaaattcccatttttagtgagcgcgaacggatcgctaaagaatggcaagaaatgcaggagagggaaaagaatgaggagataaccgtggcattttgctattgggacgggtccagccatcggaaggactcaaaaacaaaggtcaactgtcaaaaaacaacaacaattattcttggcatggatttatttgttaatcattcagaaagggacgacaattgctcaatttctgcagaaggcattggacgtgggcgaaagtttactaccacaagatttattttttgtttttagacatttcgcaaagaattcctcgaattgaaattggcaacagtggataatctgatgttcgtgaaggaggacttaatcatcccgcacttttacacgtaaatttattatattctcattcatttgatgacaaaaccctgatttcttatgaaaattttgctttttttttttaaaaagagaaataacaaacagtgaaaaatagaagaattattagggtgga

SEQ ID NO: 47591 - DNA, 1932 bp, Heterodera glycines
  Genomic contig location: Contig_ID=SeqID_3344; Location=412..2343; Strand=+
  SCN-specific regions: Sequence locations=1-48,71-302,325-470,492 -509,531-849,872-1124,1159-1175,1199-1395,1426-1479,1502-1932
  Gene Ontology: Mol. function=microtubule motor activity; Cellular component=microtubule associated complex; Biological process =intracellular protein transport
taccattttgtcggaaaaaaccttaccataaacaccatacacatccaataaaagataaaatttagaaaaatgctttcacaagaagaaatttttcgaaatacacgaactgttgcccaaggattggatgcattgagggaagaaaatgaggccatcaagaacaaattgttggtcgggatggacgtgttgacacctgatgaacgtcaactcatcgatgagaaggcgtcaattgtggaaaaaaatcttgaaaacatccaactcggactggaagaatcgcaggttctttttcccattaaaattctttgaagttttttaaacttttcaaggtgatgttggcattggcatcgcatttacaaaatttggaggcggaaaaacaaaaatataaggcgcaagtgcgtcgtctttgtcaggaaaatgcgtggattcgggacgagctgaactcaacgcaacaacagcttcgccaatgcgaacaagtacaataaatgaatttttcattgaaattgacgaattatttacttcctaggacaaggcacaactcgaggaagagaacaagcacttgaaatttatgaacagtatcaagaagttcgacgaggatttgccggacagatcggagaacgaagaaaacacatcggagcaactgcgatccaacgaagtgaacacgtcgacgactttgcaagagcttggttttggaccggacgaggacgacgatttgcacagtgagttgggagaaattgttttgctaagtgatgagttaagattagaaaacggttcaatcggattttatacaaccataaaaatatacgcttcccacatttgtgcctgtgctctcctatttttttttcaatttttattaacatcttgtaccatattaaaattaaaaaagtcttaatctactttcactttaaaatagagtttatttgaattagcagatgccagtcacttttcacaaccgactccggcgaatgcgatggctgccagtaccagcgcgggttacgatattccgcagcgtttgaaaacgctccacaatttggtaagtttgtctgctgttctctgttcttgactatttaactgttaattaggtcattcaatacgctgcccaggggcgttacgaagttgccgttccgttgtgcaagcaggccctggaggacctggagaagaacaacggccacgaccaccccgacgttgccaccatgctgaacattctcgcattggtttatcggtttgtcccgcggttctttctttacgctatgtttcccattcagtgaccagcgcaagtacaaagaggctgccgccctcctcaacgaggccttggccattcgcgagcgatgcctcggcgaggaccacccggcggttgccgcaactctgaacaatttggccgtcctttatgggaagaggggcaagtacaaagaggcggagccactttgcaagagagcgttggaaatccgagagaaagttttgggcaacgaccatcccgacgtggccaaacagctgaacaacctggccttgatttgtcaaaaccaggcaattatcaacaaatgaatcacccattcattgtccatttttagggaatgtacgatgaagttgaaaaatattatcgtcgagcgctggaaatttacgagtcgaaattgggaccggacgattcgaatgtggcgaagacaaagaacaatctttcgtcggcatttctgaagcaaggcaaatacaaggtaaatagtcaaaagtgggaaaagggcgagcaagcagtctcttaattttgcaaattttggtgatttgttaaattaaggaggcggaaatgttgtacaaacaaattctgacacgggcgcacgaacgacagtacggccgagtgaccgatgagaacaaaccgatttggatgatagcggaagaccgggaggacagtaaacaagcggacagcggaatttaccacgagaatttgcaagt

SEQ ID NO: 47592 - DNA, 742 bp, Heterodera glycines
  Genomic contig location: Contig_ID=SeqID_3348; Location=1221..1962; Strand=-
  SCN-specific regions: Sequence locations=1-742
  Gene Ontology: Mol. function=DNA binding; Cellular component =cytoplasm; Biological process=protein-nucleus import
gatataacgcaacaaatgttaaacaatgaaatggccttggatttggttgagaaatgcgctcggcttcacattttttgcattttttggacttgttgaacttgaagcggatctttttgaccataaaatgaacacgggtattattactaccagttttaatatattttttgcatattctttagagaatttgtcgaaaagtctccaaacacttcggcacatgtatgacgatttggcaaaaaaacaacttttctgtgtcaatgagtccgaattccgttcctacgacatccttttgaacttgtccgatttcaaaaattctacttttcaaattttgagtttttggttcattcccttcctattaagccaagtgctctcctaagtccgtgccaatccgcaagtgcaactcgccctctctctctccagtgcccttcagaataacaattacatccgtttcttccgtctcgtacgtcttcaaaccacttttcttcaggtcgttcgttgcctaattgactgacttctcctcctatttattgctaattaattactctccgttttgccttaggcgtgtctgtgcatcacttttttccgctcatccgttccaatgctcttaaagtgatttgcatgccttaaaacattttcccaattgaaacttttgtcgaatatctctccttcgactcaatagacgaggcgatgaaattcattcgccaattcaacttggaaatggacgccaccgaccccaatttgataa

SEQ ID NO: 47593 - DNA, 496 bp, Heterodera glycines
  Genomic contig location: Contig_ID=SeqID_19587; Location=192..687; Strand=+
  SCN-specific regions: Sequence locations=1-45,69-193,215-496
atgacgaaaggaacttcttcgtttggcaagcgccacaacaaaacccacacgttgtgccgtcgctgtggtcggtcctcataccacatccagaagcacacttgctcttcctgtggctatccggagaagcgaaagcgcactttcgatggtgggttttgcaaacgaaacgaatttctcggagcggaggactcagtgtgaaaacgaaatttgcaaaagcagaatgtccaaataaacaccaaattcatgaactgcaagcaatttggttttcggacccccccccccccatttacataagtgttacatttcttcaaaaagacccgcaaacgtttcattctcaattcattaaaaggccatcgctttcttccacaggtctgtcaagtccatccgccgacgcaccaccggcaccggccgaatgcgtcatctgaagcttgtgcaccgccgcttccgcaacggattccgcgagggagtgaccgcgccgcgcaaaggcggagtgaaagcg

SEQ ID NO: 47594 - DNA, 941 bp, Heterodera glycines
  Genomic contig location: Contig_ID=SeqID_3353; Location=378..1318; Strand=+
  SCN-specific regions: Sequence locations=1-221,243-597,619-941
  Gene Ontology: Biological process=chromosome segregation
atgcgcagcccaacaacagtcacgaagcaatctccagaatggacgtggtttgtgcacaagggaccaaccatttttgagggtggaaaaatgatggaaatggtgccatcctccgacgctcttttaaaatgcctaaataaaatggtttaagctagaggtagagcgggaccgggaccaaaacacggacaactgagtaccgaggtcccggttttgaccgggaccagtcccgggttttttcccggttttcccagccaaaaatccccggtcccgctctactctagtttaagcaacaattcatttggtcttttaattcagttaagtgagcggatccgtgacttccattacaacgaggaccaaacgcacgcacagctcaatcgaaaattgcaattacgcgaccaactttattacgcaatttcaccgattttcccaagtacaatcgaattatttttgataaatgaagcacaaaatgctccgttctgttgttcagtgtgcggactttacattgtcggctcgtcactgaacggattcgggacgaagcggtcggacttggacctttgtctgatgataaccaatcgtgatgtgagtttaggcattaataaagggcagaaaagcaaaggaaatgtccagagaaattgggccccaattctcttttaaattcattttgtcgtccgcagattgaccaacgcactgatgcggttgttgtcctgtcgtcggtgatgcggacattggagagcaatcaaattgtggccgagcagaatctgatcctggccaaagtgccgattctacgcatcaaatttatcggcactttccacgacataacggttgacctgaacgtcaacaactcggtggccattcggaacacgcatttgatgtgttactacagctcttgtgagttatcttcattaaacggctttttgtcaatccccgagaggcctgttttttga

SEQ ID NO: 47595 - DNA, 780 bp, Heterodera glycines
  Genomic contig location: Contig_ID=SeqID_19653; Location=1..780; Strand=+
  SCN-specific regions: Sequence locations=1-558,580-780
acaaagaaggcgagtggatcggtggcaaatgatcagacccatgaacgaatgtgcttttccccacttaagggtggtgccgcaacaaaaagtacatacaaatagtcaaaaaaggtgccattgcaatgccaatttaaatattgccatcaaattcgccatcgttcccttaggctatcggtgtttggtgtgcaacaaagtgtacggtcgctacaactcggtcagttaccacgtgaccatttaccatcggaacccgcccatccgttgcgaggaggagggatgtcagttcaccaccaggcaagccaagcccagcggaatactgccaaaagagtgtctttccgtttagagaagcgcggtacattcactttcacaaatattaccgtcaccaaatcgcactgccggaatccatcgacttgggcaagtttaacaaccaatgggagacggacgaacaaattttaagacagaataggaaaaggggtcaaaattaagtgaacaaaacccaaaaagagtcgaatagagcgggcgaactctgttcaaagacattatatgtacacatataccgtattacttaaattttttccaatttacatttcggaggggggggcaattggatggcactccgttttgatatgttcgtcaattggtagaatattttgccaatttctgatttgaattgactccgccttctgctgttcagcttctcgcaaatgccctctgttaggctgtaaacacgtgtccaaaagcccggccatgttggacaaacacatccaccgacacgtggccgac

SEQ ID NO: 47596 - DNA, 2168 bp, Heterodera glycines
  Genomic contig location: Contig_ID=SeqID_3365; Location=83..2250; Strand=-
  SCN-specific regions: Sequence locations=1-457,482-1175,1198 -1265,1287-1767,1789-2168
  Gene Ontology: Mol. function=inositol/phosphatidylinositol kinase activity; Cellular component=1-phosphatidylinositol 3-kinase complex; Biological process=regulation of cell cycle
atgaccttttgtcaggctctctcatgcgcccgtacaatttctgcttgtcttggctcccatgtccatttgattctgccgccaattctgtccgtattggacgaccgcaaaacggaggagaaagtgcgtacgtcggcactggacactttgcttgagttggcccgtcgacattccatcgaggattacgctttgcccgtcatgcaaacatggcttcgttgcattggcatcaagtctcaacagccgcgactgatggagttactcggcatcatcgtcagagttcgtcttcatttaagcttttcggcggaaaaagttcatttccccttcattttcagaaatggactcagttttctgtgtacaaagagaatgtaaatgccgccttggtgcggtgtcgtgtcgaaccaatgctgtgccatgagtaccaggaacagttggcacttctccaggcgccttcatacgcacgccaacagcagcagcaacaacagaatgccgttggcagtggtggaggcgtttaccaacaacaacagggcacattcagtgccagcacttcatcaccattattcgcgcgtcaagtgtcttttttaccgccgacgcaaaacggcggggcgacaacggacacttcgcccttgcccgacacaaacaacggaattgtcggttttttgcccgggcccggcggaagcagtgcggacatgtctcgagtgcacagaatgtcttcgggtaaggcgaacaggaaaatgccgggacgaatggttgggtttaggccgtgatctttcccgcttggccatcaatttggaccaattgcgtcgcttttggacggtccaaccactgctctcgcgtgaggattggcttcagtgggttggcactttgcgcaaccaattcatccgtcagagtccgtcgtccgcacttcgcgcctgcgctgtgttggccgaaatgtgcgaatcactctcaaagtccgttctttttccccttacttttctatttttaatgaaataatttacagggaattattcaatgccgcttttatgtccgtttggactgaactgccggagcgggaacagaacgaactgaccaatcagctgatcgatgtgttgaggcactgcccccatgccgaacccattcagaccatactgaatttggccgaattcatggaccattctgagaaggcaataaacaaagcgcagtaaaaaaaaaaaatttttttttgtttgtttattctttaagggacctcttccaattaaacatcgaatgctcagcgaatcggcggagaagacacgtgcatacgcaaaagcactgcgttacaaagaaatggaaattttgagcacccgcggcaacggagaaccgaacgcggatgactgtcaaacgatgataatgctattcaacaaattaaatctggaagaaggcgccgccggcattgttcagtatgccaaacgtcacaacatggaaatatcggtaagtcgtgactttcttttctcaacatgggttttaataccttttttcgttgctcaccgattcaactgtttttagggtcgttggtacgaaaaattaggcgaatgggaaaaggcgttggagatgtatcagaacgacatgaccaccttgcccgacgaacaactatcatggaaatctatttcgtcacacagtgaaccccaattgctcccgactaacagagaggagttggaccagtccaaacccactgcaaacgcaggactcggtgatgatgccgccgtttccgccagtgcttccacgaatcgaattgcgacaccgcagcaacaaaacggagtacaaacacacggattttatgtttatttttcaaagcattctcctgactatttagtcttctcgctccgatcttttgctgcaccaaatgcgctgtttggaggcgctcggtcagtggagtcagttggaccgcatttgtgagacagcactcgccgaggaggaaagcaaccagtacaactccaacttcaacagcgccacagagaagcagcagccgcagcgacaattgttacggaaacggtcgagcaggagaagcggagcccgactccctcaactacacgcccccaggcaaccgacaccgttggtggacgcagtcgccgccgaatttctgaacgcaacgctaagcgaagtggcaaagcgacagaaaattgcgacgataggagcccggggctgttgggcagtcg

SEQ ID NO: 47597 - DNA, 2964 bp, Heterodera glycines
  misc_feature (2892)..(2892): n is a, c, g, or t
  Genomic contig location: Contig_ID=SeqID_19654; Location=66..3029; Strand=+
  SCN-specific regions: Sequence locations=1-42,70-150,172-240,283 -1079,1101-1789,1812-2964
  Gene Ontology: Mol. function=zinc ion binding; Cellular component =integral to plasma membrane; Biological process=body morphogenesis (sensu Nematoda)
ttttctccattcttcgccctcgggcgatgcgtcgcccatccgatgatcattattattattattacagtttatgtttaaatttccgataattcatctacagaaatgactttgttggtagctttttcagaatgcttcgtttgctttttaccttttccacaattttcacgggtttcggtctcgcctcgcccattaaaaatcgttcatcggcaacagaaacagtcgatgatcaaccgcaaaacgtaatttattatttttaaatgttaaaattaaattgaatttaatcgcaaaattttttactttagcaaatcggcacacaattcgttgaagtccgtcggttattagatgaaataaaaatagcttcaataaaacaacatggtcgcttctctgatcaggcaataagcaaaaagaaaaaaaatttgcttttttacttacaaaaataggacccaacccgagaaagggcacggcaacgaattcgggacaaagtggcgattaatgacggcaccgaggcgaccgtcaaccgagccgtggcggacgaccttttcgagaacgacattttgctgacattgccacaggccaagcaaatattggaggaaatcaaagaaggtgccgcgggcggaatgccatcgaatgaatgaataaaaagttcattcagtttcgccatcgaacaaacgacgcggaagacgacaggcgaacccaacgccgagctcaatttggggcaatgtgaacattccctacttgttccaagtctcgcaaaccgattgtgagattaagcacagagaatgggactgaatttgcaatttcagcaaattggcaaaataacatcagaaaagggcaccggcacattgagtgggcattggccataagccaaccctctgactcttttcattttgaagaagcctcacgtgtgtccgttttgtgttccaccaaaatgaccacgcgttgaaaggcaaagattacctgcaatactttcgtggctccggctgttggtcccaagtgggcaaaaccggcgggcgacagcccatttcgatcggatacggttgcgaatccgtaaactcatcgggttttggcatcttcgtcaatccctccccctctctccccctaaagctcggcatcgtcgctcacgaaactttgcatgcactcggactttggcacgaacagtcgcggctggacagggacagtttcgtcaggataaattacgactccattttgccggtaccttcgccattttgttgtcaatttattcatacgtctgtttttgtcagggcaccgaatcgaattttgaaaaacgaacaccggacacaagtgacaacctgggccaaccttacgtagaaggggcgaagttgaccatttgagacggcctttgtttaggatttggggtccgccatgcattacggcaacagggcattcgcatcggactttcgaaggtgcggcacccttcagacggcacatttggcctcttttgcttcagtttcaccattctgacggtggatcggatgtatcagcagacaataggacaacgcggcggactttccttcaaagacgccaaaatgatcaacacgcgctactgctcaggtggacagtggcgcattggcaccaaaatgggcaatacaaattgcagaaatatgcaagactaagttggactgtgacaacggcggatacaccgacccaacggattgcgaacggtgccgctgccccgacgtacgaatcattggcataaaattaaaaatggcatttgtttgttggcttagggatacgccggcgattactgccaacgcattcccagcagcagtaattaataaaataattaactacaccctagcatttgtctcgttccccaagattcccaaacttgtctaacgaccggcgaattcacccgccggccgatggccgggcagcctcaaaacaagttcactggtgccgcgtgcttcatgttattggcgaatccatgtaaatgaatgcgttcactaattaacccaaacgattaaataattaattatttagcctttgcatcggacacatagagttgtgataaacatcgaaaagttggacatgccctgcaaagattcgtgtgcctcctttttggagctcaaatacaaaaaggacaaaatagccacaggcaaatgacgtcaaaaagctttcatttcactttttattttgccatttttttgctatttaggtgccagactttgctgcggaaatgcgaccacaatttacgcggacattggcaccgatgtgctggtgattttgatgtcggacaacaatttggaagcgaagtacaccgggttcgagctgagttacaaatcgggcaagtgattagcgggagaccaaaagagaccataattagcaaattcacagagggcacagatccgacagtaatttcaccaatggtaacagcgaagccgacaattgctataacgaaaaggccgccgaaaacattgaccaacattacgccaaagataacaatagaaacaacgccaaggataacgacaacgacggacacaatgccaaggataacgacggaaacttcgccaaggacaactacggaaacatcgctaaaaacaacgacaacttcggaaccaacgaccgaaacgacggcggaaccaactaccccaaaagaagaagaggcaagttacttggatcagcagattgaaaagaaacacttaaaacggatgagcaggggatttggagcaaatggggcggatggagcggatgttcggcttcgtgcggtgcgtgcggtcacaggagaagagtccgcacgtgtttcaaaggcaaatgcaagtgcgttttgggcacaaaggcaatgcatggccaaacgctgttgttcaggggggagtccggccaaatggagcgttgcgccttcggaatttgccctttggccaaacaaagaacaanccgttgtcaaggtcgactggtaatgccattcaatgggatggaaagcctcgagttcggcacggtgattaatta

SEQ ID NO: 47598 - DNA, 2605 bp, Heterodera glycines
  Genomic contig location: Contig_ID=SeqID_19674; Location=75..2679; Strand=-
  SCN-specific regions: Sequence locations=1-26,48-91,114-285,385 -430,574-617,696-696,755-756,794-1248,1271-1285,1320-1738,1760 -1857,1879-1993,2027-2514,2547-2605
  Gene Ontology: Mol. function=protein serine/threonine phosphatase activity; Cellular component=cytoplasm; Biological process=protein folding
gaggctttaaacggagattccgctgaaacactgaaagaaaaaggaaacaaattttaccaaaacgaagattttacgtcatgtattgaagtatatacaaaagcattggagctaaaacctgatgataaattacgattggtcatttataagaacagagcaatggccaagctgaagacggacgattttgagggagccgagtccgactgcaacaatggcatgttttatgggtgaacattctcgctcagtaattattatttcagcacttgaattaaacccaagcgacccaaagtcttattatagacgcgctttggcgagagaaaaattagacaaaatcggctcagcttttaatgatgcaaaagaggccattcgtttacgaccaggggacacgtaattttcggctgattaattcttgcaattttataataaacttcagtgtgttagtggaattatgctcgcgtcttctcaaaatcaacgcagagcgtttaaaacaggtcgaaagtgtggaaaatcgtgcggaagaaatgctaaaaattgcatttggagagcaacaaagtgacaaagaaaagcacataaaggtgaagggaatgggatggatgtgttacagttttgagctgttatttaggccatgaacaatttgcttgttttatgccgagactcaaatagcggggcaatgcgagtttggcaaaatggacaaattgtggcgcaattgttgggagttatcaaaggaaatgcatcggacgaagaagcactgtgtgctgttaggattttggacgaattggccaagtcacgagaaagggtatgcctttcttggttttaaattatgtacatttttctcgatctttgcttaatattatttttgtaaaataatgcactagcggggaagagtcatttttgtcgtaagaactggttaaaatttcggagggaatacgtgcccctcgtgtgcgaagtgaaaaattttatttgttctttgccagtccgtccaaatgatggaattgctttccgtacaaaccctcgctcgactgccttctcttcgcccatcgattgcaaatgcggaggctgccagcgcagtcattcagcgtgtgttcaacggattggcggcgatggatttatccaaggagattaagccggactcggaagtagtcgaacggaacaaggtcgcaattctgcggctcattctcgagttggaagaaattctaacggacccgcaatattcggcaacagcgagagaaatcagcattgaccttctgcttaaaaatttgatgcatatgagtgggggattaccccgtggatggtttgttttagtttttgtttagaagaataaattttatgatagagaattccacatttaaacttcgaccggaaccattccttttttttcaggtcctggcgttttgtcgaggacagaggacttttcaaaatcttgcacattgccacacaattgccagaacaatgcgactatccagtcacttccgaaactcgtcaccatgtttctgttttccttgctcaactttatgacgatatggtcggtgtaattccttcatgagaaataaataaatttaagatttttgaccaacggagagcgatttacaaagaaagggtggaccaaatatttggtggtttaatgtccgaccttaatgatccaaagaacagaatcaatttggctgctcttctgatcactttgctccaagggcccgttgatgttggcgttaatttggtgaccaacgaccaaatcaccgaagtaatgctccagatggcctcttccgacgactttctgcagcaaagcgttgcagccgaattaattgtgctttcagtgagcaaatacgaaagggccaccaacatgatcaagcaggggctggtcagtatttaaagcattttggaaaaatctaaccaatttgacggggtccatcggtgcaataggcatggagaagcctgttaaattaggactttgtctctcttattttagccatttaaagctctcctgttttcaacaatgccttttagccagtgcttaaaaagttatttttgtcttcggatccaaatgtccgtgtccgcgcattggtgggcctttgtaaatgcgcttcgtctgccggcgatgattgcagtaaacagccaatggacgatgaatctcgcatgaaactggcgaacacgtgtcataaatttttaattgaaaaggcagaaaatttttcggtggatttttttctataatatttggaattttttggcagtttacggctgtctaatattttcccacatttatttgtcaggtcgatgtcagacgtttcgcttgtgaaggactttcttacctttctttggatgctgaaataaaggaatatattgtcggaaaatcggaattgctgaaggcattggtcgatttggcaaaaaatgccgggggatgcgtgttcacaatggccacaatttatgtgaattgtgcgaatgcctacgaaaaaccaaagatggacgaggaaatggtcaaattagcgcagtttgccaaacatcacgtgccacaaacgcacccaaagggtaaaaggaaatttaaaaaataatttgacaaagcgaatattacgatgaagataccgaagaatgcgtggacaaaaggatcagaaaaatg

SEQ ID NO: 47599 - DNA, 1046 bp, Heterodera glycines
  Genomic contig location: Contig_ID=SeqID_3371; Location=1..1046; Strand=+
  SCN-specific regions: Sequence locations=1-6,28-117,140-864,886 -976,1015-1046
atgaattacttttatacaaattgggaaaaaattggtatacagtgcaaacttttgatgtggataaaggactttttgagtaataggacttttcgtgttaaaattggggatgctttatcctccagtaacaaagttggctctggcgtcccccagggctctgtcatgggccctttattatttttgatttatattaacgatcttcctgatgctttgccatcaggagtgaaaataaaattatatgctgatgatgttaaattgtatatttgttataaagcaagaaccgaaacagaaattatgcataaagcattgcataatttatcagaatgggcaaataaatggcagatcagaatctcaattaaaaaaacttttgtacttcatttggggaataaaaaccccaaagaaatatataaaattgatggaaatataataaatgttgtggatacaattagggatttaggcataaatattgataataaattgcaattttccaatcatgtcacacaaataataaagaatgcatatttacgtatgcgttctttatttcgggttattaaatcaaagtcttctaggatttggattattttgtacaaaacttatgttagaccgttattggaatatgctcctgaggtttggaatcaatctcttctaaaaaatattaaaaaaattgaaaaatgtcaaaaatatttcaccaaaagagttcttttcaaatgcagccttccacccattccataccaacaaagattagaataccttcaactgccgacacttgaaagcaggcgaaagctgtctgatctgttcatggctcataaaataatttatggccgaacagatcttaatccctttgaaatattcaaaccttctgaacgctttaacattcccttttatagacttaactcgaaatataaattaggcaaaaaatttataccttttgcggggcgggtaactaaaatttggaaccaactcgataaaaggctcattgaaataaactattaaatcaatttaaaaataaaattaaaagtcgaattattaattcattaaacaaaaagtga

SEQ ID NO: 47600 - DNA, 875 bp, Heterodera glycines
  misc_feature (14)..(14): n is a, c, g, or t
  Genomic contig location: Contig_ID=SeqID_19687; Location=2729..3603; Strand=-
  SCN-specific regions: Sequence locations=1-163,185-228,251-733,756 -809,848-875
cctttattattttntgatgtatattaacgatcttcctgatgctttgccatcaggagtgaaaataaaattatatgctgatgatgttaaattatatatttgttataaagcaagaaccgacacagaaattatgcataaagcattgcataatttattcgaatgggcaaataaatggcaaataaaagtttcaatgcaaaaaacttttgtattatatttgggttcaaaaaacccaaaagaaacatataaatttgatggaaatacaataaatgctgtggatacaattagggatttaggagtaaacattgataacaaattacaattttccgatcatattaaccaaataacaaggaatgcgtatttacgtatgcgttccttgtttagaataattaaatccaaatcgtctaagatttggattacgttatataaaacttatattaggcctttattggaatacgctccagaggtttggaatccgtctcttcaaaaaaatattaaaaaaatcgaaaagtgtcaaaaatatttcaccaaaagagtattttttaaatgtagccttccgccaattccataccaaaatcgattagaatacctgcaactgccaacacttgagaaaaggcgaaagctgtttgatctgttcatggcgcataaaattgtttatggccgaacagatctgaaactattttctatttttaatccatcagcacgctttaacatccccttttatagatttaacacaaaatacaaactgggcaaaaaattcattccctttgctgggagggtaacaaaattgtggaatcaactagataaagaactaataaaaacaaattctttaaatcaatttaaaataaaacttaaagttcactagggtaatatgtaagacc

SEQ ID NO: 47601 - DNA, 3195 bp, Heterodera glycines
  Genomic contig location: Contig_ID=SeqID_3373; Location=3673..6867; Strand=-
  SCN-specific regions: Sequence locations=1-125,147-178,201-248,278 -809,879-1088,1120-1162,1223-1349,1403-1509,1624-1634,1657-1744,1766 -1784,1828-2040,2062-2204,2226-2384,2406-2509,2531-2813,2844 -2927,2971-3195
  Gene Ontology: Mol. function=procollagen-proline,2-oxoglutarate-4 -dioxygenase activity; Cellular component=cell; Biological process =embryonic development
atgggtagtgttgttaaacatatgaccaccccaaaagggagtgcagttggtaaaatggtttgtaactaataataacattttgacaggggacagtgaatggtatcattataaagcccacaaaaaatgctacaagaaatataaaacatacctatatacacaatatagtcatattgagattttataatcaatttaaatcaaatttggtagaaattttgagtgttgttaaacatatgaccatgactgtataaatcagtattttatttatttttcccatataaaatatagaatttggaatcccacagtttttggggtgccgagtcccagtggccatccgggtcgaaccctctgatcaacatgctcactaattaaactcagaatttatctaatgtgctaatgattctttttcttttttaggatacctatcagctgaaaagcggcgatctcgcaaatggttatgttggtggcgaaaatgtcggcactgggcttaatgcgcacgactgtttcgaggtcggccgtgccgcgtacaaccaaaaggcaagtgccggaattcagtgccgaaatttagctgattaaattaaatttgctaatgattttgttttagaattatttctacactttgcaatggatgcaagaagctttagagcgccagccgagccacgagttggaagtggacatcatcgagtacttggcctacgcgctttaccagcaggggaaccccggcagagcgttggcatacacccgacgcttggcatatttggcaccgaaccatccgagggcggatggtaaagattgcaatgctttcaaatagcattattaaattttaaattaattttatcgaaatatctacaagaattaatttgaaattattttttaaatatcgaacgggacaaaatttcgccgatgaaatttcgcctggacaaaatttcacctcgaaaattaaaaaaaattcatcttagaatattttaagaaaaaaattttatggtaaattaataagttttttcgaaatttttcaaaaaatggctaaaaaaatttacaaatgtttttcccttggaattttcatataaaaaaattttctaatgttttttttcttgaaaatttgaaaattaaaaagaaaatttctttggcgaaattatgtcccggcgaaattttggggtgcaccccgaaatattaataaacaaaattatttttattctctataaaattaaattaatttcataaaaaagggaatttgcaatggtacaaagagcgaatgtctgctgaagaatttgatgaccaaactgatttgcccgaattgcagaatgagtacaaacgatacaaagacataccggagagagactcatttgaaaggcaattaattaaaaattaatttaaaaaataattaaaaatatatttttgaatttttcagtttatgccgtggcgaatttgaaattccaccagaaaatgtcacacaattgaactgttattataagaaagacaaggtgttgttatgttgaacaaaaagacaaaaacttttaaattatttatgaaagaaattaattatttttcgaaaattaattaattaatttatcataaattcgaaatttttacggaattatctttaatagtttataattttattaaaaagcaactcaattaaaactattaaaatcaatcatttcagccttttctgaagttggcaccccataaagtggaaattgtccgttttgaaccattggtcgttctttttcgtggtgtcatttcggacgccgaaatttcagtgatcaaagaattggcaacaccaaaagtaaaaattaaaaaataataattaaaatttatgtttaaaaaaatgtttagcttcgtcgggccaccgtacacgacccggccactggacaactcgtgttcgcctcatatcgaatcagcaaatcggcatggcttaaggatgaagaacacgaagtggtggcacgggtcaacaaacgcatcagtgtgagtgtttattaggcagttaccgtaagacgagacgtacggtagggagtgagttatcataagagtgatactgtgggtttagaaatgtactgcatttttaaacatgaaatagtgcgaatatggggtgtcatggcaactcgtacaattttaaattgatgtggccataacttttttttagtcggccaatttcttaaaacttggtatcattcgaatgcttttcacaaaaaatctaacctccttattataaatcatagattaaaaaataattcattgaattgattataggactcttttttatgaatttatttaccaaaaaatgccgaaattgtgggagaagaatttgtcccgtttcactatttcattatctgatgcgggtttttctatatttcaactgctcatcatactgaaaaatggattttaagaaattttcaacttttctttcaggacatgaccaacctgaacctggacacggcggaggaattgcaggtggccaattatggcatcggagggcactacgacccgcacttcgatttttcgagggtatgtaaatttcctgggggtttttcttaatcggcagtaaattttttaatcttttcaccacaaattagcgagaagagaagaaccaattcgactcgagaggcaatcgcgtggcaaccgttctcttttacgtatggccggaaaattaaatttcgggtttttttcactgtttttttctcagatgtcccagcccaaaacggggggcttcactgtgtacactgacctgaaaatgggcgttgcgccgtcgctgcacgacgcgttgttttggtacaatttgcaccgggacggaaacggagatctgcgcacgagacacgtaaaaaaaataattaaaaaataaaatttttggcaaaaagccgcgaaaatcggtggcggcattttttgatattttctttgtaatttaaatttgccaagtttcatttaagacatgcaattaaattaaaaatatattttaaaattattttcaaaattaaactaaaaaggtgttaaaatctttttaattaaatctcctcattatattcctttcggattgtttttatgactattaattaatccatttaggctgcttgtcctgtgttgaccggcgttaaatgggtgtcaaacaaatggatccacgaacggggccaggaattcatacggccatgcccgctgaagaaagaatataacgaaaaatatgtgggcgacgttagaccattttga

SEQ ID NO: 47602 - DNA, 2823 bp, Heterodera glycines
  Genomic contig location: Contig_ID=SeqID_19696; Location=609..3431; Strand=-
  SCN-specific regions: Sequence locations=1-224,246-793,833-1212,1234 -1303,1329-1545,1567-1591,1614-1712,1734-2030,2052-2301,2330 -2613,2635-2651,2688-2736,2758-2823
atgattaccgaggcaatcatcaattccgaacagctcaaagagatgtcgactcgggcagtcatcgaaaaattgccggaggcgatggacggacgggcattggcggaacaaattgcagaagaatgcggcgtcaaagacaaactttcgccggacattcaccgccacccgaggacacgacctgagggcgggacaaaaaaggaccgaattttgaaggtgccattcttggacaaattttcccgtgaccaatttctttacaagttccgtaatgcactgaaaaaattccctaatttgccgcaatttatcaaagtccgcagggatatgacccaaagcgaactcaaaattttatactccctacggcaacaagcctaccaggccaacattgccgcaggtgagtacaaatattttgtggtcgacttggagatcaaatctctgaaagatccccgcccgctcagaactcgctagggatacgcgagcaaaccagacaaaaaaatttggaataccggagaaaaaaatccttggatttcttgcctattaataaacgcccgatcgataacaaataaaatagccgacttagaacatatagccaaaaaatatgatccttctataattctaataaatgagacctggttaaactccagaaatacagtagaatcagaacttaaagtacatggtcaatatcaaataatccttgcaagccgaaatgataaaaagggcggaggatcggcaattttattaaaatcaaacatcccttatcagacacttttctctgggacaaaataccaaagcgaaattattcacattaaattactttttaaaaaaccaattcaaattataaatatatatcgtccaccaaattgtacagttccgaatactaaaaagctactcaaattcatttctgaccagagtgattctgaaaatatcatattctgtggtgatattaatatcccaaatatattatgggatgaaaataaagtaaaaaaataaatgatccgatgtctaattctctgattgagtttatggaccaaaaacaattgatacagcatgttaaagaaacaaccagagaaaaagcaattttagatttagtaatgactagtgaatcagaattaattaatgaattaattgtattggaacatttttaaacttccgatcattaaatggtcggatttaaaataaatgaaaaattccggcgtaataatcccagtgtttatagaagagattttaaaaatattaatttttcgaaattaagtcgggcgatacttgaaaatcgaattgatttatcaataaactcagtgtacaccgttgatcaaaaatataaagaatttttaaataaagttctgaaattatatgatacttttatacccaatagacatctaaaatcgataataaaacaatcgtatcctcaaaaaataagagacttattttcagagaaattacgtttgcataagcttgtaaaaaaattccctgaaaaaagtgatctcattttaaattacaaaataatttcaagggaagtgaaaaaacaattgaaccaatttagaaatgaaaaagagtcaaaaattatttcccgggggcaaaattcagttaacaaatttatccgaaataagttatcaaaattttttgagattcctactctaattgataatgctggaaatatgttttccagcaatgtataaaaatgtaaaatattagcagaaatatttcaaaagtcttttttaagaaaatcaattgttaatggtccacaaactcagtcaacacagaataagattaaactttctgacattgaattgaatgcgggaataatttggaatatattaagaagacttccccggcgtaattccacttcaccggataatgttccttacattttattaaaaaattgtgctgagccaattacaaaaatattagcagatatatttaggctaattttggattccggtcaaattccggaagtatggcaaacatctttggtaataccaattttcaaaaaaggcgaaaaaactgatccattaaattataggccggtgtcattaaccagcactgtctgtagagtttttgaacgaattttgagtagtaaaattttagaatttctgaacagtacaagattctttgataaagaacaatttgggttcttaaaaaatagatcgactacaactcaaatattaaaaatgatggacgatatatataattctatacaaaagaatcaacaaattgacataatctatattgattttgtcaaggcgtttgattctgttccaattgatttattacttcaaaaaatcaaaaagattggaattgaaggaaaaattcataattttttaactaactttttaaaaaatcggagttttaaggttaaaattggcgaagaattgtcagaaagtttcagaatattttcaggagtgccccagggaagtgtcttagggccattactctttttaatttttataaatgatctgccgtccgttattacaaatgaagcggcatcagttggcataaaaatgtatgccgatgatgttaaattatattatgcccacgaaaatgatgaccattcgaatcagttggataaagcaattgaggctctggaaaaatggtcaaaaataaatgggttagaaatttcaactgaaaaatgttttgttttattttagggaaaaataatatgaaaaaagaatattttattaactcaaaaaagatttcagaatcggataatgttcgtgacttgggaattataattgactcgaaacttaatttttcagaacacataagcaaaattatacgaaacgcatatcttagaagctttcagattttgagagtgttgaaaagcagggaaataaa

SEQ ID NO: 47603 - DNA, 1028 bp, Heterodera glycines
  Genomic contig location: Contig_ID=SeqID_19710; Location=373..1400; Strand=+
  SCN-specific regions: Sequence locations=1-171,193-331,353-451,477 -682,719-991,1015-1028
  Gene Ontology: Mol. function=transcription co-activator activity; Cellular component=nucleus; Biological process=transcription from Pol II promoter
ggctgaaaaggaaagggagaagctgaaactggaacagcagcagcagcagcaactccagcaaaaacagcccaaacaaccattacctatacaagtggaaaaaccaattgaccccgcaatacaagccgaactcgacgcgcaaaaggaacgtgaaaaggttttgtttgtctcatcttattattcattttattattcttgaattttaggtaccgttggaagagcgtattaagcagtttcgtcagttgttggaagacaaaaaagtcagtgcgacaagttcatgggagaaggaactctcgaaggtgcagcgcattatcatttacaggatttgtcacttgcaaaatattttaaatttaagattgtctttgatcagcgctatcttctccttagtactgtggaaagaaaagctgcttttgaggcctattgtcgtgaacgggctgagattgaaagggcggagaagaagaaaagagcaaaagaagccaaggatgggtttcttaaacttatggaagaggctaaactgcatggaaagtctgcttttcaattacagatcatggcacaatgccttgatttttttaacattttaaggtcgacatttgcttccttctctacaaaatgggttaaagatgcacgtttcaaggcagtagagaaaatgcgtgaccgcgaggcttacttcaaggattacgttgaagaactctacaagaaggaaaaggaggagaaaaggaaggagcgcgaaaaggtgaacaaatgctaaaaagtaaacacttacaattggtttgcaggccaaggatgaattcaaagctcttctgagtgagcaaaatgatctgagacgcaattcaatctgggctatcgtgaagaaacggctggacaaagaagcgcgctacaagaacaaacatttggacagtgaaacgcgtcaacgccttttcgaggagcacgtgaaagactgtccggagccaactgaggttattaagctaatgaatattccgagaaaacaatttgtaggaagaggaggaggaagccaaacggttggcggctga

SEQ ID NO: 47604 - DNA, 744 bp, Heterodera glycines
  Genomic contig location: Contig_ID=SeqID_19715; Location=54..797; Strand=-
  SCN-specific regions: Sequence locations=1-744
  Gene Ontology: Mol. function=snoRNA binding; Cellular component=small nuclear ribonucleoprotein complex; Biological process=rRNA processing
atggtgcgcacattgaaattccatgagaaaaagttgctgaagaaagtggacttcatcaattggccggccgagttggacaacagtcttcatgagaataaaatcatgcgccgttaccatgtggagaagcgcgagcactacacactgtacaacaaactgtccagagaggtacgacgaataatgaaatttgaacttgtgggcatggttttcatggtaaaacgacgaaaatatttccaaacttttgaaaattacaactgcttaggctgggcctcccaggcttaaattacaaaattctgtatgttttgcaattgatgcgttgcttttagcgggatggacaattcgggttttccgcaaattcaggctgatggccagggggttgggtgtggtagaacccgggaatttcgaaatttgcggacttcggtgcgctgcatgattgaaactcaaaaaagggttgcgattttgatcgaaaaattcgacttttgcagggttttttttgggggggggggggagaaagggtcccgtgccgggattattgaagtttttggcgggtttactgggtttagaaccagagtttttccttcctcataaaaaaaacttttttttttgcagatccgagaaatggccaaacgcatccgcgagttggacgacaaaaacccgaacaagttggtgttggcacggatgctgctcggcaagctgttcgacatgggcgtgattccgaccgcggacacacttgagcgatgtgacaaa

SEQ ID NO: 47605 - DNA, 683 bp, Heterodera glycines
  Genomic contig location: Contig_ID=SeqID_3380; Location=2756..3438; Strand=+
  SCN-specific regions: Sequence locations=1-218,240-284,306-606,628-683
tcgagggtgccgattatgaacctgaactcggatttgcccaattccgaagctcggatccgaagtgcagcgaatagatgagaacgactcggatgattagatcgtattgattatgattggacaacgtgcttcggatgttagatgaacgacagggcgaatgtcgggtcttcgttatatgatgtaaaaagggatgggagtggcatggacaaaatggtcataataatgaaaaatgattatgtaaaaatctattaaaaataagaatgatgtagcgaacgcggcttttccgattggaatgcttacaaacagaagcatggcaagtcataaggaattggaaaataaacgagataaaaattaagggaaagcatacgcggaccaagaagtggagaacgaacggatgctgacttatttgaggttagctgaaaatactaaattaatttgaaattgaaatacccaatatttatagcgccaaacagttcattgacaaacacaacgaggcgtacaaagagggcaaagtgtccttccgagtgggagagactcatattgccgacctggtcagaaatcccgaactgttgttcgaatttccccctctgtttcagcccttttccgaataccaaaagctgaacggattccgtcgtttgatgggcgacagtttgcgccgcaatgcgtccacttttctggcgccaatg

SEQ ID NO: 47606 - DNA, 1390 bp, Heterodera glycines
  Genomic contig location: Contig_ID=SeqID_3385; Location=2868..4257; Strand=-
  SCN-specific regions: Sequence locations=1-93,120-173,197-398,463 -862,933-954,984-1390
  Gene Ontology: Mol. function=microtubule motor activity; Cellular component=cytoplasm; Biological process=microtubule-based movement
atggacgacaacaagcgcgagctgctcaagttggacaggaaaattgttgccgccgcttccattggcattcttggccaacaacacaaagcgcttcaacagcatcaacaacaacaacaacagctgaccagcaacggcacaatcactgccggcggtggtcgccccgtctgtgccattgaattttccaccattttccccgaattggtggcggtgtgccatgaccgggacaaggacgagccgttggcacccgacagtgtgatcaatgtgtggaacacacgcttcaaaacggcatcgcccgagtgcgtcagtgtgttggtgttgttgttatataatgatgatgattgtccttggcaagggtgggggagcatcattccccccgtcgttgctccacccccggaaagtttttttaaattttacaaaaaaaatcttggaattttaaaaaaaaaattaatttttttaatttttcaaaaagggtaataattggccgactaagttgtcgtgttaaacttcaaataaataatcctgggggtgtaccgcaacaattgaggagaagttttatcgtccagtttgcggttatgtgatttttttttaccgaataaacaaataaacaattgcacacaaattcatttgttttccaggatgacattcaccagctcatcacgcgtgatgagcatgacatgggacatgttcaacgcgaacatcatcttcggtgcatgttattcgggtcaaatttgcatttgggacacgcgggtgaacaaacggatgcctgtgtgtaaggtgagcagtgaaccgttttagttttagttatctaccaaatttttcttagctattttcgaaattttatgaagaattactacctattttcaaaaaattttcaaaaaaactttttttttttgtgtttcaaaatttatatttcaatttatttatcaaaatttgtaaccttttcttgagataatcaaacatgaatatacaaaatcttttatcatttatttaatttttccccctctcagactccgttgaccgccaaagcacacacacagccccttttgtgcatgcgtatggtcggcacagcaaatgcgcacgacttggtcaccatttcgacggacggtcgaatgtgttcatggagcattgacaacttgcagtcgcccattgaagccaccgaattgacatgtaacaggacaaaaaagccggtgattatttttttcgctttgcatatcaatgaaatgaaaattgtctctcctttccaatgtttcagatttgtgcacttagcatggcattcctacacaacagcatcaacaattacgtgctgggcactgaggagggcgagctgtacattggcgaccgacacgcggccagcggcgagtcgagtagaagcattgctggtgggtggtga

SEQ ID NO: 47607 - DNA, 2368 bp, Heterodera glycines
  Genomic contig location: Contig_ID=SeqID_3389; Location=72..2439; Strand=+
  SCN-specific regions: Sequence locations=1-96,120-198,220-454,476 -1263,1285-1414,1436-1627,1676-1938,1960-2368
  Gene Ontology: Cellular component=cytoplasm; Biological process =signal transduction
ttggggaaagcgatggcaatgagcagcggagtgttgcggtccgtctcttctcggaggacggcaaagagattggccaggcacccgtcgttgtgcgtctttttaatatttaaaatttatttccaatttttgcttctcgtcctttagcttcttgcttccaccactgctgaacagctccaagtgctttaccaccaattgttgcgcagtgaaaaacagcaaaacggcgaatgcggcgacgacggagactttgacgaagggacggcgcccgtccaatttcggaccgtcgcagacgaaaaaagtggcggaaaagggacggaaattgtcgattctttgctcgactcactgccctcagaacgcctcttcttggaaaaggttattattttcacgctttagcataaagcaactggacatttattacgctgtgacaaaaagccattacataattagggcattcgatcaaaaatacagaaaaataggtataaattaccaaaaacggaatatatttgcaaaacgtgggaattttatcaaattcgtttcatatttatatgatgaggttgacagcctagtgaagtgtaactgttttaaagtgtttcatttccaattgactttcagcccctcgagttggtctgtctgccacaggccgtgttccgagttcggcccgtcactcggtgcaccgcttcgttgcccggccatggcgaacccgtcctttccgtacagttcagtcccgacggaaggtgtgcctttttcatttttgtctcactccccccaccccctctttaagctgtttggccagtggttctggtgaccggacagtgcgtttgtgggatttgcacacgaatctgcccaaacagacgttgaccggtcacaacgattgggtgctgtgcatcggctggtcgccggacggtcgcgcgttagcatccgcgtgcaaaagcggcgtcatccgcgtgtgggacgcgcgcagcggggcgcagcgacgcgtgctgaacggccatcagaaatgggtgaatgcactcgcatggcagccgctgcatgaggcgaccagcgacgcgcagtgcaggccgtgttttcttcgaacgagcaattattaagcgttggttggctttttaggttgttggccagtgccggatgggacaaaaccattcgaatttgggacattcttttgggtggcactgtccgcgtgctcagcggtcacaccgcatcggtcggtaattgggcaaagagttactatcaattggtcaatttatttggattgattgtctcattgtcaggtgacagcagttcggtggggcggttgcggactgatttattcggggtcacaggtcggctgaacatttttaatttggctttttacaatatttgtcccctttcttgttttcaaagaagccaagttttacaagcaattgtcattttacaacacaaaaaagaatgaaatataattacttaaagccctaaattaaattcgaatttttcattttaaaattgtgagcacctttttcgttttttatttcatttttattagtatttttgaaaatactgaaaacgaattttaacctaaaaattccatctcttattggctctgtgctcttttgggcccggatttgaatttcgaaaaaattaacgaactacccattcccaaaacaggaaattctcctcttatttttgtttttaattgtttaatttcaaccttttgtgtttgaggatcggaccgtaaaagtgtggcgcgcggaggacggcactttgtgccgcactttgaccggacatggccattggatcaacactttgtcgctgagctgcgattacgtgctcagagtgggctatttctcggccgaggcgcaaagcaaaggccaaccgacgctcagtccgttctccgacggaatttccacggaaaaagtgttccatttttgcaaattcattagttatcagtgcccagtgattccattttttctctttcacagattgtaaacgatgccaaacagcgctatttgagggcactcggccaaccgtcgctggaacggctcgtgtcgggctcggacgacttcacaatgtttttgtgggagccgggcgaaaagaagcagccaattgcgcggatgaccggccaccaacagttggtcaatcaggtgggccaactcaaccaaaacacggagagacgaaatgccaaacaactgttgaatgttcgaatttgaacaggtccaatttgcgcccgacacgcggaccatcgcctccgcctcttttgacaagtcaattaaactgtgggacggacgcaccggcgcattcgtcgccactctgcgcggccacgtgggccccgtgtaccaaattggctggtcctctgacagccgactgctcgtctccggctctgccgactcgacactga

SEQ ID NO: 47608 - DNA, 1293 bp, Heterodera glycines
  Genomic contig location: Contig_ID=SeqID_19785; Location=126..1418; Strand=+
  SCN-specific regions: Sequence locations=1-24,47-126,168-398,420 -442,465-623,645-677,699-782,807-1293
atggatgcttcctttgaccaattcggtggtggaggatggggtgaccaaggcgaacaagaatttgcagcttcacaattccaaaaaaatatttatgacaaagttcctgtccccgttgcaatcgatgtccttatttccatgactggtgatgaagaaaaatatgttcttggaaatttttcttttaacacggtaatttgttgttgttttttgttgttgtaaattcatcattcttttcaggttcaattgatgggaaaagttgccaatgtgtcggaagttgaccaatgtacgacttacgagttatgcgatgccatggccacggatattcgtgtggcaaagagatttactgtcattcgttatattacggctgacttggttctttttccatttctacttatttgactaatatttactcttccataaaagcaacccgttaaagacgaggttttcacaattggccaattggtccaagtaattggaaagctgcggctgtataacaatcggctgagtgccgtctgcttcaatatccgtgaaggttttggtgtaaacatttcgcaaaaaatatacttaaaattcagttgaaattgatgagattgctattcacaaattggaatgcaaacttgccaaaatctactttgagaaggttttgtcctctcctattttaccacttccaattatttaggatttgaatatttagaatttgactgaattttcacttgggattgttgagaatgacacgattttccatggcaaagtgtccaaccaacggcctggctcgtcgattggccattcttttgctgggaatatggcaacacctaacagaaaactaagcgggacaaccactcaaatgactgcgaataggccgcaaatgtaccaacagaagcaacagttgaactttccaacgcattggacgcatcagcagcagaaagtaattggccaaattggaaaaataaattaattgcttatcgcttaagatttacgagttcattaagcacaatgcaattggcgaaggtttgtttaataaactcatgctttttgtgtccctcccttattttttttcgttaccatttgctaaaatctcagttctctttatttttttattgccgattcaaacttgagggggaaaggtcacaaatggaaactgataatatgttcttgcttcgttggtaattcgttctttctaaagcgggtgttcacaaggacgtgataagaaatgcgctgggtcttaatgcgagttgcaacacggacttggcaattctgagcaacgagggatcgatttacgcaacaattggtaattga

SEQ ID NO: 47609 - DNA, 577 bp, Heterodera glycines
  Genomic contig location: Contig_ID=SeqID_19792; Location=39..615; Strand=-
  SCN-specific regions: Sequence locations=1-577
  Gene Ontology: Mol. function=ATP binding
atggcctatttgaactacgaccaagtccaatgcccttgcatgcgtgccaacaatgtggtggggccaaggatgggcggggctaattcgtcgcttggccgtgcttacacgcccgggggaggaggtattgaaggagtggtcgagagtttgaacggtggacagtcccaaaatgcgagcatactgagccgttttcaggtgccaaccacaacaacggaggaacgtccggacaatcgaccgcacggcacgctgaccattccggcattggccagccgtgctccagccacgtgcgcgaactgcccacgctgaacacccatttgacttctcccgcagcagccgtcgctctcggcctcatttatctgcgaacgggcgattgttggatcagagaaacgctggcaattgctgacacattttacgagattgaccaaattcggtggaaccgatttctcaaacgacccaatgctaattttgctttttagtcctgacatgctaatgattcgcactttttcgcgttgccttgtcgatttcgaagacattaaatgcacgagagaatgggtcgatgcccaaattccgcagataattc

SEQ ID NO: 47610 - DNA, 4412 bp, Heterodera glycines
  Genomic contig location: Contig_ID=SeqID_3403; Location=1..4412; Strand=-
  SCN-specific regions: Sequence locations=1-399,423-438,461-1759,1781 -2776,2802-2989,3011-3333,3355-3512,3535-3536,3564-3716,3739 -4275,4298-4412
  Gene Ontology: Mol. function=protein binding; Cellular component =basolateral plasma membrane; Biological process=muscle contraction
gggtccacgggtgtgctttgctttctgaagggtgttgatttttctcgaaacgatttttccgctgatcgcttcccggacgaagttattgagatgactcaagccacttggttgaagctaaaccgtgctcagatggagcgactgcccgatgttctttctaatcttaaacacttagaacacctgcaaatggcgcgtaataaattgcaggtactgtacaagtaaagaccgaaatgattaaataaaacttgggaggattcgtctatttgtacgcaatccatcgaattccctatcttgtcctgctttttctctatttccttgttatacagaatgtgcatggcgaattgtccgaccttccgctccttcgctcaatcatcgtccgatacaaccaggtatttatcagacgaattagatttatttattttaatctttcggtttaagataaaaacatcagcaataccaacagacatttttcgaatgaaggatttgaccatcattgatttcagtaacaatttgttgagggatgtgccttctaacttggaatatgcaaaatgtgccatcgtgttgaacctgagcgggaataatattgaaaatgtaccaaaccaggtcatattcacttaattttttagttgtcaattcactgtttcagattttttccaatttaatcgacttgatatatcttgacctgagcaataatcggttggaagtggtgcccccacaactgaagcggctgaccaacttgcaagtgttgaagctgtccaataatccgctcactcacttacaacttaaacaactccccgggtgagtgtcgcttatttcctacctttaattcacgtgtacttattatccatttagttctaaaaagcttcgtgttttaattctgagaaacacacataggactttgtcaaatattccttactcatttgaggatgttttgaatttgcaggtaaattaaaacaacataaatattgctaatttgaatttgcactttgtttaaggaattggatctttcgatgaatgagctccaatcgttgcccgattcactttatgcactcaaacaattgcgcaaattggacctcagtttcaacaaaatatcgaaaattgaatttccttcctccgtttttactcagttagaaacattgaatgtgtcgggcaacaatttgacttctcttcctgccaaaattgtgaattgtcaaaaattgcagcggttatatgcgagttacaacaaactgaaatttgaaggtcggaatttataattttattacttgggatttttattttaaacaatttaggcttgcctgccagttttggacaacttctgcaattacaagttttgttcttgtcggacaatgacttggaattaattcccgaaggcattggccgttgtgtgaaacttcgtaaaatcaaattggacaacaatcgcttaataacccttcccgatgggatatatttactgcccgacttgaaggaactcgacctgcacaagtaatttgcaaattcttattccctttcaatgattattctgtttttgtaatcccgacctcgtgatgccgcctaaaccctccgacaaagaaaaaggtaaaacccgagggactttcattcattctgattgtgattcctttactagctatggctttctacaacattgacttttccctgtccaatcaggttgggtttttccactttccattgttcaatcaatgcccgatttcagcttcgtttggctggacaaagtcccggttcttcagtggactcgcttagtcctaacaaaagtcaacaaaaagactacatgcaacgcaaaaaggactttatacggcgccgaaggtgtcaagcagatcaagacagggcctctaaagtcatccaaggaatgtccaaaatggcacaagatgcacatgaaatgaatcaatccgtggagaaagaaaacgacgccaatttacgcccagttattggctggaaagagaaaatggagcagcacaaaccgcgattggactattcggacgtattcgacgctgtcgctggagcggatgctggtctttgggtttgggagattgagaacttttatcctgtgcttgtcgactcgggttttcatggtcaattctatgaagctgactgttatttggtccttaaaacaactcgggagacaaacggagcactgacacatgccatttattattggattggtgaaaagaccagcctggacaaggccatgtgcgcggcggtacacgcagtcaatttgcgaaatcatttgggagcatcttgtcggacaattcgtgaagaaatgaatgaggaaacggacgagtttctggagatgttcagtgaggaaatcgtttactatgacggggcccgcactcaatcgggcttttatgctgtggaaaaagtcgctttctcaaacaaactctatcgagcatttgtcaacggaccgtccgtcgaaatggaggcggttccgttgaatgccgagtcgttggacccacgcttcgtctttttgcttgattgtgacaaagttatttggatttggagtggagctcggtcgagggtattcataacaacacttttcatttcaatttaattttttaggtaacgattgccaataaagtgcgacttttcgcggtgaaaatgaacaaaagggataagaagggaaaagccgagattgagtcttgtaaccagctaaaaacgccggaagaattttggcttgcgctcactggtaaaaaatgaatgaaaatgaaaataaagtaaaattaggatcatctaaaaggccggatgagcccatctttgaacacattttggaagatcgtaaaccagaaaggaaacgtctctacgaagtccaacttggcatgggatttttggagttgcctcaggtggagctgagaaatggcgtgttgcataaagaactgctgaagccgaaaggagtgtttctgttggattgcacttcagaattattcttgtgggtcggcaaaaatgctaatcgtcttacgaaaatggcgggacaggttttgaattgtgaacacagctttggaagtgaattgttttttttttgctagaaaatcgcatctgaaatccatcgaatgatcgaacggcctgacttctgtgtgatttgccgagaaaacgaagatgaagaatcaacgatatttcgttccaaattcgcggcgtgggatgacattgtgccattcgatttcacaatgacagcggacactgtgcaaagacgcggagcggacataaaagtgagatttttctggcatattaccaataactcctatcaatatttcaggttattatggagagagacaaattgaagacggatttggtcgctttgttcctcgaccgtctgcctgcaatgccacacagcgacacggagaaaatcattgaggatttcaacatggatttggaagtgatcgaatcatttgtgctggtgagatttcacttactataaaacatcaaataaatgccgcgtttaaggaagggaaaaaatttgtccgccttcctcagaatgaatttggcatttttcattcaatggactgttatgtgtttttgtgtcgttattttatcgatgacgacgatgaagaggaggagggagccgaagatgaaaaagaggcaaacgatgtgtcggatgagaatgacgagggtggtccaattaaagaggtgtgaatattcactttgttatcatttttactgccacctttagccaaagaattctgcctcgggaaaaccaagcgacttcaaatgcgtcgtttacttctggcagggccgagatgccagcaacatgggatggttacacttcacattttcactccaagttggactgtcatgccaacggaatgataattccgtttcagaaaaagtttgaaagcttgttcaaagacaagctggaggtggtgcgaatgaatcagcagcaagagaatcacaaattcctgtcacatttcaaatgcaaattggtcatccgttatggcaaaagaaatccgtcgcacaatttgagccaagcggtgccagagttattccatatgcgagccaatggcacttcaatttgcacacggaccatccaagtggactgtaatgcgacaagactgaattccgccttctgttttattcttcgagttcctccttctgaccttcaaacggatgaagagggcattggaaacgtttttgtgtggattggttccaagagtgacccttacttccacaaattggcggaagaggtggtttttgattatatttatgtttatgccctccttttatcaggttgcgagtgaattgattggtcgagattctgactttgctgttcaaagaattgaggaaggaaatgaaccattgctattttggaaggcattggggggcaaaaagaagtacgaccgggacgcggacttcatggaatacacgcggttgttccgttgcaccaacgacaaaggctatttcagtgtgtctga

SEQ ID NO: 47611 - DNA, 1396 bp, Heterodera glycines
  Genomic contig location: Contig_ID=SeqID_3403; Location=4546..5941; Strand=-
  SCN-specific regions: Sequence locations=1-230,269-454,482-496,520 -571,593-616,644-847,870-879,903-948,988-1031,1055-1088,1119-1396
  Gene Ontology: Mol. function=protein phosphatase type 1 intrinsic catalyst activity; Cellular component=cytoplasm; Biological process =cell cycle
atgacagatgctgataaaataaacctggacaatataatttcaaggcttcttgaaggttgtttttcaaatttagtaacgaagtactttttaaatttagtgcgtggttctaaaccgggaaagaatgtccagcttacggaaaatgagataaagggtctttgtatgaagtccagagagatctttctgagtcaacctgtacttcttgaactggaggctcctctgaaaatctgcggtaaaaaaacaaaaaattttttaattacaaattatttaaggtgatgtgcatgggcagtattatgatttgttgcggttgtttgagtatggagggtttccgcctgagtcgaattacttgtttttgggtgattatgtggatagaggtataatttattttgtaaatggatgcaattttacaaattaaggaaaacaatcacttgaaacaatttgtttgcttcttgcatacaagattaagtaccccgagaacttctttttgttgcgtgggaatcacgagtgtgcttccatcaaccgaatttacgggttttatgacgaatgtttgatctttcttcactattaatttcagtttatgattgtttataagcatctgtatttcaggcaagcggcgctacaacataaaactgtggaagacttttaccgactgctttaattgtttgcctgttgccgcaattattgatgagaagattttttgctgtcatggtggtctttctcccgacctccaatccatggaacaaattcgtcggctcatgcgaccaactgacgttccggatcaggggcttctttgcgatctgctttggtctgacccagacaaggtatttacttgatcaacaattttagacataatcaacatataattttttaaaggatgtgaccggttggggtgaaaatgatcgtggtgtgtcttttacttttggacctgaagtcgtctctaaattcttgcacaaacatgacctagatttgatttgtcgtgctcatcaagttagtcaataataatcatttgaaatttattggtttaaaaggtggtcgaagatggctatgaattctttgcaaagcgtcaattggttacactgttttccgctccaaattactgtggagagtttgacaatgccgggtcaatgatgaccgttgatgagacattgatgtgttcttttcaggtaaatgaattccttgtgaatgtgattgtatttcggttttagattctgaagccgtccgacaagaaaggcaaattttcatacactggggctggacagaatcgtccggttacgcctcctcgtgcaactcctgctgaacaaaacaaaaaggcgaagaaatagtgttttgtcgttttagatttgaattggacagccctttattgatcttttttatatcagtttcttttatctcaattaaa

SEQ ID NO: 47612 - DNA, 1160 bp, Heterodera glycines
  Genomic contig location: Contig_ID=SeqID_19852; Location=1..1160; Strand=-
  SCN-specific regions: Sequence locations=1-141,165-254,296-363,385 -678,701-973,995-1160
  Gene Ontology: Mol. function=protein serine/threonine kinase activity; Cellular component=microtubule cytoskeleton; Biological process=protein amino acid phosphorylation
aagttccgtcaattgtttctgccgtccaataccttcactcgaagaatgttattcatagagatttgaaggtttctaaactaattcttattggaacaaattttgtggttaaggcagagaatttgttgctcgatgccgacatgaacatcaaaattgccgactttgggttcagcaacacattttcaccgggcaacaaactcgacacattctgtggcagtccgccctatgcagcacccgaattgtttcaaggcaaaaaatatgacggtcctgaagtggatgtttggagtcttggtgttatcctttacacacttgtttccggcagtcttccgtttgatggccaaaaccttaaggtacacttaaacacacaattaaattcaaattgaactttttgttaggaacttcgtgagcgggttctcagagggaagtacagagtccctttttacatgtcaacaggtccgaaactgtgcaattcattgaagaatattatatctaattttagactgcgagaatctcctgaagaagtttctcgttttaaacccgataaggagaggaactttggagatgataatgcgggataaatggatgaatatgggctatgaggaggacgaattaaagccttacaccgaaccgacaaaagacgttcgggatgaaaggcgcattttgaagttgcaagcatttggctacactctccagcaaatacacgagtcgttggaaagagaaaggttcgacgaaattttcggcacgtatttgctgatgaaagaggcaaaaaagcacgacgcgcaaggccaatcgttgggagggagtggaccaaatgcgacggccgaatcgccgtttaatcaatcgatggggccgaccgtgccacaatcgcatggggtggccagtggtcttggctttccatgtgataaatcaaatttattaagccaacggtgtcaaatacgaagaacagcagacgctcttcttcaaatgccgaacaaatccaaccacagcaacatgccataacatctcacagcgtaataaaccaacagtcggctgctcccatccaacaaatttcggcaactccacaagcgattccttctcgtcaaagacaaactgctccgggacaagtgacgttcagaacggcacaaaaaccagtcgccaaccgactctcagcgttcaaccacaag

SEQ ID NO: 47613 - DNA, 1344 bp, Heterodera glycines
  Genomic contig location: Contig_ID=SeqID_3420; Location=8..1351; Strand=-
  SCN-specific regions: Sequence locations=1-1344
atggcatttcacaaaattgactcgagcagcattgattcaattaccaatgctgttgactttttcagtataccccctacaaatgttaccgtatcatcgtcaaaggttttcgagattttgccgagtaacccactcaccgacacaccttaccattttaaaatacactcgagccaaaactacattgacctgtcaaagtgttaccttttgaccgaatttcgaatgcgaaaattgacaccaccaaatggtgaatggggacatttggatgctactgatcaggttgtaccgatacaactgatcggacacacgttcatacgagacatgaaaattgcaataaacggtcgtgaaattttcaattcaaattcactgatggcatacaaaacttatctttctcatgaactttctcaatcacttgaagctaaagtttcgcatttaactgctgccggatacgaccgtgaggatgctagcaatctacaaaacgcaaattccgaagggttcaaaagtagaagacaacggtatttgggaggtcgaacagcacaatacattgcaaaaatcgatgccgatcttttcaatgtaccccaatatttgattaatcattgtgaaattgacataacgatacaaccccatgacgacaattttttgttaattgacaccttagacccacccggtcagccatatagtattgagcttgttggattgaaactctactgcaaaaaagtcagtcttatggatggcttggctcttgagttggcgaaaaaattggaaatgaaaccagcacggtatgctgtacggaagacaatgatgaaagcactgttcataagcccgggacgctatgaatttaatgcaaatttattcatggaccaagttccacgccgtgtaacaatgggacttgtcgcaaattcagattatgtgggaaacatcaaaaggagcccattcaactttcagcactttaatgtacgggagttgagtgttgtggccaatggtcgctcttatccccaggccccgtatgacattgactatgaaaattggaaatttgttcgtccctacaatgacacgcaggaggcgcttggttttgctaactctacatatggaaatggaattgattacttttcatttttgcacactcactgtatttatgtgtttaatatgacaaacagtggagacgatcatggcggcttatttgatctaatcaaaaagggatgtacggcagtaaacattaaattcaaaaaaccagtgcccgatggtggaattacactgatagttatgggagaagcagactcaatctactttttggataaaacagaacgatcgcgaccgacacaaccatttaaatcatttttaaaatgttga

SEQ ID NO: 47614 - DNA, 733 bp, Heterodera glycines
  Genomic contig location: Contig_ID=SeqID_19881; Location=3..735; Strand=-
  SCN-specific regions: Sequence locations=1-269,292-609,631-733
atggagacggcgctgtgggagttggaggaggcgcaattggcggagaaacacgcgctgctcacccaacagtttcgggtgagttgagtcaagcagataccaagagttgttcaacaaggagacaacgagacaagcatcgggaacagtcccctcttacatgaaaaaagaggcgatgggtcaaattatgcgaatggtgtcaatttgtttttttatcaggtaactcactcggcttcttttcaaaagatcctttttccttttggagcaggcgccgctgggaaaaatttgaaattttttactatttttagcagattcaccaaaaattaatcaaattttgcgattttgagccaattttttttaatagaaataagaattttaaggccggcgctgccaacaggcgccggccgctaggaaaatttttcagtttttaaaaacaaaaaatttataataacaataagtacagcagattataaatacaagaaatgcggttacatgaatttatgtttttttggattttatcaaaaaatttctccaacttttcatttttaaaaatcatttctccccgcaggacgtgttccacttacagcggacgcacatgttggcccggcatgccaaggaacaggagcacgtgcgccgcatcaaccagtccaaggaggaacagctgttgcgcgcgctcaccgccgaccgcaaggcgttgccccaaagtgttgcgcaacgaggcgaagaacgcggacgatga

SEQ ID NO: 47615 - DNA, 3688 bp, Heterodera glycines
  Genomic contig location: Contig_ID=SeqID_3427; Location=1..3688; Strand=-
  SCN-specific regions: Sequence locations=1-122,146-418,450-722,744 -826,849-1259,1282-1601,1624-1715,1737-1787,1809-1863,1891-2247,2269 -2320,2343-2749,2771-2789,2811-3133,3155-3421,3454-3660,3684-3688
  Gene Ontology: Cellular component=mRNA cleavage and polyadenylation specificity factor complex; Biological process=histogenesis and organogenesis
atgttctctgtccactacaaattcaaggcgacgctcgagtacaaaacgctgacatttgacgggctgcacatcggcgttgacgagctgaagaaggccatctgcgacaaggagaacatccggacggagtcgttcgacctgctgctgaccaacgcgcacaccaaacgcgaatatgcagtgggcgaattggtgccgcgcaattcgtcggtggttgtgcagcgaattccgcgcgaaaatgcgcaaaaattgcccaaagtgcagtaagtgttgggctgacaatgaatgggcgagaaaatacggcatggccttttttggcacaaaatggccaatcgatgggcccattttggatttgagaattgtgggattacctctcaaaagttaattgtttgaagcgtgagggaaccgaatttactctgtcgatttttctcgtattttgtttttgcatttctgagaaaaaaactcgagattttaaatgagtacaatcatttttcttttctttgcttttaacatgggaatcccattttgaaaaagttgctcattttctccaatttagtgataccagcacaagcggaattgtcgtaagaaacttgtcgacgtaccaacagaacagcgccaacagctacattaacccggtttgctttgtctttattgtaacgagtcgggaaatttttgttagtactttgcccgggttttgagtgctcttgccgagttttgatttgtggctgtatttactattgtattgtatttaaaatctggtccaaaattcgtttgttcggcggagttcttgcggagagatttttaaaaaaatcttgtttataaaaccaaaatcttaaaattaaatatttaaaaaactggttgtgtagcagctttaaacaaaagtttaggactgaatattcttttttcgaaatttcttttcaaattcaattcattttcgtatttttaggaggaatttgccggaatgagcgaagaacagcgcctggcacacatcaaacgagtgtcaacggagaagtacagctcgacaaagtgagctaacaataagcaaggcattgacaatgagcacttttaagcagttggagtgggacgcgtttttaagaaaacaatggaaaccttttggttacgcaacattggcgcgaatgactaaaagcgatttcatatcaatgctttttttcatttttgataatttcaattaaagaaaccggtacttgtctagtttacaggagcaattccacataccttttcagattccaataaatgtgttttagaaattaattaaaataagttttaaggggtttttgaggtcgctgatcacgaatacagcacccatttttgcctatttcgaacccctgacgcgaactcgaacaaaaataaaattagaatcttgtatggataatatcctcattgacatcttgcccatgtgggtacccttggtacaggaagaataaaattcgaaaattgtacgcatgatatcctcatgggccccttggccatgagggtattaaaatggtacaggaagcctgtcaatttattgtccctgtacagctcatgtaatgaacggtagcgctgaactgagcccggattcgtgatcagcgacctcaaaaaccctttaaaacttattttaattaatttctaaaacacatttattggaatctgaaaaggtatgtggaattgctcctgtaaactagacaagtaccaagaaaccaacttcttttgacaataattgggttcaaaaattttctaagaatgaggtatcgcatttagtcaaattccatctcttatttaatgctctttatgatatttaaaattgacaaaacaactaaatttgaaaccgatttttggcataggcgcaaatctctgctgcacacgaactgtttggttttttcaatttttcttcaaacaaaaaaagttgttaagtagatgtatcgtcccatcccaactgaaaaagtgtgccatttttgtaaaaaaaaaaacaacctttattggcaaattggcatcgaaatgccacccactaaatcgggaattttttttcaaaatttctttttttcggagccatctttcggaaccttcaaccactgggcttttttcaagcaaaaaagcttatgaatatgaccaacaatgtgtccgcttctttcagttatcagcgacgcagcggcggtataatgacgggccctccgccggccacgtacgtgtgcaaccgttgcggccagcccgggcattggtacaaaagctgtccactggtaaatgcttcttcttctccttcccattgctccgcccattggttgggcaggcaaaaacactgtgctgtctgtcggtgatggatcagcgaatttcaaaattaatctcaaaatggccactcttcctttgtcggcgttgtaattgtcagtctccccctccccgtcatgctttacccttcacttccattaactaattggctaattaagtgtgtcaataattgcccaccctactcagccttttattgtccgtcaatcctcaatacctctccatcaaattatgcattttgttagcgcaaaatactaaaaaaaatttggtattcgaaatgcataatttggtggacgttttcgcattccatgcatataaatgttcgacttttcactcttttcttaaaatattccatctgttttaccatataatgccataataatggaaaagttgtcgcacgaaggcaaaacaaatttttcatgccctagtccaaaatggcacctctagaaaatgacggcacacttttccattcattttattcaaaaatgtattttgtccgatctcatttgtatagaaatcttttaaattaatgcaataaaatttccatttcagccaaaatgaccaaagttttaaattttaaataagctgaaacccggcctaagtcatgcccgaaaatttcacttttcagctaaacttacggcgcacagcgggcatcacaatggaagagctgatggagacggaccgggacgacccgctggcgatgctccacccgtccggcaaatttgtcaagccgatcatgcaccaccaggcacgaatgcagcgaaaacacgtaagccaccagcagagggggggggggggggattcggggattgacatgtcgggcgagaaattaaggaatggaaattaacataatttaaatggaaaatttttataaaaatttgcgaccaggcttaaacctgaaaaaagaagcttgactgagaaattctctgctcttcggccattattcgaataggcgaagaaatcgctttttagcagttttcgccaataacgtgaccaaattcctctaacaattaattttaggaattccagcggtgccgataggatccatcgggcaaattttttactaaacttgttaagaaaactaatgtacattttcaaaaaatttccctattttttgacctctatacgacttgataaacacgatttcaatttgtgcatttctatttttctttattttcaggagccattccctggtcagccggatgaaagccgttctcctggtcagcaacagtccgccatatctgcagttccggagcagttcaggtgattgacgcaacccaatctcattgacaaatcagaaacgaaaattggcttctgctcgttcaccattcttttcttccctctaaaaatgtgtcaaaacatggtacattttgctgccttacccgaaaaaatatgaaaaataaatttaatttct

SEQ ID NO: 47616 - DNA, 2084 bp, Heterodera glycines
  misc_feature (485)..(485): n is a, c, g, or t
  Genomic contig location: Contig_ID=SeqID_19912; Location=71..2154; Strand=+
  SCN-specific regions: Sequence locations=1-732,758-1303,1326 -1499,1521-1535,1557-1690,1722-1967,1989-2084
  Gene Ontology: Biological process=gametogenesis
gcaatggagaaccattggagcctccgcaggcatttgccaccgcgtcgaccagcgaagattcatttgaggaggaccaggagtttttggagctgcaagagagggaacaaattgtggacaaatacgaaagggtcagaaaaatgaaatgaaaagtgtgagaaagagaaaataatatagtacataggttggaggaaataacaaaacgagttccgtcggtgacgtcccagggttttgtggtgtcattcattacccattttttattttatgtagaaaagggcatattgagttgtgggtttttgaatatgcatttaccatcaaaaaagtcccatttttaaattaaaatttcattcagcataaagtgatgaaggtttccgataacttcttttttttgtgctcgtcggtgataaaaaaaaagtgcagtgcaatgcttcttttttgacaaatgaatccggccatttcggaggggggggggggtgggtgattccgangatctttttttctgctcttcggattgccagtcttaatttttaaaatcttcagcgcgggaactggaaataatattgtacactatgcttttctgcattttcagggaccagatcaaaatgacgtggacccgtgggagaacccggactttgagctgtacaaaatcacggaccgatatggctttatgcagttaattgactgtctataatataagccaatttcccaataattctcacaatcagtaaaaaaacaccagagcaaacagaagagcagaagagggtacaaaaagagttgaagcgagagcagaaatggttaaggatgctcaaggaatgggagcagcggtaagtgcaaattgatggacaattctgctagatgcaaacatttttgaaaataagtaactgattatacaggcatccaactaaacttgctgagcgaatgtggaagggtgtgccggataggcttcgattggtggtgagccattgatacttacaattaggaattcgttttaaattgattatacaaactcaatactagtacatttacctaaacaaaacttaatatcgtgtctcttttataggattcaaaaacgaattttagattttattatttgttatataatctttcagatatggaagcgtttgactggtgctgacacaatgaaggccaattcgagagaaaaactttacaaggaattgttagcacgggctcgacttgtctccagggacatcaaacaaatcgatttggacattaaccgtacataccgggacaacttggcattccggaggcgctatgatgtgaagttggtgatttatttaaaagatttattgtgtgtatgttttcagattgttttaatacctacctattcttacatttaatttaatagttaaccttcttcttatctttgttgcaacttcatgggcttttccaattttcttttcattttctttctttcaattcgtcttttttccaaatacttacaacatgaaaccgcaaaaaaatttctgattttttgcagttccgttcttattttaataaattctgttaagagctttcggttaatattttggtcacaaaaaagttattacgctctaaacttgggtgggacggaactgtcggagggaacttattgttagtcttgagggtggttgattcgctccaaatattttcccgctaaaaatttaccaattttaagatgctccaatatggaatatttttagcttaatcaattcatttttagacaacagtcccttttcaatgtgctgactgcctacgcgatgcttaacacggaagtgggttattgtcaaggtaaaatgggtttttaaacgatttaatatcataagacaattactgtgatttcaggaatgagtcagattgccgcactttttctgatgtacatggatgaggaggaggcattttggtctttacacggactattggttaatcgaaaatacggaatgcatggtacatttacttctttctttcttttcaaattttattaaaatattttaggatttttcgtgcccggcttcccaaaactccatcgttttcagaatcattacgataaagtgcttctcaaatatttgccacgagtgaagagccatttg

SEQ ID NO: 47617 - DNA, 930 bp, Heterodera glycines
  Genomic contig location: Contig_ID=SeqID_366; Location=288..1217; Strand=-
  SCN-specific regions: Sequence locations=1-161,183-365,387-634,656-930
  Gene Ontology: Mol. function=ketoreductase activity; Cellular component=endoplasmic reticulum; Biological process=fatty acid elongation
agcatcaattaataatcaaacgaatgtaaacattgtttcagtgaacaatgtcgggatgagctacgagtaccccgagcgattggaccgtattgagggcggactgcaacgcgtctccgacattaccgtacgttttaaatcagttgaactgctggtggtcttaagtgttttgattttgtacctttcaaggtgatcaacaccctgcccactacggtactctccgcttttgtgctcaaacagatgagggaacggggacgcggcgtcgtcgtcaatttggcctcctcggcagcgtatttcaattggttttacctggccgcttattccgcgtcgaaggtggaggggaaaaggggggtgccgcgttggaattttgaaaacattttgcttttattgggctgtattgtatattttttggtctaattaatgatttgggacctcataaaacaattcggtaatactttatagatgactcaccccgattttaaattgaatattaaaaattcatgagaaataattttaaaatggagccaccaactaaagagtgtcatcgaacgtttcaaattatttagaatttctcaaaaaatgtttttcaaatgattagaacttttaattttctaagatacgccgatcactaaaaaccctaaaaatacacaagaaaattttattcgattccttttcattttggaaataatttaaagaattcaatcttatcaaaaaaatcatttgaatctctgtctcagaaatacgtgtgttggttgtcctccattctgcgcatggaatacgccgacaccgacattgtcatccaaacggtgtgcccgatgatggtggccaccaaaatggccaagattcgcaaggcttccttcttcacgcccagccccgaggaatttgccgcccaagcgctccgcagcattggtttggttgacgagaccaccggct

SEQ ID NO: 47618 - DNA, 544 bp, Heterodera glycines
  Genomic contig location: Contig_ID=SeqID_367; Location=16..559; Strand=-
  SCN-specific regions: Sequence locations=1-171,193-239,287-544
  Gene Ontology: Cellular component=integral to membrane; Biological process=fatty acid biosynthesis
atgtcttttcttgtcacattagccggctatttgacaattgccatttttctccagaaactcttccgctctctgtacaatgtggttttcccctatttgttcgctgttcctcagaatatcaaggtgggtagaggacctcgtcggatttagaccgaccaagtcttatttcccaaaaaatatcaatttatatttttcccaaattatgggtgaagagaactgtcagaataaaagaatacactcacaaaaaaaagattaattttcatatttaaatttttacttttttaaatttcattcaaaaatatagaaaaatggagcaaaataattcattttttgaaatttaagcattgcaaaatctttggtggggaatgcggcgttccaattccctaacatttccgttcaaatcggttgtttccaggtgctcgcgggtgccgagtgggcagtggtcaccggcagcactgacggcattggcaaggcatacgcgctcgagttggccaagaaaaacttcaacgtggtgctcatctcacgctccatggacaaactgaacgca

SEQ ID NO: 47619 - DNA, 2066 bp, Heterodera glycines
  Genomic contig location: Contig_ID=SeqID_3444; Location=85..2150; Strand=+
  SCN-specific regions: Sequence locations=1-6,28-275,302-433,456 -912,946-1123,1184-1185,1213-1492,1514-1702,1730-1747,1779-2066
atggacgccaatttgctgcaaaatgtgacgacggacaacaacaacgaacgccaaattggacaacagcaaattcttctcggccaaacattcgattgggcacaattcaaagtgagtggaaaatggggggaaataaatgaaaaaaaaaatagaaaattccctccccgttttgtcagaatcgtctcgcgttggatcgctgcgtgtgcatgggccacagttttggcgccgcctcatcgctgtccgcatgtgccgaatatccgtcgctgttcaacgcctgtgtgctgctcgacgcctggctgtacccggtggaacgacgaatgtatccggcgactgtgcaggtgtgtgaaatgcgattttttggaaaaaaaattttgaggaacggcggaagggtgccgataggcgccactggaaatttttaaatttgttcaaattcaaaatttgtcttctttccccccttcatcggcacatacacccaatgggattcgaacccacgccaataaaacccattttgtgcaaaaaataaatttggcccgtttccagaaaatttcggaagtttttttttctcatcgcctttccccgcttttttagcctgtgctgatgctcaacgccagcaaatggcaatggccacgcaatgtgcgacgaatgcagcgactgttagcgaaagcgaccacttccaccaatgacgacaaaacagcaacggagacgacaacaacgacggcaccgcagcaacagtcgcaggacggcgccgcaacgacagcagcaactgcacagccgagtgtcaccaacacggacagccgaatgatgttcacgataaagtgagtggtgggagaagcggtgggaaaagcaaaaaatatacatattttcttgttttcacccactctttttggcattccccgaattgctcgctcatatttatttgaacatttgtttccttttcagggacattgtgcaccaatcgttcagcgactttggcttcctggtgcctggccgtgtcgcccgttacatcggcgttcagggcgacttggacccgctgttgaccggcacagccgtgctcgagatggttctgcagttcttggagtcgcaatttctgcaccagcaacaacagaaggaggacgaggaggacacggaagatgaagaaggagaagaagacgagttggaagaaaaggaagaggaaggagagaaggagtcaaaagagagaggaggaggagggcaaagggatgtgcggactgagcaaggggagcaggacgaagtggcgagaaggtgaaaaacagggcattaccttaaatttggagttcattttgtttcctccccatcccccgaaaaaaatcaacaaattttcaaactgagaattttcaacaaaaactttttccagacataaaagtaaaaaaatcactgaaaatgtttcgttttttgaaatttcataagaaaaaaatttcgggcgggaaacgagctctgctctccctatttgtaagtgtgagagggtgaatttgaatccaaaaaataataatttttgatacaatttgaccaataatatgggaaatccatgcattttgtcaaatttgccccaaatttacagcaatgcctccgcgttggaccgtttgcgtcgtttggtggcggagaaatacgcggcttttgtggtggaagggacggacattccgcaggtgaattggggtcctgggcatattggatggccatttggggcgcctttaacaattttggaaaaattgttttcacactaacacatgttttcaaaaaataaaaaatatttttttcttaattttcccaccttttactaatgtttttttattttcgcccaaaattttaagaaattgcaatttttccccgtctaaacactgtgctctaattcaggtcaaattggacgaggtggccccccttgtggaagcggaacaacagcaggcggtgtccgcggaggaggagcgcaacgtggccaatgacagcggcgtggacacaccgccgacgactgagacaacgacggaggaggcggccgagaataataatcagcccagcagttaaagaatgaagtgccaaaagtgtgatattgaattcaa

SEQ ID NO: 47620 - DNA, 1134 bp, Heterodera glycines
  Genomic contig location: Contig_ID=SeqID_19943; Location=3..1136; Strand=-
  SCN-specific regions: Sequence locations=1-621,643-941,978-1134
  Gene Ontology: Cellular component=nucleoplasm; Biological process =establishment and/or maintenance of chromatin architecture
atgccaacacagacgaagaagggattttctctcgcaaaagcgcaggttttttgcattaaattgacatttttaaacatgaatttgtctaatttttcgatttatacattttatgaaaaacggattggtacaaattggcgccagctcgctttttggagtataatccgaatgaattgaagagatttgatatatcaataattcgatagccctttctctattttcctgcaaaatgtcaaaaaaaattgttaaatttcgggtaagatactccaaaaatctggctagcgcccattttcccacaacggcgaaaattaaataatttcaatctaattcattcattttaaacaaattagggactttttaaattttctgattaattaaattgattgaaaattgtatttgttattcgtttttttagctgggtaaacgtcctgtcagaaaatggctttggtgtccatttgaaaacgaggcgagaaaggatggacttgcgcttaagcattgggaacgtgaggacaaacattcaacgccctactcctttgtgcagttcaataaggtgtttatattgttatcaattagaacatgggtcggaccaaattccggagaaaatttttttggatgcactatgtctcaaattaatttgaatttttagacgaatctggatttttagtttttttgaaaattataaacaaaaatatgaaaaatctcatatttgtaattataaataaaatctgaggttttgtttcaaaaaaaatccgatttttaacccaaaaaaatggagaataatactttccaaaatgatttcacttccccattttcagcaacttgatgtgccttcttttacggatgaggaatatgaagaacatttggtggacccgcgttggactcgtgaacagacacagcacttgttggagctttgcaagcagtttgatttgaggtttttaccacttctttaaaaaattttgccaaattttcactgtttaatcatagccaaatttaagatggccaatcattgaggaccgatttgatcaagaattgtgccggaatcgaaaaagcatggaggacatgaaggagcgctattacgggttgggtcacacgctcaacgatgtccgaaatgtacaggcggaccccattgggctatga

SEQ ID NO: 47621 - DNA, 1018 bp, Heterodera glycines
  Genomic contig location: Contig_ID=SeqID_19950; Location=206..1223; Strand=+
  SCN-specific regions: Sequence locations=131-188,230-400,422-499,543 -607,660-839,861-965,987-1018
  Gene Ontology: Mol. function=ATP binding; Cellular component=Golgi membrane; Biological process=protein amino acid phosphorylation
ctcacttctcgtgccgccattctgtgccgacctttctacaagtcgacactgtacgaccggctcagcacgcggccctatttgacgggcattgagaagcgatggatcgcatttcaactgctcaaggcattgggtagcaaaactttgcttatgagttctttttacctttttcaaaaaattttttttttgaagctcaattacgcattgcaatggtacgccatggagacataaagtcggtaacaaagactttttttgggtatttttagattttaaattattttacgacataaattgggttgatcgatgtaattaataaatattgattgcctcatatcggatcatttaattttccccctttccgtttttttttaatttcaaaatttgaaattgaaaaacctaaactaagagcaagatgaaaaaacaataatatttttatttattgcgattttcagcgtttttaatgagaaataaggattttaggcaccgtcggagaagtttttagaatttttaatgatatcattaataaatttgtttaaattttaaatcttcccttttcccttcccgattttttaatttcaaaattgcaattaaaaaagccgacgttttttggttttatttgatttttaataaaaaaatttgttttttgaattttaactttttttgccgataaattagctttccgcatcgttttccccagtcaactatttttgtaccatttatcctcccccctctcatttaagacctcaaaatgtgctcgtgtcctcttccctgtggattcagctcaccgattttgcgcccttcaagcccgccctgctcccatttgttgggcaaaaaaatatatatgtttttgttttaattgaacaaaataaatttcaggacaatccgtcggactttacctttttcttcgacaccaaccgacgacggcactgttatttggcgccggaacgcttccgcgacagtgaggagttggaggcgcgggcggcggtggcggccggcatggaattccccaatttctatgaag

SEQ ID NO: 47622 - DNA, 1361 bp, Heterodera glycines
  Genomic contig location: Contig_ID=SeqID_19965; Location=34..1394; Strand=-
  SCN-specific regions: Sequence locations=1-532,568-674,696-786,809 -1316,1340-1361
  Gene Ontology: Cellular component=cytoplasm; Biological process =signal transduction
atgggcgaacaaatgaaattggagggttcactccgtggccacaacggatgggtcacgcaaattgccaccaacccattgtataagaatatgttggtgtcggcctcaagaggttaattttttccacaagcaaatttaatggtttctctgtttcctttgaagacaaaaccatcatcgtttggatgcttgatgagagtgggtcggtgctaaacggcaaaccgatcaaatcattgcacggacatggacactttgtctccgatgttgtcatgtcctcggatggacagtacgcactgtccggctcctgggacaaaacattacgactgtgggacttgaacacgtccgttttgatgatataatgaaaagtggcgataccaaaaattggattaacggaatttcgtctggggtatatcctactatttcgtaggacaaaaatgataactgaagacgagattaatcgttagaaagcactcataaattcagaggacaaacgactcgtcagttcgtctcccacacccaggatgtgctgtccgttgctttctccgccgacaaccgtcagattgtgtctggctcgcgcgacaagaagatcaaactgtggaatacacttgcccagtgcaaacacacaatcgtggtaagaattcaaggattctttatggcccagattaggggtaagggcttttgtgacaaaataaattgctttaggaggagtgccattccgattgggtgtccaccgtgcgcttttcgccttctcatgcgaacccagtgattgtgtccgccggctgggacaaaattgtcaaggtgtggaacttggccacttgccgactgaagaccaaccacttcggacacaccggctacatcaactcggtcaccgtatcacccgacggctcactttgtgcttccggaggaaaggttggataagcaaattgttgattttctgagcacctatacaatcagcaaagtatcaggacaaacattcgaccaaactttcttcatacttataaggatcctgcttctacttgctaaaactaaacagcacttgcattcttttcgcctttcaggacggctcggcaatgttgtgggacttaaacgacggcaaacacttgtacacattgggcggcaatgacgtgatcaacgctttggcgttttcgcctaatcgctattggctgtgcgccgcggttggcccggtggtgaaaatttgggacttggagaacaagacggtggtggacgagctgaagttggacattgccagcaccagcgccgcaaatccgatgcgtgtatccaaaaaatcgtgtccccaatgcatttcattggcatggtccacggacggacagacgctgtttgccggttacaccgacaacatgatccga

SEQ ID NO: 47623 - DNA, 1169 bp, Heterodera glycines
  Genomic contig location: Contig_ID=SeqID_19982; Location=1030..2198; Strand=-
  SCN-specific regions: Sequence locations=1-307,329-436,458-1169
  Gene Ontology: Cellular component=nucleolus; Biological process=rRNA processing
atgacatcacagacactttctttggcaaaacgtcctcacattatcgttggtaagtattttacttgataattctgtcggtggtgaaagcagttcccctcccccccctccctaaaaaaatttccggcgtggggggcgtagtacacccgtcagtggtggtcctcatcatttttttggtgtaggagtaacccatcgactgcattatctttttcttttaattttaattaatcgtctattttaagcaactcccggccgtctcgtcgatcatttggaaaataccaaagggttcgatctgcgcactgtcaaatttcttgtattggatgaagctgatcgaatcttaaacatggattttgaagtggaacttgacaaaattttgaaagtattgccaaaggctcgtaaaacttatcttttctcggcgacaatgacccaaaaggtgttggattttgtttgactgctattataagtcataaatcaaaatggaaaattgaatctattgaaacaaaggggtgaatttttagaatctaatttcggcaagatgtttttcctcttactcacttgtgtacctctataaaaattgtttttggcatttataggtgtccaaattagaaagagcgcatctcaaaaaaccagagagaattgaactttcgacgaagtaccaaacggtgagcactctcatccaaaatatgctgttcatcccgttcaagtacaggttgggatttcaattaatactctaatggcaatgagattcaaattatgtgcttactttttccactttaggaggcttatttggtttatttactcaacgaaaaggcgggcaatactgccattgtgttcgtcagtacgtgcgcaagtgcggtcaaattgtcgttgctgctgcgacatttgggctttggtgcgatttcccttcacggacagatgtcacagccgaagcgtttgggggctttgcataagtttaagaaaaaggacagaccaatcctcgtttgtacggacgtggcatcacgaggtgttttacttacaattagaagtgggcaattagtggaaaatttgcttgcagggcttgacataccaaatgttgacatggtcatcaattacgacgttcctcaaagctcgaaagactacgttcacagagtcggacgaactgcgagagcgggaaaggtaccgcaagaaataaa

SEQ ID NO: 47624 - DNA, 4767 bp, Heterodera glycines
  Genomic contig location: Contig_ID=SeqID_3466; Location=942..5708; Strand=+
  SCN-specific regions: Sequence locations=1-12,34-1047,1069-1298,1320 -1345,1367-1987,2011-2264,2286-2640,2662-2738,2767-3071,3100 -3364,3395-3663,3687-3763,3796-3842,3865-3980,4002-4086,4108 -4164,4187-4210,4233-4767
  Gene Ontology: Mol. function=pre-mRNA splicing factor activity; Cellular component=spliceosome complex; Biological process=mRNA splicing
atgacatgttcggtaggttatctttaaaattaaaagattataatatcggtttagttgaccaaactccggacgcgcgagaccgaacttacgcgcaaattatgcaagagcaaagatttctgacagaaaaggtccgttattttccgtattgtggaacctaagccagagatttagttttttagcatccaatgtaataatctgattgtgtttatgaatatcttcaggaaaaaattgaaaatgagctagcagagaaacaacagcatggtgaactaaatcaatcggcaaagatgtctaaaccttttgttgctgggactgatttgacttctgttgcatctgaggacgttgaaaatacaccgtcccaattggttcggaaaaagcggattgtattgagcgaaaatgttatttcagcggtgagataattccgacatttaataaatggaattgcaaatttttcgatttgcttcaggaaaaaactccaaatgttgcgcgttgggaggagacaccggctcatatcggtgctggtgatgcaactccagcggcaggcaaacaatgggacgcaactccgtcccaaactcctcgtcgaaatcgttgggacgaaacaccaaaagagtctgttcgcgatggcggtatgactcccgggtggggttctgaaacgcctcgcgacataaaagtcgacatgtcggagcgttctgaggagacgccgggtgcttctaaacgacgttctcggtgggatttgactcctgcccaaacgcccgccgttggttctgagacacctttgaatggaatggatgcaccaactccagcgcatttcactcctaaaatccaaaatggaggaatgactccgtcgctgttaaccccgggagggtcgactccgatcggaacgcctgcgatgggcatgaaaacgccggctgttccctttgttccaatgacacccgagcaagctgcaatttacaagtgggagaaggaaattgacgaccgaaatcggccactttctgatgaagagttggacgcacttatcccacccggatatcgcattttggctcctccatctggtactgtttttaaaatattttactggttattttcctcattccaataactaaaaccttttcaggatatattccaataagaacgccggctcggaaattactgtccactccaacgccaatgaccggagtcggtggttttatgattcctcctaccccggagcgtggcggtgctggtgacaaaggcgttggtggaattctggacacgcagccaaaggacccggagttgccagcacttaagccagaagacattcagtacttcgacaagctgcttcaagacgtcgacgagagcacattgacaaaggctgagaagaatgagcgtgagattatgggttatctacttaaaatcaaaaatggagcgccaccacaacgaaaatctggacttcgaaaaatcacggaaaatgctcgtcgtcttggagctgggccattgtttaaccaaattttaccacttctgatgtcaccaacattggaggaccaggaaaggcatttgatggtcaaagtgattgatcgtattctctacaagttggacgatttggtgcgtccttacgtgcacaaaatacttgtcgtcattgagccattgttaattgatgaggattactacgcccgtgttgaaggtcggccatttaattgttattcccttttattttaatttacttggaaagttcaggtagagaaatcatttccaacttggccaaagcggctggacttgccacaatgatctctacaatgcgacccgacattgacaatgtggacgaatatgtgcggaatacaactgctcgcgcatttgctgttgtcgcttcagcactaggaatacccgcgcttttgcccttcctcaaagccgtctgtaaaagcaaaaaaagttggcaggcacgacacacaggtacaaaaataagaacattttgcccaaatttctgtgctttttgtaatccaactgatccatttgaggaattaaaattgtgcagcaaatagcaattttgatgggctgtgcggtgttgccccatttgaaatctttggtcgaaattgtggaaagcggactcgtcgatgatcaacaaaaagtgcgcacaatcaccgccctttgtattgccgcgttggctgaggccgcgacgccatacggaattgaagcgtttgattccgtacttaagccattgtggaaaggtaaaataaagaagcaaaaaacatcctaaaataacaaaaaaatataggtatccgaactcatcgaggaaagggattggctgcatttttgaaggctattggttttctgatcccattgatggatgccgaatacgccagttattacacaaaggaagtgatgctgattttgattcgagaatttgtttctccggacgaagaaatgaaaaagattgttttgaaggtatggttactttactggactgtagttataatttatatttcgaattattgttttaggttgtaaagcaatgttgctcaactgacggggtggagccagcttacatccgcgaagagatattaacgcccttttttagggcgttttggaaccaccgaatggccatggaccgtcgcaattacaaacaattggtggacacaacagtggaaatagcgcaaaaagtgttttctatattttaagttattgttataattgcaagctttaggttggctctgtcgagattatcagtcgaattgtcgatgacctcaaagacgaaaacgaacaatatcggaaaatggttatggaaaccattgaaaatatcgttgctctgatgggcgcttctgaaatcgactcgcgactggaggaacagctgatcgacggcattctctacgcttttcaggaacaaactcaggaggtttactaatctgttctcctcttttcttatttttttattatttaacaggatgcaataatgctcgaaggctttgggaccgtttgcaaaggattgggacgtcgtaccaaaccttaccttcctcaaatttgcggaaccattctgtggcggttgaacaataaatcggctaaagtccgacagcaagcgactgatttggttctactgtttcttcattttttcttattataaatttaatttttgcagattgcaaagatagcccctgtgatgaacatttgccaggaggagaaattgatgggtcatttgggcgtagtattatacgaatatcttggagaggaatatccagaagtgctcgggtcaattcttggggcacttagtgctattgtttctgtgatcggaatgacgaagatgacgccgccaataaaagatttgttgccacgactgactccaattcttaaaaatcggtaaatctatacaatacttaatttctcctttttccttagcaaattttgtatattggttttatttccaattattcattcagacatgagagagtgcaggagaattgcattgaattggttggaaagattgcggaccgtggctccgaatttgtgtcggccagagaatggatgcgcatttgcttcgaattgttggagcttctcaaggcacataaaaagtccattcgtcgtgcagcaataaacacttttggttacattgctaaagcaatcggtcctcacgacgtattggccacccttttgaacaacctcaaagtccaagagcgacagttgcgtgtgtgtacaaccgttgccattgcaattgttgcagaaacttgtgctccattcactgtgctgccggctattatgaatgaataccgagtgccgggtcattttttgctttatcccctggatattttatacatattattaatatttatttttcagaaatcaatgtgcaaaatggtgttttgaaagcgctgtctttcatgtttgagtacattggtgaaatggcaaaggattacatttatgcagttacaccgcttttggttgatgcgatgatggaacggttggtcacataattaatttttcttaatagtcattgatcttacaattaggcttttttatactcttatcagaccaaagagcaactaatttaaagaacaataattttcaaaagaggtttttaaatatttttttcgggaagatatcttacaatattttccaacaacttattattttatgtattattttgtatttccagagatgtggttcatcgccaaattgccattgacgcggttgcccatttgaccctcggcgtccatggttttggttgcgaggatgcgttgatgcatttgctcaattttgtttggcccaacatgctcgagaattctccacatgtcattcaacgtttcgtgttcgcatgcgatgcgatgcgcgtgtcacttgggcctatcaaagtgctgcagtactgtctgcaagcactgtggcatcccgcgcggaaggtgcgagagccgacctggaaggtaaactgataattgcatagccgaacacgctgtattttgtctttaattcaggtgtacaataacctcattctcgggtcccaagatgcagtcgttgccggatatccgcgaattggttagtcatgcctattctattcacaatcagcagtttgtaaaacccaatttcccgtttttagctaacactgaccgaaaccactacactcgctatgagcttgattacgttctttgaatgaaatcgtatcggtctgtgaatgtttgggcgacctgtggtgaaattctgtaaaacaatgatctaaaaatggtttcgtaaaatatactcgatttgtaatagtagttcgtttctttgtttcttccaacaactggttaaatttgtgtactgtcagaatgtcgtaca

SEQ ID NO: 47625 - DNA, 2290 bp, Heterodera glycines
  Genomic contig location: Contig_ID=SeqID_3470; Location=463..2752; Strand=+
  SCN-specific regions: Sequence locations=1-209,231-280,302-340,362 -443,466-1045,1069-1092,1114-1161,1197-1307,1357-1950,1973-2290
  Gene Ontology: Mol. function=diacylglycerol O-acyltransferase activity; Cellular component=lipid particle; Biological process =triacylglycerol biosynthesis
tttcggctggctttacgacagattttgggtaaaataattttaaagataacattaaaagacaatctaacaaacaaattcataaatcataaaaacttttctcagtgacgaaatgatagggagccgaaaactgaacctaactttccttctaagtaattactagggctgggatttttatgtgctaaaaatcctgaaatatgtaataaaatatgtgctaaaaaatgctgaaatatgtgctataagcccaaaaaaatgactcattctttatcattttcgcccgcacaattgcaaataaaaaacatttggaggtgtttgggggtaaaattagtccttttttgataaattgtttttaaagataatttttccatcagttgagtaagttcagcaagaaacttcgatatccagtaacgaattaatgaagaattcgattttcggtacacgaaataaataaagaaaattttgaaagagcctctaaaaatggcaagaaagttgatttttaggggtgcatttttaaattttttgtgttttcttagatatttttttcaaaaatgccaaatatttgcaaaatatgtgccaaaccccgaaatatgtgcgatatttatttatatgccaaaatgccaaaatatgtgtttttatgtttttataagtcgctctaattcgaaaattgttcggagaaaatgttatttttgggcttctctcgccataactaagccgcagaaaaaatatgtaaaaacataaaaatcccagccctagtaattacatattggattgtaagtaaatgctgatgttaaataaaggaatgtgagcaatttcaacagaaattgagcattcagtaattattgctcatatgtaaatgctttggctaactttgttttctataataattgcctaattagatgttcctaaaatttaaccacccttttcatcagatgcttcaatttatcgctgtgtttcactttttgtgagttcttctttaaaaattgttttaaagtacgcgcctttctttcagttttctttgggttgttttgcctttgctttccgtctttgtgccattttatttatttttctacactaaattttggtggattgtctgtttgtatttcatttggtttctttacgactttgacacgccaagaagaggatcaagaaattgggtgctttttgaatttaatttttttttaaagtttcaaataattttagttatggtacaaaaattcctttgtatggaagcattttgctgattattttccaatcaaattgatcaaaactgctgaccttccaccgaacaacaattacattttagggcactgtttaatttatattcattaaataattttaatttatatcttattttaaattgtgtatttgtactggcattgtttgtttcagatgccatcctcacggagtgttcagtaccgcttcgttcgttcatctttgcacttctgcgacggggtttgggcagctttttcccggattgaaatcgaacattctgacattgaatggccaattttggtttccatttcgtcgcgaaattggcatcggattgggcatgtttacggagacaaacgcggcaaaaggacaatcaaattgtccaaagtttacccaatttaaggtggggtcgaaagttcttcgcacagtctcaaattcttgctgaataaccccggccgaggccgtctcattggcattgtcatcggcggtgctgaggaagtgctggacgcacacccgggaaaacaccacctgaacataatgggacgacgcggattctgccgattcgcgttgaaaacggggcaagtggaaaaggcgcaaaaatatgcacaaaatgtgcaattttataagtaatattttctgatttagcacccctcttgtgccttcgtacagttttggtgaaaatgatttgtttgaccaattaccaaacccccgagggtcccttctgaggacagttcaggcaacgcattctctttctgtttctgactttgcacttcttcatttagtccaccatcaagaggaagtgtggtttttgcattccgatcatcaacggatgttgcggaatctccgatcgctttggtctgttgccacgccgtcgttcgatcacgacagttatcggtgaatgaagagacaatgtttacacaaatcctttgattaaggtgccccgattgaagtgaaacgcattggcagcccaacccctgctcaggtcgaccaactccatcttcgctattgcaatgcattgaatgagctattcgaagagcacaaatcgaaatatggcgttccaaacgacaaacatttgactgtccat

SEQ ID NO: 47626 - DNA, 699 bp, Heterodera glycines
  Genomic contig location: Contig_ID=SeqID_3477; Location=1639..2337; Strand=-
  SCN-specific regions: Sequence locations=1-504,527-699
atgacttgcccacaaaaaatcagcgacagcagtccactagcaattaacactggtctgaacattttcttagttccaccaaccaatgtttctgttgtacgttcattctttcgtcaggtgcttccgctagcaacaatcacgcaagaatcaccgtacctgtttcgactgtacagtgacaatttgtggactgatttatctcggatatatctttatctcgaactgtccattgaaaaaccgggagcaaacgataaatgggttgcgatagatgatgcggatactagtgtctctgccattcaagggattggtcaaacatttgtccagcaactaaaagttacggttggcaatacggaagtatacgatagcggaaacttatacccattcaaggcctatatcactaatgagttaagctttccaataaatgccaagaaaaattttcttggttcaacagggtattatcacaccataaaccaagatgactcaacagacgaggggttcaaagagcgttgtaaaattttcaagggtggaaaaaatgcacaattcctctctcgtctcgactttgatctgggaaaccaggagctttatcttttaaacaatttggatttgctgttcacaatttacaaggctaaagatgtctttcttttgcaaactttaaaagcaaatgatgacagtttacgatgtcaagatttatgccaaaatggttga

SEQ ID NO: 47627 - DNA, 934 bp, Heterodera glycines
  Genomic contig location: Contig_ID=SeqID_20048; Location=611..1544; Strand=+
  SCN-specific regions: Sequence locations=1-48,71-124,146-174,206 -221,252-799,821-934
atgaccattgtgccaattttacttcaagctttgagtggttcgtttcccatttattttgggttaaatttttagtctgacaatgagtagaagggtatctgattcatttacaattttgcttctcctgaatactttacacaaataaaagctctattccctggtgggtttttatctttcaattctcactttttcaaaaattttttataatcctgtaaaattatggcaaaaaataatttatttattatttaaaatttctcctctcacaatcagcggcttctattacttttttttgaacctccccctgagaaatataaaacctttttacaacgtacaaagtcgattttaactttttttgatttcagcacttgcaaaagaacgaccatcggacccaatcgaatttgtcgcgaattatcttttgaaggaaaagccacgttttaacggtgcagctaatgcatcagcaaccaatgaacattgattttatttgattgtttaacagtttagccacttgtctcttgaaataggtacttttacatttatgtgacaaaaagcgattttgcccctgattttcgaacagtttcagagcagatcaagaaaacttgacttgctctgaaaattattgctcaatatttgaaaaaaaaagaatctgaacctggttccatattgtacctggatttcctgacaaaaacacagctctaggaaacatccaggcttgtcatggcttgaatccgtgcatggactggattttttgaaattggttatcagaattaaaatttctggggaccagggggttcggtagtgccgaagggagagggggtgtccgaggcctcttactattgttcgtaaccttaactgtaaaagtatcttggaacaaagtaatcaaatcgtgagtaaattgtttatactaataatgcggttactggggaaattctttgaaaca

SEQ ID NO: 47628 - DNA, 1121 bp, Heterodera glycines
  misc_feature (547)..(547): n is a, c, g, or t
  Genomic contig location: Contig_ID=SeqID_20056; Location=595..1715; Strand=-
  SCN-specific regions: Sequence locations=1-298,320-1121
atgaccctgtgggagatcatgcaagctcgatccacactgtttgtgcacaagatcttcaaccgatcagctcggcccagtcagtctctgttcgatcagtccgccatccccggcaacgacgcctcccgttcctcacgcaacacttcttactcttcctccaccacttgctcatccatccgcaacagtgcaggcggaattctctgcggagctgagccgatcactttgttcaggctggaactggaacggctgcagtacatcctgcacttcccggaggaagtcgcctttcaggcaagcgacccgaacgcattcccaacagaagcaggagttgttgccatgctcacaccaacacatattccgaccaaaatgcctttgatcaatcgcattataatgatgattatacctctctgagggttgattagtgatctctgtctgatcacactccgatcacttaaaacaccatacttttgttcgctgttcatttgcattcattcagctctcctccacggagtaccagttgttctacaacatttgcagctttggattttgttcngtttcgtcggttgcgacttggccaacatcagtgcccaggacaacccaagtccggtgaagaatttggtgaagcgactgtcagaagttagctcatggatcactcacatcatcatcagccagccgacgcacgaagagcggaagagctgtctggcggcgattatgcgagtgatggacacgtggttggtcaattagctaatgtttgccttggggggctggcaaatgacggttagttcaacggcaaaacattggtccgaagtgctagagaagccggtttaataaacccatgttctttcagttggaacattggcaatttcaatgctaccattgaaattctgctgggcctgaagagtccccgcctgcgccccttttggctttcgttgaagcaggaggagcgccaacgcttcgacgaatttgcggccattttggtgccaccgacgaatcaaaagcagcaaaatcaaataccaacgaatggttgcgcatatcagcaaatgaatggcggaggaaccgcacattggacgccccacccggcgtacattgaggtggccaagggagtgggcaattcatcaaaactttaa

SEQ ID NO: 47629 - DNA, 4568 bp, Heterodera glycines
  misc_feature (60)..(60): n is a, c, g, or t
  misc_feature (63)..(65): n is a, c, g, or t
  Genomic contig location: Contig_ID=SeqID_3479; Location=1..4568; Strand=-
  SCN-specific regions: Sequence locations=27-877,945-1610,1638 -1928,1957-2130,2152-2770,2792-3223,3262-3608,3645-4275,4306-4568
  Gene Ontology: Mol. function=co-chaperone activity; Cellular component=vesicle membrane; Biological process=receptor mediated endocytosis
aaaaatttatttaaaaataaccatttgactagaatttagctttataagtaattatgagangannnaataaataatgttaaaccaaatattgtttaaaacagactctttctttaattaatttcccataatatttaagctttcacttgacaaacaaaatgtacgtgaattgatctccgcaaatttgatctcacttttcatcgacattgcagtcttggcccatttgcataccaacagagcaaaacttcacggccaaacaaatgtgattgaggcaaccaaagatgcggcacattgtgaggagactgagccaaaagaatggtattacaacgaccggcagggccaacgccaaggaccgatttcgttcaaaaaagttgaatcattttactccaataaagaatttaaattattgtcgtcattttagatgaagcgtttataccgcgacggtgtgctttttgagaagagtgaaatttgggcagaaggattggacaaatggtgccatttgtcgtcagtttcccaatttcggtggaccgtttgttgtgtcggcaatgcaaaactgggcgcttcatcaaccattgaccgaggaattggggacgaagccgtaatagaaagaagggacgatgaaccaacgacactgccgatgggcctttacaacctcactgacctatgctcactgatcctcgacactctcatccaaatgtgcactttcttcccatccaggtaaacccccaccaataaacacctcagaggattagttcatatagggaataaaacgaattggtggtttggcgataaatcagtaaattttcatttttttcacagcaataattcaccaaatgattatcattagtaaatccattcctttgcacttatcatgtgggtagttggtctagtggtatgattctcgcttagggtgcgagaggtcctgggttcaattcccagactacccctaactttttgattaaattacatttaagtgtcaattgttcaattttttatttttgcttaaaagtgctttagagatgagacagacgctgtcattcgtccaatgcctcgaatcaaaaaagtgctttctgaacccgtgttgctgtaccaattggtgcagttgttgcttacttacgacccgtccattgtgcaacgagttgcaactttggtcaacgatgtcatgcaggacaacccttacatttcgagactgtatttgtcgggcatatttttctttatcttgatgtacaatgggtccaacattttgccggttgctcgcttcctcaaagacactcatttgagacaagcattccgttcaactctttccaagtcggagctcgcctcccgttcggtgctttgcccaatgttgccagaagcaaatattttctacctcgaggtgaatttttaattcgtattgctttttcaaaaattggtctaggaatatggagcggaaaaatatgccgaagtttttctgggagagtttgagaatcccgaatgtatttggaatagtgaaatgcgacggaatatgatcgaaaagattgctcttcatgtgtccgatttttcgtccagactttcttcaaatgttaaggcactttacaggtattgaaaaccaaaaactttttatttgtttcaaacccattattattattatttttgtcagatattgtcctattcctcccattgattatccacaactaaaagaagagctgttctgccatttctattaccttcgccatttgactgataatcaccgctttccgaattggcctattcgcgagcctgtcgattttttgcgggcctgtctctccgcctggcatgatgaaatcacgcgcaaaccggcgaaaatgtctgttgagcaggcttgtgaacgcctggggctgtccacgacggattccactggcgggtggaaagacgcatcggcagtgcgccgagcctacttcaaattagcacaaaagtatcacccggacaaaaacccggatggtcgggaacagtttgagcagatcaactacgcctacgaattcctcacatcgacgctggtcagagccaattcctcgtcaacgccagacatgaatcgcatagtgatcatcattcgtgcacaaagcattgtatacaagaggaacttacaaggttcgccagcaattcggtgcaaaatcaatcatttataattttctttagtgctttcgccatacaaatatgccgggtatacccaacttatcaaaaccatcgatctcgagtcgtccgacgacacattgtttgctcgaaccaaggaggacggtggtcaattgctggttgctgccgttgagttatgccattggacgctaaggagttcgtcattgaatgcggagcagttgcgacgggacggagggttagatgtatgtactaatgggcgaatgtattaactgtgcgataaataagtcctaatgctgtgttcaggctctgtacaaaacatttgagcggtgtgttccgatgattactgctggttcactcgaaagcgaaatgccagtgcaagtttgtactcacgtgtgcaattgttttgccaccgctgcccgttttgatgcgtgccgtgaaaaaattgcagaaatgaaaacgttgttccaaagcatttgccaactgcttagattcgaagtgatttgctttttgctcaaaattactcagagtatgcttttaagtctctccatcggttggcttgcgctgcggcggagtgcgtttgtgccttttcagtgtgcacattgttacagacgcaactgtttcaagcgggtgtcatttggcaactcttacctcatctttttcgcttcgattacacgttggacgaaggaggttggttggaaggcaatataacaaataaatatagccaaattgaaaataaacgcataccaattccaaggggttgcccattccgagaagacgaaccaccaagcggtacttaaccgactggcccgcaactgttgtgaagcgcttgcctgtttggccggctttcgtccggacacgccggacaatgatggagtacaaaaaaggtggttacttacaattaggcaaacgattgctgaatttatctccattatgataccgtttaaagtttgcgtgccatgctaacgccattcatttgccgtcaaatgcaattggctcggattgctttgcccgttaatgttttacaatttggtgatgacgatgaaatagcacagaatgtaaagcagaaacaacagccgaactcatcagccaaagctcccaacggcggtggtgaaagtgcaaaaatatacattatatttttaaaatttatcatattaagggcaaaatggggatgaggacgaagagggaatggccaatgccaagcccaatgttgaacagtgccgtaatgattttgtgttgaaattactcaacgcaaacaccgaagacccctatctgatttgggacaactccactcgtgctgaactgctcgattttgtggacaaacaaagaaactcacacgagaacgtatttaatttaatttaattcaaatttagtaattcatctttttttatctagagcgaaatgtttggtgccgaattcaaactgagtatttacgcaacagaattggtggttggcgaaatattcgtgcgtatttacaacgctcaaccggaattcagactgctggtattttattaaaagtatttatttattgccttaattacggtaaaggaaccaaaacggacgtgcatggactttttggactatctatctaaacatgtggaggaactccttatcggtgaaggcgtcgttcgacctgcggcagtgaagcagaaaccgattaccaccccgaaacccttgaatttacccgcaagaccagcagggtcctcattaaacggaaccaacattgcaacactgtccaggcccaaggtacgtttagtagtaagaattggggaaaggataggaccatcaatttaaaaaattaaatgaggaaatgatcaaaaagcatctagtattttttgtacgggcggcagggcattagcgaaagagaaaaaaaaatcaatgagaatttggtattgactactatactaacctgtttatttaagccggcgaaaaccgaagaggccgatttaatagatttgacaaccgaatttgtggtggaagaggagcacccggctgtcgactggggacggtttgccaacgccaatgcttccaacccggaaataacgacgcattcttccacttttggcaccgttaatctaaacggtgcttccgggggtcgctttcctctccaggaacgggttcggatggtgctcgaggcgttgcgtaatgtgctgatgatgaatccaggttttgttttgtccttcctttctttctttatttttcgtttaaggcattgaattgctgttaattggccacttttccgccatttttgcttttcttcgtgttcattcgctatcagccatccaactgaaggcattgcaaatcatttcgatcgcggccaacaacaaagagtgcgtcagcgacatcgcctgctccattcagctgccacttctgctcactcttctttctaagcttcacaaaggtcgagaaaattttacagaattaaagtctccaagaaatcttctaattttaaaatgtgatttttt

SEQ ID NO: 47630 - DNA, 1781 bp, Heterodera glycines
  Genomic contig location: Contig_ID=SeqID_3486; Location=89..1869; Strand=-
  SCN-specific regions: Sequence locations=1-711,738-788,810-1359,1381 -1781
  Gene Ontology: Mol. function=5'-3' exoribonuclease activity; Cellular component=nucleus; Biological process=cell growth
atgggagttccagcctttttccgttggctttcacgaaagtatgtgtcgatcattgttgacgcggtggaacagcgcagaagagaaattgacggagtaaaaatcccaatagatgcaactcaaccaaatgagaattaccaagtgagataattggacaaatgaaaaattcaatgagtaaatgatgcatttttaggagtttgacaatctttacttggacatgaacggcattatccatccgtgcacacatccggaagaccgacccgcgccgaagaccgaggaagaaatgttcattttgatcttcgagtatattgaccgcctcttttccatcgttcggccaagaaaacttctctacatggcagttgatggggtcgcccccagagcaaaggtttttttgagtggaaataaaaagcatcgcaaaactttaaagatctcaaaaccctaactttgtagatgaaccaacagcgaagtcgtcgttttcgagcagcacaagaagcggcggagaagcgcgagctcatcgaaaatgtgcgtaagcggttggagtcggaaggaattccgttgccgccaccgcgaaaggaagaggaacactttgactccaattgcataacacccggcacgccgtttatggcccgtctttctgttgcccttcgctattacgtgcacaaacggatcacctacgacccggcatggcaaaagatccaggttctttttttgttactgggttttggttttatttttgaacaatgaaatgtttttaggttattctttccgatgcgaatgtgccgggtgagggcgaacataaaatcatggactacgtccgacgtcagcgcgcttcgccggcgcatgacccgaacaccgttcactgtctttgtggcgccgatgccgaccttatcatgcttggattggccacccacgagtccaatttcaacataattcgagaagagtttttgccgaatcaaccgaggccgtgcgaactttgcggtcaatacgggcacgaggtcgaacattgtgaagggttggcacgtgccgagaccgggccggaccaagcggacccgttgaagaaggagaagaacttcatcttcatacgtctgccagtgcttcgggaatatttggagcgtgaactttccatgccaaatttgccatttccgttcgatttggagagagccattgatgattgggtaattcaaagcaaagtctctattctgaaactacgatattctcaggtcatgatgtgtttttttgtgggcaacgattttctcccccatttgccatcgttagaaatccgtgaaaatgccatcgaccgtctcgtgaagttgtacaaggacatggtttatcaggctggcgggtgcgaaaaatttcaatcattttttatgaattaaagaaacatttttagctggctcactgaaaacggcatagtgaatatcgaaagagtgaagaagatcatgggcggacttgggaaggttgaggacgaaatattcaaacaaagacaggttggcccagaaattaaacagaaatggcaaactcaaaagcaacttaagctcaaagaattgcgcttcaaagaatcaaagaaacagcgaaagcagcaacaacggcaggcaatggcaaaaattatgccgtacaatgccaatttgatagcaccaatgccacttggacagcaaaagcgaatgtcgggcgaggaaatgcgcagattggcggcgggagaccgacaggaggtggcattttaacatttggaatttaaattagagcaattaaacgcggatggcttatgatgcttatttgaaaataaa

SEQ ID NO: 47631 - DNA, 500 bp, Heterodera glycines
  Genomic contig location: Contig_ID=SeqID_3487; Location=755..1254; Strand=+
  SCN-specific regions: Sequence locations=1-500
ttggtatttctataactcatttattgttaattgttcggtcggaatatctgctcgtccttttggctgtctccgttattcgctttaaatgatttccggtcaccgttcggttggcagatgtttgctgtctctgccacaatttgcaagtcggttgattcccatttacggccatgtccaggcacaatgtttccacttcatgaaaaaacaagtagaaatgtactgaattgttaaaattggtcatttcaatgtaaggtcaccgtcgacccagaaattgcaaaactgagagagggcagaaaacggcgtaaattgacaaaagcaatcaagaagctggcggagtacagcaaaaagccggtaccggttgaggagattgaggtcgacctacgccaccaggcaacgaagggacagagggaacggacggacaacggagtacaaggacgagacgagaagaaagaggcatatggcagaaagaagttgctcaagcagtacgcccagtcgagagccag

SEQ ID NO: 47632 - DNA, 633 bp, Heterodera glycines
  Genomic contig location: Contig_ID=SeqID_3488; Location=58..690; Strand=+
  SCN-specific regions: Sequence locations=1-166,192-341,364-371,401 -487,509-633
atgtggattaaacgttcaattgatgcccaagagaatgcgttggaagtgttgaagcaactctctcccacactttacgaagcggcggtacaactcgacgagcgcttattctacacacaaattcaaggtataggcctgttgtactttattcaccatccaacccttttacaaattaaaaaaaaaattaaatttttcgtgtgaaggtccaccaatcagtccgccgattgacaattacaattgcccagacggggagtaccaagacgtaaccaagaaatgggagctcccgatgctagaagaactggagaagaagttcggcacgggacgattgatcaaaatgccggaatttaaaaagaaacaaattcaaatgatgcgacaaaaagcagaagaagaggaagaaaaaatggcgataaaggacccgtggctgaagaaagacacatcatgtgctgtagaggaacagaacgaaacggaagtacaattggcgaaggcgtaaagcgtacccgaacacttagaaattcattacatgtattttaaatacccatttcgaaaaagactggaattgttttaaaaagccggactaattgtaagttggacagtgcttggcttaatttctcgaaaacaaaaagcgtttctttgaaa

SEQ ID NO: 47633 - DNA, 983 bp, Heterodera glycines
  Genomic contig location: Contig_ID=SeqID_20101; Location=45..1027; Strand=+
  SCN-specific regions: Sequence locations=1-114,136-299,321-401,423 -441,463-512,534-538,570-718,741-983
atgagtgattggatgggcagggatatcagcacaatctccgcgtcaatctttagccttcgccaagacgaaacgcatcccggaaaaggaacaaacaaaggacagcagcgaagcggaagaacaaattgggggtggggaaagcgcaagttgagaaatgtttcaaagagaacatttggaagtgatctgacagaattggcaaaggcgggagaaagtggcaaacggagcgatcggaatttgccagaaaacgctgaaagaaaggcaagcgaatcgaattgaatggataaatccaacggaagggacactcaaaaggacgagggagggcacaatgctcacagccttaaattgaactttttggaaagggaaaggccggcacatccgccgatttgtcccttgaaaaggccgtggatttaaatgtttttgtttttctccccccccccctcctcctcaatttccccttaatttccctctctttcaaaatttgcccttatcagtggcttatcattaatcatttcttcttctgctgatcgcccagcccctacttcctccgccttttttcttctctttgccttttttgcacaccaaacgccaaagtcatcaccaaaaatcgtttcccttcgctccgtttactccgatggattattttacacaatttatcggccattttccttcccttggcactcttttaactaaacattcttcggaatccgagaaggaacagcaacttcagcaacacaacataaaaaaggacgaaacaaacggcggaggggacgaaatggcaactgaaaaagccgaattagtggccaaaagagcgaaaatgataaggcaatgatgagagttcaaacgcctaacgattgtttgccgacatttcagcagcaaatgccaaacattttacgccgatgagcccattttggtcactcgcgcgtcgatgcaattccttttcgatgagaatgggagacgtttcctggactgtatttcgaatgtgcaac

SEQ ID NO: 47634 - DNA, 847 bp, Heterodera glycines
  Genomic contig location: Contig_ID=SeqID_3505; Location=118..964; Strand=-
  SCN-specific regions: Sequence locations=1-173,195-847
  Gene Ontology: Mol. function=protein binding; Cellular component =cytoplasm; Biological process=synaptic vesicle priming
atgacccaagaccttttaaatatcgagaatgatgtttaccgttacgaaacgggaggagccgaatctgttgacaaagaggtgctacttgatgaaaacgacgacctatgggcggacaaccgtcacaagcacattgctgttgtttcgcaagaagtattgaacatggggttaaattaagcaaatgcttattttattttaactcgagctggcataatacccatttattcaggtgactcgtggtttgaaaaaattctcggaaaataagaaaatgccaagtgatgccagatcaataaaggacctttcgcttctgatcaaaaaagctccgcaatatcaaaaggaattgaataagttcaggtggcttatctaacaaaaaaaaacagtttatcgttataaaaaacgatatttctttcttatttaccttttagtactcattttcatctggcagaagaatgtatgaatcgttacaagcacggagtcgacaaattgtgtaaagttgaacaggtctttgctccggttaccaaattcgtccgaattatatttggtttaggatttggcgattggaatggatgctgatggggagagaatcaaagaccccatgaaactgatggttcctttgctcattgacccgtcagtgaaacttgaggatcgcttgcgcctcattttgctttatattttccacaaaaacggtactgtttattatattgtgctagtacaattataaacagtgatcttattttcagggataacggatgaaaaccttaataaactgttacaacatgccaacattcctcagacggaaagggagacgctgacgaatgctgctttattgggtcttaacatcgtaatcgat

SEQ ID NO: 47635 - DNA, 1508 bp, Heterodera glycines
  Genomic contig location: Contig_ID=SeqID_3506; Location=1326..2833; Strand=+
  SCN-specific regions: Sequence locations=1-178,241-305,327-374,396 -851,873-1508
  Gene Ontology: Cellular component=intracellular; Biological process =RNA processing
atggctactactatacctgggtcgttggttaacaaaacgaagaagcattttttgggtatgacggcgccggcaggttatgtggccggagttggtcgaggtgccactgggtttacaactcggtccgacattgggccggccagggacagcacggacgtccctatggatgctgctatggcttcagccgcagctgcagctgctgctccagcgccagggccgccacccaaaaaacaaagaaatgacgatgaccatgatgaagctgaggatttgaatgatgctaattacgacgaggtttcccacaaaaaaccttttgaaaataataagatttattagttcgaaggttatggtggaagtctgtttgctaaagacccatacgacaaagatgatgaggaagcagacgaaatttatcatgcggttgatatgaggcaggacgaacgtcgtcgagaataccgagagcgaaagtacaaagaggcggtcgagagttaccgaaaggagcgaccgaagatccagcaacaattcagtgatttgagacggcagttagcgactgtgaaggaggaggaatgggctgcaattcccgaagtcggcgacagcagaaacagagcaaaacgcaatccacgaggagagcagtatgccttgccaactatgatttcttctgagtcaagctttaagactaactcctgtccccgactccgtaattgcctctgcaatgagctacaaccaaatgaacacaatgcttgacaaaaatgtgcagaatgggatttctactccatattccggcttccaatcaactctcgggggctttcaatccacgtttgggttccaatcaacttttggatttcaatcgaccctcggaggatttcattctgttctcaatggaggacagatgacgccagggtggaaaacacaaactggctcctcaactgacctggatttgcgcaaaatcggacaggcaaaaaacagaataatggacattcgacttaaccaggtgagtgttttattttaataaaagttgatggttgccaaatgatgaggaagtaaaaggtctgacgcccattaactgtgcattaatggctgttgaaatgcattcaaatgttttgtgcgattctcttgtctgtggggatataattttgcattcccttaaattacttgctaaatgaaatgtcactttagtgagctaatcaatgcacatttgtttcatttatctaaacccgcaaagacactaatgtcatgaaatgtacaactgagttaatgaaaaggtggttgatcacgaagttttcaatctgatggcacatagcaaaatttgaacatgaataattttataataattcctataaacattgcaatttttaaggtgtccgactcggtgtccggtcaaactgtcgttgaccctaagggctatctgactgacctccaatccatgatccctcagtttggagcagacatgcaagacattaagaaagggcgaatgctgctgaaatcactgcgcgagacaaatccagaaaaaccacagg

SEQ ID NO: 47636 - DNA, 2617 bp, Heterodera glycines; identical to SEQ ID NO: 20236
  Genomic contig location: Contig_ID=SeqID_20236; Location=1..2617; Strand=+
  SCN-specific regions: Sequence locations=1-61,83-637,727-872,894 -1469,1491-1898,1923-1941,1985-2008,2033-2193,2229-2368,2390 -2549,2573-2617
  Gene Ontology: Mol. function=voltage-gated chloride channel activity; Cellular component=integral to membrane; Biological process=transport

SEQ ID NO: 47637 - DNA, 1172 bp, Heterodera glycines
  Genomic contig location: Contig_ID=SeqID_3531; Location=1005..2176; Strand=+
  SCN-specific regions: Sequence locations=1-333,356-430,495-602,642 -1082,1105-1172
  Gene Ontology: Biological process=mitotic spindle positioning
atggacgaagaggcgaagcaggaaaacctggcgaaagagcttctaaagctcacttcttctctcaagcaaaactttacgactgccggttcggtgctaaaggaagacaatgcggtaagccacaggaaaagaatgctgcaaaagaaggcccaaatatttcagacattggatgttatgcaaagggtcgccctgtccaacaaagaaaatctgataagggagaggggccgacttggccaccacgcctaccaatcgtgcttcaactgtgtgatggtcatgacagtgattgtggtcatttggtcgttcattgcgatgattattatgatgcgaatgttccccaaaatttaagtgttttatattttctttggataactcaaaacgggcccaaaccaacaaaataagaacgattcacttctgtgattgcttctgagctgtgttattctgttttgtttatttatttttcgtcatttaaatttgtttttctttaatttatttcttttgtccgttcgtttgcctgtttttaacccaatttttctcctaattattgtttttttctgtttttaatttggtgttttagaaatggttgactgaatgaattgcgtgccttttttcctttcctttcgttgcacttccctttcctttcccttttcccgtcgttttatgactgctcaccaagcatccgtcgcattgcgtcccttttattttgctgtccatcccgacagattcgcgacagaaccgaacattcgaaataacaatgagaaggcgctgcaggtgaccgatgcctttagactttactttgcaaatggtcaggtgttcaacgggtatctcagcagccttttcccgaggccaacagcccaacaacagccggtccaggttcgtcgaaagtgacgcttttgtgggactcaccaaccgattaaaaaacaaaaatgggtgattcgcattttatttgatttcgaatgcatccgtttttgaatttatttttttaggtcgatttctttgtccgagggaaagataacaaatttcggagtgttcggctgtcattgtccggctttgatgttgagcaaattgtcaggtgcctttttaagcatttcttattttccaactttttcagcgctttcattcccattttcaggaccactttggaattgttcgaattaaacaccgacactttaccaaca

SEQ ID NO: 47638 - DNA, 1783 bp, Heterodera glycines
  misc_feature (67)..(67): n is a, c, g, or t
  Genomic contig location: Contig_ID=SeqID_20266; Location=1..1783; Strand=-
  SCN-specific regions: Sequence locations=1-496,518-640,662-1067,1089 -1783
  Gene Ontology: Cellular component=eukaryotic 48S initiation complex; Biological process=protein biosynthesis
ggacacaatgttttgctcactttcgcctgccttcagattggcgagtccgacatcattcaagagcttnatcacatgttgctcgaaagggattccagttgtcaccgcacctgtttcaagttgtactacgagggaacagcactagacaattacacggagcttcgcaatgtgccggacatcaaagacaacgccgtcatgagagtggtcgagggttggtgctgaccaatgccggcccattcgctcctcattcggttgtccgtcattcagaaccgtataatttgcgggaggctcgagtgcatgtgcgccatttgcgcgaaataattcgttcggtggacatttctgatgcggtcagcggcgtcgactttgcctcactttcgtgtctgtcgaccattactcaatcgacctctgacgaattgggcaaaaagtcgaaaggctctcccacaattgaattgctccgtgccgagtcggactgtcttcctcccgaatggcttttgcccaactcttccgacatcattttgaagccgctgattccaatggccgagcacagcaacggcactctgcagcccactcagcttatcgctctcaaacagatctcattctctgctttcaatcccccgcccggaccaaggaaaatgaaggcactcccttctttctctctttcattgctttttccgtcttaagggggacattctctatttggttgtggacacggtcgaagatcgtcgttttcacgtcacttgctgcacccgtggattcttcgtcaactcgactattggcgaaaagttcaagcccgaaaggtcgtccacttacggcggtcgcgtgttccacagtctcttcgatttgctttccgacattagcgctcactttaaaaagacactcgtccaattgttgaagctgcgcaatgagaaacacattttcgagcgattgcccacgccttttcagctttatcaatgggttggttttgccaatgtcaaccgaagcagaaaattcgctttcagattgtcccctctgtggaaaatacccaggaccagttgcgagccgatgagcaagttcagccgcacagactcggcttggaagaccatatgcctggacaaatccgagactggaacgaggagctgcaaacgacgcacgacatgccgcagagcagttttgcagagaaactctgtcgggatagggccaggttcaaagtccatgccgacttcctttccgcttgcactcggggcgcttcagcggtaatgtcaaatttaattagtcgtttattgtttttaattaccgaatttgattaggttattgatgggtcggtgcacaccatcaacccaatggacgagccgcgcatgcacatgttcatttggaacaacatcttcttctcactgggctttgatgttaaggaccattataaggttgacaatgcgttcgggtggggcgcgagaaaaccaatgcctttgtccaattgcaggaactcggcggggacgcggctgcgcacgcatcgtattcagctgacttggccgcggttcaggcatatgcccaaattgacgatccaaagtgagtcaattaaaaatcgcctggaaaatggccgagtccaaactttgcaggcttcacacttctggcatggccatcatcgacttcaaaggtttacgtgttatggcccagtcgatcattcccggcattttggaacgggaacagcaggattcgattgtttatgggtcttatgactcgggaaaaacagtgacaaccaacgaactatacgaagaattgttgaaaactcggccaaactgttgaaaattga

SEQ ID NO: 47639 - DNA, 691 bp, Heterodera glycines
  Genomic contig location: Contig_ID=SeqID_20269; Location=94..784; Strand=-
  SCN-specific regions: Sequence locations=1-59,121-131,154-232,258-691
  Gene Ontology: Mol. function=meprin A activity; Cellular component =microvillus; Biological process=embryogenesis and morphogenesis
atgcatgaaacactgcactcgcttgggcttggccatgaacagagccgagcgggtgggccaattaaaaaatttactaaaataaattaatgatatataaaaattatttttaattaattatttccccgctttagaccgtgacaaatatattacaataaataaggacaatattaatccgcaacaatatgatgtttttgcaatatctgatcagacaaaatattcaaggtaaaatctctaattttatttttattttatttttaccaataaatttcatacatctaattaattatggtagacacttgattgtataaatcatttccgattaatgagaattgtgataagcccaggaaacatccaggttgctgaaaaattgcctgagcctgtacctggatccaggaaattagtaattagtgctctctgattgaattgttattcattgaattttgtaattttaaattttagctacggtgtgaagtacgattacggtagcgtgatgcactacgatgcccacatgggtgccaaaacgtggggtgtgaagacaatccatgccaaattcgacccggaacataatgacagcaaaatgggacaacgtgaaaagttgtcggacagcgacatcgaggcactgcgacggatgtactgtatgccaagtaaggcgaatactgtatttgctagtatgccacacaatttgaaatag

SEQ ID NO: 47640 - DNA, 1592 bp, Heterodera glycines
  Genomic contig location: Contig_ID=SeqID_20272; Location=1..1592; Strand=+
  SCN-specific regions: Sequence locations=1-42,65-203,226-266,296 -620,646-833,855-900,936-1006,1028-1431,1455-1484,1560-1592
  Gene Ontology: Mol. function=small monomeric GTPase activity; Cellular component=cytoplasm; Biological process=signal transduction
gcaactttccgctttggagactcttctcgacatttcttatcaggtacttattttgtttgttgggtctttaagctaaagataaatttttgtttgtttagggctcaaatgttgagaagtcctttttatttgatgtttccagcaaaatttacatcgccactgactcttctccggtggatatggtgggcatatcattcatccgttgtatttcacaattttgattttcctcctcttcaggcaacatatgagttgtgctgcgatatgattgatgtttgttattttattttatttttgtaattaagttgaatgatttaggtaacaattgactgaattatttaggtaacaattgacatttcatccatttatgggcaccggaatgagcagaaaaacttccgaccgattggctttgatcaggattcgtccgccgttatcactctccggaccagacaagtcttatttattaaatcgaagaaacattattttgtaccaattatttaatttaggttatttttttgcgccaaataaatgtttatttggcattggtttgtgtgatcaaagaagacaatttcgaaaagcaaggacttatcgatttcaatttcaatgtgtttaaacaggcaaatatcattttaatttaattttatattaattgacaattctttaaagggagtggaagatgtgttcgaattaggcaaaagacggttgccttccctggctgttggatgacaccaaaactcagcttctaatttttccgtttattcactggcattgtcttttatttttgttgccgcatagaccaaatttctatcaaattattattcaaatgaaatttataaagacacattcaaaaatacattcctaattattattgttgctgggaacttttgctgttgggaggggcttttcaaaaaaattaaatcttttgatttaaaattttttttcagagataacaaattgctaattacatattcatatcagttaccatgatctggtaaattcatggtatcagttatgctttaagaattctctatcacctaaattaaaattctttttcgcatttttggcctaatggatttgtttcaatcttcacaggctaatagtgaactcagagttcgacagataccaaaatgtttattttagagaaaaaaatgaatttataagccaaaagggtccacgctttgttctcaaatccaaaaaaagaaaagtatcaattttgtcaaattaatattttaggtctttggcgttatgttctttccgtttccaatctttgtgaagtaacaaattgttgttttaagggtaaatctttgttttgttaaaaatgctttctctcgcaattcgacgtttcatcgtccaacattcaaatggcacatttatgagcactaattttgtcgcgacatcgtcaaactttttgctgatggaccaagaaaatgacaaagagacgaagaaggactttaggaaaattgtgaaactgctcgaacgaagtccgactcagaaaacaaagaaagggcaggaaaaagcggaagaaaatgcgaaaagagaagagaacggaagggaggaggaaaggaccaattggaaggagcacatcagcaaaagtctgc

SEQ ID NO: 47641 - DNA, 1840 bp, Heterodera glycines
  Genomic contig location: Contig_ID=SeqID_3539; Location=1193..3032; Strand=+
  SCN-specific regions: Sequence locations=1-83,105-152,174-1226,1248 -1703,1725-1840
  Gene Ontology: Mol. function=heat shock protein activity; Cellular component=cytosol; Biological process=protein folding
atgggcgtaagttattttcacataattcattcgtcggtcaatggaaattcgctctcgttaccgttcaccttaatttaaatatccatttgttttctttttaattttggttcgttcttggcgtaataatttttgccaagccaaagactttcatcgaaaccaaaagaaaattaatttactttaagaaaattcgtgatattattgttttactatcaatagatttttgaattgtatttacctaaacttttttttttctgctttagcgacaaaagaaaatggtcaaagacaaaaaatattacgacatcctcgaagtaaacaccagtgcaacagaccatgacttgaaaaaggcctatcgaaaattagcgtatttacttccgcgttatgactttattaatcgcccctttttaggcttaaatatcatcctgacaaaaatccgaatgaaggcgaacgttttaaactcatttctcaggttttcttttctctgtctttgtaagctgtttcatttttcaggcttacgaagtgttgagcaaccccgaaaagcgtaaagtatacgacgaatatggagaagaagggcttaagggtggcggagaaggcggcggaatgcacaatccaatggacatattcgaaatgtttttcggcggtggtggtaagggttggattcatttgtccttgtttaactgctgttgcaaatttttaggttttcgtggcggtggtgaaaaaccgaccaaggtcagagatactgttcatcagcttaccgtttcgttagacaaactgtacaacggatgcaccaaacacttgcgcatcacaaggtttgcatcattgatattttcgaagattttctgacacggtctgagaagaggggtaatactatagatggtaccccccctttttgacgaaaattttttttgttctgaaaagtcttggaaacatgtttatggggggtttcagggtcgctgatcacgaatatgaccttcattggaccaatttcgaataccggacccgaattcgaacaaaaagtctaaaactcaaaatttaaaaaattctcactttagttcctaaattgattaaaacgtgctaaatttggtcacaaaccattggaatatcaaagaatggtcattctatacagctacgaacataaaagtgaattttcaaaattttgattttcttcaaaaaggggggtaccatctatagtattaccagaagaggaattgggttggggtggcatttgccattttgaaagaaataatattttttcgaccccttaatattttcaattttgttcaacacttaatttattattcaggcatatcctttgtccgaaatgtaatggtgtcggcggcgctaaggaaggggtcaaacaatgcgaaaattgtcgtggacgcggactggagattcacaacatgcaaattggtccgggaatgattcagcgaattcaaagagcttgttctgaatgtggcggtgagggggaaataaatcgcaacccgtgcaaacactgtggcggcaaaaaacgggtgcgttatatcgaaaatagtccactaaaactatacttcgatgaaaaaatggtggggggggggactttcaaaaacctcggaattttttgctcttttgtctgatagtttctctttaaaggcattaatttgttttacagatcaaatcagaagagacaatcgaagtgcatattgagaaagggatgcgcgacgggcagcgactgatgttctacggaaagggcgaccaacagccggggctggagcctggcaacgtgatcattgtgctggacgaggaggagcatcccgtgttcacgcgaagaggcaccaacgtcaccctgaacatgaaactgacgtga

SEQ ID NO: 47642 - DNA, 1064 bp, Heterodera glycines
  Genomic contig location: Contig_ID=SeqID_20282; Location=97..1160; Strand=+
  SCN-specific regions: Sequence locations=1-590,623-1064
ctgtgcatacacatcggtggcggtgtaaagtttgactatttcatgctcaatttgcacccgcgcggtccaaccgttgcggacgaaacgtacgacgagcgcgtgatcgaagtgcgccgtgaccccaaccgaacgccgtacattgcgctagttgcgggtgtcaaggttcctattttggcaattttggatacatttagtaatttgtaaccattgagaaagatgtccaatcctccaaagttcttacgccacaaaaaaccaaaaaaatatgaaaaaatatagtttgtatatgcgagaaaaaattatggggcctcaaaaagcgaaattttgactgtattaccttgaggttgggtttggatagggcaattcgattgaaaactgatgatcttttttgccgtcttatcgggttctctagacgcccaaaacgcaaaactttttttttcaaattgcttaattttgctccgttcagggaaagcgttggatatacgccacgcagaacatgcaggccggccaaatcatacaaacgacgtgtcacattccggaacggccggtcattggctgtgagggcaactcatacccattgggtgtgcaattcgtttttgtaaaaaattaatttatttcatttttgaatgacacgttgttttttaagtgctacgtcctcctcaattggaaaaattttttttatccgaaatcctttttcgtttcaaaatccgtcaattttcttttgcaggcgctttggtcgaagggacaatggtgaattcgattgagcttcatcggaacaaccctaactgtatttcatttttttgttgaattttcgtacatttgggcggtgaaaattgatcatttgcgtcctctttagcgcacgtggtcatcaccgaggcgggcggttgtgccgaaattattcgacacatggacgaattcactgttgtccgggttggtcattcgttggtggtcccaaattttaatagatttcctctagaattgaacaattaactccccaaacttttagccattaattccaattccatttttttcagatgccgaacaaatatgaatacgcggtgcgcaag

SEQ ID NO: 47643 - DNA, 953 bp, Heterodera glycines
  misc_feature (52)..(52): n is a, c, g, or t
  Genomic contig location: Contig_ID=SeqID_20283; Location=1..953; Strand=+
  SCN-specific regions: Sequence locations=1-305,328-418,440-953
  Gene Ontology: Cellular component=cytoplasm; Biological process =coenzymes and prosthetic group metabolism
gctgtcctttcatgtttaacgcagttaatttatgccttttgtcagactttcnccagtggaatcggtgttgctctgttatcggcatggaggacaacgccattttggcgagaattacctgcaagaattggagacaaaagctcagcaaatggctgagcatggggccgaccaaattcgatggcattacattggccgaatacaatcgaacatggtaactctgcatctttgacaggattttattcaggcatttcaaaaaaaaaccacaaaaagataaatcgcatttgtgccgtgcccaatttgtggtgtgtggaaacggtggacagtgttaaacatgcgaatggtcttcagagggcaatgaatgcgatggggaaaccattgaaaattttcattcaaggcaaaaattgcagaaaaattctaaaaacaaatttgccaccaattttcagtaaacacaagcggcgagctcaacaagggcggtgtacatcctgaaggactgcttccattggccacacatgtcacggaacagtgccattctttgacactgatcggtgggtagaggtccaaaattgaaaaaaaaatttgttagaaccccgctacgacctgccctaagattacggaatcaggaatcccgcaattgtgtccataagcatttttgaagaattttaaaggtttgatgacgattggatcgattagccaaagtttgggaagcggagacgaaaatgcggactttgcactgctccgaaagttgcgtgacgcattgcaaacggaactgcggttgtccaccgagttggagttgtccatgggaatgagtgccgactatcaattgggtgcatgccgattccgatcactttctcatcactgataaactgttgttcaatctattttcagcgatcaaatatggcagtacaaatgtgcgcgttggttcgaccatttttggtgtacgaaattatgccaaaaaa

SEQ ID NO: 47644 - DNA, 356 bp, Heterodera glycines
  SCN-specific regions: Sequence locations=1-72,100-169,204-329,353-356
agaagaatttctcaaccatcataggaccgaatagatgaatagtgttttatcgatctccattttattcctgctcagccaggttctttccactgtctcctctagcgatgtgttggaatacacggatgctagctttgactcgggaatgcagcagcacgacatcgcattggcagaattctatgccccctggtgtggacattgcaaaaaactcgctccggaatacgaaaaagcggccactaaactgaagaacaacgacccaccaattccactcatcaaagtcgattgtactgcggaaaaagagacttgcgataaatttggagttagcggttttccaacattgaaaatcttcaggaaggggc

SEQ ID NO: 47645 - DNA, 700 bp, Heterodera glycines
  SCN-specific regions: Sequence locations=1-86,111-186,208-679
gtacagccacgagcagagcatcgaccagaccagcatcccctaccaaatgggatcgaacaaatacgcgtcgcagaagggcatgaccggctttggacagccacgttgggaggtgcttgacccgtccatttcgtaccagaaccgcaagtcgcaaggcatggttcgtctccaatccggcaccaaccgattcgcctcccaggcgggcatgaccggctttggcacgccgaggaacaacacctacgaggcggaggcgggcgagctgccttacgaggatatgaagaagtcggaggcgatcatcccgtcccaggccggatggaacaagggcgactcgcagaagctgatgaccaactttggcacaccgcgtgacgtgaagggcaaacatttgaagcgcatttgggaattggagtacccggaggaagccgaagtgtcgctggaccgtctctgatcagcgacacggattgaattgtgctgctgatcagcacatgaatacacacggaggaaggaggagtaggacaaatgccatcgtcctcatcaagttggagcagtacacacccaccacaccgtcatcctttgccgtccggagagtgatcgatccattgtttgatagattgattgatcagaaaacatccatccatcctccgatcacagcccctggcattttttgctgcttaaaactttgtggttttaaaaaaaaaaaaaaaaa

SEQ ID NO: 47646 - DNA, 437 bp, Heterodera glycines
  SCN-specific regions: Sequence locations=27-411
aataagaccaagccgatctggacccgcaatcccgatgacatttcaaatgaggtgtgaatttaggcttccttattcacttgctttgagctattttttttctaattccaggagtatgcggagttctacaagagcttgtcaaatgactgggaggaccatcttgctgtcaagcatttcagcgttgaaggccaactcgaattccggtcggtcttgccttacctatgtttattctattactagtaatgagaaattggtgtcccagcggaatgcaaaaaggattttttcttgagcgaagaataagctggcaaaatgaacttattttttctagtgctctcctcttcgtcccccaacgcgctccgttcgatctctttgagaacaaaaagagcaagaatgccatcaagctttatgtccgtcgggtcttcatcatggacaactgcgaa

SEQ ID NO: 47647 - DNA, 2029 bp, Heterodera glycines
  SCN-specific regions: Sequence locations=1-80,137-171,211-259,301 -400,425-451,509-534,557-566,592-606,656-656,692-754,785-821,845 -856,881-888,910-913,942-1186,1208-1328,1352-1368,1403-1434,1456 -1457,1490-1501,1550-1568,...
  SCN-specific regions: Sequence locations=...1601-1637,1662-1696,1742 -1784,1823-1832,1862-1946,1976-2029
gtcaaattgctttttcaaaaatgccatctaaagctaatgcaattggtattgacctcggcatgacgtattcgtgtgttggagtcttccagcacggaaaggtggagatcatcgcgaacgaccaaggcaaccgcaccacgccgtcctatgtcgcgttcaccgacaccgaacgtttgatcggcgatgcggccaagaaccaggtggcgatgaacccatccaacaccgtgttcgacgccaaacgtctcatcggacgcaagttcgacgacccggcggtgcagtcggacatgaagcactggccgttcaaagtggtgcagggagagggtgctcgtccgaaagtgatggtggaagtcaaaggcgaggacaaagcgttcttccctgaggaggtttcgtccatggtgcttatcaagatgaaggagacggccgaggccttccttggccagactgtcacggatgcggtggtcacagtgcccgcttacttcaacgactcgcagcgtcaggccaccaaggacgccgggaccatcgccgggctgaacgtgttgcgcatcatcaacgagccgacagccgccgcgattgcctacggcttggacaagaaggggcagggtgagcgccatgtgctcattttcgacttgggcggtggcactttcgacgtgtccatccttaccatcgaggacggcatcttcgaggtgaaatcgaccgccggtgacactcatctcggtggcgaggacttcgacaatcgaatggtcaaccactttgtcgcggagttcaagcgcaagcacaagaaggacctcagttcgaaccctcgtgcgttgcgtcgtttgcgtacggcctgcgagcgcgccaagcgcactctgtccggttccacccaggccagcatcgaaattgactctctcttcgacggcatcgacttctacaccaacatcacgcgcgcccgcttcgaggagctttgcgccgaccttttccgcaacaccatggaccctgtggagaaggctttgcgcgacgcgaagatggacaagtcccagatccacgacattgtgttggtcggcggctcgactcgaattccgaaggtgcagaagcttctctccgactttttctccggcaaggagctgaacaaaagcatcaacccggacgaggcagtggcctacggagcggctgtccaggcggccattctttccggcgacaaatcggaaactgttcaggacttgctgctgcttgacgttgcccctctctccctgggcattgaaacggccggcggcgtgatgacttcactcatcaagcgcaacacgaccattccgacaaagacgtcgcagacattcaccacctattcggacaatcagcctggtgtgctgattcaggtctacgaaggcgagcgcgcgatgaccaaggacaacaacctgctgggcaagttcgagctcagcggcattccgccggcgccacgaggagtgcctcaaatcgaagtcactttcgacatcgacgccaacggcattctgaacgtgtcggcccaggacaagtctaccgggaagcagaacaagatcaccatcaccaacgacaaaggccgcctttccaaggaggaaattgagcgcatggtgcaggaggcggagaagttttccaaggaggacgaggtgcagcgtgaccgtgtgtctgccaagaacgccttggagtcctactgcttcaacatcaagcagacaatggaggactcaaatctgaaggacaagatcagcgaggacgacaagaagaaggtgctggagaagtgcggtgaggtgctggcatggctcgacgccaaccaggcggcagagaaggaggaatttgagcaccagcagaaggaactcgaagggatctgcaatcccatcatcaccaagctctaccaagccggcggcgcaatgcccggcggtccaatgcctggcggagggatgcccggaggtggcggcgctgctggtgcgggaggagccggtggaccgaccatcgaggaagtggactaagcgagtcgatctcttcgcgatcattttttgtttgatcgattatttaattttaaaaa

SEQ ID NO: 47648 - DNA, 1443 bp, Heterodera glycines
  SCN-specific regions: Sequence locations=1-267,289-645,669-746,795 -1095,1117-1180,1203-1419
atcgagcgccaagtgcgcaacgacgcgctgtgggccggcctcgccatccgacggggatggaagaagtacttcttttgctccaaggaccaggcgacacgcgcaatttctcagtcgtggagacagccgaagaacggggaggacgcgttggagttccagcacaaattctaccgcgaactttacccaaaaatcactgctgacattcggcaaattgagcagaattggcgcgagggacgacatcgattggagcgcatcaattgccaatcggagaatagcaaaggtgtctactgtctccaatacgacgacgaaaagatcatctcgggactgcgcgacaacacaatcaaaatttggtcccggcccagcctcggctgtgtgcaaacactgagcgggcacaccggctccgtgctgtgcctgcagtacgacaaccagatgatcgccagtggcagcagtgacgcgacagtcagaatatgggacgtgaacacgggtgagcaactgaagacgctggtccaccattgtgaagctgttctccacctgagatttcaggacggcatgctggtcacatgctccaaggaccggtccatcgcggtttgggacatggcatcgcctcgtgacattgaagtgcgtcgggtgctcgttggccaccgggcggcggtcaacgtggtggactttgatcacaaatacattgtgtcggccagcggtgatcggacaataaaggtatggaatgccagcacgtgcgagttcgtgcgcacactgaacggccacaagcgtggcattgcctgtctgcagtaccgggaccgactcatcgtgtcaggctccagcgactattcaatcagactttgggacatcgaatgcggcaactgcttgcgcgtgttggaaggccacgaggagttggtgcggtgcattcgcttcgattccaaacgcattgtgtccggcgcttacgacggcaaaattatgatctgggacctggcggcggcacttgacccgatgacaccgcccaactccatctgtataaagacactttcgcaacacaccggacgcgtttttcggcttcaatttgacgagttccaaatcatcagcagctcccatgacgacaccattctcatctgggacttcctcaacacgggcccgtccgccgccgttgccgcgggcgctgcggcagcagccgcgcacaaccaggccgttcaacatcaccaagcagcacccgcagcccaaccggctgctgcagcgatgcccgggggcgctggtgccgcgccggccgccgctatcattccgttggcaccgccgccgtccccataaaaagcaaacctaaaaatgctgaaatgatttgatgaatatacaacactttttaattccaaatgtttcgtttcgcttttttgtgggatttccttttatgttttcttcacaattttgtgtattatggtgaacaacaaacaaacaaatgaaaaa

SEQ ID NO: 47649 - DNA, 1245 bp, Heterodera glycines
  SCN-specific regions: Sequence locations=1-1058,1080-1143,1166-1245
ttgaggtttttcgagaaatgacaaatgagcgtgatttttctcacgatgaccacattaacaacgctgttgggaccaatggcgacagtaaagacgcagccaaaagaaaggacatctgccgtgattttctgaataatatttgcagcagggggaatcgatgcaaattttatcatccggaagacagtgtcgaaaagaatcaaaactcggcggatgagccttatcagttctgcattgattttcagaaccagggctgttaccgcgaaaattgtcgttatgttcacgcgtttcgcgaggatgtcgatcgttacaagcgcagcggcgacgtgacgcttgggttggcgcgagctttggcagcgctgttgaaaggcgatacgataaatggaattccgctttgcaaagagttccaaaatggacactgcgcgcgcggcccgcaatgtcgctattggcatatcaatcgcgacgaagagcgacgcaaacgctttggcggcggcaggaactgcggcggttcgccttcgtcgcttgcgttcggcgcttacccggcggtgcctccggcaggagcgcaactcagcagacgaagaggtgacgagttcgtcagtgaagattttgcaccgccctccaaacgatcttttgctcacaatcagccgtttgcaacgattcccggacagatggctccaacgtcagcaccaaccgcaccgtctcacccgtcacctcaattagtcattgagttggaacgtcgaaacgcggaattaaccactgaagtggaaagtctgaagagggagcttaaccgggaaaaggagcgttacgatgaccttatgtcgctttttcgagccgcccaaggccaaccgacggttcaacgttcggtgatttcgactccgtctttggtacccgccaatttgcagccaaacatttcttcactaagtgcgcttcaacaacaacatcagccgcagtctctgcagcagtggagcgcaacgtcaacatcgcaacagccaaattggacaaaattcgattggggtgcaaattgatcaatgaaatgatttgtcaccattacgattccctttaaatgaaccacaaattccttttcaacatatgaactgtttcctcttcctgtggttgtttcccttttggcatgctatcgtatctaactgagccccccccccccccggggggcaaagggatcattggggaagccactcaattttttgtatgtttaatcaatcacctgcataaattcaatttttttgaaaaaaa

SEQ ID NO: 47650 - DNA, 639 bp, Heterodera glycines
  misc_feature (569)..(569): n is a, c, g, or t
  SCN-specific regions: Sequence locations=1-391,414-639
atgcacttgattaacttaatcgccctctttttcatgcttttcggcccatccgtccagcaatacacaaaaacgccaacgaatgaggacaaagaagcggctgtcaattgtcacaacaaattccgatcgcaattggccctgggcaatgccgacaataaattgggcggcaacaaaatgccaaaggcgggcaacatgcgtaagtttgaatgggacgaaaacttggccaaacttgcggatgaatgggccaacaaatgcacattatcgcactcgtggaacggctgggcaggcgaaaatttggcaatgaatggcggaacattttcgaacaaggatggcttcgagtacgcttgcggtcgctggtgggacgaactgaaccgttacgggttcaacccggatctgattatgaccggggaaaacttcagtggcatcggccattggactcagatggcgtgggccgacaccgaccgaattggctgtgccatggcacaaaactgcccaaataccaattggaaaacatatgtggtctgctggtattacacgggtggtaattactttggtgcgcctgtctatttggnccgggagccgtgcagcaaatgcaaagcaaatgacaaatgtgacaaagccactggactttgctctcaatga

SEQ ID NO: 47651 - DNA, 881 bp, Heterodera glycines
  SCN-specific regions: Sequence locations=1-500,523-582,604-881
atgcacttgattaacttaatcgccctctttttcatgcttttcggtaagtcaattgtttaaattcattagcgggataattgggtaattattttgctaatcgtttcaaggcccatccgtccagcaatacacaaaaacgccaacgaatgaggacaaagaagcggctgtcaattgtcacaacaaattccgatcgcaattggccctgggcaatgccgacaataaattgggcggcaacaaaatgccaaaggcgggcaacatgcgtaagtttgaatgggacgaaaacttggccaaacttgcggatgaatgggccaacaaatgcacattatcgcactcgtggaacggctgggcaggcgaaaatttggcaatgaatggcggaacattttcgaacagttcgatacaaattgataattgtggctactaattgcctgcttaagaggatggcttcgagtacgcttgcggtcgctggtgggacgaactgaaccgttacgggttcaacccggatctgattatgaccggggaaaacttcagtggcatcggccattggactcaggtgacctattcattatttcgccgtttctagtcccattattgctaattagacactaattagttttctcttcgttttgttcagatggcgtgggccgacaccgaccgaattggctgtgccatggcacaaaactgcccaaataccaattggaaaacatatgtggtctgctggtattacacggggtaataatcaaccactgataaaacataattagtttactaataccccttttagtggtaattactttggtgcgcctgtctatttggcccgggagccgtgcagcaaatgcaaagcaaatgacaaatgtgacaaagccactggactttgctctcaatga

SEQ ID NO: 47652 - DNA, 1555 bp, Heterodera glycines
  SCN-specific regions: Sequence locations=1-55,95-248,271-349,373 -1335,1357-1395,1422-1555
atggagcattttccttctaaatttgttctctgcttgctcattgcattcatcggtgaattaatttaaaaaaaaataacaattttagttaataattgaaatgtcacaaaattagcggataataaaaaaatgaggagttgttggtgcggtaaaagagaatcgggaaattaggaatgaaggcaaaaatttaatattggaagaaaaataaataaaaaaccaaaatttcatattagatcatttctcggatcaaaaattttccaaaatcagaaacatcgggccgaaaaaaacagattttggggtcgaaaaccagaaccttttgcaaattgctttaaatcggcttgtgtaacaattgatcatttaaatataatatcacattttgattttgcacctcacattatcggttttaataattttttagggattagattagcaaattgtatatttcggtgcaatcgggatcaaaaaaaaaatcagatttttcattcgctacatgaaatttcccgggctctaggggccccaaaaaaaccgaaaattctcgactcaaaactctgtactccgactgctgaatatttttacataattcctttccattcaattaaacactaataatataatcttcaaattcgcagccgttccatgctctgttttggcactttctgctggcagccgcgtgtcgatgctcgcgtgccacaacaattaccgctcacaactggccaaaggcactgcggacaacaaatcgggcaaaatgccggctggcagcaatttgatccaacaaaaatatgattcgaatattgagtcggtggcgcagaagtgggccaacggatgctcaatgtcccactcgggttcatcagggatgggcgagaatttgtacatgactagttcatcgacaatttcggaaggtttaattggggtgcaatttttaacagattaggcaattaaaattcaagggggacggcggcaaatcttttcggtttatgcctgtctgctaattggctattaatctaccataaaagtcacattatttcctgggcctactttaagcatacatattagtttaaatgaggaagaccattttgcagctgatgcgctgaaacaagcttgtgacatgtggtgggcggagttgaagcagttcggctttcagtcaagtcttgtgctggacatggctcagttcaacaagggcatcggacattggagccaggcaaatgaatattagagctaatcaaattaattttgttgctttcagcaagcatgggcctccactgcacaaattggctgtgccatggcacgttgtccctcctccacctggaagacatgggttgtgtgcaactacaaggaggcgtaagcaaaaatggaattattcttagctttattaacgtcgatttaaatgggttttttctgattaatttattttattttatattaatctaattcattaattctcaacagtggcaacttcttgaaccagccggtctacaaaaaaggtgccgcgtgcagcaagtgttcggattacaatggggcgacctgtgacagcgccagcggactgtgcaaattgccataa

SEQ ID NO: 47653 - DNA, 2057 bp, Heterodera glycines
  SCN-specific regions: Sequence locations=1-6,28-207,229-949,971 -1791,1813-2057
ccccgccatgccgtcccccctgaaaatggcggcccttccccctttggctgtggttgtccttctcgtcgctgtcgtccttcccgaagcactgttcgccctggaagtctttaccaaccattttctcgtccacacgaataccgccggaacagaaaatgcgcatcgggtggccaaacggaatggcttcgtcaaccggggcccggtgctcgggtcggacacgcaatggcattttgtacagcccgcactttcccacgcgcggactcgtcgatcggtcggacacaacgccaaactctcacaggataaagacattgcttatgtggaacaaatgactggttataagcgcttaaaacgcggctaccgtccgctggctgaccgtcttcaaaaacagctcgacttcacttcagttcaatcgcccaccgaccctttgtaccctttccaatggtatttgaagaacgacggccaatcaaatgggaaaccgcggcttgatctgaacgtggagaaggcgtgggctctcggatacaccggcaaaaacattacaacggcgataatggacgatggggtcgattacatgcatgccgatctccgcttcaacttcaatgccgaggcgagttacgacttcagctccaacgacccttacccgtacccgcggtacaccgacgattggttcaactctcacggcacgcgctgtgcgggagagatttcagctgctcgcgacaacggaatttgcggggtcggcgttgcctatgacagcaaagtggcagggatacgaatgcttgaccagccgtacatgaccgatctgatcgaagccaattcgatgggccacgagccgaacaaaattcacatttactcagcgagttggggaccaacagacgacgggaaaacggtggacggcccaagaaacgcgacaatgcgagccattgtaaagggagtgaatgagggtcgtttcggtctcggctccatttttgtttgggccagtggcgacggtggcgaggacgacgactgcaattgcgatggatacgcagcatcaatgtggaccatttcaattaattctgcgattaacaacggcgaaaatgcacattatgacgagagttgctcctccactttggcctcgaccttttccaacggtggtcgaaacccggagagtggcgtggccaccaccgacctttacggccgttgcactcgttctcattccggcacttcggccgccgcgcccgaagctgccggcgtttttgcgctgactttggaagcgaatccgaagctgacatggcgcgacctgcagcacctcaccgttttgacgtcatctcgcaattctctcttcgatggtcgctgtcgggaattgccgcctctcgaattggaagacatcaaacggcagttggtctcgcggcaggcgagctgctcgcacttcgagtggcaaacgaacggagtcggtctcgagtacaatcatttgttcggttttggtgtgctcgacgccgcagaaatggttctgatggcaaaggtgtataaaacggcaccgccgcgctttcattgtgaggcgggcacaattgaaatgccaagggaaatccccgcaagcggcgaaatggtgctgacgctgaggacggacgcatgtacgggttcaacaacggaagtgaactttttggagcatgtgcaggccatcgtgtcgctgaacagctcgcgtcggggagacacgacgctgtacctcatctcgcccgccggcactccttcgatgattctctcgagaaggcctaaggacgacgatgccaaagacggattcaccaattggccatttatgacaactcacacgtggggagagaaccctcgcgggcgttggcgtttggtggtgcgcttccaaccaggcaaatcgacgccgaagggccataaataccgagggacgctgaaaaagttcacgctgatgctgcacggcacaaaggagccgccttatcgcggcattgagcccctgcagggacacgccaattccaagctgagtgtggtgcaaagtgcgcacaaacggatggcaaacaggcgatgatggcacgacagacgaatggacgaacgatggaaaa

SEQ ID NO: 47654 - DNA, 1367 bp, Heterodera glycines
  SCN-specific regions: Sequence locations=1-130,172-241,263-284,820 -820,1039-1043,1078-1083,1226-1310,1353-1367
cgacagcacacacagccgaaaagcgcttcttctcatcgccttcgccttcaaaactttgaagcaccaatcccaaccagaaaaaatgtgcgacgaagaagttgctgctctcgtggtggacaatgggtccggaatgtgcaaggccggtttcgcgggcgatgacgcgccccgcgcggtgtttccgtccattgtgggccgcccccgtcatcagggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgcgtgtcgcccccgaggagcacccggtgctgctcacagaggccccgctgaacccgaaggccaacagagaaaagatgacccaaatcatgttcgagacgttcaacacgccggccatgtacgtggccatccaggccgtgctgtccctgtacgcctccggccgtaccaccggtctcgtgttggactccggcgatggtgtcacccacaccgtgcccatctacgagggttacgccctgccccacgccatcctccgtttggacttggccggccgtgacctcactgactacctgatgaagatcctcactgagcgtggttactccttcgtgaccacggccgagcgtgagatcgtccgtgacatcaaggagaagttgtgctacgtggcactcgacttcgagcaggaaatggccactgccgcctcctcctcctcgctggagaagagctacgaactgcccgacggccaagtgatcaccgtcggcaacgagcgcttccgttgcccagaggcgctgttccagccgtccttcatcggcatggagtcggccggcatccacgagtccacctacaactcgatcatgaagtgcgacatcgacatccgtaaggacctgtacgccaacaatgtgctgtccggcggcaccaccatgtacccgggcattgctgaccgcatgcagaaggagatgaccgcgctggccccgtccaccatgaagatcaaaatcatcgctcccccggagcgcaagtactccgtctggatcggcggctccatcctcgcctccctgtccaccttccaacagatgtggatcagcaagcaggagtacgacgagtcgggcccgtccattgtccaccgcaagtgcttctgagcagcagctgcacgaccgcacggaggaggaggagaagaccaacgaagccgggacactcgccatccgccgacccattcgccaccccccaccaccatctgttttttgctgaaaattatgcaaaaatatttttgaataaaatctatgaacaaaaaaa

SEQ ID NO: 47655 - DNA, 463 bp, Heterodera glycines
  SCN-specific regions: Sequence locations=1-439
atgactagttcatcgacaatttcggaagctgatgcgctgaaacaagcttgtgacatgtggtgggcggagttgaagcagttcggctttcagtcaagtcttgtgctggacatggctcagttcaacaagggcatcggacattggagccagcaagcatgggcctccactgctcaaattggctgtgccatggcacgttgtccgtcctccacctggaagacatgggttgtgtgcaactacaaggaggctggcaacttcttgaaccagccggtctacaaaaaaggtgccgcgtgcagcaagtgttcggattacaatggggcgacctgtgacagcgccagcggactgtgcaaattgccataagtgaggggagaatgcttggaagaaggattttttaatttgatttatgaatattgtagaatgggagtgaataaatgggcattaattgaaaaaaaaaaaaaaaaaaaaaaaa

SEQ ID NO: 47656 - DNA, 750 bp, Heterodera glycines
  SCN-specific regions: Sequence locations=1-699,722-750
atggcggatgagcttgtggcgcttgcaccaggaacgcgtgtctcaggccgatggaccatcctaaagaagcttggcgccggagcatttggagccgtctatttgtgcaaagatggcaagggaacagtggcagcgctgaaaacggagccaatcgacacacgtcaaccgcttcttgttatggaggccaccgttttggacaccctgggcaaaaaacttaagaatgctgatggtcaacacttctgccgtctgttggaccttggacgtagtgaacaacggaatgctacgtctggagatacggtgttcaactacgttgtcatgactgtggttggcactccgttggacaaacttattcgaaacgcgggcgatcgcttcagtccgggaaccgcaatcggcatgtcaatccaattgctgagtgccatcaaggctcttcacaatgtcggtttccttcatcgcgacatcaaaccagcaaacacagcgattggacgggcggagaccaacgaacatcgacttctctaccttatcgacttcgggatggcccgtcaatttcttcggcccgatggtacgcagcgacgtccgcgagccttcgcgaatttccgagggacgccaatttacggcaccgatcctctgcacatatcaagggtgactacagccgcaaagatgacgtcgaatcgtggttttatgtcatggtcaaattctacaaaggtgctgtcccctgaaaatttgcgaatgacgtcaaggagatcggaaggatga

SEQ ID NO: 47657 - DNA, 511 bp, Heterodera glycines
  misc_feature (304)..(304): n is a, c, g, or t
  misc_feature (312)..(312): n is a, c, g, or t
  misc_feature (364)..(364): n is a, c, g, or t
  misc_feature (461)..(461): n is a, c, g, or t
  misc_feature (475)..(475): n is a, c, g, or t
  SCN-specific regions: Sequence locations=1-13,35-35,59-511
atgacggacactgcaaatcgacagcgacgcggccgaggcgagagacgcacacgagtgcttctacgcgacagtgccaagaaaatcaccaaagcgtccattcttcgtctggcccgacgcgccggtgtcgcccgaatcaacgcaagagtctacgacgaggtccgtgccgcgctgcgctcgtacttggaaaccatcattcgagacgcggccatctactgtcagcacgagaggcgcaagaccatgaagagccgggatgtggtacacgcactgaggcgccagggcaatttgatgtacggcttcgaacaanaagcgcanggaggaggaggatggatatatttggaaccggcaccatatgatattttcgganaatattattattgtacatatgtgtgtatatgcctatattgtatattgttatgtcgatgctattgtacaccattttatccgtgtaattgtgacccgtnattattattgtctntgtgtgttgatatttgcgtattttggtacgataaaa

SEQ ID NO: 47658 - DNA, 457 bp, Heterodera glycines
  SCN-specific regions: Sequence locations=1-457
atggaggactcggacagacagttatttctgcgcaacgaaacaatcgccgaacaattcaattcggttaaacgattgaccgatcaaagtcacgtcaaatggttcggaaatgtgcgaataatgacggagagattgtcggaattccaaggcaaaacgaagtcaaaaaatggacaaaaaacggatggaaaaaataaaaattcaccggcaaatttcaaaatgtatccgtcgcgggacattggaattctgacggaacaatcgcaaagggacaaaatggcgatggccgaaaaacgggcttatgtggacacgcaaatggagagaattgggaaggcattggacgaaataatgccaaaaaacggacaaaacgaatcttttgggggcgacagaataacgcaaacggaatgccataacgaagtgatgcacactttcaacaaaatttgttttaatttctcaaagagtccgt

SEQ ID NO: 47659 - DNA, 551 bp, Heterodera glycines
  misc_feature (115)..(115): n is a, c, g, or t
  misc_feature (226)..(226): n is a, c, g, or t
  misc_feature (262)..(262): n is a, c, g, or t
  misc_feature (307)..(307): n is a, c, g, or t
  misc_feature (394)..(394): n is a, c, g, or t
  misc_feature (458)..(458): n is a, c, g, or t
  misc_feature (484)..(484): n is a, c, g, or t
  misc_feature (515)..(515): n is a, c, g, or t
  misc_feature (539)..(539): n is a, c, g, or t
  SCN-specific regions: Sequence locations=1-551
atgtttggaagcattctgagctgcaagattgccactgacattgagggaggaagcaaagggtatgggttcatccattttgagactgaggaagcggcgaacaggcaattgcgaaagngaacgggatgcttttggatgggaagaaagtgtttgttggaaaatttgtgccacgcactgctcgtgagaagcaaattggtgacccgtccagtcgtttcaccaatgtttatgngaaaaattttggcgaggcaatggattcggagaagcngagcgaagtgttctcacagtatggcgaaatcatcagtgcaaaagngatggaggatgacagcggcaaatccaaggggttcggctttgtcgcctacaaggaccatgaaagtgctgcgagggcggtggagaagangaacgaggtttcggtgccaggcagtgagaaggtcgagcaaaagtttacggtgtgccgtgcgcanaagaagagcgagcgccaggctgagcngaagcgtcgttactagcagtacaaagctgancgcattcagcgttatcagggagtnaatctgtacgtc

SEQ ID NO: 47660 - DNA, 461 bp, Heterodera glycines
  SCN-specific regions: Sequence locations=1-123,145-306,328-461
gatgatcaactgctgcgcgacacaattttccaaaaatggatgggaatattggattcctcacaaaatatgttccgtcatgagcttgctcgcattgagtatctgtcaactgcggacgagcgcttacaatggaacaataatggaatgccgaaggacgaattatgcacggagaatgccattatgctcaggcggttcaaccgtttcccattgatcatcgaccccagcggacaatccatcgaattcatttgcaaagaattttccacagcatctggcaaggaacatcaaaagggaggctcggtggcaacaacggttcaactgactagttttaatgataattcgttcagaaagaatcttgagtcagcgcttcggtttggcacaactttgcttgtgcaagatgttgagtcctatgatccgatcctcaatcctgtgttgaataaggaggttaagcgaactggcggacgtgt

SEQ ID NO: 47661 - DNA, 720 bp, Heterodera glycines
  misc_feature (618)..(618): n is a, c, g, or t
  misc_feature (642)..(642): n is a, c, g, or t
  misc_feature (659)..(659): n is a, c, g, or t
  misc_feature (672)..(672): n is a, c, g, or t
  misc_feature (690)..(690): n is a, c, g, or t
  misc_feature (704)..(704): n is a, c, g, or t
  SCN-specific regions: Sequence locations=1-720
atgcgagatctgttcatcgaagacaacagcccgatcactccggcccggcttgccgaactgatcagacatttctacgcgttgggatggatgcgcgataacggcggaggaatggcggtcctttgcaacggcgccgtgttcggttcgcccacttcggtgcagaaggagaaagtgcccgaaaatgatctgtttgtaattgatgctacgaccggcacagtactgaaacggccgcaaaacgcggcgagtgttccgagtgccacctgcggactgttaatgaacacaggtctgaactgcgtaattcacacccactccaaatacgcaaatcttgtctctcagttggtcacgggcaacgaattcgccatccaaaaccaggagatgattcagggggtcgagaatcgtagcagcggactccgtctcgacaacgtcgaccgcctcgttgtgcctatcgttgattctgagttaaacgaacaaatgctcagtcctgttttgctccgaactttggacaaatacacagaagcatcggccattttggtgcgtggccacggcttttttgtgttcggctcttcacttgctggcagtctaccaaaagtgatgttggagttgtttccgagtacccttctnttgagtttagccttgctaaatgantcaaatacaaattgccnatttggtgcccanaaattcgccgtaaatttnaaaataattgccgncccaattttccctttt

SEQ ID NO: 47662 - DNA, 659 bp, Heterodera glycines
  misc_feature (531)..(531): n is a, c, g, or t
  misc_feature (587)..(587): n is a, c, g, or t
  SCN-specific regions: Sequence locations=1-274,296-659
atgaacgaggtttcggtgccaggcagtgagaaggtcgagcaaaagtttacggtgtgccgtgcgcagaagaagagcgagcgccaggctgagctgaagcgtcgttacgagcagtacaaagctgagcgcatccagcgttatcagggagtcaatctgtacgtcaagaacctgcacgataccatcaatgatgagacacttcgaagcaattttgaatcctacggaaacatcacaagtgcaaaggttatgtgtgatgagcatggtcgctccaaaggattcggttttgtgtgctttgaaaaggcggatgaagcaaccaaggctgttgtggaaatgaacaacaaaatcatcgaaaacaagccgctttacgtcgcgcttgcgcaacgtaaggaagaccgcaaagctcaactggcctcgcagtacatgcagcgcttagccgcgatgcgcatgcagaaccctgctggcctcatggggacaatgtatgcgcctgccagcggtggatttttcctgccacaggccatccagaaccaacgtgcttgngccgttcatgcaaacaccgaatctgtccggggcacaaatgcgtggcgctgtccctngctggaacaatatgggcggcttcaaccatcccaatgcaaggctttcatgatgggttccagctgttggcggtt

SEQ ID NO: 47663 - DNA, 396 bp, Heterodera glycines
  misc_feature (316)..(316): n is a, c, g, or t
  misc_feature (358)..(358): n is a, c, g, or t
  misc_feature (385)..(385): n is a, c, g, or t
  SCN-specific regions: Sequence locations=1-396
actcgggatgagatacaggaagtgcggaagagcagggaccccatcaccagtttcaaagatcgcattgtcacggcgggacttgtcactgaggaggaattaaaggacattgacaagaaagtgcgtcaggaggtggacgaggcggtcaaagtcgcactttcagacgaagttttacctccggaaacgctcttctccgatttgtatgccaacactccgccgcttgcggtgcgcgggacgactgccgacgcaaccgtcacacagccatttgtgagcacggcggaagtgttgagaaaaatggggagggagccgaagaattatngagagaacgaacggacagatagccaaagacgcattgataatnaggagaagcacggaataattaattgtnagtcaattatt

SEQ ID NO: 47664 - DNA, 153 bp, Heterodera glycines
  SCN-specific regions: Sequence locations=1-153
caagggcaatgcggctcgtgctgggcattcagtgccaccggcgcattggagggacaacacgtgcgcgacaagggacatcttgtttcactgtcggaacaaaatctgatcgactgctcgaagaagtacggaaacatgggctgcaatggcggctac

SEQ ID NO: 47665 - DNA, 1332 bp, Heterodera glycines
  SCN-specific regions: Sequence locations=1-239,261-461,501-534,558 -582,610-692,732-749,772-1332
acataaatcaattgcgcaaacgaagtccaaatggcagaagtcggaaactcgtacagaccgccgctaagcgaagagaaacaaaacgaactccgcgcaattgctcagaaaattcttcagccgggcaaagggattctcgctgctgacgagagcacaggttcgattggaaaacgcttcgatactattgggttggagaatacggagaacaatcgccgtcgctaccgccaacttttgttcaccacaccgagctttggacagaatcttagcggcgtcattctttttgatgagacattccgtcagtcaaccgacaacggagtccgatttgttgacgtcatcaaaaaggcgggagccgttgctggcatcaaagtggacacgggagttgtgccattggccggcactctcgatgaggggacgacccagggactcgacaaattgtcggaccgctgtgccgagtacaaaaagggcggctgtgactttgccaagtggcgttgtgtgctgaacatcggtgcccacaaaccgtcccatttggcattgatggagaatgccaatgtgctcgcccgatacgcgagcatttgtcagcagaacggacttgtgcccatcgtggagccggaggtgctttgtgacggcgaacacagcttggaacgatgccagaaggtgactgagttgactttggcctacacctacaaagcattggccgaccaccacatttacctggagggcactctgctcaagccgaacatggtcacccccggccaatcccactcgcccaaggccacgcccgaccaaattggtctcgccaccgtgactgccctccgccgttctgttccgattgccgtccccggcattgttttcctctccggcggccaatccgagatcgaggctacacgcaatcttaacgccattaacagtgtgcccgggccaaagccgtggacgctgtccttttcctacggaagagcgctgcagtcgtcagtgatcaaaaaatggaacggcaaagacgagaatttgggcgatgcgcagaaagtgttgctgcaccgtgccaaggccaacggcgacgctcagcaggggaaatacaccggcgaggaggcagccgcgtctgccgctgaatcactttttgtggcaaagcacgcctattgaacagaagtgtggaatatgcgatgaataggcgcgaatccgagaatcactcatcatatattttagctggaggaattggcagaataatctgacaatgaacataatgataatttcgtttcatatttcattgttgtcactttccgtttggtgcacttaataattaacatatagtgataattgatgaatgaagcgtttccttaaaaa

SEQ ID NO: 47666 - DNA, 3464 bp, Heterodera glycines
  SCN-specific regions: Sequence locations=1-12,34-90,126-1640,1662 -2673,2696-2993,3015-3065,3088-3361,3383-3442
ggcacgagggaagattaaaaatttttgaaaaaagttaataagctaataagggcactaaagaatacaccaaactacacaacaaaatggcgacaacaacagcaccaccagcagcagcagaaatccccagaaaatcaccacaacaacggaagcgcgaagaaatggcgcagcttctagagtcacgaaaagtggatcaaggtgctaccttcgtcgagccaagaaaaccttcaggaacagccggacaaaaggggaggatgaaactcatcacaaacgcacacattctcaaactactgggtacgcaagccatctaccactacgaggtgaccatcaacgcagtgagcagtcgttcggaccggaagttttgcgtttcagagccgagcggtccacgggatagggacgatttcccattactcaaccgtcgtgacaaatgccgtgaggtcttctcggcgttctacaggaccatggaacagtcactgaaagataccgggaacttactctactacgatttatcgaaaacaatattcacattgaagaagctacagatcgagtcggaaggaaaattcatgtttaacatcggcacggtgccaaccgctgaacgcccagacgcggcacggttcaaacattatgaattcatcatcaggccagcgactggcttcgaggttaacgacttgtccttcatcacgaacgacgtgtcgaaaatggaacgatcacttgagcaattccttgacattgcaacggcgcagaaggcaaacatggacggaaagcaatttatcgggtttacttcgtctcgtgtttacttattggcgccaaccgactatggcttcggagccaacgagtgtcctgtcttcgattccaaccactcattcttaggtgtcggagtgaacaagggatgtcgaattgttgaaggagatcaaggccctggccaaatgacaccagccatcgtcatccaaacgaaaaagtccgctttccacattccggacatgtgcattttggacaaggcaaaaacgctccttttccgagagaatcagggaaggttcgagacaggtgactttactcaaagtgactacgaggcgctttgcaatggccttgtcggaatttatgctgaaccgcgctatggaacgtcgggacgatttttccgcatcagtgacattacaaaaccaaacactggaaatggtcttaactcggagaacacatacatcacacaccaagtcagcgggaaaatcagcgtcaaacaatatttcgaggatacctatcagaaaacgcttcagtaccctaaagcaccactcctcgtcaattatcgcagaattggggacccggcgtattatcccatggaggtttgctttgttttggatggtcaacgcgtcaaaagttctcaacaaaatcccgagcaaattcgtgaaatgatcaaagagactgccattccgcccaccgttttgcgagtgcacaacgaaagggtgaaggagtcgcttcagttggtcaacaacgaatacctgacaaaagcgtccgttcactttgacacaacgccactccatgtcgattaccgtgttcttggtccgccagcaactctctatcggaacaaccatcgtgtcactcctgccgcgtcaaactgtgaatggcgtccgggtgacgctttggtgaatgcgcaaattggcaactgggtagcctatgcgtttgggaaccctgcgggtgactcggtgcgacgattaggcttaaccgaaacgatgtggaggaatttcgtggacaagtatgcaggtgaaatgcgtaacaagggcattgtttgtgtgcctccggtgcgtgtctctttttgctggtttacgtccgtgaacgaggtcttgaatgttttgcacaaggaagccctgaacggcgttgagttctgtctcattggtcatgcgaaaggctttgagggtgatgacgtgcatgttacgatcaaggcgtttgaacaacagactgaaattgtcactcaagcaattacatttgacgttctcaaggaggtgctcgataaaggcagcccattgactgttacgaattgcattcacaaaacgaatgtgaaaatgggcggtctaaattatgctcttcatatggatgatccatctgtggcccaattgttcgacggtcaaacactgtttcttggttttgcaatgaacttcccgggtggattcgctccttccgaatctgctgcccctatcaatggtgctgtgccttcaggaagtaaagctggactaacgccgcaaaatggtgcgaacggtgccgccgctactggagcaaacaccattcctctcggctcaaatggaaatgttgttccgagtacgcccgtgccacgtgttggctcctcattgcctcctccttcgtgcattgggtgggccgcgacaatcggaaaacgacacaaggacgaatacattggtgactttgtctaccaggctccgcgacgtgaggagaaaattgatatcattgcaagcgttgtcaggagatgcattgagtccttcaaaaagaacaggaacaaattaccactacgcgtggtcattttgcgcaacggatgtaccgagggacaattcgaatatatcatgaagtatgaaattccgctggccaagaaggaactggaggaattgggttgcaccgcaaaacttactgtgattgttccaaaccgacttcaggatgtacgcttcctgcgtcaagatgccaggccggaggacaagagcaatgagcaaaacatccccccagggactgttgtcgacactgtcgttgttcaccccaaacgctccgagttcttccttaacagtcacgtggcgatcaagggcactgcttgtacgccacattacactgttctgcgggacgagaacgatatgtcgatggacacactccaaacaatggtccattacctctgctttgggcatcaaattgtcacgaagccgacctcattgccctcgccggtgtacatcgccgatgaatatgcgaaacgcggtcgaaacatctactcacactacgccaagaacggtattgacaacagcaaaaatttgcagctcttcgcaaagaacaaaggggtggaatggccgctgcgcacttatgcggacatgaccaaagtcctttcttttctcacgaccacctatctgaaggagctgcgcatcaacgcctgataagttagtgatggatgggttttgattgattgtttttgctttccatttgattgtttttctttttgtttaatatttcttttttttcttcgtgttgtttaacattgatacttttctcttctaatattttctcaatttgattgtttaactcccctcacctttgcctcttcaattcgtgcatttgctttcgtttctttggtcattcttcgtgcattctcttttctttatgtggaatgattttttccttctctgttttattgtaccaatccttttgttgtttattatattcttagctttaataaattgaaaacggggggaaaaaaaaaaaaaaaaaaaaaa

SEQ ID NO: 47667 - DNA, 279 bp, Heterodera glycines
  misc_feature (270)..(270): n is a, c, g, or t
  SCN-specific regions: Sequence locations=1-119,141-279
agcatggaagactcccagcagaatattactgaacagtcggtatcggcaccaaccactgatcgcaacgaatatgaagaactttccaaattggtcaacccaatctcaaaaccgcttgcaaacagaaaattggctaagaaagtctacaaattggtgaaaaaagcggcaaaagagaagggctttctgagacatggattggctgatgtgatgaaagccttccgaaagaatgaaaaaggaattatcgtctggcagggaacgtttcaccgattacgngtacagtca

SEQ ID NO: 47668 - DNA, 175 bp, Heterodera glycines
  misc_feature (87)..(87): n is a, c, g, or t
  SCN-specific regions: Sequence locations=1-175
acttgaaaaaggcctatcgaaaattagcgcttaaatatcattctgacaaaaatccgaatgaaggcgaacgttttaaactcatttctnaggcttacgaagtgttgagcaaccccgaaaagcgtaaagtatacgacgaatatggagaagaagggcttaagggtggcggataaggcgg

SEQ ID NO: 47669 - DNA, 1980 bp, Heterodera glycines
  SCN-specific regions: Sequence locations=1-111,144-171,198-234,268 -348,370-454,486-550,576-636,658-714,738-761,783-824,847-996,1023 -1658,1680-1957
atgaaaaaatcattcgtttcttttctgttttttacggcattgctcgtcattgtttgctcaaaagaggaggaagggggcgcaaaggaaaagaagtacggcacaatcattggtattgaccttggcaccacctactcctgtgttggcgtctacaaaaacggcagagtggagataatcgccaatgaccagggaaaccgaataacgccttcctacgtggctttcacaccagactcgggcgagcgtctgatcggagatgctgcaaaaaaccagttgactctaaacccggaaaacaccattttcgatgccaaacgactcattggacgggaattcaccgacaaaaccgtccaggacgatatgaaactttggccttttaagatctacaacaaggcaaacaagccccatgttcaagtgaaagtcggtaacgaggataagcaatttgcggcggaggaggtttctgctatggttctgacgaagatgaaggaaattgcggagtcttacctcggtcacgaagtgaaaaatgccgtcgttactgtgccggcttactttaacgatgctcagcgacaagcaacaaaagatgcggggaccatcgctggactgaacgtggtgaggattatcaacgaacctaccgctgccgcaatcgcttatggtctggacaaaaaagaaggcgagcgtaacattctcgtgtttgaccttggcggtggaacattcgatgtctctcttctgacaattgacaacggagtgttcgaagtgttggccaccaacggagacacacatttgggaggtgaggactttgacccccggacaatcgaatactttatcaaactgatcaagaagaagaccggcaaggacttacgcaaggacaatcgcgcagtgcaaaaactccgccgagaagttgaaaaagccaaacgggcgctgtctgttcagcatcaagtcaaacttgaagttgagtcgctgattgacggcgaagacttctccgaaacgctcacccgagccaaattcgaagagctcaacatggacttgttccgagggacgcttaagccggtgcagaaagtgctcgaggatgccgacctgaagaaggaagacatccacgaagtcgtgttggtcggaggttcaacacgcatcccaaaagtccagcagctgctcaaggaattcttcaatgggaaggaaccgtcccgcggcatcaatcccgacgaagctgtcgcctatggtgcggccgttcaagcaggagtcatttcgggggaggagaactcagaaattgttctgttggatgtcaaccctcttacaatgggcattgaaactgtcggtggagtgatgacaaaactgatcactcgcaacactgtcattccgaccaaaaagtctcagatattttctaccgcggcggacaatcagccaactgtgactattcaggtcttcgaaggagaaaggccgatgacgaaagacaatcatttgttggggaaattcgacttgaccggcattcctcctgctccccgaggcgttcctcaaatcgaagtcacttttgagatcgatgtcaatggaattttgcacgtgactgccgaggacaaagggactggcaataagaacaaaattacgatcaccaatgatcacaaccgactgtcgccggaagagattgagcgaatgatcaacgacgcggaaaagttcgcagaggaggacaagaaaaccaaggaagtggtcgaagcgaggaacgagtttgagtcgtacgcctactcactgaagaaccagctcggagacagtgaaaagttgggaggaaaactcagtgcggaggacaaaacgaccatcgaaggggctgtggatgaggccatttcgtggttggactccaacaaggacgcgccacctgaggagcttaaggagcggaagaaggacctcgaggccaaagtgcagccgatcatcagcaaactctacgcagggcagtcgcctccgcccggcagcgaaccgccgccgactgaggagaaggacgagctgtga

SEQ ID NO: 47670 - DNA, 1321 bp, Heterodera glycines
  SCN-specific regions: Sequence locations=1-39,61-233,255-415,437 -900,924-1041,1083-1286,1308-1321
caaatatttcaattctcccaattttataaagcaagtaaaatgtttcttcttttcttattatcaatgcttctacttcagacaaatggttggcgtgcccgcgagcgtgcaattgaattggccgactcggacgaatcgatcgaattgcagaacattggccaacggaaaacggacattcgaacaccgacagaacgaatgtctgctcttcgtcaaatgatcgaacgcggcttttccgattggaatgcttacaaacagaagcatgggaaagcatacgcggaccaagaagtggagaacgaacggatgctgacttatttgagcgccaaacagttcattgacaagcacaacgaggcgtacaaagagggcaaagtgtccttccgagtgggagagactcatattgccgacctgcccttttccgaataccaaaagctgaacggattccgtcgtttgatgggcgacagtttgcgccgcaatgcgtccacttttctggcgccaatgaatgtgggcgatttgccggaatcggtggactggcgggacaaaggatgggtgaccgaagtgaaaaaccagggaatgtgcggctcgtgctgggcattcagtgccaccggcgcattggagggacaacacgtgcgcgacaagggacatcttgtttcactgtcggaacaaaatctgatcgactgctcgaagaagtacggaaacatgggctgcaacggaggcatcatggacaacgccttccaatacattaaggacaacaaaggcatcgacaaagagacggcctacccctacaaggccaagaccggcaaaaagtgtttgttcaagcgcaacgacgtgggggcaaccgactcgggttataacgacatagccgaaggggacgaggaggacctgaagatggctgttgcaacgcaagggcccgtctcagttgccattgatgctggtcaccgttccttccaattgtacaccaacggcgtttactttgagaaggaatgcgacccggaaaatttggaccatggtgtgctcgtggtgggctacggcaccgacccaacccaaggcgactattggattgtgaagaacagctggggcacccgctggggcgagcagggatacattcgcatggcacgcaatcgcaacaacaattgcggcatcgcttcccacgcctctttcccattggtctgatcggagtgaatttgttgcccttgcgctgattcagagacatttcatttgattaatcgtgcaaaatgataagataattgataatccatcagtcaatcggtcgatttccattttttatgttcgcaattttattcacatataaataaattacttattttaa

SEQ ID NO: 47671 - DNA, 1219 bp, Heterodera glycines
  SCN-specific regions: Sequence locations=1-586,611-911,933-974,999 -1121,1143-1219
catttgtcagcccatcccaaaaactgataaaaaaaatggcgttcctctcccgtctctccatccttccaaattcgccaatttcgctgcttgcagtttctttggccgttttggctttcgtcgctttggcatcggccaatccgccgacggcacgcgaaacggcgccaaatgcacagcaaaacaatgccaattcagtggcaactggggaaattgcgaaaaatattgcggaaaagatggagcggatgaatgagttcattaaggcgaagaagttcatcgatgcacataatttggcatttgagaagggcgaagtgtcgttcaaagttgcgccaaaccatctgatgcattttacacctgcccaatataatcgaattcgcggcttgcaaatgcgcagcaaccgacaacggcacaacatggcaactctggcgggaaacagcagtactttgccggaaaagttggactggcgcgagaaaggggcggtgaccgaggtcaaagatcagggggactgcggctcgtgttgggcattcagtgccaccggtgccattgagggagcattggcacagaaaaaagcgtcgaaaattatttcattgtccgaacaaaacctggtcgactgttcgtccaagtacggtaacgagggctgtgacggtggactgatggacagcgcatttgaatatgtgcgagacaacaacgggttggacacggaggagtcgtacccgtacgaggccgtaacgggcaaatgccaattcaaaaatgagaccgtgggcggcactgtcgttagcttcaaagacttgaagaaaggcgacgaagagcagctgaagattgccgtcgccacaattgggcccatttccgttgcgctcgatgccagcaatttgtccttccaattttacaaaaccggcgtttattacgagcggtggtgcagcaaccgatacttggaccacggcgttctcctcgtcggctacggtaccgacgaaacgcacggtgactattggctggtgaagaacagttggggcccgcattggggagagaacggttacattcgaattgcgcgcaacaaacaaaaccattgtggcattgcgacgatggcatcgtaccccgtggtctgagaaagcgtgggaatgaatgggacgagaagggatcagaagaagaagcaggcagaccaaatagaagcaattcacaatcattatcattgttatgctttttggtaataaataaaattgctttgtaa

SEQ ID NO: 47672 - DNA, 360 bp, Heterodera glycines
  SCN-specific regions: Sequence locations=1-68,94-108,132-168,195 -196,222-240,270-360
atgaatcactttgggctgacttttctgttcgtcgccgtttctctgctggtaattgcgcccggctgcgatggcatgcaaattttcgtgaagacattgacgggcaaaacgatcactttggaggtggagagctcggacactgtggacaatgtgaaggagaagatccaagagaaggagggcattccgccggatcagcaacggctgatcttcgccggcaaacagctcgaggacggacgaacgttggccgactacaacatacagaaggagtccacgctccacttggtcctccgtctccggggcggaaatgggaagagaaacacgggtaagaacaagaaaagcaacaaaaagcttgatcagaattga

SEQ ID NO: 47673 - DNA, 390 bp, Heterodera glycines
  SCN-specific regions: Sequence locations=1-239,263-290,312-390
tcgcaatcccgatgacatttcaaatgaggtgtgaatttaggcttccttattcacttgytttgagctaatttttctctaattccagaagtatgcggagttctacaagagcttgtcaaatgactgggaggaccatcttgctgtcaagcatttcagcgttgaaggccaactcgaattccggtcggtcttgccttacctatgtttattctattactagtaatgagaaattggtgtcccagcggaatgtaaaaaggattttttcttgagcgaagaataagctggcaaaatgaacttatttttcctagtgctctcctcttcgtcccccaacgcgctccgttcgatctctttgagaacaaaaagagcaagaatgccatcaagctttatgtccgtcgg

SEQ ID NO: 47674 - DNA, 390 bp, Heterodera glycines
  SCN-specific regions: Sequence locations=1-239,263-390
tcgcaatcccgatgacatttcaaatgaggtgtgaatttaggcttccttattcacttgttttgagctaatttttctctaattccaggagtatgcggagttctacaagagcttgtcaaatgactgggaggaccatcttgctgtcaagcatytcagcgttgaaggccaactcgaattccggtcggtcttgccttacctatgtttattctattactagyaatgagraattggtgtcccagcggaatgtaaaaaggattttttcttgagcgaagaataarctggyaaaatgaacttatttttyctagtgctctcctcttcgtcccccaacgcgctccgttcgatctctttgagaacaaaaagagcaagaatgccataaagctttatgtccgtcgg

SEQ ID NO: 47675 - DNA, 390 bp, Heterodera glycines
  SCN-specific regions: Sequence locations=1-239,263-390
tcgcaatcccgatgacatttcaaatgaggtgtgaatttaggcttccttattcacttgttttgagctaatttttctctaattccaggagtatgcggagttctacaagagcttgtcaaatgactgggaggaccatcttgctgtcaagcatttcagcgttgaaggccaactcgaattccggtcggtcttgccttacctatgtttattctattactagcaatgagaaattggtgtcccagcggaatgtaaaaaggattttttcttgagcgaagaataaactggcaaaacgaacttattttttctagtgctctcctcttcgtcccccaacgcgctccgttcgatctctttgagaacaaaaagagcaagaatgccatcaagctttatgtccgtcgg

SEQ ID NO: 47676 - DNA, 390 bp, Heterodera glycines
  SCN-specific regions: Sequence locations=1-239,263-390
tcgcaatccckatgacatttcaaatgaggtgtgratttaggcttccttattcacttgttttgagctaatttttctctaattccaggagtatgcggagttctacaagagcttgtcaaatgactgggaggaccatcttgctgtcaagcatttcagcgttgaaggccaactcgaattccggtcggtcttgccttacctatgtttattctattactagcaatgagaaattggtgtcccagcggaatgtaaaaaggattttttcttgagcgaagaataaactggcaaaatgaacttattttttctagtgctctcctcttcgtcccccaacgcgctccgttcgatctctttgagaacaaaaagagcaagaatgccatcaagctttatgtccgtcgg

SEQ ID NO: 47677 - DNA, 390 bp, Heterodera glycines
  SCN-specific regions: Sequence locations=1-239,263-390
tcgcaatcccgatgacatttcaaatgaggtgtgaatttaggcttccttattcacttgttttgagctaatttttctctaattccaggagtatgcggagttctacaagagcttgtcaaatgactgggaggaccatcttgctgtcaagcatttcagcgttgaaggccaactcgaattccggtcggtcttgccttacctatgtttattctattactagcaatgagaaattggtgtcccagcggaatgtaaaaaggattttttcttgagcgaagaataaactggcaaaatgaacttattttttctagtgctctcctcttcgtcccccaacgcgctccgttcgatctctttgagaacaaaaagagcaagaatgccatcaagctttatgtccgtcgg

SEQ ID NO: 47678 - DNA, 390 bp, Heterodera glycines
  SCN-specific regions: Sequence locations=1-54,76-239,263-390
tcgcaatcccgatgrcatttcaaatgaggtgtgaatttaggcttccttattcacttattttgagctaatttttctctaattccaggagtatgcggagttctacaagagcttgtcaaatgactgggaggaccatcttgctgtcaagcatttcagcgttgaaggccaactcgaattccggtcggtcttgccttatctatgtttattctattactagtaatgagaaattggtgtcccagcggaatgtaaaaaggattttttcttgagcgaagrataagctggcaaaatgaacttattttttctagtgctctcctcttcgtcccccaacgcgctccgttcgatctctttgagaacaaaaagagcaagaatgccatcaagctttatgtccgtcgg

SEQ ID NO: 47679 - DNA, 390 bp, Heterodera glycines
  SCN-specific regions: Sequence locations=1-390
tcgcaatcccgatgacrtttcaaatgaggtgtgaatttaggcttccttattcacttrttttgagctaatttttctctaattccaggagtatgcggagttctacaagagcttgtcaaatgactgggaggaccatcttgctgtcaagcatttcagcgttgaaggccaactcgaattccggtcggtcttgccttayctatgtttattctattactagyaatgagaaattggtgtcccagcggaatgtraaaaggattttttcttgagcgaagaataarctggcaaaatgaacttattttttctagtgctctcctcttcgtcccccaacgcgctccgttcgatctctttgagaacaaaaagagcaagaatgccatcaagctttatgtccgtcgg

SEQ ID NO: 47680 - DNA, 2286 bp, Heterodera glycines
  SCN-specific regions: Sequence locations=1-305,328-545,592-641,665 -734,756-777,863-939,1010-1053,1176-1225,1431-1482,1545-1545,1600 -1659,1827-1831,1866-1871,1941-2060,2139-2223,2266-2286
cgacagcacacacagccgaaaagcgcttcttctcatcgccttcgccttcaaaactttgaagcaccaatcccaaccagaaaaaatgtgcgacgaagaagttgctgctctcgtggtggacaatgggtccggaatgtgcaaggcgagttttgggatttggacttattattatgtacaattgggaaccatcaaaatgggcaaaagcaatgcttttgatatgctaaatctcaatttgggcattggccacatttttacagtgaaattcaaacaaatttttgatcaaatcaaccgaaaataattttccgaatatttttaaaataaatcaaatttcataagaaaatgcccactcgggcaaaatgtctcctcattattggaaaaagaaaaaagcaaatccccccccccggggtggaaattctccgaattctttgagcacaacgaatgtttttgcttcgccaacaaaaaaagcgggcgatgggggggggggagagaatgttttatttgtgactcacacttttgaccgacttttctcttcagaatgttacaattccaagaagagggagaaaaagggggaaaagaataaaaagaaaacaaaaattggctaattaaaattggattgaatttccgctttaattcaggccggtttcgcgggcgatgacgcgccccgcgcggtgtttccgtccattgtgggccgcccccgtcatcagggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgtgagtggtggtgccatcgtcagattggcattggcactcgccgtcggtcacttggccaatccgtccctttaaggcgtgtcgcccccgaggagcacccggtgctgctcacagaggccccgctgaacccgaaggccaacagagaaaaggtctatctgccaaatggaacagtgaaactgacggaatctccccttttcagatgacccaaatcatgttcgagacgttcaacacgccggccatgtacgtggccatccaggccgtgctgtccctgtacgcctccggccgtaccaccggtctcgtgttggactccggcgatggtatgcagccaaatcgttggcataatatcatagctatcaatctccatgcacaggtgtcacccacaccgtgcccatctacgagggttacgccctgccccacgccatcctccgtttggacttggccggccgtgacctcactgactacctgatgaagatcctcactgagcgtggttactccttcgtgaccacggccgagcgtgagatcgtccgtgacatcaaggagaagttgtgctacgtggcactcgacttcgagcaggtcggacatttggccaatttgatgccaaaattacccttcctcccgtcttggttcaggaaatggccactgccgcctcctcctcctcgctggagaagagctacgaactgcccgacggccaagtgatcaccgtcggcaacgagcgcttccgttgcccagaggcgctgttccaggtgagtgcccggcggagggcgcgtgcctatggcaacggcacaatttgatttggctctgttcagccgtccttcatcggcatggagtcggccggcatccacgagtccacctacaactcgatcatgaagtgcgacatcgacatccgtaaggacctgtacgccaacaatgtgctgtccggcggcaccaccatgtacccgggcattgctgaccgcatgcagaaggagatgaccgcgctggccccgtccaccatgaagatcaaaatcatcgctcccccggagcgcaagtactccgtctggatcggcggctccatcctcgcctccctgtccaccttccaacagatgtgagttgtggttgcattgggctgatctgacccaccaatgcttttccccctctgatcagttgcccaattagctgatcattgtccgttgttttccccctctgagcactcttttgcccttttctcaggtggatcagcaagcaggagtacgacgagtcgggcccgtccattgtccaccgcaagtgcttctgagcagcagctgcacgaccgcacggaggaggaggagaagaccaacgaagccgggacactcgccatccgccgacccattcgccaccccccaccaccatctgttttttgctgaaaattatgcaaaaatatttttgaataaaatctatgaacaaaaaaaaaaaaa

SEQ ID NO: 47681 - DNA, 2917 bp, Heterodera glycines
gtcaaattgctttttcaaaaatgccatctaaagctaatgcaattggtattgacctcggcacgacgtattcgtgtgttggagtcttccagcacggaaaggtggagatcatcgcgaacgaccaaggtgcagtaaagaccggacgtgctttccctcaaaatattgttaccatcccgaatttcaggcaaccgcaccacgccgtcctatgtcgcgttcaccgacaccgaacgtttgatcggcgatgcggccaagaaccaggcaacttttcacaaaatcaactgtttaagcagtttaaactgatttgtttgacaggtggcgatgaacccatccaacaccgtgttcgacgccaaacgtctcatcggacgcaagttcgacgacccggcggtgcagtcggacatgaagcactggccgttcaaagtggtgcagggagagggtgctcgtccgaaagtgatggtggaagtcaaaggcgaggacaaagcgttcttccctgaggtttgtgctgtttgctaaactgctccatccccccgccccagttgaaaattttgaatggaggcaatttcgtatgcttgattctttttcggaaaatctacaatctgaggaattaaagctttccgaaaaatgaaatttgggagggaagaggactctaaaagcaaccaaaattggcgtttgttgagtgtttgcttgttgtacttaaatgtgttttttctttgcaggaggtttcgtccatggtgcttatcaagatgaaggagacggccgaggccttccttggccagactgtcacggatgcggtggtcacagtgcccgcttacttcaacgactcgcagcgtcaggccaccaaggacgccgggaccatcgccgggctgaacgtgttgcgcatcatcaacgagccgacagccgccgcgattgcctacggcttggacaagaaggggcagggtgagcgccatgtgctcattttcgacttgggcggtggcactttcgacgtgtccatccttaccatcgaggacggcatcttcgaggtgaaatcgaccgccggtgacactcatctcggtggcgaggacttcgacaatcgaatggtttgattttcgaatttgccagcaattcaaaatggttcgaactaaggtttaagaaaaatgaaaaagatagtttggtcgaaccaacacttaaaatgaatgaaaagcattttcttttgcttgtttgaatttaaactgcttttccttcaggtcaaccactttgtcgcggagttcaagcgcaagcacaagaaggacctcagttcgaaccctcgtgcgttgcgtcgtttgcgtacggcctgcgagcgcgccaagcgcactctgtccggttccacccaggccaggtttgtttctttccctttttggcgggtcatttcacaaactcatttgccccatgtaaaactaattccttcaatttcagcatcgaaattgactctctcttcgacggcatcgacttctacaccaacatcacgcgcgcccgcttcgaggagctttgcgccgaccttttccgcaacaccatggaccctgtggagaaggctttgcgcgacgcgaagatggacaagtcccagatccacgacattgtgttggtcggcggctcgactcgaattccgaaggtgcagaagcttctctccgactttttctccggcaaggagctgaacaaaagcatcaacccggacgaggcagtggcctacggagcggctgtccaggcggccattctttccggcgacaaatcggaaactgttcaggtgaacgattaagcctacctatcttaaatttcgaattaaattttgtttttcttgtttgtttttttgactgttgtgtattcctttctttttaggacttgctgctgcttgacgttgcccctctctccctgggcattgaaacggccggcggcgtgatgacttcactcatcaagcgcaacacgaccattccgacaaagacgtcgcagacattcaccacctattcggacaatcagcctggtgtgctgattcaggtaaagcaacaggcatttccccttttgattgtttctgtgtgaaaactgttcacattgaggtctacgaaggcgagcgcgcgatgaccaaggacaacaacctgctgggcaagttcgagctcagcggcattccgccggcgccacgaggagtgcctcaaatcgaagtcactttcgacatcgacgccaacggcattctgaacgtgtcggcccaggacaagtctaccgggaagcagaacaagatcaccatcaccaacgacaaaggccgcctttccaaggaggaaattgagcgcatggtgcaggaggcggagaagttttccaaggaggacgaggtgcagcgtgaccgtgtgtctgccaagaacgccttggagtcctactgcttcaacatcaagcagacaatggaggactcaaatgtacgttttttgtggagtccttttctttttttttattccacctcccgtcgcaaatgattaaaattttggtagcgggcgttaacaattttctgagccctttacgaaattactgtcaatgggttgagtgagaccccctgggactgcggggtttttccctcctttctatcttttgattttaagctgaaggacaagatcagcgaggacgacaagaagaaggtgctggagaagtgcggtgaggtgctggcatggctcgacgccaaccaggcggcagagaaggaggaatttgagcaccagcagaaggaactcgaagggatctgcaatcccatcatcaccaagctctaccaagccggcggcgcaatgcccggcggtccaatgcctggcggagggatgcccggaggtggcggcgctgctggtgcgggaggagccggtggaccgaccatcgaggaagtggactaagcgagtcgatctcttcgcgatcattttttgtttgatcgattatttaattttaaaaa

SEQ ID NO: 47682 - DNA, 318 bp, Heterodera glycines
  SCN-specific regions: Sequence locations=1-66,90-154,180-198,228-318
atgaatcactttgggctgacctttctgttcgtcgccgtttctctgctgacattgacgggcaaaacgatcactttggaggtggagagctcggacactgtggacaatgtgaagacgaagatccaagagaaggagggcgttccgccggatcagcaacggctgatcttcgccggcaaacagctcgaggacggacgaacgttggccgactacaacatacagaaggagtccacgctccacttggtcctccgtctccggggcggaaatgggaagagaaacacgagtaagaacaagaaaagcaacaaaaagcttgatcagaattga

SEQ ID NO: 47683 - DNA, 2053 bp, Heterodera glycines
  SCN-specific regions: Sequence locations=1-199,223-641,675-1793,1815 -1852,1877-2053
gagatcactttggtccctacttctgatcaatcccgttaccctctcccaattttgtctgcaaaatgtcggacgactaccgcagttcgattggcccacggcctgcgttcaaccgcaactcaacagcctattcaagtacgggcggacctgtctcgggcggcaaccgcgtgctgaaaattgtcacggagacaatgtcatcgagcaccagcggcggcggcggtggcatgtcaccgtttggcgccaacgcggcacaaatccgtgactcccgtgatcgcgagaagaaggagctgagcgatttgaacgatcgattagccaattacattgaaaaggtccgcttcctcgaggcccagaaccgcaagttgaaggcggacctggacatgctgcaaggacgccgcggcaaggacaccatcaccatcaagacgatgtacgagagcgagattcagacggccaaaaagctgatcgaagacacgggccgatcaaagcacgagttggagcaggacgtggccaaactgcaacgtgacttggacgagcagcgccgcaaatacgaggaagctgttcgctcacgggccggtgaccgtgaaaagttggacgatttgctggtccaattgagcaatttggaggccgaaatcagcctgttgaagcgtcgcattgccctgctggaggaggagctgagcaaactgcgcaaggagaactcacgactgcaggccgacctgcagcgcgtgcgtgccgagttggatcaggagacgctgaaccgcattgactaccaaaaccaagtgcagacactgctcgaggagatcgacttcatccgacgctcgcatgaccaggagatcaaggacttgcaggcgatggccgcccgcgacacgaccagcgaaaaccgcgagttcttccgcaacgaattggcatcggccatccgcgacattcgcaacgagtacgacgtgttgaacaacaaagaccgtaacgacattgagtcgtggtacaagctgaaggtgcaagagattgagacgcaaagtgcacgacagaacatggagcagggctaccagaaggatgagctgaagcggctgcgcgttcagctgacggatttgcgcggcaaattgtcggatttggaagcgcggaactcgctgttggagaagcagatccaggagctgaactaccagcttgaggatgaccagcgcgcttatgaggacgcgctgaatgcgaaggatgcccaaattcgaaagatgcgcgacgagtgccaagcgctgatggtcgagctgcaaatgctgcttgacaccaaacaaacgttggatgccgaaattgccatttaccgcaaaatgctggagggcgaaggggacgggcccggcctgaaacagttggtggagcaggtggtgcgcaccaccggcatcaacgaggtggcggacacagaaacgatgcgtgtcgtcaagggcgagacgtcctcccgccagtcgtaccaacggtcggccaagggcaatgtgtccattttggagacgtcgccggagggcaaatacgtggtgttggagaacacgcaccgatcaaaggaggagaccattggagagtggaagctgaagcgtcgcattgatggcaagcgcgaaattgtgtacacattgcccgccaactttgtgctccgcccgatggcccgtctgaaggtgtgggcccgtaaccagggcggcctgcacgccccgccggatcagctgatcttcgatggcgaagaatcgttcggcgtcggctcaaacgtgcaaaccattctctacaatgcgcaaggagaagaacgtgccacgcacatccaacgttcaagccagacagctgcctgaagaggaagagagagataatgctgataagagtgatcactgggggacggaattttaaattttttaattattttcgaaaaatcgaaaaatgtccccccccccctcctaagaattgattttcttttttaattttcaaaaaattccccttatataaaattgattttttcaatgtccaaccgacatttaaccattaaattttaccaaattggggataaagtgacaaataatcgataaatttctgttgataaatt

SEQ ID NO: 47684 - DNA, 801 bp, Heterodera glycines
  SCN-specific regions: Sequence locations=24-127,152-173,195-772
ggtttaattacccaagtttgagtcaaatttcccatttggccgtccatttaaccgcgtccgtccaagtcccacccaatccagcgccaattttgattaaaacatggccatgaacaccaattcaattcattgctcctccgcctcctcctccccgtccgttccgatgatgttgtccatgttctgcttcatcttcgccatttttttgcatcccgcttcttcgtccgatttgctgtcctcgtccgacgatgcgaagctgcagcaaatgctgtgcgcccgtttcccgggactcgcggagtgccaaccgaacgacgaagcgtcgcgtggcatcatgacgaagcgcaagtccgcttacatgcgctttgggcgtgcggcggccgctgccgacccatcggaagaatatgaaatggagaagcggaagagcgcctatatgagattcggcaaacgctcgccggcggaagagggggaaacgtaccaaatctgggcagccaatgagccggacgcccaaatggaaaagcggaaaagcgcttacatgcgcttcgggaagaggaagagcgcatacatgagattcggccgtaagtaatcaggcccatgacaaggcgatgaatgaaattttatcttggcaacgacatacgccaatcaatgcgtggccaattacacaccgtaacatccgattgtgttttgactgcgttaccgtattcttatttcccattgatccaattgatctctcacatttgtatatttagaaagctaattaaacgcggataatgttttaaccaaaaaaaaaaaaaaaaaaaaaaaaaaaaa

SEQ ID NO: 47685 - DNA, 1197 bp, Heterodera glycines
  SCN-specific regions: Sequence locations=1-58,81-205,229-532,554 -676,698-1017,1140-1197
atgctgaggattgctctactcatctccattttggcactgtttggtgattgcatggacatgggaaaaagaaaattaggaggaatcagtattaatgagccaagtgaatatggaaccaaagaaaaagaagccatcgcaacaaaagaaaatgcacaaacatcaaaggacccgccgacatcggcgggtggtcaaaatgaagcaatcccttcaccaaaaaagccaagccccaaggggaagttgaaaagcgattttggcctaaacttagccaaggcttttccacggccggttccgaaaggcagaaggggcaaagaaaaagtcggcgaaaaaataagcgttatgaacacagctgaacgcattgaaaaaatggacattgcccaagacaaagctaaaatggaaatagacaatatagacaccaatgccaaacccaaacaaaatgaggataaagctccaaccatattccccaaatgtgcggacaacgtggaagtggaagtagagctcgatcgtaatatttttcgtttttctactacgcttgacacaatgatggaagatcttggaatgtacactgctgaaggcacaaaccagaaattgccggtttcaaatgtcagtagtacggtgatgcgagaagtgattgaatggtgcgagcatcacaaaaacgatgcctcaatagagccaatttatgaagaaattgctttggatgtgccaactggtaaagatgcggaggcatccgcaccaaatgctcaagctggagaagttgcggaggcagccgaatcaaatgccaaaccaaataatgaaaagcgtctcgtctttccaagctgggatgagaattttttggataaggaatggcctgagcttgttgatataattttagcagccaactatttgaacatcaaacttttgcttaccttcgcgaccacaatggttgataacaagtggatcaatggcaaaacgccgcaggaaattcgcaaggcattcggcgtcgaagagccgtacccgccgggacatccggaatgggcacgagttgagaaggagaacgagtgggaagaatcggacgaggaacgtgaggcacgccatgcaaaggaacgagaggaggaagaggagcgtgagagaaaggaagaacagaagcgtaaggaagaggaagcggaacgcctccatcaggaacaactgcagcaacaacagaatcaggaacagcaacctcagtag

SEQ ID NO: 47686 - DNA, 738 bp, Heterodera glycines
  SCN-specific regions: Sequence locations=1-6,29-738
atgctgatcatggtcattgtgctgctcacgggaaagatagcttttgccgccacagatggcatgacggaccttaagttgatcaacgaggggctgaccacggacaaaattgcgtcccgctccatcttcctcactccgctgcaaatcattctgccgtgggtgctcggcaaacagacggccgggccgaagccgttgaacgtgttcttgtgggcgtacccgtaccgactggtgatgagtttggcactggcactgctcgtctactggacaccgtcatttcgcgaacccaacggggagtatccgtacttttattacgccatttggattggtgcctactatttgcaacaagtgtcctcctattgcattttcctctcaatgatggcgttcaatgcacaaatttcggaccccaaaattggcggcacttacaggaccctgctgaacacgctgaacaacttaggcggcaattggcctgtcacactgttcctgagcatcaccgattttttcaaccgtaaaaattgtgtggccaaaggcaccaaaattgtgctgggcgtatgcaccagcaaacatgacgaggagttgtgcaaagcgggcggtgatgcgtgcgaatttgtgatcgacggttattacatttctgtggcaatttgcgtggtcgtcggtctgctgtggtatcgaattttctaccggcgcatcaaatacttccagaagatttcccgccaagattggcgcgtgatcaaaacaaaatga

SEQ ID NO: 47687 - DNA, 580 bp, Heterodera glycines
  SCN-specific regions: Sequence locations=1-111,158-274,310-560
attagcagcggattgtggaaaggccgatgcccgtgagtcaaaaggtttggcggattgcatcatgagatcctcaagtcggacggtcccatcgggtctctaccgcggcttcttcgtctccgtccagggcatcatcatttaccgcgccgcttacttcggctgcttcgacaccgccaaaatgctcttctccccggagggcaagcagatgaacttcttcgtcaactgggccattgcgcaggtcgtcaccgtgtcgtccggcgttctctcctacccgtgggacaccgtccgtcgtcgtatgatgatgcagtcgggccgcaaggacatcatgtacaagaacactttggactgtgccatcaaaatcatcaaaaacgagggactgctcaagggcatgttcaagggtgctttatccaatgtgttccgtggtactggcggtgcccttgttcttgcgttctacgacgaaatccagaaatatatccactgattgtgtgtgatcttcttagtatatttgtttgtgttgcgtcatattcggtcatttgggtaatgataaagaagataggtgtgttaaaaaaaaaaaaaaaaaaaa

SEQ ID NO: 47688 - DNA, 469 bp, Heterodera glycines
  SCN-specific regions: Sequence locations=1-469
gcggtggcgccgccgttcgggcagcaacgattttacgctgaaaatgttcgattattcaaaaactgcggttaaaagggcaatgaaaacgatcacggaggtcgagccgatcactgcggtcagttttcatccgagcggagagttttttctatgcgcaactcggcatccgaccttgcgtctttatagtgccgaaacacagcaatgctttgtttctacaataccgaaggaccaacattctgattccattacggatgtgtgctattcggaaaatgcgcgaatgtttgtcacgggaagtcgtgatgggaatgtaaaagtttgggacggagtttccaatcgatgcattgagacttttacccgcgcgcatgacggagccccgatttgcagtgctcagttcactcgtaatggaaagtacgttctcacagtaggaatggcagtgtgcccaaattatgggaattgtccaccaatcgctgtt

SEQ ID NO: 47689 - DNA, 2828 bp, Heterodera glycines
  SCN-specific regions: Sequence locations=1-111,144-171,198-234,268 -348,370-498,530-594,620-680,702-808,832-855,877-918,941-1090,1117 -2103,2140-2409,2431-2751,2775-2828
atgaaaaaatcattcgtttcttttctgttttttacggcattgctcgtcattgtttgctcaaaagaggaggaagggggcgcaaaggaaaagaagtacggcacaatcattggtattgaccttggcaccacctactcctgtgttggcgtctacaaaaacggcagagtggagataatcgccaatgaccagggaaaccgaataacgccttcctacgtggctttcacaccagactcgggcgagcgtctgatcggagatgctgcaaaaaaccagttgactctaaacccggaaaacaccattttcgatgccaaacgactcattggacgggaattcaccgacaaaaccgtccaggacgatatgaaactttggccttttaaggttccgaaaagcacgaatatttaatgagaaaaaactatttttagatctacaacaaggcaaacaagccccatgttcaagtgaaagtcggtaacgaggataagcaatttgcggcggaggaggtttctgctatggttctgacgaagatgaaggaaattgcggagtcttacctcggtcacgaagtgaaaaatgccgtcgttactgtgccggcttactttaacgatgctcagcgacaagcaacaaaagatgcggggaccatcgctggactgaacgtggtgaggattatcaacgaacctaccgctgccgcaatcgcttatggtctggacaaaaaagaaggtgtgtgcaacagtctctgtgcccaactcattttttatatgcaatttcaggcgagcgtaacattctcgtgtttgaccttggcggtggaacattcgatgtctctcttctgacaattgacaacggagtgttcgaagtgttggccaccaacggagacacacatttgggaggtgaggactttgacccccggacaatcgaatactttatcaaactgatcaagaagaagaccggcaaggacttacgcaaggacaatcgcgcagtgcaaaaactccgccgagaagttgaaaaagccaaacgggcgctgtctgttcagcatcaagtcaaacttgaagttgagtcgctgattgacggcgaagacttctccgaaacgctcacccgagccaaattcgaagagctcaacatggacttgttccgagggacgcttaagccggtgcagaaagtgctcgaggatgccgacctgaagaaggaagacatccacgaagtcgtgttggtcggaggttcaacacgcatcccaaaagtccagcagctgctcaaggaattcttcaatgggaaggaaccgtcccgcggcatcaatcccgacgaagctgtcgcctatggtgcggccgttcaagcaggagtcatttcgggggaggagaactcagagtacgtggtgaaagggctgcactagtggtgggattttgtttttaatcgatttttaatataagtgagaatttcgaaaattttgaattactttttgttcgaatttgggtcctggattcgaaataggtcgaaatggttattatatccgtgatcagcgatcccgaaaaacctataagaaatgtttttacgacttttaaaaacttaagaaaatttttgtcaaaaaggtgtggcaccatctaaactattacccaaaatccgacataatttctccattttgcctgtccagtaagctccactttactcggggatagcactcgcacattggtcgaatacttaattgctttttaagaattgttctgttggatgtcaaccctcttacaatgggcattgaaactgtcggtggagtgatgacaaaactgatcactcgcaacactgtcattccgaccaaaaagtctcagatattttctaccgcggcggacaatcagccaactgtgactattcaggtattacaactacgataattattacaacgctggctatagtcgccagaaaaaagaacatttacattcgattgagtttcaatatttcccatgggttgtccaagcattggcttcgtccctatttaagcaatttttcgtagcattttgtgcttccaaagagaaggaaaaatggcggaaatctaagcataatagtagttaagacgcatttagtacaaagtgttttaaatgactgattgccaatttgtatctatattaaaatcccttttaaggttttaatttaaaaataattctcattaaaatgaaaaaattaacaggtcttcgaaggagaaaggccgatgacgaaagacaatcatttgttggggaaattcgacttgaccggcattcctcctgctccccgaggcgttcctcaaatcgaagtcacttttgagatcgatgtcaatggaattttgcacgtgactgccgaggacaaagggactggcaataagaacaaaattacgatcaccaatgatcacaaccgactgtcgccggaagagattgagcgaatgatcaacgacgcggaaaagttcgcagaggaggacaagaaaaccaaggaagtggtcgaagcgaggaacgagtttgagtcgtacgcctactcactgaagaaccaggtgaaacggttgtcctttgctagagttcattacgacaatttagctcggagacagtgaaaagttgggaggaaaactcagtgcggaggacaaaacgaccatcgaaggggctgtggatgaggccatttcgtggttggactccaacaaggacgcgccacctgaggagcttaaggagcggaagaaggacctcgaggccaaagtgcagccgatcatcagcaaactctacgcagggcagtcgcctccgcccggcagcgaaccgccgccgactgaggagaaggacgagctgtgaacggtggaatcaccaaggctaactgtgacgactttccttggtctatcccccttc

SEQ ID NO: 47690 - DNA, 1321 bp, Heterodera glycines; identical to SEQ ID NO: 47670
  SCN-specific regions: Sequence locations=1-39,61-233,255-415,437 -900,924-1041,1083-1286,1308-1321

SEQ ID NO: 47691 - DNA, 1935 bp, Heterodera glycines
  SCN-specific regions: Sequence locations=1-257,279-579,619-652,676 -700,728-765,788-962,985-1080,1102-1356,1404-1421,1444-1935
atggcagaagtcggaaactcgtacagaccgccgctaagcgaagagaaacaaaacgaactccgcgcaattgctcagaaaattcttcagccgggcaaagggattctcgctgctgacgagagcacaggtcgttgtgccatttcgaccgtttttaccccagccccataaattttaggttcgattggaaaacgcttcgatactattgggttggagaatacggagaacaatcgccgtcgctaccgccaacttttgttcaccacaccgagctttggacagaatcttagcggcgtcattctttttgatgagacattccgtcaggtgggcagacatcgcataattgggtccaattttaacgttttttagtcaaccgacaacggagtccgatttgttgacgtcatcaaaaaggcgggagccgttgctggcatcaaagtggacacgggagttgtgccattggccggcactctcgatgaggggacgacccagggtctgttttggagcaaaacccaaaaattcggaaagcaatgacacaacatttttaggcctcgataaattgtcggaccgctgtgccgagtacaaaaagggcggctgtgactttgccaagtggcgttgtgtgctgaacatcggtgcccacaaaccgtcccatttggcattgatggagaatgccaatgtgctcgcccgatatgcgagcatttgtcagcagaacggacttgtgcccatcgtggagccggaggtgctttgtgacggcgaccacagcttggaacgatgccagaaggtttgatttggattgttggccatcggttgcttttacaattagcccagtccaaccaatgtgcccaaatggccgccgtcttcgcatgctcccttttgcgaaatttttgcttttaaatggttatttattttggtactgaagtgtccattttctctgggactcagttgtcccaatgcttagatggcattggttcgagtttataccttgtgtttttagatttagctcatcaagagctttcgaatgataccaaatttgtccgaatttgagcgttttaaaaggtcaagagccctctttttcattcaaattttcgagttttaaaccggttcaaaaaccggtttaaatgcttttccgcgcccaattttaagcttttctatcgttctcagcacctaagaaaacctataaaagtgtttttgtgcgattttgagccgatactgtattcggcaattttaccgagagaaaatgttgaaacgcggatgagcatttaaaaactgacatcgggtgttttgttgcacaccttttcaatttcatttttaattgttgtatcggtctttgtttaggtgactgagttgactttggcctacacctacaaagcattggccaaccaccacatttacctggagggcactctgctcaagccgaacatggtcacccccggccaatcccactcgcccaaggccacgcccgaccaaattggtctcgccaccgtgactgccctccgccgttctgttccgattgccgtccccggtgcgtaatgagtgcctttccttcgcattttgcatttcctttttcaaggcattgttttcctctccggcggccaatccgagatcgaggctacacacaatcttaacgccattaacagtgtgcccgggccgaagccgtggacgctgtccttttcctacggaagagcgctgcagtcgtcagtgatcaaaaaatggaacggcaaagacgagaatttgggcgatgcgcagaaagtgttgctgcaccgtgccaaggtagggggggggcgactgatgatgcccagcaattggttcttttatgctgtcctcggtaacatttcatttctgactttcctttaggccaacggcgacgctcagcaggggaaatacaccggcgaggaggcagccgcgtctgccgctgaatcactttttgtggcaaagcacgcctattga

SEQ ID NO: 47692 - DNA, 504 bp, Heterodera glycines
  SCN-specific regions: Sequence locations=1-60,82-189,211-504
gatttttcgggagcacaaacaataacaactggaaaagtattcaatattttgagttttatttttataataaagcatggaagactcccagcagaatattactgaacattcggtatcggcaccaaccactgatcgcaacgaatatgaagaactttccaaattggtcaacccaatctcaaaaccgcttgcaaacagaaaattggctaagaaagtctacaaattggtgaaaaaagcggcaaaagagaagggctttctgagacatggattggctgatgtgatgaaagccttccgaaagaatgaaaaaggaattatcgtcttggcagggaacgtttcaccgattgacgtgtacagtcatattcctgccatttgtgaagaaaagggtcttccttatgttttcactccgtctcgtgaacaccttggtctttgcgctggctataaacgtcctgcaattgtgcttttggtgaagcgacacgattcatacgcggatcctttcgatcaaacgcacga

SEQ ID NO: 47693 - DNA, 608 bp, Heterodera glycines
  misc_feature (606)..(606): n is a, c, g, or t
  SCN-specific regions: Sequence locations=1-608
atattaaatggcgtggctcagtcgtgcgactttttgtcctcaccaattacaccaaaaagctgtcaaaacgccgttacagaaagcggtcacttcggcggcagagcgtgcgcttgacattgtcggcaatgcgtcgcgagtgcggcttcaggacttgagggacaacccgggcgcgaggacggtgggcaggcaagtgcgcgcgaagggccacaaccaagcgggtcacaccattggcgagttgcaacacgcgtcgaagccgccgctcggctgggtttgggacgactattacaaaccttggcagcggtcctttgacggcgacagacgcttcaacggggacataaatctccgccgtgaatacattcccatttctttggtcgagcttcagcgcctcatcgacttgggctggttggacacgagtcgactcgtcgacatcgccgcaatttgtgccaccaaattgttggaacagaaattcaagccggaattgcgtcagtttggcattcatctgactgatgaaggcgaagaaatattctcaactccgatcaatttggaggtccaatgggcctcgtgcactgcaattgctgccatcgaacgcgctggtggtcgaattcnga

SEQ ID NO: 47694 - DNA, 683 bp, Heterodera glycines
  misc_feature (628)..(628): n is a, c, g, or t
  SCN-specific regions: Sequence locations=1-683
gcgtaagaccggagtgcgggaattggaagtgttgaagaagttgaacgaggccgaccgattggacaagtatcacattttacagctttacaggcaattttaccatcggaatcacttgtgtttggtcttcgaaaatctcagcatgaatttgagggaagtgctgaagaagtacggcaacaacgtcggccttcacatgaaagcggtccgcagttatgcccagcaattacttttggcaatgaaactgctgaaaaaatgcaacattttgcatgcggacataaagccggacaatattttgtcaatgccgcaaaatgttgtagcatctgttcacaatcagtctctcactcacatagtgtgaatgagacaaaaatgcttttgaagctttgcgattttggctctgcttgtcacgtgggcgacgcggagccggccccctatttggtgtcccgtttctaccgcgcccctgaaataatgctcgggttgccctacgattttggaatcgacctttggtctgtggctgtgactttttcatgatggatttgcgcgggaagttcccgaacaaggtgattcgaaaggcggtcttcaaggaccaacacttcgactacaactgcaattttttgtaccatgagacggacanagtcaccgggcaagacaaaagtacagtgctcaccaacatcaaattgttgcgcaat

SEQ ID NO: 47695 - DNA, 566 bp, Heterodera glycines
  SCN-specific regions: Sequence locations=1-255,279-544
gatgtttggcaatattacatcatccagtcaggcttttacctttctctcctcttcagtctttttgcctttgacgttcggcggtccaaccattacgaaatggccacgcaccatttggccaccattttgctcctcttcatgagcttctctatcaattttgtgcgtgccgggacgctcattttgcttctccacgacagtgcggacgtttttcttgagcttggcaagctgttccgttatgctggctgggaccgggcggtgaccatcgacttctgtgtgttcatgttggtctggatcagcacacggcttgtctacttcccactgaaacttgtccggtatatgctgttcgacgcacccaagctcattatggagacctatcggtaaaaattgatggaccgacattcttcaaaaaccgatcatccctcgcgtctttttggccgttctttgtattttgctgctcttgcacatcttctggacctatttgttgatcaaaattgccatcaaatccgtgaagagtggcgttgatgacatcagggaagatgaggacgacgattcggaggaggaagcggaga

SEQ ID NO: 47696 - DNA, 514 bp, Heterodera glycines
  SCN-specific regions: Sequence locations=26-514
atatttatttatttaaaatgtcttcgcataatacttcagttattgatgaaaatcgacgatggagtgacttacgctgtttaacagatagggcgtctacatttgccaattcaggattcgtccctggaatcaagaatttgaaagaagttcataaaatgccggtgctagttgttggtgctggtgggcttggctgtgaaatccttaaagacttggctttatctggtttccatgacattcatattattgatatggacacaatcgatctctcaaatttaaaccgacaatttctctttcgtgaaaatgacattggacgctcaaaagctgatgtggcggctgcctttatcgagaaaagggtgtttggctgtaaagttactccccataattgcaaaatccaggacaaatctctcgaattttatcgtaaatttttcattattatttgcggacttgactccattgaagctcgccgttggcttaatgcgactgtgtgctctttggttgaatttgatgacggaaataa

SEQ ID NO: 47697 - DNA, 608 bp, Heterodera glycines
  SCN-specific regions: Sequence locations=1-608
gcttcttcgttttaaattcatgcagtttttcgacatgaatctgagatatgaccccgtccgtatcaatcaattgtatgaacaggccaaatggtccgtccttttggaggaggtcgaacacacggaggaggagtcatcattatttgcagcgctgcagttgcaagccgcgcttcagcgaaactctccggaccgcgaatctccggaacgtgacgaggtcgatgtactgcttgatgagttggaacagactttggacaccactgcctcactaagtcgccgtgatttaacatacgtgcctgagttgacagaatatctcaaatatttgaaacctaaaaaattgggttttaacaacttcaagagagcttactttacatttcgagacctttacttgagttattacaacacagctcaagatgcaaatgggcctccacttggtcactattatctcaaaggttgcgaggtcagccaggatttgagcgtctcgcaaggaaagttcaacataaaattgcaagtgccgagcagtgaagggatgtcggaactaatattgaagtgtgacacggagcaacagtttgccaaatggatggccgcttgtcgtttggcatctcgtggaaaga

SEQ ID NO: 47698 - DNA, 495 bp, Heterodera glycines
  SCN-specific regions: Sequence locations=1-445,469-495
ccttctcaatgtgttgctacaggcgtatgattttcaacccgtcgagaaatttcaagcgtacgtacattgggccgccaaacattttgggatacaaatcgtagaaagttatgctcttgcacacacttctgagcttgtcaaggagtacaaggctggctcgaccattcccgtttcgcaatctgttttgaaaacgtacagcagagttgtgcgggttggacccgtccccggcatccaactccccctcttcattgcccttttgcaagcgcacgcacccgttgggatgaaaattgttgtgaagaaacattccccgcgcgacgaacgctgcagatatattcctgacccacaattggaagattttaaagaaacgttgcgtaatttggatgaccctgtcgtcaggaaacttttgggttgggaggcgtaacaaccgagtcaatggaaatgtacagtaattaatgcttactgttttaattctcgaaaataaaaaaagtgtgcaaaatt

SEQ ID NO: 47699 - DNA, 590 bp, Heterodera glycines
  SCN-specific regions: Sequence locations=1-46,70-152,174-590
gacaacgtttctacttttacttctgaatctataagtactacttccctattttaaaataataattattaagtgaattttcgacttacctataaatgtttctgacccgcagcgaatacgacaggggagtgaacactttttccccggagggccgtctgttccaagtggaatatgccatcgaaactgtcaagcttggttccacaagcatcggaattcacaccaaagaaggcgttctttcggctgcggaaaggcgttcaatgagcaaattggtggtggacgactcaatgagcaaaatttcggaagttgagaagcacattgccgtcgcctcggccggtctcatcgcagattcacgcacttgggtcgaacacgcgcgggtggaggctcaacacttttggtttacttacggtggcaaaattcgggtggaagacattactcaaaaggtctcaagattggcactgcattttggagacgacgactcaactatcagtctcggccgtccgtttggagtttctatgctttttgccggcattgatcacacgggtgcgcatctcttccatttggacccgtccgggacgtacattaaatgtttggcc

SEQ ID NO: 47700 - DNA, 579 bp, Heterodera glycines
  SCN-specific regions: Sequence locations=1-579
gcaccgatgtgctggtgattttgatgtcggacaacaatttggaagcgaagtacaccgggttcgagctgagttacaaatcggagggcacagatccgacagtaatttcaccaatggtaacagcgaagccgacaattgctataacgaaaaggccgccgaaaacattgaccaacattacgccaaagataacagtagaaacaacgccaaggataacgacaacgacggacacaatgccaaggataacgacggaaacttcgccaaggacaactacggaaacatcgccaaaaacaacgacaacttcggaaccaacgaccgaaacgacggcggaaccaactaccccaaaagaagaagaggggatttggagcaaatggggcggatggagcggatgttcggcttcgtgcggtgcgtgcggtcacaggagaagagtccgcacgtgtttcaaaggcaaatgcaagggggagtccggccaaatggagcgttgcgccttcggaatttgccctttggccaaacgccgaacaaaccgttgtcaaggtcgactggtaatgccatgcgatctgatggaaagcctcgagttcggcacgg

SEQ ID NO: 47701 - DNA, 539 bp, Heterodera glycines
  SCN-specific regions: Sequence locations=24-61,83-96,118-120,142 -382,404-539
tttttttttttttttttttttttcgtctgcgtgtttaacatatgcaaatcttattcaacaataaaagaaaaaaggggtttttatctaaggataaaaatcattccactggggaagcatcggttcttttctttccttccttcacatttttgatcagttcgtcaattgtttttgccctttctttgtcgccacagcctttttccagctgagcaaatcgcatcaaaatagtcaaatgtcttttcttctccgaacattgaaaaaaacgcttaagcaagttttgaaatgcgtcggcatcgttttgctgtaaaaggggcctcccgtactcaaaccatggctcaagttcgaggggccgaaaccttttaatcattgattcgtataattctccgatctcctcttctcttccttttgcgttcgtttgcttcttcaacagtccaatcaaataccgatgcatttgtatggaattggacacggcacacgcccttttgaacacttcctgcagcgattcttccgtccctaatgcaacttccaaattcaaataagca

SEQ ID NO: 47702 - DNA, 588 bp, Heterodera glycines
  SCN-specific regions: Sequence locations=1-266,288-588
gcatatcctttgtccgaaatgtaatggtgtcggcggcgctaaggaaggggtcaaacaatgcgaaaattgtcgtggacgcggactggagattcacaacatgcaaattggtccgggaatgattcagcgaattcaaagagcttgttctgaatgtggcggtgagggggaaataaatcgcaacccgtgcaaacactgtggcggcaaaaaacggatcaaatcagaagagacaatcgaagtgcatattgagaaagggatgcgcgacgggcagcgactgatgttctacggaaagggcgaccaacagccggggctggagcctggcaacgtgatcattgtgctggacgaggaggagcatcccgtgttcacgcgaagaggcaccaacctcaccctgaacatgaaactgacgttgacagaggcattgtgtggctgcactaaacatgtggtgacgttggacaaacgcattctcagctttactcagttgcctggcgaggttatcaatcaccgcgacttctatgtaatccaaggcgaagggatgccgacccatcgtcacccggaccaaaaaggcgacctgattatccaattcttcgtggattt

SEQ ID NO: 47703 - DNA, 591 bp, Heterodera glycines
  misc_feature (589)..(589): n is a, c, g, or t
  SCN-specific regions: Sequence locations=1-284,306-346,368-591
cgacgaagacaatgatggcatcacccaacttggtgctattggcagttggcctgtgactaacgaatggtcgacacctccggcgactgaactgccagaactcccgaatggtgtcggtactgatggtggcgttgtgtccgaacgactgatgctgtcaatcaacgagacagtgctcaaccaattgctgcaccagtttagatgggacttcaaaattatcgaagagaagatcccactgaacagctcgagcttgccggaggaaacgcgggacttttttgccaacctctgtccccagtgcatttttattttcaacgtgtcggctgacggacttcccagtatgaccatcgaagacgactccatcctgatcaaaatacacaaccgaattgctgccgaagttgagaatccaacaattggagagagcggacagaagaaaacggccatcgatctgacactttctctggccgtgcaactgatcccacaagtgcgggacggtattttccacacgcagctgaacctgaaggagcgcaaaattgacatgaaaaacaagacagcatttccgaaacagatgaagccggtggtggaggaactgctgcanga

SEQ ID NO: 47704 - DNA, 540 bp, Heterodera glycines
  SCN-specific regions: Sequence locations=1-479,523-540
gtccaaataagcaatactccctttttcccaaatcttacaaatgaacatgaatcaacttttggttggccgttcgctgttcccaaaaatcatccgccctttctcgcacaccaaaccccttgccaagtctgaggctgacccggatgattacggctacttcccggacccaattgaacactcatggggtttggagaggaaaatgctcatcgctcgtctgaagggtgacgaccgctatgagccgaaggtgtatttccgcgctgaacataccacccgggactatccgaatttggtgccggtccatttgcaggacaaagtcgtcgggtgcctttgcgagccggacgcggagtacgtgaactattggcatattaggaaaggccagatgaagcgatgcgagtgcggacattggtttaagggcgtgcaagccgaccctgacagtttcgcctgaatgcgatggatacgaattggctttgaagtgataggagatcatataaaatgatcagttattttaattgtatttctaagttggttggataaatgtaaagc

SEQ ID NO: 47705 - DNA, 594 bp, Heterodera glycines
  misc_feature (558)..(558): n is a, c, g, or t
  misc_feature (578)..(578): n is a, c, g, or t
  SCN-specific regions: Sequence locations=1-75,99-212,235-594
gaggcgtattgttagtcaaaaatggtgaattggccttggagtgcgaaacagcgcgacgaaccggcgcaagacaagcaaaaagttgtgaccactcatcccgaacccactcaaggcattcacggaatccgaaccattctgatgggtccacccggtgcaggaaaaggcactcaggctaccaaactggcgaaaaagtacgagtcgtgccacctgtccactggcgatctgctcagagccgagataaaagcaggcactccacttggccaaaaaatcaaagggctcgttgaagggggcgacttggtgtcggatgacattgtgtgtgagatgatcgacaagcatttgtccaccgccgagtgtcgcaacggattcattctcgacggttttccgcgcaacaccgcacaggcggagaagttggacgctctgttggagaaacgccagcgccctttgcaggcggcgcttgaattggcgttggatgactctttgctggtcaaacgcatcactggacgtctgttccacgtgccgtccgggcgcagttaccacgagcagttcaacccgccgaanaaggcgatgactgacgattntacgggcgaaccgttg

SEQ ID NO: 47706 - DNA, 638 bp, Heterodera glycines
  SCN-specific regions: Sequence locations=1-518,540-638
ctttatcgaccacaacaacaagacgaccacctacaaccacccgcggactggtcggcctgttgggcctcttggtggtcccggcttacacatggctgccgacaaaacattcaaaaacaaagttgcccagttccgttatttgtgctattcaaacagcgtgcctaaccatgtgaaaatttctgtgacaagaaacaatttgttcgaggattccttccaagaaataatgagaaaaaaccccttcgacttgcgtcgtcggttgtacattcagtttaaggcggaagatggactggattacggtggaattgctagggaatggtttttcttgctctctcacgaagtacttaatccgatgtattgtctgtttatgtatgccaattcgagcaactacagtctgcagattaatcccgcttcttttgtaaatcctgaccacttgaaatattttgagttcatcggtcgcttcattgctatggcacttttccatggaaaatttatctacagtggtttcacgctcccattctacaagaaaatgcttaacagaaagatcactctcaaagacttggaatcggtcgacactgaattttacaattccattgtttggattcgcgacaatgacattgatgaatgcgacatggaattgtact

SEQ ID NO: 47707 - DNA, 469 bp, Heterodera glycines
  SCN-specific regions: Sequence locations=1-22,46-128,150-469
gaatctataagtactacttccctattttaaaataataattattaagtgaattttcgacttacctataaatgtttctgacccgcagcgaatacgacaggggagtgaacactttttccccggagggccgtctgttccaagtggaatatgccatcgaaactgtcaagcttggttccacaagcatcggaattcacaccaaagaaggcgttcttttggctgcggaaaggcgttcaatgagcaaattggtggtggacgactcaatgagcaaaatttcggaagttgagaagcacattgccgtcgcctcggccggtctcatcgcagattcacgcacttgggtcgaacacgcgcgggtggaggctcaacacttttggtttacttacggtggcaaaattcgggtggaagacattactcaaaaggtctcaagattggcactgcattttggagacgacgactcaactatcagtctcggccg

SEQ ID NO: 47708 - DNA, 590 bp, Heterodera glycines
  SCN-specific regions: Sequence locations=1-590
gctcagcgacttgttgcgattgtgactggcggtgcttcggggcttggctgtgcgactgttcgtcggttggtcgccaaagggttcaacgtttctctgttggatttgccaatgtctgaaggagcgaaagtggttttttaattgggcaccactgacaatgtgcttttctctccggtcgatatttcgtctgatgatcaagtgaaaaaggcaatggacgcaacaacggagaaatttggtggtctcaatgttttggtcaattgcgctggaatcgctttcgcgcagagattgtacaatccgtcgagcagagcccaaatggacctcgacaaaattcggcgactcatcgacgtgaacatcttcggcaccatcaacgtgatcagacacgccctcccgctgctgattgacaatgtgccggacgaaaacgaccagcgcggagtgatcatcaacacttcatcaattgcagcctttgaaggacaaatgggacagaccctttattccgcttcaaaaggtgccgttgcatcattaaccgttccattggcgcgcgattattccaacaatggcattcgcgtgatggcaattgctcccggcttaatgga

SEQ ID NO: 47709 - DNA, 659 bp, Heterodera glycines
  misc_feature (132)..(132): n is a, c, g, or t
  SCN-specific regions: Sequence locations=1-14,36-659
ttgttaattgtttgataaataataaaataataattgcacaacgtcaatgcctccattatttcccgaaaaggtagagagcattcgtcacttgtccacaaaatcttgggaggcgacatttacgaaggattattnctcctatgaaggccaactccgttttctttcgcgcatgtgttacctcgcaatggcacattaccttttgtaccgtggagtgctccccaaaggagttttcaaacgccgaaagctcgaagatttggctatttactgtttcgatggcaacacgcgttggggacgtaaattgtcggagatgatgaaaggtatcagagaggccatcgaccaaaagtacatcaaacaagcattcgtgatgatcaacgaggacaaagaggacccggacgtcgcaactgaagttttctcagtcggtttttgttacaacgaacagcacacgatgactgtcttggatgacaaaggcaatcgtatcgtttcatttggctacaaaggggagaaggtttttcgaatgcaagtgaagcacatcatcaagaagctcagtgtggtcactaagaatctggagccgttgaaaaagggggccgtgccttatttgaaactcacttattacgagaacacgccggatgactacgagccgtcaatgttcaagcattgcgaga

SEQ ID NO: 47710 - DNA, 469 bp, Heterodera glycines
  SCN-specific regions: Sequence locations=1-201,226-353,395-444
gttcttcgttatttttttaaaattgatcctcgcatatatgtacaccgataaatgacattgtcatttaacgaagctgcttccgttgtcaaaactttgaggacttcgccctctaatgacgaattgttggagatatacgcattgtataagcaagcgacctgtggcgacaacaacacatgcaaacctggcacttttgatttccgtgggaaggccaagtgggaggcgtggaaaaaaaagcaaggcatctctcaggagaaggctcggattgattatgtgaaaattgtcgaaaaaatggtggccaaatacggtgttaattagaaggagcaccaaaagaggcaatcacttagacccgatgctttaatattgtatttaaaaaacaaatattttataatattttgaatgctattattgaaaatatttgtgaacccgtatacaaaatgatcattgaaaaaaaaaaaaagaaaaaaaaaaa

SEQ ID NO: 47711 - DNA, 528 bp, Heterodera glycines
  SCN-specific regions: Sequence locations=1-164,186-255,290-315,337-528
gacaattaattgtccaaataagtaaaagataatttactaatcaaataattactattggtttttgacagcaaattgtctgattgaatggcaaaaaagcagtacgaccttttgttcaaacttctgttgatcggcgacagcggagtgggcaaaacttgcattttgtacagattcagcgacgatgcctttaacacgtcttttatttcgaccattggaattgacttcaaaatcaagacgattgagctgagagggaagaaaataaagctgcagatttgggacactgcgggtcaagagcgttttcacacgattaccacctcatattaccggggcgccatgggcattatgatggtttacgacataaccaacgcgaagagcttcgacaacatcgccaaatggctgagatacatcgacgagcatgcctctgaagatgtcgtaaaaatgttacttggcaacaaatgtgacatgtccgaccgaagagttgtgccgaaggaacgcggggaaaaaattgcgattgaccatggcattcgtttc

SEQ ID NO: 47712 - DNA, 578 bp, Heterodera glycines
  SCN-specific regions: Sequence locations=1-93,116-446,473-578
tgaaatgcgcacatcagcagcatcaacaggacaaaggcggtagtggacgaaaaacgacggctgccggtgcgtcagcagacgcggcttggattacgagtggtgtgttcatgcagcccattggtgatgaggactcccctcgagttggccggcaaacgtttggcagcaattcgatacgatagaaacaatcggctgatggccgaactgttttcgccctcttatttgcccgacccgcgcgcctttgtgccccaacagcgcattgaccattttcggcgtcagcgcatgtcgctggagcagcaccaagtgaagtccaacgaggagttggcccgcatggcggagctgttcagccagcgcaagcgggccatccaacgcgactcggaggcgtaccatgaaatgctgaaaaaagtgtgcgcagaacggccccgggtggaccagcagcggtgcgaagagctgaccgagcagtacaaggagcagttgttgaacgcatgggaccagttccagacaaagcaggccgcaatccaggccaaactggaagccgatcgacgcgcaaacccagtgttagccgaattgatcaccggaaa

SEQ ID NO: 47713 - DNA, 595 bp, Heterodera glycines
  SCN-specific regions: Sequence locations=1-436,461-595
gaacataatcatcatttttcttttctttctaatattcaattttttgaattaacataattcttttggaatggctcctgcaccagaaaaggaaaaaactgaagataagaaactgaaagacgggcaaaaaccaaatgtgaccacggatcacgcacactgtttgagcaatgtccaaccaaatcttcccgtcaataaagtggtggtgcatccgctcgttctgcttagtgtggtcgaccacttcaaccgcgtgaacaaaacgcacaaagtcaatcgagtggtcggtgttttgcttggttgtatgaagcacgacaaaacccttgacatcgcaaattgttttgctgtgccttatgacgaggactccgagaattcgaacattttctttcttgatgctgattttctggaggacatgtttgggatgttttacaaagtcgcggcacgtgaaagaattgtcggatggtatcactctgggccgcgtctttgcaagaatgacattctgatcaacgaagtcatcaaacgctttaccccgaaccccgtgctggtcataatccaagctgctcaaggccgacaggatttggcactgccgacggatgcttatgtg

SEQ ID NO: 47714 - DNA, 590 bp, Heterodera glycines
  SCN-specific regions: Sequence locations=1-173,195-590
ccaaaaccaaaaggacgccgattctgagcgaattttggcgagaaggaagcgaattgagctgtacaaagagaccaatgagcaagtgaagcgggaaaaattgcagaaggaacaggcacaggcgaacaaacaggaggaacagcgcagaagggaggagttgaagaagttgcaggaggagaacaaagagaacgagcggaggcgcaaactgaacgaacaggaggagattcagcgaaagttgcaatccgagaagttgaagaagtaccaggcgcaccctttcttccaacagttggtcaaagagcatggggaggcgatattcgacaaagttgaccctgacaaactcatcagagagaagcgaattcgttttgacgctgagcgacgcgagcagcagaccaaattgcaaaacttggagaagaaatatgaccacaccgtccgggcatttcatttggaggaaatggcactgtggaaacatttgtcggacgaacgccagagaatttacccgggacttcatgaggcttacgaaacaaaacgaattgaaaaggcggtaaaggagcgcgaattgtcattcgaaaaatatgcttatttggtgagcgcca

SEQ ID NO: 47715 - DNA, 544 bp, Heterodera glycines
  SCN-specific regions: Sequence locations=1-544
atttgaatgcattcgggacaatttgctgactttcatcaaggccaacatgcgcaaaatgctcttcgacaagatttccgctgtccttgttcttgacactttggaagtcccgtcaccttcggatccctttcttcgtgaaattggcgacagcgatttggatgactgtttccgggctattgctgagattgccactgacgaattcgtcccccattcgcccgatggtccgtcccatattgtgcagggcggttgcgctcgcttcgtgttccgcaaactgttgcaggcggacccgggacggtgtgacggacaccgcctcagcgacttcctgaccgaccttccggccgacaatttgtcctcctggaccagcatggactgcggatgttacaccctggtggaggtgttcaagagcgggtcggacaaggcccgcaaggtgctcagacgggcgctcagtgtggccatgttgcagaattcgcatttgtccggcgccaagtctttgttggatttgctattgggcaaaggcaaagagcaaccgccgcgggaacattcggtg

SEQ ID NO: 47716 - DNA, 518 bp, Heterodera glycines
  SCN-specific regions: Sequence locations=1-401,443-518
catcagtgactcggaagacgaacggcacaatccaagaaaagccatcaaactcccgggcacacggcacacagacatggccgaacggtccatccaccaacccgtcactgttaccaagatgggcttttgtccaactggtggttctttcgccgtcgtttcaacggaaggcgttgcactttactctctgttccaaatgcgaagattcgaccccttccaattggaaattgacgtggtccccaactccatcgtccaattttctctttccggcgaacacgcgaaagccatttcgttggcacttcggctcaacgatgccaaactgacgaggagagtggtcgaatccgttcccattttacaactttctgctgtcgttcgggggattgagctgatttacatcgaacgcctgattgtttggcttttgttttttgctgacaaaggccaccaaaagcatgtccatttttaccaattattggtccgagaaattcttattgcaaatgcatccaagctgaagcaatcagttgatc

SEQ ID NO: 47717 - DNA, 587 bp, Heterodera glycines
  SCN-specific regions: Sequence locations=1-587
gacacgtggttgtccaataagaaagcattaaaatggcatcgaatttgacggttaaagttcaccccatcgtttacatgtccatcgtcgacgcctatgagcgtaagtcatcttcgaacatcaacagtcgcgtgggcaccgttcgttccgtggaaacaacggaaaaccgagcgttgggcacgttgttgggattttacaagaagaatgtcgtccaggtgacaagctgttacgccgtgccgttccgcgagacctccgacgacattcccgaaataaatgatgcattgaacagacaaatgtggcacatgtccaaaaggacttcgccgtccgaacaaatcgtcggatggttcttcactgtgcccgacctttctgaaatgtgtccgcattatcacggctattacacggggttagtcaatgaaacgccgcgaaaagaaccgccgcccattattctgatcaccatggatttcaccttttcgggagagagcgccgaccgacttccgatcaaagcatacgcggcacgcgaggcgggggtcccggggaaaggagcgactcaagcgacgattttctacccgttaaaagttgaaatggacgtg

SEQ ID NO: 47718 - DNA, 580 bp, Heterodera glycines
  SCN-specific regions: Sequence locations=1-265,288-580
gatggaccatatgaagccgaaaatggtgcacgcttttctcacctcactcttttaccaaagacggagcaaaatgaacccatttctgaacacaatggttgtctgcggcatgcaaccggtcgagtttcatgccggataaattaagcctttcaccggcgtcatcgacatgcgtggcaatgcctatgaagttgaccatgtcgcgacagaaattggcaaatatttgcttcgccaaatgttggagacgcgacaaacgcaggcaaatggagcggaacaaatgagcaaagaagaagcacttcgaatggtcgcagcggcgttggaggtgtccgtcagtcgtaacagcagaacgggccaaatgttcgatgtttccactgtggacgccaacggagtgaaattccacgaccaattccaaataattggcaaatgggacgaaatcgaagtgtgtgacggcacttacaagtaaagcaacggaaaatgatggaagtgattggcacagaattttggatgttttggctcggatttggttgtcgatatgttaaaatgttttttttgaatcaaatgttctcaataatatttatattattgc

SEQ ID NO: 47719 - DNA, 539 bp, Heterodera glycines
  SCN-specific regions: Sequence locations=1-115,143-539
gggatttgcgtctgtgtgcgaaaacgaccgttaggcaaaagggaattggcgagcagagaagtggaagtgatcaccgtgccgaatcgagaccatgtcattgtgcatcagcctcaagtgaaggtggacttgaccaagtatttggtcaaccacaaattccgctttgactacgtcttcaacgaagcggcgacaaatgaaatggtttacagattcagtgcccagccgcttgtccgaacaatttttcaacgaggattcgccacctgttttgcctatggccagaccggttctgggaagacgtacacaatgggagggatcatcgaaggacgacgccaggattgctcaaacggaatttacgccatgacagcacatgatgtgtttgcgatgcttcattctcctgagtatgccaatcagaaactgaccctctcgtgcagtttttttgaaatttatggttctaaggtgtttgatctcttgaataaaaaatcggtacttcgcattttggaggacggaaagcatttggtacaggtggtcgggctgagggagac

SEQ ID NO: 47720 - DNA, 489 bp, Heterodera glycines
  SCN-specific regions: Sequence locations=24-489
tttttttttttttttttttttttcgtttatactttttaatcattgtatttaaactgacaatgagtttctaataacttggtttctattatattgatacaaattacggttttttggaagcatcatcaagctttttggcctcaattttgcctgccttttgaatgacattgtatccggaggttatcgattcgtcacgaaatgcagggaaaacctcccacggtgtgttcaagtcaaacttccggaactcttgtgtcatttcggttggctcataaatcactcggttcagctcgtggtcccaacgcagttcgacgtatccggacaatgggaagtcttttcgctggggatgaccttcaaacccgtaatcggtcaaaatacgtcttaagtctgggtggttgttgaaccaaaccccgtacatgtcgtagatttcacgttcataccattcagcaccggaaaagactggagtgatggaatcgattggagcaacttcgtcag

SEQ ID NO: 47721 - DNA, 258 bp, Heterodera glycines
  SCN-specific regions: Sequence locations=1-258
ggggaggttaaatggcaaggtcaccgctgtttttactttccatttttattcgcactgaatttgtcctttgtgcagtaaaatcgaagaatcttttgaatctaaatgacgaaaattggcgaaacattctcagcggccaatggatgatggaatttcacgctccgtggtgccctgcctgcaaagacctccaaaaatcatggaattcattcgctgattggtcaaaggatttgaacataaatgttgcggaaatagacgtgacca

SEQ ID NO: 47722 - DNA, 442 bp, Heterodera glycines
  SCN-specific regions: Sequence locations=1-14,36-100,123-189,213 -255,301-324,349-360,384-442
gggaacccagccaccgttccattcgtcccaatctctggcttcaatggcgacaacatgttggagccgtctgacaggatgccgtggtttaaggggtgggcgatcgagcgcaaagatggcaatgcatctggcaaaactctgctcgaggctcttgactccattcttccgccgcaaagaccaactgacaagccgttgcgtttgcctcttcaggatgtgtataagatcgggggtattgggacagtgccggttggccgtgtcgagactggtgttctcaagcctggaatggtggtcacttttgctccgcaaggcatttccactgaagtcaaatcagtggaaatgcaccacgagtccttgccagaagcgcttccaggagacaatgtgggcttcaacgtgaaaaacatctctgtgaaggacattcgccgtggttcggtcgcgtccgactcga

SEQ ID NO: 47723 - DNA, 371 bp, Heterodera glycines
  SCN-specific regions: Sequence locations=1-325,347-371
gggcaacaagatccatccacgccctcgtaaagtgttgcagctgcttcgtctgcgtcagatcaacaacggcgtattcgtcaagttgaacaaagcgacaatccagatgttgcgcattgctgacccgtacattgcgtggggctacccgagtcagaagatcattcgccagttggtgtacaagcgtggttatgccaaggagagtgggcagcgcattccgatcacggacaatgccattgttgagcgaaacatgggcaaatcggacgtgatctgtgtggaggacatgattcaccagatttggacagtcgggccccacttcaagcaagtgaccaactttttgtggcccttcaaactcagcaaccccgtgggcgggttca

SEQ ID NO: 47724 - DNA, 334 bp, Heterodera glycines
  SCN-specific regions: Sequence locations=24-125,147-258,280-334
tttttttttttttttttttttttattaacaaaacaacaaaatttatcattcactcaaaaggaacggacaacaaaattggaaacgcaattccaagcttcggtgcggcatcacttcgcctttttagccttcagtttcttgttgtagaactcgagttctttgccctccaaaatgtacccatcgcagcgtccgctttggcctggtcgtgagcttatgcaagcgagaagtcgtccggcctggaactgttccagaagatgcggctccaccccggcggttttttggcgttccgtgtatttcttcagagtcgactttgagcgtttctgtgctcctccaatcc

SEQ ID NO: 47725 - DNA, 337 bp, Heterodera glycines
  SCN-specific regions: Sequence locations=1-129,151-337
ttttgtactccatcattgtccggcgtgtccggacgaaagccggccaaacaggcaagcgcttcacaacagttgcgggccagtcggttaagtaccgcttggtggttcgtcttctcggaatgggcaacccctccttcgtccaacgtgtaatcgaagcgaaaaagatgaggtaagagttgccaaatgacacccgcttgaaacagttgcgtctgtaacaatgtgcacactgaaaaggcacaaacgcactccgtcgcagcgcaagccaaccgatggagagattcgaatctaagcagctggtaaatgctttggaacaacgttttcatttctgcaattttttcac

SEQ ID NO: 47726 - DNA, 325 bp, Heterodera glycines
  misc_feature (235)..(235): n is a, c, g, or t
  SCN-specific regions: Sequence locations=27-325
tttttttttttttttgttttttttttggtggtcgtattcaggcgccagataatgaacatttttgatgttctcacggaatgtcttcacatggtggtgaatggtttttggtgcgacgcatccaattttgaccagtccgttctgttggatgaacacggaattgcacgtgaggttggcgtgcacaatgggcgggtcgcacgagtgcaagtaggacagtgcggtcaaaatttgacgcgtncaactcttccacgccttgatgttgagcagtgaacccgaggagcgtgccctttgcaaaaaacgcgacatcgaaccggaggacatgtattcg

SEQ ID NO: 47727 - DNA, 503 bp, Heterodera glycines
  SCN-specific regions: Sequence locations=26-233,256-471,493-503
tttttttttttttttttttttttttgcaattttatgtgtttatcaatgaaagtgacgtttggagtaattggccaatcgcttttaaataaatgcaagcataaaattgagatcaaatgacccttctcgaacttctattgacctgattcattgaaatttgcaccaaaacagtattcattggattcaagagtccgtaaattcagcagaataactgattttgtcttgcaaaacttaggaacagccaaaaggcaacatcttttcgttggttttccgccaaattcaacgattcgtttttcaaaggttggctgattcccgacgaaataaatgtgcggaatttggtccaaaacaagcgggtcgcgtccagaaaaaggaaatccgggaagagtgtcggggactgtcgggaaaatatagcccatttccaacgtgcgttccatcaatgctaatgtgtcctttccgcgtgtcaaccgccgcaaatcattgatgttttgacctgatgtccccaaaaa

SEQ ID NO: 47728 - DNA, 426 bp, Heterodera glycines
  SCN-specific regions: Sequence locations=1-357,379-426
gggcgacttcaggatgtacgctttctgcgtcaagatgccaagccggaggacaagagcaatgagcaaaacatccccccagggactgttgtcgacactgtcgttgtttttttcaaacgctccgagttcttccttaacagtcacgtggcgatcaagggcactgcttgtacgccacattacactgttctgcgggacgagaacgatatgtcgatggacacacttcaaacaatggtccattacctctgctttgggcatcaaattgtcacaaagccgacctcattgccctcgccggtgtacatcgccgatgaatatgcgaaacgcggtcgaaacatctactcacactacgccaagaacggtattgacaacagcaaaaatttgcagctcttcgcaaagaacaaaggggtggaatggccgctgcgcacttatgcg

SEQ ID NO: 47729 - DNA, 550 bp, Heterodera glycines
  SCN-specific regions: Sequence locations=1-550
gggcatgtcgtctggtgtaatggtgaattccgaatgtcaaaacgctttccaacaactttcggaagggaaacgctatcgttacatcatctacaaaatagtggacaaggaagtgattgttgaggtggcagtttcttcggaagacattggctccactggaactgaaagttatgatgacaattcgaaggccgcgtatgaaacatttgtgaaagacctcaaggagcgaactgagggttttgtggactgtcgctacgcagtgttcgacttcaaattccagacacagcgccccggcgcaggcacttccaagatggataagattgtcttcattcagctttgcccggacggtgcgtcaatcaaaaagaaaatgctttatgcttcatctgcgtcggccatcaaggcgtctctcggaaccgctaaaattctgcaatttcaggtgtctgatgagtcggaaattgcccacaaggaattgctgagcaagctgaacgaacaataccgcgacaattgaatgattggttgggatatgatgtcctgcacattcctctcaatttttgtc

SEQ ID NO: 47730 - DNA, 376 bp, Heterodera glycines
  SCN-specific regions: Sequence locations=28-376
tttttttttttttttttttttttttttcgtactcttttcgattgtttaatgaaaacaaattataaaggaagtggaattaagttcaaatatgttctgcgcttaaagttcacatcacttttctacaatgaaagggtgtttcaaagcatccgaacacgaaattcgtttggaggggtccaaagctgtcatcggagagttcagccggaagattgcgcaacaatttgatgttggtgagcactgtaactttgtctttgccggtgactttgtccgtctcatggtacaaaaaattgcagttgtagtcgaagtgttggtccttgaagaccgcctttcgaatcaccttgttcgggaacttcccgcgcaaatccatcatgaaaaagtc

SEQ ID NO: 47731 - DNA, 331 bp, Heterodera glycines
  SCN-specific regions: Sequence locations=25-331
ttttttttttttttttttttttttctcactttcaaagcgaactttaagatggtcgggaacgtcctcttcagacacagaaccgagcacttcgccagtcgcacttttctttatgtagaccaacatgtacgcattcgtaaaactccgaccaactccttctggattctccccaccaaaatttgcagtcaccgcatcgcgtgaagtgacacgcgaaacgacatcatcatcgaatttacaccacctcggagagcccttcaaattcgtgtttatgaatgccacgtaatgtccgccgtggaaatcaccagaatggacaagcacagcataaagcaaatat

SEQ ID NO: 47732 - DNA, 467 bp, Heterodera glycines
  SCN-specific regions: Sequence locations=1-20,42-467
gggatacaagaggaacttacaagtgctttcgccatacaaatatgccgggtatacccaacttatcaaaaccatcgatctcgagtcgtccgacgacacattgtttgctcgaaccaaggaggacggtggtcaattgctggttgctgccgttgagttatgccattggacgctaaggagttcgtcattgaatgcggagcagttgcgacgagacggagggttagatgctctgtacaaaacatttgagcggtgtgttccgatgattactgcttgttcactcgaaagcgaaatgccagtgcaagtttgtactcacgtgtgcaattgttttgccaccgctgcccgttttgatgcgtgccgtgaaaaaattgcagaaatgaaaacgttgttccaaagcatttgccaactgcttagattcgaatctctccatcggttggcttgcgctgcggcggagtgcgtttgtgccttttcagtgt

SEQ ID NO: 47733 - DNA, 410 bp, Heterodera glycines
  SCN-specific regions: Sequence locations=1-126,151-410
gggggacaagtaattgtccaattaagatgaaagtcaaagtgatctccagacatccggatgaataccaacgcgagacaaaacatgacatattcaaggtgcctcggaattacgccgccccgcccgacccatttcagcagcaggtggagtacacgagagcactgaacgcggcaaagttggagcgcatgttcgcgaagccatttctggctgcctttgatgggcacaatgaggcggtcaatttgttggtcaaacatcccacccgtctgtccaccgttctgtccggtgcgcgtgatggccaagtccgagtgtggcatttggccactcgccgctgtttgcacgtcctccaggcacattccggccccatcaacggtctctctgttgatgcatctgacggtttgcactttgtcacggtt

SEQ ID NO: 47734 - DNA, 462 bp, Heterodera glycines
  SCN-specific regions: Sequence locations=1-124,146-186,209-349,371 -399,421-462
gggcaggactactcttctttctcaaggagggccaaaatgccaattattgacggggaccgacccaacttcaacatccccgaacttcctcataatctaaacacattgcttgatctttcggaagaagagatcctcaagacagataaggaagtccggcacctcaaaaaccaaaatgaggcgcttataagcgaagaaaaaaggattttggaggaaagtgccgaaagtcagttcgaatttgtccgccttcaagagctggaacaacttgtcagcaagttctgcgtatccgctgaagaatcttctttagacgaatgcaaaaaactgttccagaagctacataagcaatttgaggctgaatttaaaatgtatggacttgatgcgttggccatgccaattgtgcttccaaagataaagagatattttatggaatgggatccgttaaatcccgaacaaaccttttttggattt

SEQ ID NO: 47735 - DNA, 376 bp, Heterodera glycines
  SCN-specific regions: Sequence locations=1-65,113-149,182-200,222 -243,335-376
gggattcaactttctttctcgtgctcaattcgtggacaaaaatgtgcgacgaagaagttgcggctctcgtggtggacaacggctccggcatgtgcaaggctggtttcgctggcgatgacgcgccccgtgcggtgttcccgtcaattgtgggtcgtccccgtcaccagggcgtcatggtcggcatgggacagaaggactcgtacgtgggagacgaggcgcagtccaagcgtggtattctgacgctgaagtacccgattgagcacggcatcgtcaccaaccgggacgacatggagaagatctggcaccacaccttctacaacgagctgcgtgtcgcacccgaggagcatccggtgttgctcacagaggctccgctgaa

SEQ ID NO: 47736 - DNA, 512 bp, Heterodera glycines
  SCN-specific regions: Sequence locations=1-467,490-512
gggtgcgatattatcaaaatttcatcgatggtcccaaatcgcgagcgttttgtgaagaggcgagcccgattagttggacagaacggagcaacgctaaaggcaatcgaactcctcacggaatgttttgtgcacattcagggcggcaccgtctcgtccattggaacacactttggactgaagcaagtcagaaaaattgtggaagattgcatgaaaaacattcatccgatttacaacataaaaacgctaatgatcaaaaaggagctgatgaaggatgacaaactgaggaacgaaaattgggaacgttttctgccaaagttcaaaaagaaggtgcaaaatgctaaagatatccgaaaaacgaagcaaaaatcaaaaaccaaatggaagacaaaggccgattacacaccatttccaccaccgcaaaaagcacggaaagtggacgaacaattggagacgggcgaatactttctcaatgagaaggtgaatcataaacagaaaaagatgaaacgcgaaca

SEQ ID NO: 47737 - DNA, 522 bp, Heterodera glycines
  SCN-specific regions: Sequence locations=1-221,260-265,291-332,354 -402,440-522
gggggcactttcattcgaaagcaagcggatcgattcacccagagcgttctcttcagcaaaaccttcacttttctccatattttgttaacaaaatgccaccaaaaccatccggcaagggagcgaagaaggcagtcaagtcgaccaaggcggtgcgcacgggagacaagaagcggagaaaggcccgcaaggagtcttactcggtgtacatctaccgtgtgctcaagcaggtccacccggacaccggcatttcctccaaagcgatgtccatcatgaactcgtttgtcaacgacgttttcgagcgcattgctgcggaagcctcgcgattggcccattacaacaagcggtccaccatctcctcgcgcgaaatccagacggctgtccgactgattctgcccggcgagttggccaaacatgccgtgtccgaggggaccaaggcggtgacgaagtacacctcgtcaaaatgagcaggagacgacgaatgcgggccacaatcactcaaatggacgtgcatgactatttttt

SEQ ID NO: 47738 - DNA, 494 bp, Heterodera glycines
  SCN-specific regions: Sequence locations=1-62,89-222,245-392,416-494
ggggcgttaacaaggactcttatctcatcctggaaaaactgccacccgagtacgactcacgcgtgaaggccatggaagtggacgagcgtccgaaagaaacgtactcagacattggcggatgcgatagtcaaatcagagaattggttgaagcaattgttcttccgatgactaaaaaagatctcttcataaacattggcattcagccgcctaagggcgttcttatgtatggaccaccaggtacgggtaaaacgatgttggcacgtgccgttgccgctcaaaccaagtccacttttctgaagctggctggtccgcaacttgtccaaatgttcatcggagacggcgccaaattggttcgagatgcttttgcactggccaaagagaaagcaccgtccattattttcattgacgaattggacgcaattgggacaaaacgattcagttcggagaaggccggcgatagggaagtgcagcgaacgatgttggaattgcttacc

SEQ ID NO: 47739 - DNA, 628 bp, Heterodera glycines
  SCN-specific regions: Sequence locations=1-221,243-628
catcactgctcccggcgaccgagtcacttacatgatcaacaagacctcttatgtcaaccccgagcatttggactacttccggtttgttggtcgtgtgatcgccaaggccatttatgacaacaaacaacttgattgctactttactcgtgccttttacaagcacgtcttgaacaagcatgttcggtaccaggacattgagagtgaggaccccgacctcttcaaatcgctggaatttttgctgaacaatgccgttgaggacctcggagccgagctgacttttactgttgaggtggaggagtttggtgtgcgatcgactcggcagttgttggaaaatgggaacaagacaacggtgaccgatgccaataaacacgaatacgtccatttgatgtgccaaatgaaaatgacaggctcaatacggcaacagttgaacgcgtttctcgagggtttctacgaggtcatccccaaaaagctcatctcgattttcaacgagcaagagttggaattgcttatctccggcctgcccgatatcgacatcgacgacctttgtgcaaacactgaatacaaaacatacacacggacgagtccgcaaattcaatggttctggcgcgctcttaaagctttcgatgcc

SEQ ID NO: 47740 - DNA, 393 bp, Heterodera glycines
  SCN-specific regions: Sequence locations=1-25,47-179,203-267,293 -311,341-393
ggggactcattccatcgccgctcactcattttcttccctttcctttgtcttccattcattccgcttttccctccccatttctcatttgttcttctccgcttcttctctccccgatgaatcactttgggctgacctttctgttcgtcgccgtttctctgctgacattgacgggcaaaacgatcactttggaggtggagagctcggacactgtggacaatgtgaagacgaagatccaagagaaggagggcgttccgccggatcagcaacggctgatcttcgccggcaaacagctcgaggacggacgaacgttggccgactacaacatacagaaggagtccacgctccacttggtcctccgtctccggggcggaaatgggaagagaaacacgagta

SEQ ID NO: 47741 - DNA, 465 bp, Heterodera glycines
  SCN-specific regions: Sequence locations=1-100,122-330,354-377,411 -435,459-465
gggtcagcgtcaaaattttttctgaagtcgaacgacgatgaggtgtttgaggttgaccgcaatgtgatccgtctctccaccacactcaacacgatgtttcaagaccttggaatggaccaggccgaggcgggtgaaaagatgtacaccgacccaattccattggcaaacgtcaacggtgcaattctccgtaaggtgattgcatggtgcaatcaccacaaggacgatgttccaactggcgaagatgcggagtcgaaagagcgtcgcactgatgacataccgagttgggatgtggagtttttgaaggtcgaccagggaacgctgtttgagctaattttggcagccaactatttggacgtgcgcgggttgctcgacgttgcgtgcaagacggtggccaacatgatcaaaggcaagtcgccggatgagattcgtcgcacattcaacatcaaaaacgatttcacgcccgaa

SEQ ID NO: 47742 - DNA, 471 bp, Heterodera glycines
  SCN-specific regions: Sequence locations=1-130,152-471
ggggataataaagcatggaagactcccagcagaatattactgaacagtcggtatcggcaccaaccactgatcgcaacgaatatgaagaactttccaaattggtcaacccaatctcaaaaccgcttgcaaacagaaaattggctaagaaagtctacaaattggtgaaaaaaagcggcaaaagagaagggctttctgagacatggattggctgatgtgatgaaagccttccgaaagaatgaaaaaggaattatcgtcttggcagggaacgtttcaccgattgacgtgtacagtcatattcctgccatttgtgaagaaaagggtcttccttatgttttcactccgtctcgtgaacaccttggtctttgtgctggctataaacgtcctgcaattgtccttttggtgaagcgacacgattcatacgcggatcttttcgatcaaacgcacgagtcaacttatgcgctggtggtggaa

SEQ ID NO: 47743 - DNA, 504 bp, Heterodera glycines
  SCN-specific regions: Sequence locations=1-101,145-145
gggggagcgtatcattgaagtgtctcattggggcggaaacatcgctgtggaggaaaacgtcgaaattttgcacaaaggagccaaactaaagggttcattttctcgacttgactttcaaatggatcgccgaggttcccgtcaacccgtcatcaaaaactttaagacaattttgccggctgcatccaatgacatttattatcgagatgagatcggcaacatctccacctcaaatgtttatccccgtgccgatcgtgttgaggttgagctccgcccgcgtttcccattgtatggcgggtggcgtacaaattacattttgggttacaacgttccaagtacgtcctttctccgtcattccggctcgaattttgcgatcaaaatgaaactgatggatcgtctctacgataatgctgttgtggaaaaactgtgtgtcaaaatcatattgcctgaaacgagcaagaacattaagctggtcaccccttactctgtgaagcgtcttcccgacga

SEQ ID NO: 47744 - DNA, 282 bp, Heterodera glycines
  SCN-specific regions: Sequence locations=28-47,91-282
tttttttttttttttttttttttttttatgctttacatttatccaaccaacttagaaatacaattaaaataactgatcattttatatgatctcctatcacttcaaagccaattcgtatccatcgcattcaggcgaaactgtcaggggcggcttgcacgcccttaaaccaatgtccgcactcgcatcgcttcatctggcctttcctaatatgccaatagttcacgtactccgggtccgggtcgcaaagggacccgacgactttgtcctgcaaatggaccggca

SEQ ID NO: 47745 - DNA, 487 bp, Heterodera glycines
  SCN-specific regions: Sequence locations=1-149,171-487
ggggattcacttactttattattctattgcgctattcttcttctgcaacacattaaacaacgacgcatgccggaggaactggtggcgctcagtcccggaacgcgtgtctccggccgctggaccatcatcaagaagcttggggcgggtgcgtttggagccgtctacttgtgtcaagaccgagatggaaggacaatggcagcactgaaaaccgaaccgatcgacgctcagcgaccactgctgtatatggaggcccacgtgttgctcagcctgaacgaacttcgatcaaacagtggacgccatttttgccgttgtctggaccttggacgcgatgaacaaccggatgccgattctggacagacgatggagttcaactacgttgtcatgtcgttggttggccgtccaatggacaaactccttcacgaatccggtgaccgcttcagccccggaactgcgatcggcacttcaattcaacttctcaaagcgctta

SEQ ID NO: 47746 - DNA, 414 bp, Heterodera glycines
  SCN-specific regions: Sequence locations=1-202,224-414
agaaatttacattcgatcacttacgcaaaatcaaattcaatcattcggatgctcttcaatcatttgggcgaagcgactttccaaaaggccattcgcgattacttgaaaaagcaccaatacgcaaatgcagagaccaacgacctgtggaagagtttgtccgacgcttctgggattgatgtcaaagcactgatgtcttcctggacccaacagatgggcttccctttggttactgtcgaggaaaaaattttggatggagaccgtattgaattgcacttaaaacaatctcgctttttggccgatggaggtcatgacgaagcgaaccccgtttggcaagtgccgttcggagtcaccaccgcggcggacccgactcatccaaatgccaaatttttactgatgaaagccgaagacaaattc

SEQ ID NO: 47747 - DNA, 544 bp, Heterodera glycines
  SCN-specific regions: Sequence locations=1-28,51-281,308-544
gtgaaatggcttctcgacccttggtctctatttataatgagaaaaatgagccaaccggcaagcaaatcaagcttccggccgttttccgggctccaattcgacctgacattgtgagcttcatccatgaccaaattcgcaaaaacaaacgacaagcgtatgctgtgtcaaccgctgccggtcatcaaacttccgccgagtcgtggggcactggtcgcgcagtggcgcgtattccgcgcgtccgtggcggtggcacccaccgctctggccaaggagcgttcggcaacatgtgtcgtggtggccgtatgttcgcaccgaccaaagtgtaccgtcgttggcaccgccgggttaatgtggcgcaacgtcgttacgccattgtgtccgcaattgccgcttcggcggttcccgcactggtccaagcgcgtggccatgtgattgaccagctcaacgaaattccgctcgtcatttcggacaaaattgagtcgttcacgaagaccaaggaagcggttggctttcttcagcgagcgcatttgtgggacgatgttga

SEQ ID NO: 47748 - DNA, 463 bp, Heterodera glycines
  SCN-specific regions: Sequence locations=1-21,43-177,203-217,241 -277,304-305,331-349,379-463
ggggattccatcgcccctcactcattttcttccctttcctttgtcttccattcattccgcttttccctccccatttctcaattgttcttctccgcttcttctctccccgatgaatcactttgggctgacttttctgttcgtcgccgtttctctgctggtaattgcgcccggctgcgatggcatgcaaattttcgtgaagacattgacgggcaaaacgatcactttggaggtggagagctcggacactgtggacaatgtgaaggagaagatccaagagaaggagggcattccgccggatcagcaacggctgatcttcgccggcaaacagctcgaggacggacgaacgttggccgactacaacatacagaaggagtccacgctccacttggtcctccgtctccggggcggaaatgggaagagaaacacgggtaagaacaagaaaagcaacaaaaagcttgatcag

SEQ ID NO: 47749 - DNA, 386 bp, Heterodera glycines
  SCN-specific regions: Sequence locations=1-386
ctctgaacgacaccgaattgactgacttaagcattttgatgggcggagattcgacagcgaaactaagcggcggagggaatgccaacacaatgggcggaagtgatggattggctgcttcgattccgatgctttacccgccgcggtcccaaataaagcgccaaaagatgacttaccattgtaaattcggtgaatttggggtcatcgaaggccaattcaccgaacccagcggagtggcggtgaatgcgcagtgcgacattattgtcgcggacacgaacaaccaccgaattcaggtgttcgatcgcgagggccgcttcaaattccaattcggcgaatgtggcaaacgcgatggccaactcctctacccaaaccgcgtttctgtcaatcgc

SEQ ID NO: 47750 - DNA, 646 bp, Heterodera glycines
  SCN-specific regions: Sequence locations=1-328,368-646
gggatcaaacggttggcacgcatcgaacggaccggccctatcacttttaggctatcgcaaggcggtgaatagggacgttttcgggggacaaatgttcgcgcaggcaattgccgcggcagaagcaacggtggacggcgacgaatttgcaccgaacgcggcccattcgatgttcattagaaaagcattcattgaccatcccatcgaatatattgtcaccagaacgcgcgacgggcgttcattttgcactcggacagtcgaagcgcgacagaacggcgaaaccgttttctgtgcgcagatttcactttgcgttaaggaacgctcttccattgaacaccaaacagaaatgccagcggaagtgccggagcccgaggagttggtgccgttcttcgagacggtccgtcgagtggtcaccgaacacgacgagggcaggacggagcgtaacggacggaccatcgctaaccttcgcgcggtgctcgaggacgagcagcaaccgtccgtcttcgagttccgacccattcattccgacatttttcttggcattcgaccccattcgcccacgccgattcgttactggttgaaatgcgccgttcctttgggtagcgaacggacaaataaggcactgaaccgcttcctgctggcatttata

SEQ ID NO: 47751 - DNA, 612 bp, Heterodera glycines
  SCN-specific regions: Sequence locations=1-612
gggggaaatgccgtgacttgttccccgtttgtttcgaaggtgccaaggcaatggtccaaaaggggctcagctcgcattttcaggtttctcataacatcagcatttctccagcactcaatgggtatcgcttcggcgcgacttatgtgggatatatgcaggcgaccccagccgaagtctttcccgtttttttcggcgaaatggaccttcaagggaacacgcaggcgacggttctgcaccaaattggcaactttcgtggcaaatttcaaggccaaatccagcaaaacatgttggcagctgctcaattttcactggagcaccgtggacgactttccacgtacggattgacatttgccaacccgtcggtgagtgccaacaattgccagggcactttggttgcgcaaatgttgcggcgtgtcaccaaaaatctcgaccttggcgccgaatacatttaccatagggacgaacggtttcctggcaaacagtcgaacactctcagctacgccttgcgctacattcagcccacttggatattttcgggaactcttgcgccaaccgaactccatttgtgttactaccacaaacagagtgaacacttgcagttcggcgttgaat

SEQ ID NO: 47752 - DNA, 606 bp, Heterodera glycines
  SCN-specific regions: Sequence locations=1-93,117-129,165-174,196 -237,283-345,369-372,400-606
ggggacaagtaattgtccaattaagcgaaaacaaatttggttttctacgagtaagcaatgggcaaggaaaagatccatatcaatattgtggtgatcggtcacgtcgattccggcaaatcgactaccactggccatctcatctacaaatgtggtggaattgacaaacgtaccatcgaaaaattcgagaaggaggctcaggaaatgggcaagggatcatttaagtacgcttgggtgcttgacaagctgaaagccgaacgcgagcgtggtatcactatcgacatcgctttatggaaattcgagacaagcaagtactatgtcaccattattgacgctcctggccatcgcgacttcattaaaaacatgatcacagggacttctcaagctgactgcgctgtgctggtggttgcttgtgggacgggagagtttgaggctggaatttcaaaaaacggccaaacgcgtgagcacgctttgcttgcgcagactttgggggtcaagcagctcatcgtcgcttgcaacaagatggacaccactgaaccgccattcgccgaggcccgttacacggaagtgatgactgaagtgtccaacttcatcaagaagatcggttac

SEQ ID NO: 47753 - DNA, 565 bp, Heterodera glycines
  SCN-specific regions: Sequence locations=1-565
gggaagccgaacgaacgcaattacggcatcggtgcggacggcctgcccattgaaggccgtctctaccagcagggcgactgctattacggcactttcaatttggtcagcggacaattcaacgagcacaaattcacgaacagtgagcccgcttattgcgggttggtgcgaattgtgcaggaggcggagcacaaaaaaaaacgtgcacgtgttaatccaatggcgaatccaacggaatccgatcatcggcgacaaatttgcctcacgtcatggccaaaagggcatcaattcattcctttggccccccgagtcgatgcccttttccgagtcgggaatggtccccgacattatttttaaccctcacggttttccctcccgtatgaccattggaatgatgatcgaaagtatggccggaaaggccgcagcaatgcacggcacttcttacgatgcatcgccctttgttttcaatgagcaaaatacggccattgaacacttcgggaaactcctggccaaatccggatacaattattacggcaatgaaacgatgtattcggggatcgatggacga

SEQ ID NO: 47754 - DNA, 562 bp, Heterodera glycines
  SCN-specific regions: Sequence locations=1-3,185-185,263-452,490 -490,512-541
gggagtacgtcctttctccgtcattccggctcgaattttgcgatcaaaatgaaactgatggatcgtctctacgataatgctgttgtggaaaaactgtgtgtcaaaatcatattgcctgaaacgagcaagaacattaagctggtcaccccttactctgtgaagcgtcttcccgacgaggtgcacaaaacgtacttggacacttttggtcgccctgtgattgttcttgaaaaggagaatcttatcaacaaccatatccagcccttcactctttactacgaattcgaccgcttttccatgctgtacgaacctttgcttattgttgtggcatttggcgcattgtttttggctgctgttattcttttccgtcttgactttagcatcgccggcaaggacgaaaaggaagccgcaagtggacaccagaaaaaggaatgagcaatttgaactaccttttgttaatttgatataaatattaatttaattatttattttgtttattcttttttgggttttataagtagtgaaataaagattacctattaccaaaaaaaaaaaaaaaaaaaaa

SEQ ID NO: 47755 - DNA, 684 bp, Heterodera glycines
  SCN-specific regions: Sequence locations=1-514,540-566,588-684
ttcaagttcgaaatacaaaaagagtccgataagatcacgcactttttcttggtctgcgataaacttttgtagcaatcttggcaatttgggaatgaacacttccgaaagatgtactcgtccgtcatgcagcattcgaaggtcctttttttccgtccccgcgcccgggcctcgccgaattgagacgacaatgcgatttggcgggtgttcgcccgtcgcagcatgcttgacagcagcacacataatcgaaatcagctgagtgtcaaattggtcgaattcatccgaaagtaaaatgtcgaccattgtggaccaatccttgagcatggggcaaatgtcgatcagcgaatcaaccaaataggccgggtgacgatggacagcgccgtctatgaaaaatgtgaccaaatccttaatcagctggcgattttcagctggcggagtgagcagagaagtggaggaagtgagcagggaattatcggccgccgtcgaaaataattttgcattgacaaattctccagcagcagtggccaactggcgattgttgcaatagaccaactcataaagcggcacgcaagcacccgggtcgagaagagcggggaacgccctgtaaatgtgcgtcatcagttggcatgttttcgttgccacttccacgtccgtgtccaacaccatactcaccaaacgatctttgaa

SEQ ID NO: 47756 - DNA, 495 bp, Heterodera glycines
  SCN-specific regions: Sequence locations=28-258,280-468
tttttttctttttttttttttttttttgcaaaacaacaaaatttatcattcactcaaaaggaacggacaacaaaattggaaacgcaattccaagcttcggtgcggcatcacttcgcctttttagccttcaatttcttgttgtagaactcgagttctttgccctccaaaatgtacccatcgcagcgtccgctttggagtggtcgtgagcttatgcaagcgaaaagtcgtccggcctggaactgttccaaaagatgcggctccaccccggcggttttttggcgttccgtgtatttcttcagagtcgactttgagcgtttctgtgctcctccaatccgcgccttctcattttcggtcaacttttgtccctttttgcgcgccaatggcagtgcgtaatgcgcttcataccattggcggaacggaatggcatcgattgagacgatcattcccttgaccaatgttttggtgcgcaccaattcgttgttggaagcgttgtac

SEQ ID NO: 47757 - DNA, 546 bp, Heterodera glycines
  SCN-specific regions: Sequence locations=1-271,293-546
gactagtgatagtccaattaagattctgctggattgttatcatggttgctacttttgagaaactcgtaaagactgatggcaaagcgcccgatgaccttgaaaaacaagttgcaacggctttgtctgaattggcacacaattcagagatcaaggctcagctcagcgaactttattttgttggagcacaggaatacgaatttggaaacaaaaagtgtattctggtatggattcctgttccgcaacttcgagactaccaaaaaattcacccaaaattagttcgtgagctggagaagaaaatgagcgggtgtcatgtcatcttcattgccaagcgtaggattttgccaaaacctcaacgaggtaaaaaccgtaagccattgggacagaagcgtcctcgttcgcgaacactcactgctgtgcatgactcaattctcgcagacgttgtattcccagctgaagtggttggcaagcgaactcgagtcaagcttgacgggaaacaaatcatcaaagttcacttggacaaggcacaacaaacgaccgtcgaacaca

SEQ ID NO: 47758 - DNA, 613 bp, Heterodera glycines
  SCN-specific regions: Sequence locations=1-613
gggggtttttaatttttgatatcatccgacagctaattatggcacggaatcggccaaatgctaatatcataacgagtgatctcggcgaggcacaaataaaaaagcacagaccaaaagacacgaggttactacaacagagactcgttgcatggcagcctattctgaccgctaaaacggtcattccgttggttttcagtataagcattttgttcatcccaattggaattgttcttcttcgcataagtcaatctgtccaggaatatgtcgttcaatatgtaaacgatgccaacgagtgcaaagactaccatgcgaatggccaatgcgcagtgaacttcactctgaatgaggacttcaaaggcgatgtttacttttattatgctctcgagaatttcttccaaaatcatcgtcgttatatgaaaagcagaaatgatcagcaattatcgggcattgattttttaaataccaaagattgtactcctttcgagaaagctccggacggtcgtccgatcgccccttgtggcgcaatagcaaattcgttattcaatgattcattccaactcaattatcttgggcgcaatggcaatggttatgcaaatatttcatggagtcacga

SEQ ID NO: 47759 - DNA, 435 bp, Heterodera glycines
  SCN-specific regions: Sequence locations=1-62,85-96,119-151,209 -287,354-435
ggggatttcgaagatccgcgaggaatatccggaccggattatgtgctctttctcagaggtaccatctcctaaggtctctgacaccggtgatgagccatacaatgccactctttccgtgcaccaacttgtggaaaacaccgatgagaccttgtgcattgacaatgaggccctctacgacatttgcttccgcacattgaaacttcagaatccgacttatggcgatctcaacacatctcgtgtctgtgacaatgtctggcgttacaacttgcctccgtttcccggggcaactcaatgccgacctccgaaagttggccgtcaacatggttccgttcccgcggctccactttttcatgccatgatgtgcgccgctttctgccaagggggcagctgcataccaagccttgtctgtgtcacaacttaccaagcaaatgtacg

SEQ ID NO: 47760 - DNA, 452 bp, Heterodera glycines
  SCN-specific regions: Sequence locations=25-56,78-190,213-452
ttttttttttttttttttttttttgggcaaaaatacctgtatttaaccaacaaaacaaatatgtatattaacatgttgaattgacaacaaactttttttcttgtcattccttattcattcatctttatcaagaaatgtcgaaatggaattccttgtacgactggtccaactcctgcactcggacataaccgtcctctcccccaaacacaacaatgtcccccgtggggtcgaaaatgatggaattgatgggtcccaaatggcccctgaatcgggcaaattcctcttcgaaaatcaaatggtacagtcgggccacgaattgctccgctgttgtggccgtctgagtgacttccatgtgttcttcaccaccgcctaaaacgatgtggtcgcggctgggagagaccgaggcggtgttcaccgggcgattggacttgtacgttttcaaatgctgcaga

SEQ ID NO: 47761 - DNA, 627 bp, Heterodera glycines
  SCN-specific regions: Sequence locations=1-203,225-502,526-627
ggggacttgaccggcattcctcctgctccccgaggcgttcctcaaatcgaagtcacttttgagatcgatgtcaatggaattttgcacgtgactgccgaggacaaagggactggcaataagaacaaaattacgatcaccaatgatcacaaccgactgtcgccggaagagattgagcgaatgatcaacgacgcggaaaagttcgcagaggaggacaagaaaaccaaggaagtggtcgaagcgaggaacgagtttgagtcgtacgcctactcactgaagaaccagctcggagacagtgaaaagttgggaggaaaactcagtgcggaggacaaaacgaccatcgaaggggctgtggatgaggccatttcgtggttggactccaacaaggacgcgccacctgaggagcttaaggagcggaagaaggacctcgaggccaaagtgcagccgatcatcagcaaactctacgcagggcagtcgcctccgcccggcagcgaaccgccgccgactgaggagaaggacgagctgtgaacggtggaatcaccaagtgctaactgtgacgactttccttggtctatcccccttccttccaccactatctctttggtttttcatttatttatgttattggta

SEQ ID NO: 47762 - DNA, 604 bp, Heterodera glycines
  misc_feature (522)..(522): n is a, c, g, or t
  misc_feature (583)..(583): n is a, c, g, or t
  SCN-specific regions: Sequence locations=1-6,35-604
gggcgagcacatggtccaagcttgtctgctgttggcaagtaaaattgaagaagaacctcgaaaaccgcgtgacgtgctcaatgtgtacaatcgccttaagcaaatccatcatcggagaaatgcggtcgcatcacaacaccccgaagatttgcaaaagctgagcaaaaagtttgagcacttggagttgtgcagcaaaaggtaccaagagttgaagaacattgtgatcaaagcggaacgtcgactgcttaatgtgctcggatttgttgtgcacgttcaccacccgcacaaactcatctacatctatctgcacatccttgaccagctgaaaaatgatcaaaaaaagtacagtgcaagcgaaattcggaagagtcggcaactgttgcagaaggcttggagctttatgaacgacggtctgcggacggacatgtttttgcgctacaccccggagacaatcgcttgcgcatgcattcaactcgcggtccgaacagtggaccaaccaattgtgttgcccaccgaaccctntgcatggtttgaactgttcgatgccagtgaccgcgatgtgcgcgccatttcacagaccatntgggagctgtacacgcgcaaa

SEQ ID NO: 47763 - DNA, 659 bp, Heterodera glycines
  SCN-specific regions: Sequence locations=1-189,211-659
gggcaacgctttggcaacaaatctttcaagaaatggttcgagcgcctcatgtcggatggacaaagtttgctgagcgatttgtttcccgaaaatttaaagtcagctgttcttgaaatctggccttatttgatggattcgtttggaaattccactcggattgattatggatcaggtcacgaaacttcttttctcattttcctcttctgtctgtacgaaattggcgtgctccattcgcccgacgatgaccgagcttccatcttaagggttttccatcgatatctgaaattagctagacgacttcagtgtgagtatcgaatggaacccgctggttccagaggagttcatgccattgatgactttcagtttttgccttttttgtttgggagcgctcagttaattgacaataaacagagacttatccccgattattatttgcgccccgacatggtgactcaacatcaagatgacaacctatttttcgaggccattcattacataaatcagactaaaatcggtcctttccatgaacattcaaatcaactttacaacatcagtgctgtgaatacttgggatcggatcaatgaaggaatgttcaaaatgtatgagggcgaagtgctgaaagaagttcctgtcgtacagcactttctttttggtagtct

SEQ ID NO: 47764 - DNA, 591 bp, Heterodera glycines
  SCN-specific regions: Sequence locations=1-540,562-591
gggttcacaaagagtttcggggcggccggaggctatttggccggaaaatcgtcgcttatcgcccatctcaggcgccattcgccgaccagcttttactccttggcaatgtccgcgccggtggctcagcaagtgttcacttccatgtccatcataatgggtcgtgataacactgaccagggatggcgtcgcattgagcggtcggcacgcaacacgcgctacttccgccttcgactcaaacagatgggcttcattgtgtacgggtcgaacgattcgccggtcattccgataatgatttaccaccctaccaaatgcggactttgggggcgccttttgctggagcgcaaaatcagcgcggtggtcgtctcttttcccgccactgcaatgacagaaagtcgttgtcgcatttgtatcagtgcggcacatgacaaagagatgctggacagagtgttggatgccatcgacgaagttggcgacatcagtgccaccaaacattcgcacagaacgcaccgttaccgccaattggacgtgaaatggtgaacaaagaaaggggaggacggacacacgagaagagaagagacaatgacgggaaat

SEQ ID NO: 47765 - DNA, 568 bp, Heterodera glycines
  SCN-specific regions: Sequence locations=1-518,541-568
gggagctaaattccgattttttaaaaatgtcactcactggtgggactgtaattgcgttagcctacaaaggcggagttgcgatggccactgaccgtacagtttttgcatccggtgttcatcgttttcagaacaatacgcgccaatatcggttgaataattattgtctgatttctttctccggagactttgccgaattccaatggttgcaaaatttgctggaacgccgtcagatggaattacagatcgacgcggggatggaccatatgaagccgaaaatggtgcacgcttttctcacctcactcttttaccaaagacggagcaaaatgaacccatttctgaacacaatggttgtctgcggcatgcaaccggtcgagtttcatgccggagaaattaagcctttcatcggcgtcatcgacatgcgtggcaatgcctatgaagttgaccatgtcgcgacagaaattggcaaatatttgcttcgccaaatgttggagacgcgacaaacgcaggcaaatggagcggaacaaatgagcaaagaagaagcacttcgaatggtcgcagcggcgttgga

SEQ ID NO: 47766 - DNA, 596 bp, Heterodera glycines
  SCN-specific regions: Sequence locations=1-540,562-596
gggttcacaaagagtttcggggcggccggaggctatttggccggaaaatcgtcgcttatcgcccatctcaggcgccattcgccgaccagcttttactccttggcaatgtccgcgccggtggctcaccaagtgttcacttccatgtccatcataatgggtcgtgataacactgaccagggatggcgtcgcattgagcggacggcacgcaacacgcgctacttccgccttcgactcaaacagatgggcttcattgtgtacgggtcgaacgattcgccggtcattccgataatgatttaccaccctaccaaatgcggactttgggggcgccttttgctggagcgcaaaatcagcgcggtggtcgtctcttttcccgccactgcaatgacagaaagtcggtgtcgcatttgtatcagcgcggcacatgacaaagagatgctggacagagtgttggatgccatcgacgaagttggcgacatcagtgccaccaaacattcgcacagaacgcaccgttaccgccaattggacgtgaaatggtgaacaaagaaaggggaggacggacacacgagaagagaagagacaatgacgggaaataaaca

SEQ ID NO: 47767 - DNA, 486 bp, Heterodera glycines
  SCN-specific regions: Sequence locations=1-286,315-362,389-486
gggtgatacgcaatgtgaagccatgggagcaggatccgcactatttcaaggaagtcaaaatttcggccttggcccttgtcaaaatggtgatgcacgcgcgcagcggggggaacatcgaaattatgggtttgatgcagggccgggtggacgccaacacaattattgtgctggacgcttttgcgctgccggtcgaaggcaccgaaacgcgggtgaacgcgcaggcccaggcctacgaatttatgaccaacttcagcgaaagttgcgaggcggttggccgtttggaaaaggtggtcggctggtaccactcccacccgggctacggctgctggctgagcggcattgacgtgaacacgcagtccatcaaccagcaattccaggagccctttgttgccattgtgattgacccgattcggaccgtcagtgcaggaaaagtggacattggcgcgtttcgcacttacccaaaaggttataagccgcccgatgagc

SEQ ID NO: 47768 - DNA, 454 bp, Heterodera glycines
  SCN-specific regions: Sequence locations=26-92,114-454
tttttttttttttttttttttttttggaggaaaaaaagtatttttttaaaattaggaattttatgctcgaattgaaaaggaagaacacaaacaaagccaacaacaaaagaaaaacctaactaacagaatggaagaatgtcaaacaaaaattggatgggcgtcattggtcatcgattcgaaagcagaggcctttcactggacaaatttgcctctttccattattcgtaaacccacgcattctgcgcactttcccagtcgacgagttcttccgggttgaaccaatgggcaatttcacgggcggcagaagggaccgaatcggagccgtggcaaatgttacgtcccatctcaatgcaaaaattgccacgaatagtccctggggcactggccaacggattcgtagcgccgagcaaaacgcgaccctgtttaaccacattcaaacctttccaaaccattg

SEQ ID NO: 47769 - DNA, 442 bp, Heterodera glycines
  SCN-specific regions: Sequence locations=27-442
ttttttttttttttttttttttttttaagtttgatccgatttatttactaaaaatccgacaaaaaacactagttaaaattaattacatatttgcgaaaatttgtgagaaaatcaatgaacaccatccgaatcacgagaacattgactggtcagcgccgctgtcgggctttagtgggggcattgagccggcagaagcggaggactgtcctgtcccgggcacgctcgggttcccctccaaatctttgtactccaacaccatttcgcgcggaatccgtctccactgtatgggggcgaacaccaaatacgaacaccggtcgtaagtgccgccaatttctcgcggaggggccgaaaagggcgcccgcatgagccaaacgcgttccactttatggaagcgccaatcccgcgaatacagttcggtcgccgccgccacttggtaaacttc

SEQ ID NO: 47770 - DNA, 370 bp, Heterodera glycines
  SCN-specific regions: Sequence locations=27-277,303-336,359-370
ttttttttttttttttttttttttttacacccctatcttctttatcattacccaaatgaccgaatatgacgcaacacaaacaaatatactaagaagatcacacacaatcaggggatatatttctggatttcgtcgtaaaacgcaagaacaagggcaccgccagtaccacggaacacattggataaagcacccttgaacatgcccttgagcagtccctcgtttttgatgattttgatggcacagtccaaagggttcttgtacatgatgtccttgcggcccgactgcattatcatacgacgacggacggggtcccacgggtaggagagaacgccggacgacacggggacgacctgcgcaatggcccagttga

SEQ ID NO: 47771 - DNA, 482 bp, Heterodera glycines
  misc_feature (481)..(481): n is a, c, g, or t
  SCN-specific regions: Sequence locations=1-8,31-482
gggcttactttattcatttaatatttatttcaatggcttttggacaaaagggaaaactgttggctgtcattggagatgaagacactgtggtgggctttctccttgggggagtcggtcaattgaacaaagcgcggaagcccaattttgtcattgttgacaaaaacacaagcgtcgccgaaattgaggacgcattccgcactttctgtacccgcgatgacattgcgattattctgataaaccaacacgtggcggagatgatccgataccaggtggaccaacacgtggccagcatcccggccgtgctcgaaatcccctccaaagaaatgccttatgacgcgtccaaagatagcattttgaaccgagcacgtggcctggtgaacactgacgacctcaagtcatagaagaagacattacaaaaaacaaattctcctttattagtcaatgaatgtgtttaattaattatgggaatgacgagaacctnc

SEQ ID NO: 47772 - DNA, 625 bp, Heterodera glycines
  SCN-specific regions: Sequence locations=1-8,30-625
ggggccaattgtttgtttggcacaaatgtccttcgccaaatcgtgctcgttggccaaacattgtaagccgttgaccgctgcaccgccaaggcccgtgatcacatgggacaagcatgaacggatcagacggaacaaggaaatttgggacaacccaaagtcggttgtccaccggttgccacgccattaccaagaacgctactggaaaaattttgtgttggccgatcaaactgccgtaaattacaaagtgccaccttttcgattctactgggatgaacaccggaaaattgaactggaaacggagtatttcccaattctgccaatttactgtcctgaaatggaccaaggcttgtgggccggcgaaggcatcattaagggctattccgagtcggatgcgaaaatcaaaaagaaaattttgccgcgcgaatggcttcctcgtctgtggattccccacttgaatcttgtgccgttgtattcagaagtgttggacaaatactttaaagttactgtgactgaacgtttgcttcgggcggtggacaaacattttggcttcgacctttaccttttggaaacgcctgacattgacattaactcacgccttggtctggacctgaagcgactgattctt

SEQ ID NO: 47773 - DNA, 520 bp, Heterodera glycines
  SCN-specific regions: Sequence locations=1-520
gggcgctcgcttctgttttacttcagcagcaaaaattctctgctgttgcatcatcgcccaataaaaatttgaatgctgtgcttatcgatgctgtacgtactccctttctccaatcgaatacaactttccgtgagctgttggctgttgatcttcaaagacacgctcttaaagcattggttgagcgaacaaaaataccttttgatgaaattggacacattatctgtggacaagtcgttcaggaatgcaaaacgagcaatatcgcccgtgaggctgcgatcaccgccggtttccctgattcgatcccttgcaatacggtcactctcgcgtgtatttcttccggcgtttcaattcaaaatattagcctaatgatttccactggctatttaaaggcgggcatcgctggaggagtcgagttactctctgactttccaattcgttacaacagaaaggttcgactttctctcatcgatttgcagaaggccaaaagttttggagagagatttaagcacctgaaaacagt

SEQ ID NO: 47774 - DNA, 491 bp, Heterodera glycines
  SCN-specific regions: Sequence locations=1-491
ggggacaagaaattgtccatttaagcggatttgtataagtgaatggagaaattgctatcgccaaatattgccaatgctcagtcgacctcgacaacgacaacttcagcaacagcgtcgtccaataataaagaagagaatagcaaagaaaaggacgcggaacaaatttgtcactggattcgcgaactaagggagcacgaaaagcgagaaaatgcacttttgcagataagcaaacgtcgcgagggagtggaggacctcgccgtttggttgtggttctcttatgggacagtgagcgtgcttctccaagagatcattagcatttacccgttcattttgccgcccactctcaccgctgcccagtcaaaccgcgtctgcaacgcattggcactaatgcaatgcattgcctcccatcggaacacccgcaaacaatttctggacgctaacgttccgttgtacctttaccctttccttcacaccaccagcgattctcgtac

SEQ ID NO: 47775 - DNA, 484 bp, Heterodera glycines
  SCN-specific regions: Sequence locations=1-77,99-109,131-133,233-484
gggcttcgacaactttttggttgcggactctgtggaggacgcgaagaaacacgcggcggacactttcgaccagctgaaggaggcggagaagaagcagaaggaagcgcatgacgaggaggagcgcaagaagttcgaggaggaagagaagaagcggaaggaagaagaggagaagaagccgaagaaggacgaagaggaggttgaagaggacgaggaggagaagaaggaggaggagcacgacgagctttaggacggcgcccgaccattggccttgtcactttccatcctcaatgattgcaccttcccgggttctccctcatctcttcttttcggttccaccttaataagcttcccactttacttaaatgtgccctcccccctccccccgtcgcctcttcaggtatttaatggcaatttgttatttaattggttcaagagggactgttcgatgattccttcgaccgcccacaatggtctctctcaccgc

SEQ ID NO: 47776 - DNA, 498 bp, Heterodera glycines
  SCN-specific regions: Sequence locations=27-44,73-498
ttctttttttttttttttttttttttggcatcctcgtcattgctctctttttcctcctcctcttctttaattcccttcaccgcttttgccgcacgttccgctaaccttttcaccgtttttaaagaaaacagctccaaatcctcgcctatcgtcgggtcgtccccctcgtggaccatcttcagtttcttccgttcttccaagttgcgctttgccttcaacagttttctctttcgttttttcagcgttgccttttcttcggcttttgctggtctgatcagatcgtcgatctcttccaactctttgaattcagtattttcctccaactcctcgccagtatcaccctccaccatttcttcagccgattttacactttctttagacgctttttcctcctttttctgttcgtcaaccaatttcttacgccattttaaaatgcttctcagttcggcagggccacaaactttaatgtctttcaaacattctttgatttcattcggc

SEQ ID NO: 47777 - DNA, 474 bp, Heterodera glycines
  SCN-specific regions: Sequence locations=1-74,116-474
tgaactgattgcttcagctaggatgcatttgcaataagaattcctcggaccaataattggtaaaaatggacatgcttttggtggcctttgtcagcaaaaaacaaaagccaaacaatcacgcgtccgatgtaaatcagctcaatcccccgaacgacagcagaaagttgtaaaatgggaacggattcgaccactctcctcttcagtttggcatccgagagccgaagtgccaacaaaatggctttcgcgtgcacgccggaaagagaaaattggacgatggagttggggaccacgtcaatttccaattggaaggggtcgaatcttcgcatttggaacagagagtaaagtgcaacgccttccgttgaaacgacggcgaaagatccaccagttggacaaaagcccatcttgggaacagtgacgggttggtggatggaccgttcggccatgtatgtgtgccgtgtgcccgggagtttgatg

SEQ ID NO: 47778 - DNA, 398 bp, Heterodera glycines
  SCN-specific regions: Sequence locations=1-374
gggaacaaaggtggacatcctggaccaatttcatgaaattaaaattgccattggttacgaattgaatggacggcaaattgagtaccctccagcgaccgtcgatgattgggcaaatttgtgcgtccattacaaaacctttgagggttggcagtcgccaacgaccagtgcccgtcagtgggaacagttgccggacaaatgccgtgcctatttggagttcatacaaaatcaactgggcgtacccgtcgaatacatcggagttgggaagggacgggagcagctgattgtgcgcacgaataacggagggtgatagagaaagagagaagtcataattattgtttgtaaatttattttcgaagcatccaatctgccattctaaaaaaaaaaaaaaaacaaaaaaa

SEQ ID NO: 47779 - DNA, 596 bp, Heterodera glycines
  SCN-specific regions: Sequence locations=1-83,106-596
gggacaacgacgaggaactgtcgctgggcgtcttcgagacgtacgcggtgttggtcaaaattttgtgcctcaaaccgatgctgatcatggtcattgtgctgctcacgggaaagatagcttttgccgccacagatggcatgacggaccttaagttgatcaacgaggggctgaccacggacaaaattgcgtcccgctccatcttcctcactccgctgcaaatcattctgccgtgggtgctcggcaaacagacggccgggccgaagccgttgaacgtgttcttgtgggcgtacccgtaccgactggtgatgagtttggcactggcactgctcgtctactggacaccgtcatttcgcgaacccaacggggagtatccgtacttttattacgccatttggattggtgcctactatttgcaacaagtgtcctcctattgcattttcctctcaatgatggcgttcaatgcacaaatttcggaccccaaaattggcggcacttacaggaccctgctgaacacgctgaacaacttaggcggcaattggcctgtcacactgttcctgagcatcaccgattttttcaaccgtaaaaattgtgtggcc

SEQ ID NO: 47780 - DNA, 533 bp, Heterodera glycines
  SCN-specific regions: Sequence locations=1-397,422-533
gggagggaagctcggactgcagttaacgcaaaacccatagatacctgacgaggaagcaaatttcgcagcgattcaatttgatttttcaaagaatatccatattgaattagaaatgcttgctgaaggcgatgctaaaattgcgaatttcgatcatatttttactcgaaaattggaaacgtttagcaacaaatttgatgaaatattcccgattgatcaccaggaaggctctgattcatttaatcgcttgggaaaaattgcattgtccaatttactcggaggaattggagtttggcacggatattccttggtcaaaatcgacgaatccgaccagaacaactcatatggccccctttctctcatttccgcagtgccttcaagaccatttttccctcgtggttttttatgggatgaaggttttcataatttaatcattcgacattttgacccgcaacttacgcttcagattttggcttcttggcttgattcgatgaattttgatggatggatgccaagggaaatgattttgggttctg

SEQ ID NO: 47781 - DNA, 596 bp, Heterodera glycines
  SCN-specific regions: Sequence locations=1-596
ggggttttccaatgactatctcctttgccgcttccaggccttccgtaattatgcaatcaaaaaagaaaggccgccaccagcgaagattcaagtgccgccacccgcaaacgaaactggccattggaaatatgagcgtgactactcctatgacctgcgttattcaaacccgatcaacaaatactccagttttaccaggttcattacgctcaccgcaacaggccacaaagaattgtgggcacttttcgcccttctgatgctttcgtcatctctggcgataggaattgtgttctatagccttggcaagatcgaagtttgggttgaccgaagcacctcaactccgccgtgggattgggcgcgagtacgtgacaaatattggaaatttccgacggttctctatgacccgaccggcattactcatgttcgactcagcccgatggagaaacttcaggacgaaatgctggaagctgctaaagaacgtggaacccgcgatgctaagggctattgggttggaaagcaataggaaaatggatgtaatttgatgtgttaactgttctttagcttgcgttctcatataatgtatacgtggagcaaataaa

SEQ ID NO: 47782 - DNA, 410 bp, Heterodera glycines
  misc_feature (409)..(409): n is a, c, g, or t
  SCN-specific regions: Sequence locations=1-145,175-183,209-374,398-410
ggacgcggagagcgaaaccaacgaagtgcatttccgcgaaattccctcccacgtgctgcagaaggtgtgccattactttgcgtacaaggcgcgctacacgaacagcgcgacggaaatccccgaatttttcgtggcacccgaagtggcgctggaactgctgatggcggccaacttcctcgactgttgaccaaacaaacaaacaaaatttgatgcaaaaatggtagcaacgacagacagacgaaccgatggccagacaaaacactgactgattgtgattggcaccgatttggaatttttgtgccaaagataaagccaattattaatttgtgaacgacccacacaaatttgttttttgcggattcgtactttggcatctccttttggtttttgataaaatcgtggaaaaatna

SEQ ID NO: 47783 - DNA, 385 bp, Heterodera glycines
  SCN-specific regions: Sequence locations=29-77,99-280,315-339,362-385
ttttttttttttttttttttttttttttaacacacctatcttctttatcattacccaaatgaccgaatatgacgcaacacaaacaaatttactaagaagatcacacacaatcaggggatatatttctggacttcgtcgtagaacgcaagaacaagggcaccgccagtaccacggaacacattggataaagcacccttgaacatgcccttgagcagtccctcgtttttgatgattttgatggcacagtccaaagtgttcttgtacatgatgtccttgcgggccgactgcattatcatacgacgacggacggtgtcccacgggtaggagagaacgccggacgacacggggacgacctgcgcaatggcccagttgacgaaaaagttca

SEQ ID NO: 47784 - DNA, 491 bp, Heterodera glycines
  SCN-specific regions: Sequence locations=1-97,144-260,296-491
ggggaaaggccgatgcccgtgagttcaaaggtttggcggactgcatcatgaaaatcctcaagtcggacggtcccatcggtctctaccgcggcttcttcgtctccgtccagggcatcatcatttaccgcgccgcttacttcggctgcttcgacaccgccaaaatgctcttctccccggagggcaagcagatgaacttcttcgtcaactgggccattgcgcaggtcgtcaccgtgtcgtccggcgttctctcctacccgtgggacaccgtccgtcgtcgtatgatgatgcagtcgggccgcaaggacatcatgtacaagaacactttggactgtgccatcaaaatcatcaaaaacgagggactgctcaagggcatgttcaagggtgctttatccaatgtgttccgtggtactggcggtgcccttgttcttgcgttctacgacgaaatccagaaatatatccactgattgtgtgtgatcttcttagtatatttg

SEQ ID NO: 47785 - DNA, 497 bp, Heterodera glycines
  SCN-specific regions: Sequence locations=1-236,259-497
ggggatgcgattacaaaaaatggaaaaatgagcacacggcaatttgcggaagcgacggattacggaccaaaacaaatttttgagaagttgttctttgatgacattaattatttgctttcgatggccgatctttggaaggagcggaagaaaccaacgccaattcactttatgcaagttattgacgaaggacttggtgggagtcggccgaatgaggacgagaacgagcattggggcgtatcgaaatgggctgaactgtttgaggactctctttttgcgcttgcggaaagataccgaggagctgtcaaggaaaagcgaatgctcatctgggacaaggacgacgagccggcaatgcaatttgttgcggcctgtgccaatctacgggcttacatttttggaatcggcacaaaaccattgtttgacctgaaagctatggctggcaacattatcccggctattgccacaaccaatgcctgtgttgctggaatgattgtcgtcga

SEQ ID NO: 47786 - DNA, 461 bp, Heterodera glycines
  SCN-specific regions: Sequence locations=1-461
atttcatctgcggctcaactccgcttgagggcgtcgtcctcaactcaattagctccgcaaattggattaacgggacggtagatcaacctttaaaacttttgtttgcttccgatgagtcattacgggacattttcaatgattttctcgtcgtcgttgtgcgcgcttatgtgaacctttttcagacctttggtcacaatttgtcaagacaaatggacaaatttttgcgtgtaatttttgatgagtttggtgcactaatcattgaggccagcaaaatcgaggctgtattggaaacagcacgaattaatttggacgtggacaattcagactgccaaattcctaatatgcaacatttgttctccaatttctttttgcagacaattttggctctgatgcaccattactttagcatggcatttcaaatgcgtttggtccagccttatgagttccattacatttattgg

SEQ ID NO: 47787 - DNA, 435 bp, Heterodera glycines
  SCN-specific regions: Sequence locations=31-435
ttttttttttttttttttttttttttttttggcaaataattaaaaaaaacaagcaaaataatatatagaaaatgaagacaaattgcgtccatttgaacttttcccggataaaaaatgcctttctcatgaaattgcttttgccggggaattcgcttttccctctccgttcgaaccgcgtaaaattttgttcagccaaaactgttccttacgcttttacgcgtcccattcagcagcttttagttttatcacatttgtaatttcacgagcccgtctgttctggccgtaataatcatggaagttcccctccgggtcgatcaggtacatgattacggtatggtccacaatgtaatcgtccgtccgtttcgtccgtggcccctcagaatggtaaacccgaaaagctttcgcaacttttgctatctgttctttgctgccggt

SEQ ID NO: 47788 - DNA, 309 bp, Heterodera glycines
  SCN-specific regions: Sequence locations=1-309
gggggccaacggattggacaccgttttccctcagaccgactgcggttacagtccccacgccgagtttatttatacgacgacaaatgcgaaggacaaaggcggcggagagagaggcgctttgctctttttcgacgcggaatcattggaattactctataaaattgagtacccaaaacagggatgcatccgtgccttttggcacccgaaaataaaccaaattttggtcggtctgagcgatgggacgagcaaaatttactacgacccgtccatcagtctgcgcggggccctccaatgcgtcagcaaaccgat

SEQ ID NO: 47789 - DNA, 512 bp, Heterodera glycines
  SCN-specific regions: Sequence locations=1-442,464-512
gggatttcaaaatacgacgtcgccgccgtcgtgcgtccaaaaagagtggcagcaacagcggtagcagctcaccacggcggaagaaaatggacagcaaatcgcttgagattgtaccacccaacaaaaaatggcgcatttccaatgaatttgtgtcgctgttccattccattttgtccggcatttgggcacttgccattctcacacgctttgatttccaccaaattgacgaccttgtcaacaaggattcgctcgacgcgcgttatttgacgtacatgtcctttggctatttggtgcacgactttatcgacttggtgatcaacgagcgttctgcccgcatcattgagctgctgttccaccatgttgttgtgctggtcgccttaatggtcacgcatttgtcctgcaaatttttgtacattatcacgcttggtttgctcatggaggtgaacagcattttgctccattcccgttcgttgtgcaatttgtatcgccagccgaaacagtcgaacttgttc

SEQ ID NO: 47790 - DNA, 559 bp, Heterodera glycines
  SCN-specific regions: Sequence locations=1-483,507-559
gggtgatggatggatgaaaaaaagggcagcatttattatcgcatttgggaccatttgttctttggatttgccggcagaagcaaattcaaaagggttgctgagacgggttggcgcttcacttattattccatcatttggttcgtcggagtgtccgtgctctacaaagagccgcagttttccagtgtaatcgaatgctttcgcgagtggcccaaacatcacttgccaaatgatgtttggcaatattacatcatccagtcaggcttttacctttctctcctcttcagtctttttgcctttgacgttcggcggtccgaccattacgaaatggccacgcaccatttggccaccattttgctcctcttcatgagcttctctatcaattttgtgcgtgccgggacgctcattttgcttctccacgacagtgcggacgtttttcttgagcttggcaagctgttccgttatgctggctgggaccgggcggtgaccatcgacttctgtgtgttcatgttggtctggatcagcacacggcttgtctacttcccactgaaaacttgtccgg

SEQ ID NO: 47791 - DNA, 457 bp, Heterodera glycines
  SCN-specific regions: Sequence locations=1-457
gggaaccatttcgaggcgttcattgagggtctctgccgcgtgctttacgacactctccgtccgctggtcgtccacaacccgcacctcgaaacactggcacaactgtgcactcttttgaaggtcgaaatgatcgacgagcgctgtgcgcgcttccgtcgtcccatccgaacgcttttccgccccctttctccgcgacttcgccaaccgaggcaatagcggaaaatgtgaataacatggccactgaattgtccaactctcgtgctggttttgcgcgagtgatgagtgaactcgtcgccgatattgttgaacgcattgtgtacagaacttcgctgttcgcccagtcggacattttggagtacaatgccgcccccgacgacttggtttatccggagcggctgatgatgatgcgggacatcaaccagggacggagcgtgacaagcgctgtttcgaccgattc

SEQ ID NO: 47792 - DNA, 559 bp, Heterodera glycines
  SCN-specific regions: Sequence locations=26-559
tttttttttttttttttttttttttgactcggagtgattcatgcattacaattgaatagaaaaaataattgactgtaaaactgtccaggaatagttatcatttgtatcattcggctggatttgttgtacgtttcattaccgcctatcaacagctgacccattgttgttcttctggcacttccaatccgaccattctcgccgtttcttttaccgtcctttcacctcccttgaaatatttggctcggatttcgtctaaattccttttgcttcccaagtaaatggcatatgtttgtgctgagtggtgcgccttcgtagcttcacattgttttgtatttcggtgcaaactcagctgattgcgtaaatatttatgaagcgcggatttcgtcgtaaaactcttgtcggctcttttgagttctcgaaaaatttgtttgaaagttgtaattgcagttgagttgaaagaagccataaagatgaatgtctgagtttaatataatcagtagggatgcaacttttagtgacgaaaaatctcgaaataaacttaattggacaattacttgtc

SEQ ID NO: 47793 - DNA, 155 bp, Heterodera glycines
  SCN-specific regions: Sequence locations=1-155
gggagcgctggaatgacaagcgttacaaaaaaaaccaatcttggaactcgttggaaagccgatcctttcggcggagcctgtatggccaaaggaattgttctcgagaaaattggcgtcgaagcgaaacagccaaattctgcgattcgaaaatgtgc

SEQ ID NO: 47794 - DNA, 573 bp, Heterodera glycines
  SCN-specific regions: Sequence locations=1-253,276-573
gggtattaaggtaactttaatcggcgcaagtggaggcatcggccaaccgctcggattacttttgaagaagaacccttccattgcacacttggcactttacgatcttgtcggcactcccggagttgcggccgacctttcccatataaacaccccggcaaaagtgactggccatttgggaccagaccaacttgttgcagcgttggaaggtgctgacgttgtcattattcctgccggtgtgccacggaagcccggtatgactcgtgacgaccttttcaccacaaatgccggcattgtgcgggacatggccgaagcagccgcaaaaacttgtccgaaagctttcatgggcattataaccaatccggtgaactcgacccttcccatcgcctgcgaagtctacaaaaacaatgactgtttcgacccgcgacgcattttcggcgtcactcttcttgacattgttcgagcacaggcactcgtttcagaactaaaagggttggatgtttcccaaacaaaagtgtcggtggtcggtggccattccggagtgaccattgtcccacttctgtccagatgtacgcc

SEQ ID NO: 47795 - DNA, 636 bp, Heterodera glycines
  SCN-specific regions: Sequence locations=1-7,29-636
ggggctcttttggttaacaaaaaggctgcttccgtgccggcggcacttctcgcaacttttttggcactgaatataacggaaaatgaagcgaatataactgagaagaaaaatcagaggcaaataggaggaaaatggaaatcgaaacgatcgaaaaagtacgacaagcaaatcggaaagattgatgcggaactgaaagaagcgattgagaccgaagcgaattttacgaaaacgcaattggccactcaaacgatcaaaaatgtcttcttgacatattgtcgtgttctgaagcgaatgcctgccaccgctttgcttcgccccgtcttggccggcttgtcgaagtttgtccatttgattaatgcagaactgcatgaggatttggcacgtcatctcgccaatttggtccatcagaagcaattcggcttctccgatgttttgcattgtgttcacaccgctgccgtcgttttggagggcgatggccgtctattgggcgtcgatctactcagtttttatcgggctatatttggcgctttgccgaatgtctgtttccaacccgagcaaacactatttacggacctttcgctgctttctaaatcgctgcatttgctcttcgtccgccgtcgtaagtcggccgtttcg

SEQ ID NO: 47796 - DNA, 549 bp, Heterodera glycines
  SCN-specific regions: Sequence locations=1-549
ggggattgcaacattttccctgcatttccattccgtcttttcttattaaattttaaaaatgcttcgtttattggtttaacaccttcatgatgctgacttttccgactgtatcctttgttattgatgggattttgcggcgatctttagaatttgattttctcctccatcgtcaacaattatgtccaaattcgaaggagggttctcttctcatgattcctatggctatggtcaaatgccttccgctttcccttccattggtggcgctgcgcccagtgcgcctccttttggcttttctggagcaccgttcggctcgcatgcattcggaggcgatattccgagcccacttgacgcggaaatccaaattgttctgagggaaattcagtcggaagtgcatcagctagagaacagtggcgaatacggggaacaattgaaaaatgcgcgtcgactgttggccaccgaagcaaccaagctcgagaataacatcgacccagaatggctcgaagtggacatctcattacttctgatggcatatgagcaaagaattgaaac

SEQ ID NO: 47797 - DNA, 549 bp, Heterodera glycines
  misc_feature (37)..(37): n is a, c, g, or t
  SCN-specific regions: Sequence locations=1-52,90-133,155-549
cgttgggagctctcctccctatagacctgcaggcggncgcgctgccccaaaagataagcagtggtaacaacgcagagtacgccggggacaggcgaattcggacttttgctataagcgcgttggagcaaatgtgcgaagatgcttcaatgaaaatgttggagaaggaatgcttgagcttggagtattaccctcatttggcaaacttatgcaaaaacagtgagcagaatgttcgtgtcgttgcgcttcgtattttgacaaaatttgcccttgtctaccctgaagagaaagtcatggcatcgttttgtttcaaaattcgtcttcatgacgatgctttctcaatcgtttgcgatgcaatgaatgatttggaagtaaaagttcgcgctcaagctgccaatctcttgggattttttgaaaacgtctctgagtcgttcctcgaccaaacattggacaagaaattgatgcggaatatgactatgttgaacactaatgtcagaaatacgaaaaatgcgttatctgctggtgttggttatatcggaggatggagcactg

SEQ ID NO: 47798 - DNA, 563 bp, Heterodera glycines
  SCN-specific regions: Sequence locations=1-200,222-563
catttccggttcattcgacaaatgcctgaaggtttgggacattgaaaacacaggtgatcagaatggaatgccaatggcgggcaaaaacacaacgagaatgaactcgacaaagcgtatgcgaatggacgtgccaaagattactccgatggtcactttggaatcgcatcgcgagcctgtggtcggctgcgcgtggcatccgtccaacttgagccaggcgatcactgcttcatgggaccatcagctgatgctgcgggacctccaattggcaggccccatctccacgctgacttcgaataaagccttttccgcactttccgtctgtccggccaatggccttgtgcttacctcctctgtcgattcgttggttcggctttgggattttcgttccagggatggctcaatggtcaaggcatcgttccatggtcatgttggcgttgtgtccgatgtctgttggcactcaaccgaccagcatttgtttgtttcggccagctttgacaacacagttaaaatgtgggacgtccgcagccccagggcggctctatatgatttgatgggccattcgg

SEQ ID NO: 47799 - DNA, 559 bp, Heterodera glycines
  misc_feature (511)..(511): n is a, c, g, or t
  misc_feature (515)..(516): n is a, c, g, or t
  SCN-specific regions: Sequence locations=1-234,256-325,367-472,494-516
gttcgacctcgagtgcttctccttactaaccgttacatcgaatcggacctttcgcccattttggtgatggccccaaccgcggcattgtgaacattcgtggcacttccgttgagtctccccacggcgtgcctttggacttattggaccgcagccttatcatcaggacgtcgagttacaaagaaaatgaaattggagagatactgaaaatccgtgcttctgatgaactcgttgaaatggaggatgccagcatcgcagtgctcgtccaaatagcattggaaacatcgatgcgttactgcatgcaactcatttcaactgccgacattttacgacagagaagaaaaggcgaaaaggtcactgaagaagatgtgagaaaggcgagaagtcttttcatcgatgtgaagcggtgcagaaaagagatggaaaagcacggggacagtttcatcaacgatttcaactgatcattccaaactgatttatttcattgttttttgttatttggaatgaatcgtcnctcnnaaaaaaaaaaaaaaaaaaaaaaaaaaaaaaacaaaaaaaaaaa

SEQ ID NO: 47800 - DNA, 661 bp, Heterodera glycines
  SCN-specific regions: Sequence locations=1-65,87-562,585-661
atttcctggctggatggtgaaaggcatgccggaatccgggacgccgggccatacggacctcaaggcctacctgggccaaaaggcaatgctggactgccaggaatccctggattatcaggacaatcgcttgggggagtgaaaggcgagcctgggttgcccggactgcctggccgagacggtgtgccaggaccatcgggtgaaaagggcgactcgggtgtgccgggagtgcccggcttcgatggtgaaaagggatccgtcggagcgcctggatttccaggacaaaagggagaatcgggattgcccggcatacccggacaacgtggccaagacggaatgcctggatcgcccggatttcctgggcctgtcggagagcctggcccacttggtgaaccatgcttggctggcggaccaggcatgcctggacagcccggatttccggggaccaaaggcgaacttggcatgcccggctttcccggcgagaaaggtgaaccaggctttgcgggccaacctggtgttcctggcctgcccggtgctaaaggcgatgccggattgcctggacatcctggacctcagggtcttccaggacaggacggtcctcaaggcccagcgggtatggccggacctgagccgttgactcagcatgggcagaaaggactgcctg

SEQ ID NO: 47801 - DNA, 616 bp, Heterodera glycines
  misc_feature (579)..(579): n is a, c, g, or t
  SCN-specific regions: Sequence locations=1-45,219-236,258-444,482-616
tacgtcgtcgacattgacatgtctcttgacgttgcgaaactgacccgggctgtcgggtcgcattgcgagcggacagttacgcactgcacatgattttgccaaacaaagtggacccattggtcagtctgatgatggtcgagaaagtgcccgactcgacgtacgaaatgattggcggattggacactcaaatcaaggagatcaaagaggtcattgaactgcccgtcaaacatcccgagttattcgaggctttgggcattgctcagccaaagggcgttcttctctacggaccgcccggtactggtaaaactttgttggcgcgtgccgtcgcccatcacaccgaatgcactttcatccgcgtgtccggctcggagctcgttcagaagtttattggggaaggtgcccgcatggttcgcgaactgttcgtgatggcaagagagcactccccttcaatcatttttatggatgaaattgattcgattggatcgtcccgtgtcgagggaagtcacgggggtgactccgaagtgcagcgcacaatgctcgaattgcttaaccaactcgacggttttgagcctaccaaanacatcaaagtgataatggcaacgaatcggatcgacat

SEQ ID NO: 47802 - DNA, 714 bp, Heterodera glycines
  SCN-specific regions: Sequence locations=1-26,49-118,142-167,196 -265,293-358,382-385,428-655,680-714
tgattgaatccccggagtgtttacacccattgagaaggcatctgctcatcttaaaggcggcgccaagaaggtggtcatctccgctccgtctgcggatgcgccgatgtacgtgatgggcgtcaacgaggacaagtacgacccggctaaggacgacgtgatcagcaatgcgtcgtgcaccaccaactgcttagctccgttggccaaagtgatcaacgacgagtttggcatcatcgaaggactgatgaccactgtgcatgcggtgaccgccactcagaagacggtggacgggcccagcggcaaacaatggcgagacggacgtggcgcggcgcagaacatcatcccggccagcaccggggcagccaaggcggtgggcaaagtcatcccggagctgaacggcaaactgaccggcatggcgttccgtgtgcccactccgaacgtgtccgtcgtcgacctgaccgcccgtctggagaagccggccccgttggacgccatcaaagaggcggtgaagaaggcggccaatgggaagctgaagggaattttggcgtacacggaggaccaagtggtgtccacggactttcttggagactcgcactcgtccattttcgacgccggcgcttgcatttcgttgaacccgcactttgtcaagctggccagttggtacgacaacgagttcggctactcctgccgtctggtcgatctgatcactcactgtgc

SEQ ID NO: 47803 - DNA, 650 bp, Heterodera glycines
  SCN-specific regions: Sequence locations=1-11,33-650
gagcaaatgtgcgaagatgcttcaatgaaaatgttggagaaggaatgcttgagcttggagtattaccctcatttggcaaacttatgcaaaaacagtgagcagaatgttcgtgtcgttgcgcttcgtattttgacaaaatttgcccttgtctaccctgaagagaaagtcatggcatcgaagggtttcaaaattcgtcttcatgacgatgctttctcaatcgtttgcgatgcaatgaatgatttggaagtaaaagttcgcgctcaagctgccaatctcttgggattttttgaaaacgtctctgagtcgttcctcgaccaaacattggacaagaaattgatgcggaatatgactatgttgaacactaatgtcagaaatacgaaaaatgcgttatctgctggtgttggttatatcggaggatggagcactggcaaaaaaatgggtgatgacatgccgatcgaaaagctggaggacgaaagccaatctttgatccctaccggctcttgtggcgccttcgttaccgcactcgaagacgaatttatggcggttcgttaggcagctgtttactcactgggaaaacttgctaggaaccgacctgtttttgcgagtgcgtgcatcgatcatttggccgatatgttcaacgatgaaatcca

SEQ ID NO: 47804 - DNA, 658 bp, Heterodera glycines
  SCN-specific regions: Sequence locations=1-4
attcatgaaaacgagagagagccgaggcatattattgaatttgatgttgaagaaagttttgcgcctgtgttctctggactttttgttgaacttaatgttttcaaagagatcatcaaaaaatttatatacaacataccatcaatttttgaacgttctatgtcatcctcaaattgtctcggttctgcacttacagttgcaaaaaatttaattaacgaaatcggtggacggataactgtttttaccgcatccatgccaaatctcggaattggtgctctgaaatgtttggaattcaacactgcaaaaaagatcgcatttacacctcaaattgacttttacaaaagtttggctctcgaatgtactggaaaacaaattgccattgaccttttcgttgtcggatgtcaaaacgtagatcttcgaacattatctgatatgtctcggttcagcagtggcaccgtgtaccatttccctgaatatcatttccttcgggaccaagtcgaagtcaaacggttccaaatgattttacgacgttactttattcgaaagcttggtcttgaggccgtgttgaggatacgttgctcgaggggactttctcttcacactttttatggaaatttcttcgtccgttccactgatttgctcgccttgcccaatgtgagtc

SEQ ID NO: 47805 - DNA, 655 bp, Heterodera glycines
  misc_feature (611)..(611): n is a, c, g, or t
  SCN-specific regions: Sequence locations=1-125,154-201,228-375,397-655
attgtgctggacgcttttgcgctgccggtcgaaggcaccgaaacgcgggtgaacgcgcaggcccaggcctacgaatttatgaccaacttcagcgaaagttgcgaggcggttggccgtttggaaaaggtggtcggctggtaccactcccacccgggctacggctgctggctgagcggcattgacgtgaacacgcagtccatcaaccagcaattccaggagccctttgttgccattgtgattgacccgattcggaccgtcagtgcaggaaaagtggacattggcgcgtttcgcacttacccaaaaggttataagccgcccgatgagccgccctccgagtatcagacaattccgctgaacaaaattgaggactttggcgttcactgcaaacagtattattctttggatgtcacttatttcaagtcatcactggactccaaaatgttcgacgctttctggaacacttattgggtgagcacattgtgtgccaatccgttgcggaccaacgccgattacatcacggcacagttggccgatttgggcgccaaattgcagcaggtgaacacccgtcatggagcgtcatttcgtgaacggtttcgtaaggcggagcgggnacggggagaagttgggctgtgaagtgctccagggactgattgtg

SEQ ID NO: 47806 - DNA, 739 bp, Heterodera glycines
  SCN-specific regions: Sequence locations=1-46,69-326,348-691,713-739
aatttaaaggaaattctataataataattgtcctaaaaaaatggtccaatacaaattatattattttgatgggcgcggtttgggtgaatccatccgtctgttgcttcactatgttggccaaccgtttgaggacatccgaattaaagacatggaagaatgggagaaaacgtacaagccgaaatttttttacggaaaggtcccagttttggaggttgacgggaagccattgggacaaagtgctacgattttgcgctaccttgccgaaaaatttggcttggccggcaaagatgaatgggaaaaagcgaaggctaacgaaatcatcgactttcaaaaggatgctaacactgatttggccccctatttatacgtcaaaatgggattccgccaaggcgatttggacaaattgcgtgccgaagtgttcgagccgggagtcaagcacattttgccactgtttgagaaacttttgaaggagtccgggtcagggtacatgctcaagtccggcctctcaatggtggactttcaagtggccaactttctgtacacgtttaccaagttggagccggagactatcaatgcgttcccggagctgatcaaatacgttgaccgtgtccatgcgctgccccaactgcagcagtatttgaagcagcgtccgcaggaccgctgatcagtgatcagaaaagtcgagattgaatgagaaaagaaaatcaatcattgagattaattcgataagttatgataa

SEQ ID NO: 47807 - DNA, 551 bp, Heterodera glycines
  SCN-specific regions: Sequence locations=1-247,271-325,347-521,550-551
ggccgaaaattttagggctctgtgtactggcgagaaagggatgggcaaaagtggcaaaccgttgcactacaaagggtcgaagttccaccgcgtcattccgagtttcatgcttcagggtggcgattttactcgaggcaatgggaccggcggcgagtcgatctatggcgagaaattccccgacgagaatttcaaagagaagcataccgtcccgggactattgtcgatggccaatgccggccccaacactaacggctcgcagtttttcatcaccacagtgaaaacggagtggcttgacggcaaacacgtggtgtttgggcgagtcgttgagggcatggacgtggtgaagcaagtcgaagcccagggcaatcagagcggaaagacagcgaacgaaattaccatcgccgattgtggccagctttcgtgaaagcgacaaatttgtgcatcgttacagctcatttttgagataattaattattgttttgtaagtttttgcactttgttgctcgagaaatatggcgtgcaaaaaaaaaaaaaaaaaaaaaaaaaaaagg

SEQ ID NO: 47808 - DNA, 707 bp, Heterodera glycines
  SCN-specific regions: Sequence locations=1-295,319-625,647-707
ccgaagagaccgccgtttgcatttggcctctgttgcgctcaatcgctttgttcttggagaaggaaacggaccgaaccaacgaaaattcgattttgaaaagctcaaaggagtgaccaaaacagtgacccaaaaccttaacaaagtcatcgatgtcaacgattacccaacggagtgctcaaaacgctcaaacaaacgccaccgtcccattggaattggtgttcagggattggctgatacttttatgctgatgcgttacccgttcaacagcgaacaggcgcgtttgctgaacaaacaaatctttgagaccatttattatggggcgctggaggcgtcttgtgagttggcggagaaattcgggccctatgagacgtatgaaggctcaccggtcagcaaaggcattttgcaatacgacatgtgggatgttgtaccaacggatttatgggactggccgctgctcaaaggacgcatttcaaagttcggtgttcggaacagtttgctggtcgcccctatgccaactgcttcgacagcacaaatcctcggcaacaatgagtccattgagccgtacacttcaaatgtgtacagccgtcgtgtcctttcgggagactttcaaattgtcaatccgcatttgatgaaggatttaattgaactcaatctttgggatgatcaaatgaagaacagactaatcgcggagaacggatcggtgcaga

SEQ ID NO: 47809 - DNA, 680 bp, Heterodera glycines
  SCN-specific regions: Sequence locations=1-203,246-642,664-680
ttttagtgaattggatgcagactcggaccaggaaaatttacgcaccgaaactctgcggaaacaatttggcattgtgcgcgaagaaacgaacaaaagccacgtgatgcactacggcgacttgcaaattcaggacgaacacgtttctgagtttatgggcaaagagcaggcgcaaaagcgcaacgaacgcccaccatcaccgcacaaatttccaatgtttccttctcgagacattcccatgttcatgatggcacgccgtcagaatgagtctaagcagattcagcacaatctccgcgtggcgtggaaaaaaagaagctttctcgagcaaacgattaaacaaattgtgcaccaacttgtgcacgacatgaacaaccggcgacagattttgacgacttatccgcaacaaattcgcgacttggactgtcaccatgaggtggtgcacacgttcagcaatttctgcttcaaatttagcgaaaatccgtacgcgcttaaatatgcctatgttttggccaatttatgcgagcgacccgagttggacgccgaacgtatcaaaatggcactgattgaacagtgtgccgaagtcgaacttagcggtgtcatatgatcgaatttgaaaaacgcaatttgactgatattaatcctatcgaatccattttgattaaaaaatatccgaaataaaaagc

SEQ ID NO: 47810 - DNA, 421 bp, Heterodera glycines
  SCN-specific regions: Sequence locations=1-120,143-337,390-399
ttaatcggaggccaatgggcacgtgcagttacgtactgaccggcacagagaaaggcttaaacgacacgttcggcacaacttgccacggggcggggagggcaatgtcacgtgcaaagtctcggagggcactgggctttgagcaagttctgaacagactgaaacagcagggcattgccattcgggtggcatctccaaaactcgtcatggaagaggctccggaatcctacaaaaatgtttgtgatgttgtggacacgtgtcatatcgccggaatttcgaaaaaggctgtgaaacttcggcccatcgctgtcatcaaagggtgaaggaaaattatgaattgtttatataatttatttaatttgttgattttaacaaaatttaatgaataaaatcttcatttcgaaaaaaaaaaaaaaaaaaaaaa

SEQ ID NO: 47811 - DNA, 502 bp, Heterodera glycines
  misc_feature (492)..(492): n is a, c, g, or t
  SCN-specific regions: Sequence locations=1-425,447-502
ccccctttggaggtccactccagacctaaggacaaacctttctttgccgggctcgtcaaatacatggcatcaggcccgattgtcgctatggtttgggaaggtttggatgtggtaaacagggtcgcgttttgctcggcgctacgaatccgttggccagtgccccatggactattcgtggcaatttttgcattgagatgggacgtaacatttgccacggctccgattcggtgccttctgccgaccgtgaaattgcccattggttcaagccggaagaactcgtcgactgggaaagtgcgcagaatgcgtgggtttacgaatgatggaaagaggcaaatttgtgcagtgaaaggcctctgctttcgaatcgatgaccaatgacgaccatccaatttttgtttgacattcttccattctgttagttaggtttttcttttgttgttggctttgtttgtgttcttccttttcaattcgagcataaaattcctaattttnaaaaaaaaaa

SEQ ID NO: 47812 - DNA, 609 bp, Heterodera glycines
  SCN-specific regions: Sequence locations=1-80,102-228,251-609
tttggtaccgaccaaacgggaacacttttgtgcaatgcgtagttgaccattttgcgcccgacgtgtacggaccttttatcctcgccttggccaactgtcccacccgactgagcgccgttttcgaaaatagtacggctgtcgtgtgatccaattcgtccttgaaaatgtcgtccaacccgtccatggcactgcgaatgccaacaacagcttggaaaaggaaatttccatccaaatattgcatgttctcattgaacccattctcaaaaatgcgtattcgttggcccaaaacgaattcgccaattacctcgtccaatttattatcaaatcgccctatctccgccgccgacgctgttacatcatcaaaactcacatcattcgcaacgtttaccatctctcgctgcttaaatactcttcgcacgtggtcgagcaggcttttaagcacgcggaggaccgctgcaactgtttggccatgttattccgggaggtgttggaggggtacaaaccttcaactgatggaaagcagcggactgctctgtatgaaatgctgttcaatcagtacggcaattacgtcgttcagaggatgatccccatcgcccgtgacgtgtacca

SEQ ID NO: 47813 - DNA, 675 bp, Heterodera glycines
  SCN-specific regions: Sequence locations=1-22,44-528,550-675
caagaggaacttacagtgctttcgcctacaaattgccgggtatacccaacttatcaaaaccatcgatctcgagtcgtccgacgacacattgtttgctcgaaccaaggaggacggtggtcaattgctggttgctgccgttgagttatgccattggacgctaaggagttcgtcattgaatgcggagcagttgcgacgagacggagggttagatgctctgtacaaaacatttgagcggtgtgttccgatgattactgctggttcactcgaaagcgaaatgccagtgcaagtttgtactcacgtgtgcaattgttttgccaccgctgcccgttttgatgcgtgccgtgaaaaaattgcagaaatgaaaacgttgttccaaagcatttgccaactgcttagattcgaatctctccatcggttggcttgcgctgcggcggagtgcgtttgtgccttttcagtgtgcacattgttacagacgcaaccgtttcaagcgggtgtcatttggcaactcttacctcatctttttcgcttcgattacacgttggacgaaggaggggttgcccattccgagaagacgaaccaccaagcggtacttaaccgactggcccgcaactgttgtgaagcgcttgcctgtttggccggctttcgtccggacacgccggacaatgatggagtaca

SEQ ID NO: 47814 - DNA, 620 bp, Heterodera glycines
  SCN-specific regions: Sequence locations=1-404,441-620
tttccgccggctgggacaaattgtaaggtgtggaacttggctacttgccgactgaagaccaaccgcttcggacacaccggctacatcaactcggtcaccgtatcacccgacggctcactttgtgcttccggaggaaaggacggctcggcaatgttgtgggacttaaacgacggcaaacacttgtacacagttgggcggcaatgacgtgatcaacgctttggcgttttcgcctaatcgctattggctgtgcgccgcggttggcccggtggtgaaaatttgggacttggagaacaagacggtggtggacgagctgaagttggacattgccagcaccaccgccgcaaatccgatgcgtgtatccaaaaaatcgtgtcgcccaatgcatttgattggcatggaccacggacggacagacgctgtttgccggatacaccgacaacatcatccgagtgtggcgcatagcttaagcgaaatgttatggacagacaaatcggcactgatcgtccttttgatcactacttgttgttgtggatgtacttcttttctgacgatatataaaagtatggttttatggccagccaaatggcactctgatggccaactggacaaattacaaacgg

SEQ ID NO: 47815 - DNA, 624 bp, Heterodera glycines
  SCN-specific regions: Sequence locations=22-624
aaaatccagaaaaatattatggtggacaatgccaacgcgtcgatgggccttcgcctgtcctaccggtccacgtgcgtggacggccgaacgctgcaggacacgaacacgtgtgacggggtcaaagtgggcgacacggttgcgtttgaagtgacgctggaggcgctgcactgtgtgccgcaaagggacttcgccctgcacattgggccctccgggctggaggaggtgctcacgctgtacgtgcacgtcatctgtgactgcgactgtgaggacgagattgtttacaatgcgcccgaatgcaacggacatggcaatttggtgtgcggcatttgccaatgtgccgaaggctatgtgggcacccattgcgagtgcgaaagtggcggcgagtcggcggtggcgttggaagcgaagtgcaaaaaggacaacgacagtttggtgtgctcaggccgtggcatatgcaaatgcggtgtctgcgaatgcttcccacgagcgaatgcggatgaacttgtgtccggccaattctgtgagtgcggcaatttcaactgccctcgtcacgatcggctcctctgcggcggacatggcgactgcgtgtgcggcacgtgccaatgcgaaccgggatatacgggc

SEQ ID NO: 47816 - DNA, 657 bp, Heterodera glycines
  SCN-specific regions: Sequence locations=1-310,333-368,391-657
gaggacagactacttaatgaggagaacgtgcgcctttttcgctacccttttctgaagaaccctttttgggatggacacttcgatgagaatgactccgaccgaatggcaggcaaagccctcgaatggctttcataccatttgaaattggcaaaaaatgacgaaacgaattacgacgagacactgaccagagtgatcagacttttggggttgagcatacagcggaaatggacggaagcgaagtcattggcggaagagatgtttatcacagttgctccatcggacaatgcgcggcaaatgatttattcctccatggaacaaatgcagcaatttttgaattttgacgaacagattgaagcggcggagaagcaaacggaaagagaaaaagacgaccaaaattcggaggaatcggagaaaatggcactgaaaaaattatttgagcaaaaaaagtgccgaatttgaaattaacaaagcaaaagcaaccgaaaaactttccgagatgttggcagtacgatttgagccaattttgcagaaggaggaggaacgaatgatggaagtgcaaaggaaacacttttgggaatgggccgaacgcagaaagcgactcattcacagtcaggcgcaacgcgcggaacatttggcacgactgaacgaaattcaaaa

SEQ ID NO: 47817 - DNA, 688 bp, Heterodera glycines
  misc_feature (627)..(627): n is a, c, g, or t
  SCN-specific regions: Sequence locations=1-255,277-554,578-688
ggtcttcgaaggagaaaggccgatgacgaaagacaatcatttgttggggaaattcgacttgaccggcattcctcctgctccccgaggcgttcctcaaatcgaagtcacttttgagatcgatgtcaatggaattttgcacgtgactgccgaggacaaagggactggcaataagaacaaaattacgatcaccaatgatcacaaccgactgtcgccggaagagattgagcgaatgatcaacgacgcggaaaagttcgcagaggaggacaagaaaaccaaggaagtggtcgaagcgaggaacgagtttgagtcgtacgcctactcactgaagaaccagctcggagacagtgaaaagttgggaggaaaactcagtgcggaggacaaaacgaccatcgaaggagctgtggatgaggccatttcgtggttggactccaacaaggacgcgccacctgaggagcttaaggagcggaagaaggacctcgaggccaaagtgcagccgatcatcagcaaactctacgcagggcagtcgcctccgcccggcagcgaaccgccgccgactgaggagaaggacgagctgtgaacggtggaatcaccaagtgctaactgtgacgactttccttggtctatccnccttccttcccccactatctctttggtttttcatttatttatgttattggtatttttcaga

SEQ ID NO: 47818 - DNA, 758 bp, Heterodera glycines
  SCN-specific regions: Sequence locations=1-318,374-426,496-534,564 -627,650-708,732-758
attgtggtgccgtatttgcagagaattcacgaaaaggagcggaacaacacatgcccgaggtgtcccatgggcacaatgttcgattagggcagctgcaaatttcagctactccctatatcatttccgtttacaaagttcttggcgatttggtaaagaaggtcggccaacttcactacgaggacaccatttgcgacttgctttaccagttcaaatatatgtttgtcggctatgcgctcaaagaacaaaccgagattttcattctaaattttccggattcgatgcgtgaaaagttgaaatttttgttcacccattcgtcgacagcagcagcagcggtggaaaatcagcagcaaatgcttcagcaacaacagcagcaattggttggcattggatttgcacttggtcagcaactttcatttcccatggaatcagcaacacatcaacaacaacaacaagtactgcccttccaccattcacaacagcaacaacaacagcagccggcggcactgatcggaatgttgcagaggcaaagtcgcgaggacgaggggcagcaacagcaacaccaatcacgacaaaaccaagctgtgcaaatgcagcaacagaccaacacaaaccaacagcaagtggaacaaatgggcaccgctgggagcagcacaaccgcaagccaacagcaacagcagtccacgcctgccccattgtccgtgtcgtctgtctcttctgctgctctctctcccatttgatggttccgttttcctgcccgt

SEQ ID NO: 47819 - DNA, 695 bp, Heterodera glycines
  SCN-specific regions: Sequence locations=1-172,195-510,532-695
tcccttaaacttcgctcgcctttcccctattaacgggccattcgaccgtgaagtgttctcttatttctccaactgctcacaaatgggcgtcaaagttgccatcaccggtggcagtggctttctcgccgctcatctcatcaaacgcctgagggcagacgcaaatgtggacgaaatcagaaccatcgacagaaagccgttcagacagctcggaacaattgtttgttcttcttcagatgattgccctccttcctccgtcggttttccctcactcattcatttccaatgcgatttgctggatgttgccaaacttgaaaaggcattggatggtgtcgacgtgttattccatttggccagaaaggctttcgaatatattttcttcgctgatcaaaaagcactgaatgatcgctacagcagagacaatttggaagccactcattcgcttctcaacaccattttcaaatgctccgttccgcgattggtccatgtcggagatgcctttgccaacattcccccgggcgacaactttggaagcgctgagcacatccatcgcggattgccctccaaatttttgcttggccattacggagagacgcggataaaggccgaattggccgggcgagaaaaatgcgggaaaatccttccaaacggacagcccttccacgcacttttcctccgtccgacttttgtgtacggcg

SEQ ID NO: 47820 - DNA, 549 bp, Heterodera glycines
  SCN-specific regions: Sequence locations=1-69,92-156,189-549
gtgggagtccggtgcgcacattgattgccggcgcaggcgaactgcacttggagatctgcttgaaggacttggaggaggaccatgcttgcattccgctcaagaagtctgacccagtggtgtcctaccgtgagacggtcaccgaagaatccgaaattgtgtgcctgtccaagtcgcccaacaaacacaaccgtttgttctgcaaagccaggccgttgcctgatggactgccggaagccattgaacgcggcgacgtcaatccgacggacgacccgaaaaatcgtgctaaaatactcaccgagaaatttgaaatggacgcgaccgactcgcgcaaaatttggtgcttcggaccagagggcactggtgccaatttgctgattgacgtgacaaagggtgttcagtacttgaacgaaattaaggattcggtggtggccggtttccaatgggcaaccaaggagggtgtgctctgtgatgagaacatgcgcggtgtgcgttttgacatccacgacgtcacgctgcacgccgatgccattcaccgtggcggtggccaaa

SEQ ID NO: 47821 - DNA, 676 bp, Heterodera glycines
  SCN-specific regions: Sequence locations=1-46,69-676
tccctgttctctcgggacggatgtcactgaatgcgtcattaatgtcccgtttttctacgaggaaaaccaacgccgcgctttgctgaatgcgggtcgaattgctggcctttcacttcgcctgatcactgacccggccgcgttggcctattgttacggcatgtataacggggcaaatcttcctccacctgaacagcccgctcggcttgttgcgtttgtcgatgtcggccattcgtctgttcaagccagtcttattgcattcagcgccggcaaagcggaggtgctcgccgcctctttcgatttgaccgttgggggcgtccatttcgatgcgttgttgcgcgactatttcaatgaggactttggcaaacgcttcaaaatcgacgcgaggaaaaccccgcgggcgtggctccgtttgttggatgaatgcgaaaagatcaaaaagcaaatctcggcaaacagtcagcccattccctttgcaatcgaatgctttgtgaaagacaccgacgtcaacggagtgatgcaaagggaccaattcgaacaattggcggaaaaactcttccaaaaagtgcaggaactgctccaacagctcattagtgacgcgaatgtgaaggtcggcgatattttcgacgtagaattggtcggggggtcgtcgcgaattccgcgcatcaaacaaattgtg

SEQ ID NO: 47822 - DNA, 472 bp, Heterodera glycines
  SCN-specific regions: Sequence locations=1-472
catttgccttcgagcgatggcccttgtctacgaaaggcattgcattagcattggaccgtttgctgacactcgacacattgtcgaaatgttggccaaatgcacaaatgttgctgaaagggaccacttcttgttccttattaacaaactttcacttgacaaacaaaatgtacgtgaattgatctccgcaaatttgatctcacttttcatcgacattgcagtcttggcccatttgcataccaacagagcaaaacttcacggccaaacaaatgtgattgaggcaaccaaagatgcggcacattgtgaggagactgagccaaaagaatggtattacaacgaccggcagggccaacgccaaggaccgatttcgttcaaaaaaatgaagcgtttataccgcgacggtgtgctttttgagaagagtgaaatttgggcagaaggattggacaaatggtgccatttgtcgttagtttcccaa

SEQ ID NO: 47823 - DNA, 320 bp, Heterodera glycines
  SCN-specific regions: Sequence locations=1-83,111-177,201-204,234-320
caactgcttagctccgttggccaagtgatcaacacgagtttggcatcatcgaaggactgatgaccactgtgcatgcggtgaccgccactcagaagacggtggacgggcccagcggcaaacaactggcgagacggacgtggcgcggcgcagaacatcattccggccagcaccggggccgccaaggcggtgggcaaagtcatcccggagctgaacggcaaactgaccggcatggcgtctccgtgctgcccactccgaacgtgtccgtcgtcgacctgaccgcccgtctggagaagccggccccgttggacgccatcaaagat

SEQ ID NO: 47824 - DNA, 338 bp, Heterodera glycines
  SCN-specific regions: Sequence locations=1-75,97-338
cacgctcgcttctcccttgaaggcattttatgcaaatgtggcagtgaaacaaattgatgttacagggatgtccagcagtgttggaattcttcctacccatgtgcctacaattgcagtcttaaagcccggagttgtcaaagtccacgaacttgatggaaacgtctccaagtttttcgcttcttctggtaccctttcaatgaatattgacggctcgtgtcaagcgctcgctgaggaactttgttctcttagcgaactcaacgaacaggccatcaaaaatttgattgatgtcagccaaaagaaagcttctgacctcaatgcaactgatgtgcagaaggccg

SEQ ID NO: 47825 - DNA, 692 bp, Heterodera glycines
  SCN-specific regions: Sequence locations=1-51,73-692
gtgggacaggcgaccttcgacttttgctataagcgccctggagcaaatgtgcgaagatgcttcaatgaaaatgttggagaaggaatgcttgggcttggagtattaccctcatttggcaaacttatgcaaaaacagtgagcagaatgttcgtgtcgttgcgcttcgtattttgacaaaatttgcccttgtctaccctgaagagaaagtcatggcatcgaagggtttcaaaattcgtcttcatgacgatgctttctcaatcgtttgcgatgcagtgaatgatttggaagtaaaagttcgcgctcaagctgccaatctcttgggattttttgaaaacgtctctgagtcgttcctcgaccagacattggacaagaaattgatgcggaatatgactatgttgaacactaatgtcagaaatacgaaaaatgcgttatctgctggtgttggttatatcggaggatggagcactggcaaaaaaatgggtgaggacatgccgatcgaaaagctggaggacgaaagccaatctttgatccctaccggctcttgtggcgccttcgttaccgcactcgaagacgaatttatggcggttcgtcaggcagctgtttactcactgggaaaacttgctaggaaccgacctgtttttgcgagtgcgtgcatcgatcatttggccgatatgttcaacgatggaatccaac

SEQ ID NO: 47826 - DNA, 521 bp, Heterodera glycines
  SCN-specific regions: Sequence locations=1-376,398-521
gtggggcattgaacctgtcggtggagtgatgacaaactgatactcgcaacactgtcattccgaccaaaaagtctcagatattttctaccgcggcggacaatcagccaactgtgactattcaggtcttcgaaggagaaaggccgatgacgaaagacaatcatttgttggggaaattcgacttgaccggcattcctcctgctccccgaggcgttcctcaaatcgaagtcacttttgagatcgatgtcaatggaattttgcacgtgactgccgaggacaaagggactggcaataagaacaaaattacgatcaccaatgatcacaaccgactgtcgccggaagagattgagcgaatgatcaacgacgcggaaaagttcgcagaggaggacaagaaaaccaaggaagtggtcgaagcgaggaacgagtttgagtcgtacgcctactcactgaagaaccagctcggagacagtgaaaagttgggaggaaaactcagtgcggaggacaaaacgaccatcgaaggagct

SEQ ID NO: 47827 - DNA, 666 bp, Heterodera glycines
  SCN-specific regions: Sequence locations=1-34,56-226,468-666
tgttttggacagttgttggccgaagaccaaattgatgttggctcagtcattttacgacgcgtccgttgtgctttgtaaggctgccgaattatcctcaaaatttttcggcgattttgcgcctcagtcattcttgcctcatttcaattacggcaaagcactcattgaggttgcgcgtctcgaatcgctacctattaaaccaccgatggatgacattgacgagagcgatgaggaggacgaaggagaagaagaacagggcgaggaattgcaaagcaaaaatgggactgaaaaagaagtggtggaagaccagcagaagacggaagaaaagggaggcgagaaagggacggacgaatgtgcggaagagagagacggagagcagcaggacgaagcggagaaggccgacaacgaaatggcagaagtgacattgaaaacagacaatgaggaggaggaggccgatgaagacggaggagacgaggacgacggccaaatcgcgtgggaaagcctcgaagtggcgcgaaaaatttgcgaaaatcacatgaaaagcgacgaagcgaagttatggacggagcgaaaatcggatgtgctggtggctttgggcgattgtatgaccgtgacggagaactttccacttgcgttggaggaattcacgagcgcactggcgattcggaa

SEQ ID NO: 47828 - DNA, 646 bp, Heterodera glycines
  SCN-specific regions: Sequence locations=1-466,488-646
atggagaagaagggcttaagggtggcggagaaggcggcggaatgcacaatccaatggacatattcgaaatgtttttcggcggtggtggttttcgtggcggtggtgaaaaaccgaccaaggtcagagatactgttcatcagcttaccgtttcgttagacaaactgtacaacggatgcaccaaacacttgcgcatcacaagggcatatcctttgtccgaaatgtaatggtgtcggcggcgctaaggaaggggtcaaacaatgcgaaaattgtcgtggacgcggactggagattcacaacatgcaaattggtccgggaatgattcagcgaattcaaagagcttgttctgaatgtggcggtgagggggaaataaatcgcaacccgtgcaaacactgtggcggcaaaaaacggatcaaatcagaagagacaatcgaagtgcatattgagaaagggatgcgcgacgggcagcgactgatgttctacggaaagggcgaccaacagccggggctggagcctggcaacgtgatcattgtgctggacgaggaggagcatcccgtgttcacgcgaagaggcaccaacctcaccctgaacatgaaactgacgttgacagaggcattgtgtggctgcactaaacatgtggtgacgttgg

SEQ ID NO: 47829 - DNA, 655 bp, Heterodera glycines
  SCN-specific regions: Sequence locations=1-655
gagcagcgaaagccggacggcgccggcgatggtcgacgtggagacggggagagacataaatccgcacattcccgagttcatcgagaaaacgccctggtatgtgccatcttcaggacccacgctcaagcaccagcggccacatcctgaacgccaaaaacagatgtcatcggttgctgaatggtaccctaagggcactaccgaacgcgtggcattcaaataccgtgacggggcttgtcaaaattgcggtgctttgggacataacagaaaaaattgctttgagaagcctcgattagtcggtgctaaatttacgaactcaaacattgctccggatgaccatgttctgccatccctcgaaatgggatacgacgcgaaaagggaccgatggaacgggtacaacgcggaggattattcattggtggcagctgagttcgaaaaaatggaggaaacgcggaaattgatcagagcggaacagctcaaagaggccggtgaggaggacaaaaaggcggaggaggacgaggacatttacgcggaagacgcgtcggcccccggacagtccgttgacatggactcgcggacgcgaataacagtgcgaaacctgcgcattcgggaggacaccgccaaatatttgtacagtttggacccgaatggagcatat

SEQ ID NO: 47830 - DNA, 672 bp, Heterodera glycines
  SCN-specific regions: Sequence locations=1-220,242-440,463-644
taaactgcccgaaacaccgagtctaattgacgctactcaacagagattctgccaaagcgccttcgaattgctcagcggatatttgaccaaattcgacttggtccccatcttcaccatcgaagagttcgaacatttcttcctgccccgcgatgatgtcatttacacttatgtgattcagaacaacggagaggtcaccgacttggtcagcttctacagccttccctccacagtgatgcaccattcccaccacaaaagcataaaggcggcttattctttctacaatgtcgccgggagtgttccgctcagccaccttttgaacgatgcgttgattttggcaagaaatgttcgtttttttctttttgtttccgttcgtttgggtatatccaaatttgtttcacaatcagcttggctttgacgtattcaatgctttggatttgatggaaaacaagggaattctggaggatctcaaatttggcatcggagatggcaatttgcaatattacctatacaattggaaatgccccgacattccttctgatcggattgggttggttcttcagtgatcggacaagtcgaatttaattaagcaacccggatgaattcgaacaattttttactagcagttttactcttcgaattgttgccattttaaaaaatattttatgctttaca

SEQ ID NO: 47831 - DNA, 532 bp, Heterodera glycines
  SCN-specific regions: Sequence locations=1-105,175-215,246-252,276 -371,400-532
gaatatttttgttttgctttgcttcctgaagagaatacgcaactgaagatgcaaattttcatcaaaaccttgaccggaaagaccattactttggaagtcgaggcgagtgacacaattgaaaatgtcaaagccaaaatccaggacaaggaaggaattcctccggaccagcaacgtttgattttcgctgggaaacaattggaggatggacgcactttggccgattacaacattcagaaagagtccacgctccatttggtgctccgtctgcgcggagggatcattgagccgtcgttgcgcatgttggcacaaaagtacaactgcgacaagcagatctgtcgcaaatgttacgctcgtctgccgccccgtgccaccaattgccgcaagaagaagtgtggacactccaacgacttgcgcatcaagaagaagctgaagtagaggaccaaatgtttgctggacgaatgggattattgttgatcgaattatttgattttgtttgatgtcgtgagaagacaattttatgtaaaaaaaaaaa

SEQ ID NO: 47832 - DNA, 700 bp, Heterodera glycines
  SCN-specific regions: Sequence locations=1-700
ttatcggcccgaattggaggagacttatctccacaatgctttgtacttcagggcagattgggccaggcgatttcggagaggtggtcagtgtgcgttccaaagacgacggcaaattgtatgcggtgaaaagctctttggacatttatcggaacagcgctgatcggcgtgaaaagctgcaggaagtgcaaaagcacgaaatgctgccgccccatcccaacctcatccatttcgtgaaggcgtgggaagagcgcggccgactttacattcagacggaactctgctctcaaagcttggacgacatggcgagggagcgccacgaaataccggagccagaaatctggtattacctgatcgactcattgatggctctcgaacacatgcattcccacgacatcatccatgttgacatcaaaccgtcaaacatcttcgttacttcggatggcatttgcaaacttggagactttggattggttttcgatttaaacaaagacgaccctcgcaaagcttctgaaggggacagcaaatatttggcagcggaagttttgaatgacaaaccgacgaaggcagctgacatattcagccttgggatgactattctcgaacttgcgaccgatttggacctgccaaacaatggacttttttggcatgaaattcgcgatcgaatgattgatgagaaatacattggctttctttctcccga

SEQ ID NO: 47833 - DNA, 680 bp, Heterodera glycines
  SCN-specific regions: Sequence locations=1-36,58-64,88-680
gattgtcctttcgtccctttcttttccttccgccctctttttggccacttcctccccactttttctgccttctcccccactttcttccgccaatgctctcatcgtccccaaaggaatttgttgcgcctgtgggagaggtgcatgcgtttgtggtcaaatgtatgcaaagtgtcggcacttcggcggcgcacgccgcgcaattggcggaccttttgttggatgccgacatcgttggccattacagtcatggccttaaccgcctttgcatttacattgaggacgtcgcctcgggcgtaaaaggcgacggtgaaccgaaggtgctcaagcagaagggtgccaccgcttgggtggacgggtgcgatttgcttggcgccgtcgtcggtaatttctgcacagaattggccataaagttggccaaagagcacggcatcggctgggtggtgtgcaagcggtcgaatcattacggcatttgccaacattatgccaaaaagatagcaaatgccggcttgttgggactgtcgttcaccaacacttcgcccatcattttccccactcgctcttcccaaattggccttggcaccaacccaatcagttgttgtgccaattcacgcgaaaaaggcgacggattcattttggacatggcggcgtcgacagttgcgcttgggaaggtcgaaatcgca

SEQ ID NO: 47834 - DNA, 713 bp, Heterodera glycines
  SCN-specific regions: Sequence locations=37-37,325-330,411-420,544 -548,583-588
caggccgtgctgtccctgtacgcctccggccgtaccccggtctcgtgttggactccggcgatggtgtcacccacaccgtgcccatctacgagggctacgccctgccccacgccatcctccgtttggacttggccggccgtgacctcactgactacctgatgaagatcctcactgagcgtggttactccttcgtgacccggccgagcgtgagatcgtccgtgacatcaaagagaagttgtgctacgtggcactcgacttcgagcaggaaatggccactgccgcctcctcctcctcgctggagaagagctacgaactgcccgacggccaagggatcaccgtcggcaacgagcgcttccgttgccccgaggcgctgttccagccgtccttcatcggcatggagtcggccggcacccacgagtccacctacaactcgatcatgaagtgcgacatcgacatccgtaaggacctgtacgccaacaatgtgctgtccggcggcaccaccatgtacccgggcattgctgaccgcatgcagaaggagatgaccgcgctggccccgtccaccatgaagatcaaaatcatcgctcccccggagcgcaagtactccgtctggatcggcggctccatcctcgcctccctgtccaccttccaacagatgtggatcagcaagcaggagtacgacgagtcgggcccgtccattgtccaccgcaagtgct

SEQ ID NO: 47835 - DNA, 278 bp, Heterodera glycines
  SCN-specific regions: Sequence locations=1-278
cgttgctctgtgcccacctggcagaagctgaccaccaagaggtggaggagcaaattgtgaagttggcccgcaaagggttgcgtccgtctcaaattggcgtgattttgcgtgattctcatggcgttgcgcaagtgcgtcgtataaccggcaacaaaattgtgcgcattcttcgatcaaaggggatggcaccagaaattccggaggatctttaccatctgatcaagaaggcggttagcatccgcaagcatttggagcgtttccgcaaggacattgactca

SEQ ID NO: 47836 - DNA, 653 bp, Heterodera glycines
  SCN-specific regions: Sequence locations=1-225,248-419,441-653
gtgaatatttgaccccgggagatggtgggctgcacttcctcaaaaaggagtgcataacggcagccattccttatttggaacacgttatttacgaatggagtgatgagagtccccactttcacggggaattgttggagcaatacgtgctcaggtgcaatacgttgctcgggcagttcctccattcgctctcctctccgtcgattggtgttccatcttttgtcgccgaagatgatgaattatctatattgagaaggaaattacaatattttttggcgaccgaccagcattattcgattgaaagtgcaagagatctaattggggaagaccaaaatttgatggaggagagagcgatcattatggggaaattaggacagcatttaaacgcattgaaaatttatacggaaattttgatggatttcaatggcgcagaaagacactgccaaacttattacgatgaaagaaatgcatcgactcgcaacattttcttcgaccttttccattattatataaaaggcgaaatgcctcaaaaagaggtaattcaagttgaaagtgattacgaaattcggcgcaaaccaaacatttcggaggcgctgaagttgttcaaaaggcatccgaccaaaatagacacagtgggcgcttttgctctcattccg

SEQ ID NO: 47837 - DNA, 519 bp, Heterodera glycines
  SCN-specific regions: Sequence locations=1-253,289-519
taccctctcgcactaattatcttcgccgacccgggaactcagtctccaatgtcaatgagtcacgcaaatttgcttaccgcactccgattgtttcagcacttctatacggaggccgtgaaaattatcgtgatcagataacaaacttcggttgggtgtgcacatgcttatcgcaacaccaggtcgtctgatcgatgtcatccaaaatgggctgattggcatggaggcgtgccgctttttggtgttggacgaggcggacagaatgcttgacatgggctttgagccgcagattcgtcggattgtgcaaatgtccggcatgcctcaaaagggagagcgtattaccgcgatgttttctgcgacctttccaagagacattcaaattctcgcccaagacttcctcatgcctgaatatgtgtttttggctgtgggaagagttgggtccacctctgagaacatcggtcaaaaaggtgtttgggttgaagagcacaacaaacgccatttcctgatggatttgctggatgc

SEQ ID NO: 47838 - DNA, 633 bp, Heterodera glycines
  SCN-specific regions: Sequence locations=1-193,216-578,600-633
gtcgagtttttgcttaagaggggttggccaagtgcgtcgactggtcaatggccgttgtgacgggcggcgccgaaaaactgagagaagccgaacgcatcgcaaaagaaaagcgactccgattatggaagtcgttcaccgggtcctcctcaaccgtaaaaaatgcatttactgccaaagtggttgaaattggtctggtcgattctctttctgtgcttaaagacaatggagaggagatgaaagtgtacttctcatctttgcgtgcaccgagacgcgaaggcaccgatggaacttctggcggcgttcagcgccaattcaggcctctctatgacattccgtttatgtttgaagcccgcgagtttcttcgtcgtcgtcttatcggcaaatcggtccaagtgattttcgactacgtacagccaaagcaggaccaattcccggagaaaacgtgctgtacagtgatgttcaacaaccaaaacgtggccgtcatgctcattgagcgaggctttgcacgagcagtgcgtcacggccgtgacgacgacaatcgatcgccacaatacgacgcattgttcgccgcggaggcacaggcagagaaagacaaaaaaggaatttgggctgaaaagtgcacagaaaaaaaaa

SEQ ID NO: 47839 - DNA, 695 bp, Heterodera glycines
  SCN-specific regions: Sequence locations=1-128,150-695
ttctattgcgctattcttcttctgcaacacattaaacaacgacgcatgccggaggaactggtggcgctcagtcccggaacgcgtgtctccggccgctggaccatcatcaagaagcttggggcgggtgcgtttggagccgtctacttgtgtcaagaccgagatggaaggacaatggcagcactgaaaaccgaacctttcgacgctcagcgaccactgctgtatatggaggcccacgtgttgctcagcctgaacgaacttcgatcaaacagtggacgccatttttgccgttgtctggaccttggacgcgatgaacaaccggatgccgattctggacagacgatggagttcaactacgttgtcatgtcgttggttggccgtccaatggacaaactccttcacgaatccggtgaccgcttcagccccggaactgcgatcggcacttcaattcaacttctcaaagcgcttaaggcgttgcacagcgttggatacctccatcgtgacattaaaccagcaaactcggccatcggcacgcctgagacgaacgaacagcgccttctctacctcctcgactttggaatggcgcgcaaatatgtcagagaggacggcacacaccggcgccaaagggacaccgcccgcttcagagggacgccaatctacgcaccaatctctgcgcacatcaaacgcgactacagccg

SEQ ID NO: 47840 - DNA, 673 bp, Heterodera glycines
  SCN-specific regions: Sequence locations=1-179,201-273,306-306,342 -351,373-381,405-673
tgattgcgattggcaggccttagtggtttgggagcaggttcattgaacgcaacaccacacgattcgaaccaagttgacacttcggaaactgtttacatcagttcattggctttattaaaaatgctaaaacatggacgagctggcgtcccgatggaggttatgggtttaatgctaggtgaatttgttgatgattatacggttaacgtgattgatgtctttgcaatgccgcagtctgggacgggagtttctgttgaggccgtcgatccagtctttcaggctaaaatgttggatatgcttaaacaaactggaaggcctgagatggttgttggttggtaccattctcacccgggatttggttgttggctttctggggtcgatataaacactcagcagagttttgaggcgttgtctgacagagcagttgctgttgtagttgacccaattcaatctgtgaagggaaaggttgtcatcgatgcttttcgcacaattaacccacaggcaattgcactaaaccaagaacctcgtcagacaacgagcaacatcggccatttgcaaaagccttcaattcaagcccttatccacgggctaaatcgccattattattccattccaattgcttatcgtacaaacgagaatgagcaacagatgttgcttaacctcaacaaacaaagtt

SEQ ID NO: 47841 - DNA, 679 bp, Heterodera glycines
  SCN-specific regions: Sequence locations=1-255,277-387,409-679
taaaatggccctttatccgctttaatgagactaaaacaaatcgtggaagaagtttgatttcatgtcacaactttgattactgctttgaacgagatgcgcgaatcgcggagggctttgagtattggagatgcccaaggcgtcctccatattgcccaggaagagcaacagtcccaagtgcttggcaaattgatcccgacggcaaccgcttcaaaatggggcgagtgacagcaccccataatcatccacctatttttggccaacacaatataagggaggcgaatgaacgagttcgtgaagaagcgcgcagcgactttcctacgactagccgtaacattgtacgtgatgttcgatcagaaatgggaagaacaacaggcagaccaaacaacttctacacaataccaaagaaacgatatgattggcagagaaattggcgaggttttggccagagcacctctcgtcaccggggcatgccgaaaatgtggatttgttggccatttgccttttcaatgtcgaaattttattcaattgaaacccaatcaaaaattggacatcgacgtttcttcaacaagttcggaagaatatacgactccactgacagaccgcgaaggcaaaaaagccgcgaagaaaattaaaaaaagggagaaaaaggaactgaagaaattggaaaaactgaagaaga

SEQ ID NO: 47842 - DNA, 588 bp, Heterodera glycines
  misc_feature (562)..(563): n is a, c, g, or t
  misc_feature (566)..(566): n is a, c, g, or t
  SCN-specific regions: Sequence locations=1-563
gagtggacaggaagtgattgttgaggtggcagtttcttcggaagacattggctccactggaactgaaagttatgatgacaattcgaaggccgcgtatgaaacatttgtgaaagacctcaaggagcgaactgagggttttgtggactgtcgctacgcagtgttcgacttcaaattccagacacagcgccccggcgcaggcacttccaagatggataagattgtcttcattcagctttgcccggacggtgcgtcaatcaaaaagaaaatgctttatgcttcatctgcgtcggccatcaaggcgtctctcggaaccgctaaaattctgcaatttcaggtgtctgatgagtcggaaattgcccacaaggaattgctgagcaagctgaacgacaaataccgcgacaattgaatgattggttgggatatgatgtcctgcacattcctctcaatttttgtcatttatacccaaatttaatgacgcttttatgttaaaatcaaatcatgtcacttgatcgccacaatatgtttattttaatatcgggtggataaataagacagtaattcnnaanaaaaaaaaaaaaaaaaaaaaaa

SEQ ID NO: 47843 - DNA, 717 bp, Heterodera glycines
  SCN-specific regions: Sequence locations=1-10,158-469,494-606,628-717
gacgaaagctgaagaaagaggtgaaagagaaggaggagtcgtaccaggcgaggctgaagaagtgggaggagagggagaagagaatggccaaattatacgacaaagagagagaggaggaaaaacagaggcagaaaacgctgcaaaaggaggcgaagaaactgcgacagtttctggaggattacgtggacgaacgggacgacccgaagtattacaggggctcagcactgttccaaagaaaacgaaattacgaacgcgaaagggaggcggacgcaaaggaccgacacgaagaaagggcagaactggaggagataagaaggtccattttggaagaggaagtggtcagcaaaaaggaaggggacggcgaagaagcagacgaaagtggggacacttctggcagaatggacattgccgacgaacaaaaggcggaatgggaaaccgttggcgagacggcggcgatggtttctgggcctgttcctcctcctccccttcccagcgaggaaccgaccccagcccaagttgaaagtccgacgccagtgaagaaaaccatcgtgacgacgttacaacagaagcaagtggtgccgctgtcgaaactcaacggagtgttccaagaggaagaggaggatgaagtcgatacgttgcatcagatcgagaaaaagataaagcccttcgaaataacgcgagaggatcgattacaatcgatgacaccggaagaacgga

SEQ ID NO: 47844 - DNA, 673 bp, Heterodera glycines
  SCN-specific regions: Sequence locations=1-91,113-403,430-635,669-673
cagaaattcgaatggtatcgacgacgtacagcgactcactgaagacgccgacgcggcacaaaacggacaattgccgtccaacaaaaacagaaagtacagctggatgagcttttcgtccgtttctgcttcggtgtctcccgactcgaatccctgcggtttgacgcgttttcaacgaatcgctgcgtttttcctttgcatttttgctgctggcttttgcttcacaacggctatgatgctcatccccgtcctcgtcctccaaacgcgcaaattcgctgctctgaataccctcggatctgtctttttcattgtcagttttggctttctgtggggccctttggcgtattgtcaatttctgttctccgagccccgtcgcgtggtcaccgccgtttatttgctcagtgttttggccactctttacacttctctgtggcttcaaagttcccttctcaccgtaatcactgccgcccttcaaacttttggcctcatttggtttcttctttcctatgtcccgggtggggaaaacggcctcaaatggatgggccgaatggcaaaaatggcgttttgtgcgcgtcagtcgtccactttggttttgcccatttgacgccagccgatgcgactgaatattaatttacctatttttgtttctcttttctgtttcctctttctttcattt

SEQ ID NO: 47845 - DNA, 712 bp, Heterodera glycines
  SCN-specific regions: Sequence locations=1-130,152-712
gagtgcttcgtctgtttattacttcttcctgcccgtacttttttagggtttaattgtgtgattggtttaagtaaatttctcctcgtccgtcatgttttatcacgacttgcacgacaacgaaaatagccatgataaagagttaaaacagttggtacaaatggacgaccttgcaattcccaaatttgtaatgcctccgctcggcattaagccaaaaaaatttgtgcgcaaacattttgggccgaacagtcggcttccaatggcgcagtttctgaagggcactaccacactgtcctttgtgtacaagccgaagacaccgcaagacaaaggcggcgttattgtggcggtcgattcgcgtgcaacgggcggaacttacatcagctccaaaacggtagagaaaatcattccgatcaacgaccaattggtcgcgacgatggcaggcggtgcagcggactgtcagtattggacgcgggtggtgagcaaatattgcaatcttttcgaacttcgcgagggtacgcaaatttcggtggctgcggccagtaaatattttgccaatgttatgtacgactatcgtggccaagagctgggtgttcactcgatggtttgcggggttgacaagttcggcccttccatttacatggtcgaagctgaagggactcgcgtgaagattgacaccatttgttcactcggttcgggcatgttgcacgccatgtcc

SEQ ID NO: 47846 - DNA, 736 bp, Heterodera glycines
  SCN-specific regions: Sequence locations=1-736
tgggaagactcgcgtcgacgtcgaacagaaacacgcgttgagttgcgcaagaagaagtgcaatgaggagatgatgaaacggcggaacatcaacttggagtgtgcggacgactctgccacatccgccgaagaactcgtaaccgacggggaaattggcgaaccgacgggccgtttgtcgcccgaaatgctatcgttggaagacgcagttgaagttttgcaaaaagagcaaaatgcggagagattccgattggcttttgagtcggtcaggcgcgttttgagtcgcagcaaatgccctccaattgacaaagtgatcactcttggctttccttgtgctctcgtccaggcgctccattatgacgatgacaaagtgaagtttgaggcagcttggtgcatcaccaacatcgtttctgggacttcggaacagaccatgaccatggtcaacgcgggtgcggttggtccgctgcttaaactgtgctcctctccttcgctcaaattgagtgaacaggctgtttggtgcattgccaatatggccggagatggcgttcaacttcgcgacctgctgatttccgagggtattctgccgttgcttgtcgggttggctgactgcgcggatactttgggcatttcgttcgtgcgcattctcacctgggccttctccaacttgtgccgccacaagaagccgcaagtgccattgcaaatgttagccgtaatggcaccgtcaatttccaaactgatca

SEQ ID NO: 47847 - DNA, 579 bp, Heterodera glycines
  SCN-specific regions: Sequence locations=1-47,69-554
gttctaagctttctcttgccgaagatatggcattctggtcaacgaacagatgaggacaaatattgaagacgttttcgccgcgggcgatgtttgcacagcgaattggacagcaaaaagtccccattggaagcagatccgactctggacacaagcgcgacagatgggcttgttctgtgcccgatgtatgctcattgacaacgttttgctcgacatcgctttcgaacttttcacccacgtcacttctttttttggcttcaaagtgattttgcttggcgatttttcgggcgaacgattggaaaaaccctttgagaagaattatcggatcactgaaggctgcgaatatgtgaaggttctgacaaaggatcaccgtgtgcacggggcggtgttggtcggcgagactgacttggagggagcggttgaaaatctgattctgaaccaaaccgacattggtcaaattgagcaagtatttctagatcctgatttcgatcttgaagatttttttgattaatcccaattattttgcatttaatataccaaaactatatgataaattcaaaaaaaaaaaaaaaaaaaaaaaaa

SEQ ID NO: 47848 - DNA, 702 bp, Heterodera glycines
  SCN-specific regions: Sequence locations=1-702
taatcctccatccgcccgtctccattcatttccaaattattcaaatcctacaataacaatacataaaaaatggagcattttccttctaaatttgttctctgcttgctcattgcattcatcgccgttccatgctctgttttggctctttctgctggcagccgcgtgtcgatgctcgcgtgccacaacaattaccgctcacaactggccaaaggcactgcggacaacaaatcgggcaaaatgccggctggcagcaatttgatccaacaaaaatatgattcgaatattgagtcggtggcgcagaagtgggccaacggatgctcaatgtcccactcgggttcatcagggatgggcgagaatttgtacatgactagttcatcgacaatttcggaagctgatgcgctgaaacaagcttgtgacatgtggtgggcggagttgaagcagttcggctttcagtcaagtcttgtgctggacatggctcagttcaacaagggcatcggacattggagccagcaagcatgggcctccactgctcaaattggctgtgccatggcacgttgtccgtcctccacctggaagacatgggttgtgtgcaactacaaggaggctggcaacttcttgaaccagccggtctacaaaaaaggtgccgcgtgcagcaagtgttcggattacaatggggcgacctgtgacagcgccagcggactg

SEQ ID NO: 47849 - DNA, 665 bp, Heterodera glycines
  SCN-specific regions: Sequence locations=1-78,102-316,338-394,418 -487,516-665
catcgtctgcaactttaatcccacgcagcgacgtgcccggcgcaacaatggcaagagaggactacggcttcgatgcaacggcggcggcagcggcggagcagtctcggccttcggcaaccacttcaacgccatattggcagcacgactccttggacatcgcccttaagccatcatccggaaggtcaggcaatcgcctgtccaccgcttcacggatgagatcaccgacgaggaactccaacaactctgcatggcggcaacggacgtcttcagaatgcagccgacgctcgtcaggattcagccgccggtcgtcgtcgtgggcgacatccatggacaattcacggacctgcagaggatcttcgacacgcatggctaccctccagagcagcagtacgtcttcctgggcgactacgtcgaccgaggcccccagtcactggaaacaattgttcttctcttctgctacaaggtcaaatacccggcgaacttcatgctgctgcgcgggaaccacgagtgcgccaacatcaacagagtgtatggcttcttcgatgagttcatcaaccgctacaagcgtccggatccctgccgcctctacgacctcttcaatcagacgttcgcctggatgccctacgtcggcctgatcggcgacaaaatcctgtgtatgcacggcg

SEQ ID NO: 47850 - DNA, 664 bp, Heterodera glycines
  SCN-specific regions: Sequence locations=1-59,81-474,497-664
catcaaagacagcgcggcggtgcggccacaaaaaggacccgtccgacccgacgcaggcgctgtttctgctggctgagaatctggctgaacttatcgactcggtctgcaaaagtgaggacaaagaaaaactgttgcccgcactgcaagcagtttggaacaacacattgccctatttgaaagcgaaaagtgctaagaatgtgcgctttttcttggccagttcacaatttctcgcttcgatgagttcctacaattacatgcgttcggtgtggaagaaaaatgcgatggatttgctgtgggacaattcattcttcaaaatggacatccacgcgttgcgccaatggctgatcgtaatcgacaatttgatgaccaacgacaaaacatcgttcaaggaattgcttacgcggatcaccacctccacgtcgaccactctgtcaacactgatcaccagcaaggagcaggagtacgagatgcgtgcccagtacctgaagcggctggcgttcgtcattctcagctcggagctggaccaatatgcgggccaattaaacgaaatccaagaacggctgacagaaaatttacgtctttgccaagtgccggtgatccacacgcaggtgttcacgtgctaccgcgtgctgttggtccgcatgagtcccagttcatttgtgtc

SEQ ID NO: 47851 - DNA, 556 bp, Heterodera glycines
  SCN-specific regions: Sequence locations=1-466,510-534
atactccctttttcccaaatcttacaaatgaacatgaatcaacttttggttggccgttcgctgttcccaaaaatcatccgccctttctcgcacaccaaaccccttgccaagtctgaggctgacccggatgattacggctacttcccggacccaattgaacactcatggggtttggagaggaaaatgctcatcgctcgtctgaagggtgacgaccgctatgagccgaaggtgtatttccgcgctgaacataccacccgggactatccgaatttggtgccggtccatttgcaggacaaagtcgtcgggtgcctttgcgagccggacgcggagtacgtgaactattggcatattaggaaaggccagatgaagcgatgcgagtgcggacattggtttaagggcgtgcaagccgaccctgacagtttcgcctgaatgcgatggatacgaattggctttgaagtgataggagatcatataaaatgatcagttattttaattgtatttctaagttggttggataaatgtaaagcatagattaaaaaaaaaaaaaaaaaaaaaa

SEQ ID NO: 47852 - DNA, 580 bp, Heterodera glycines
  SCN-specific regions: Sequence locations=1-97,121-177,210-520,544-580
tgggtaggaaacgcgcactgttgacagtttcctgctgtgtgccatgatatcgaatgaaagggaacatttgtcgtctgaggctctcgaagctgctcgaatttgtgcgaacaaatacatggtgaagaattgcgggaaggacggctttacatgcgcgtccgaatccacccgttccatgtgattcgcatcaacaaaatgttgtcctgcgctggtgctgaccgtcttcagacgggaatgcgcggcgcctttgggaaaccccaagggttggtggcgcgtgtcggcatcggtgatatgctgatgtcggttcgtgtccgtgaccagcatcaagcccacgctcttgaagcattccgtcgagcaaagttcaaattccccggccgtcaatacatcgtcatttcgcgcaaatggggcttcaccccttttgaccgcgaagtttacgagaagcaccgcaaggaagggcgagtcattccggacggagtcaactgccgattcctcaagcaacacggaccattgacggaatggctcaaaaatccaatctgatcaattgtacgacggatatattcccttttatatgctttgttgatta

SEQ ID NO: 47853 - DNA, 698 bp, Heterodera glycines
  SCN-specific regions: Sequence locations=1-357,379-483,521-698
ttaaatctactgctatttcgatgttctttgaactcgaacgcaaagacttggagttcgtcaaaggcgaaagccaagcagacattgagcaggtcgacgggaagagccaaagtacaacggtttcttgatcaatctgatcgactcgcctggccacgtggacttctccagcgaagttactgctgcgttgcgcgtactgacggtgctttggtggtggtcgactgtgtgtcaggtgtttgcgtgcaaactgagacggtgttgcgtcaagcaattgccgagcgtatcaaaccggtgttgttcatgaacaagatggaccgtgcgctgctcgaacttcagcttggccaggaggaattgttccagacattccagcgcattgtggagaacatcaacgtgatcattgccacttacggagatgatgatggaccgatgggtccgatccaagtggacccgtccattggcaatgtcggctttggctctggacttcatggttgggctttcacattgaagcagtttgcggagatgtacgctgacaagtttggagtccagattgacaaattgatgaaaaatctgtggggcgatcgcttcttcaacatgaagaccaagaaatggaccaacaaccaagagcccgagaccaagcgaggtttctgccaatttgtgttggacccgatcttcaaagtgttcgacgctgtgatgaacatcaaaaa

SEQ ID NO: 47854 - DNA, 666 bp, Heterodera glycines
  SCN-specific regions: Sequence locations=1-121,143-544,566-666
acctttaatttgtctttctatgcctcttcattggacttctgtggacactcgcaacgcacttttgtgcgccgccgttccttccattggcgccttcgtgggctcgacgatggccatcaaagatcaggaattggttcaatttctcaagaatcaaaactttccttctttcgcccgttgttgcaaatacaattatttgctggccaacacttccgtcaccattccgttcggttacgcttcttatttggtctacaaaattggaggaggtgtcagttgcaccgactcaaaaatcgcattgggactgtacggtgcgacgctgctcagcggctgttttttggtgccaacgctcaaaaaacatgataccaaggcgctgactgccaacgctgttgtccttgccggaccttccgtcgccacttctgtggctttctacaacatcgacaagatttccgcttattggaccatgcccttcactcttttggccattttatacgctggacttacggtgaaggcgaattgctggaactcaaagcttacaacctatgaggcgagttctggtggaaaaaatgagaataagaaagcggactcctgctctgattagatacgatgatgatcaatatctctttttgatcgtttatttttgttaaatcatcgcttgtttgattgggaataaat

SEQ ID NO: 47855 - DNA, 627 bp, Heterodera glycines
  SCN-specific regions: Sequence locations=1-437,460-627
ccacggaaatgatccattgcgttgtttgggccagagtttgttcaataactttttggcgagagtgaccctgatgacgatgtttctcctgagacggtcacttccgatggaatgggcgaccaaaaaaactcacaaacaatggataatgatgggacgaccaccaatggaagtgttatttttgctgacaatgggaatagtagtgctaatgatgcgattacaaaaaatggaaaaatgagcacacggcaatttgcggaagcgacggattacggaccaaaacaaatttttgagaagttgttctttgatgacattaattatttgctttcgatggccgatctttggaaggagcggaagaaaccaacgccaattcactttatgcaagttattgacgaaggacttggtgggagtcggccgaatgaggacgagaacgagcattggggcgtatcgaaatgggctgaactgtttgaggactctctctttgcgcttgcggaaagataccgaggagctgtcaaggaaaagcgaatgctcatctgggacaaggacgacgagccggcaatgcaatttgttgcggcctgtgccaatctacgggcttacatttttggaatcggcacaaaaccattgtttgacctgaaa

SEQ ID NO: 47856 - DNA, 700 bp, Heterodera glycines
  SCN-specific regions: Sequence locations=1-700
taatgaggacgcgccggtctgcgaccctggcttggtcacatctggcacgttttggtctcgacatcaaaaaattccgcaagaccgaaaaaacgactttggaaatagaacttgatgcgaatttaaagcacgaattctcggcaattcaagaagaaggattggagttggtcaatgtgagtgggcctggctacactgggctgataacctcggctcttcttgttacatcaattcggctctccaagttctgcttattgtccctgactttgtccgtgcgtttactgaagaactgttgctaagaaaacaaccacccgaaataaatgaggatttcgccgctcaattggctaaaatcttcgtcgcgatgaaatcgggggattattcgcgagaagacaacaaacatggtgccgaaaaggagaagggcattcgaccgacgacattccgtcggattgtgggccgaaaccaccccgaattttcaactgcaaaacagcaagatgtggaggaatatgttcgctttctgtttgagaaggtcgacgcgtgctccgacctctcctcggaaaatcccgtcgctgcgttccgatttcgtctggtcactcgtttcctggacgaactttcagattgcgttcgctattctttccgtactgacaacattttatcggttgcaattccaatggacttgtgcaaggagtctgacactgttgtgaatggg

SEQ ID NO: 47857 - DNA, 482 bp, Heterodera glycines
  SCN-specific regions: Sequence locations=1-457
aaggcaacggcgccttccagaagggcatgccgtttataggcgtaccacggcaagaccgggcgcgtgttcaatgtgaccaaacatgcgctgggcgtcgtcgtaacaagcgtgtcttctatcgcatcatcccgaaacgcatcaatgtccgtgttgagcatgtaatccttccggctcccggctcttttttctgcagcgatgcaaagcgaatgacttgcagaagaagcagcacaaggagggcaacgcaccgtttgtggcgctgaagcggaagccgaaggagccccggggggcgcacttggtcaaagtgaagagcaccaaagttgagcggctggctcccgtcaaattcgaaattgtcgcttgaggcattatgggggcaaacgaatgcacgagcacagaaaaccaaccaacaattgttatttttaatttgttgatccgtttcgtgttaaagaaaaagttttggaaaaaaaaaaaaaaaaaaaaaaaaa

SEQ ID NO: 47858 - DNA, 752 bp, Heterodera glycines
  SCN-specific regions: Sequence locations=1-450,472-502,525-590,628-752
ggagcttgagcgaggaggaacggtcaagactgctcactgaaattgcaatgcaagaatcgcgcgtttccgaaatgcgattcgaagttaagaacaaaacggatgagatgaacaaactgaaggcggaggttgaaagtgggaagacaactgcacacatttacaacccgggcaatggtcatttgccgaccgaattcaatgacccggacgatctgacaaacgcccacattgaattgagtacattccacgagggagacgtcaacaatgtgatgccacagcgtgaattggatcggaccaacttcactgatcaggacatgtcgttgaagaacaaactcgagttgcttacaaaggagttggacaatgcgcgagacgagcgggcgatcactgactttgatgtgctgcacatggaaaacaagaaacaaggccgtgacagatataagactttgcgtcaaattcgcagcggcaacacaaagcggagaattgaccaatacgaaaatatgtaatgctcaaaacatttggagtttgctggatggacacaattaaaaacaaaaaagacttccatatcatttgtttaacattaagacggagaatggacgaaaatatttaaattcaaatttatttttaaaattatttccaatgggaggaaaccgatttttgtttgcccatttttgcctaatttcttctcatttttgtccaaattcttcagaccagttatatcatccatccatcgtcaatttcatttaatgactattatttat

SEQ ID NO: 47859 - DNA, 723 bp, Heterodera glycines
  SCN-specific regions: Sequence locations=1-86,108-699,722-723
atcgcgttggccgcagtgcgcaatgatgccgagctgaaattgttggccgagtacgcggttgactacgcgcattcaattggcctcgttggacgcagtggggatgacaagtacaaacactccaacgatgtgtcagtggcgcctccaatcgccctgttgccgtcgccgttcccccgcgagttgtacgagcaggccactgacgcgcaacagtcgctgaacgaactgtacttccgcatcgcatgcgaccacgacttcctgatggaggcgtacaaggacgtgatcaagggcgacccgttccatgccaaactgattgagttggccaaagtcatccaaaaggagggcatccgacagccgctgatggttggactgcaacgagctgattatttatcccactggaatgaagcagcgcaaaaaatggagcttaaacaagtcgaagtgaacccgggccaaattggcggccccggggcggctactgccgtttcaaagtgccaccgtaaaatgctggacaaggtggagattatgcacggcaaaaaattgccaattatggcgaaggcagttgtgccagaaaatcgcccggggccaggaattgcgcggaccctttaccaagcctggaaaatgttcggcgacccaaacgcaatcattttgtatgtcaatcaacccgacctgttcccggtgtgccactttgagcagctccaatttgtgatgttccaagtggaaaagctggct

SEQ ID NO: 47860 - DNA, 658 bp, Heterodera glycines
  misc_feature (608)..(608): n is a, c, g, or t
  SCN-specific regions: Sequence locations=1-7,33-65,90-195,218-245,267- 369,391-508,544-658
atattcccacaaataaacaaaaacataaaaatgaatggccttcgtccgtccaaaacatttctgattttattgtcaatttcaatttgctggcaactgagtgttgtgagttcaagcccaacaacccatgacattgcccaatcagctgaagttcaaagcgagtctgaagaacaacttccactactttcaccagcaacgccaagtgaacaacaacaacaaagtgccgacactctggccaccacatattgcgtggaaaatgttgagaaggacgaagtgcttttgaagcaatacgttcgggacgcaaaagactgggcattggcccacggattggttttgccagcacttccatttcgatgcaaaaacgaagaatgcaaagaagccaacaaagcattgaacattgtccctgcggacgttgtgaaaattgcgccatttactcttttcccgtcgcccttcccacgcgaactttttgtccaagcgcagaaagtgcacaaagccatccaattaatgtattttcgcgccgcgtcgaactttgaatttttgaaaggtgtgcacaagggactgctgaaaacagaccaaaatttcatagaaacttttaaaagcattgaaagcangacacttggaaggcattaagcaaccgctgactttgttctgcacagagcag

SEQ ID NO: 47861 - DNA, 676 bp, Heterodera glycines
  SCN-specific regions: Sequence locations=1-243,265-676
cctccgctcgtttccatggccttctccccgcgatcaattggacactattctgaccgttctcgatgatgcaactgctgacaatcgattggcacttcacactttgttggcaaagtccaatttggcagattccaactgtgtatcccaatgtcttaaaaaattgctgcattctctgcgtcgttttcccatggacaaattttctatttttggttgtctcagtggtatcgggcagaaccattcttcattagttcagcctttggtgaatgattggttggatgttcatcccatttttgacacccctgaacaaagtatcgacgatgacttttatttggcccgactcatcctcgtccttaacgctgcatcccatcggtcagtgctctgttcgcttattccctcttatgcactgaaacattaccgttatttgcgtcgttcttggcctgagattgttcccaaaattctcgaatttgatcatgaaaagttacaccaatgcgattcctcaccgtttttatgcccttttttggctgttgggccggaggataaaacaattgagaaggaaaatgatgctaaaactgctagagtactcgagcctagcagagaatttagaaacaatgaaaccattcgattcgttgctggtttaccaacggggatatttatccgaattttgctttgcaatgtaacg

SEQ ID NO: 47862 - DNA, 714 bp, Heterodera glycines
  misc_feature (185)..(185): n is a, c, g, or t
  SCN-specific regions: Sequence locations=1-412,434-469,492-605,627-714
tggaatttctgcgcacagtcgacggacgtcgtgttggacacgatttggtgccgagccaattgtgcgagttcgaggcgtacaattgcttactaaaacagaaactgctgcctgccctgaaccatttattttgggtcgacaaatgcaattacggcacaattgtgcaccctctctatgcccaacaggtncaccttcccatacaacatttattacatggaaaggagacggagacgaatggacacaacagtcagagcgatcaggaagaaccaacaacagctaacttcggatgcaattcaggcactgaatttactttcggcaaagttgtcagacaacaaatatttctgtggcgacaagccatgctctatcgatgcgctcgtcttcggctgtttggctccgctgctgcgcacccctttgcccaatgatcggcttcagcttcacctttcggccaccccaaacctcgtccgattcgtcgattccattttgagtatttatttgccactgcccgaaaaagtgatcaaggaacaggcgatggcgagaaaaaagtggcaaaaactgaaaatggacgcccaacagacaatggaagagggccgaattgagagggaactgcgcaaggcggagaagaaggagcgcaactccatgcaccacattctgttcttcgccatcagttcaattaccatctcacttctgttcgcccttcacacgggcattatcgtagtg

SEQ ID NO: 47863 - DNA, 678 bp, Heterodera glycines
  SCN-specific regions: Sequence locations=1-612,634-678
cgcgttctgttttacttacgcagcaaaattctctgctgttgcatcatcgcccaataaaaatttgaatgctgtgcttatcgatgctgtacgtactccctttctccatcgaatcaactttccgtgagctgttggctgttgatcttcaaagacacgctcttaaagcattggttgagcgaacaaaaataccttttgatgaaattggacacattatctgtggacaagtcgttcaggaatgcaaaacgagcaatatcgcccgtgaggctgcgatcaccgccggtttccctgattcgatcccttgcaatacggtcactctcgcgtgtatttcttccggcgtttcaattcaaaatattagcctaatgatttccactggctatttaaaggcgggcatcgctggaggagtcgagttactctctgactttccaattcgttacaacagaaaggttcgactttctctcatcgatttgcagaaggccaaaagttttggagagagatttaagcacctgaaaacagtcgcctccaattggttctctcctgagttgccggccgtaagcgaattcacaaccggcgaagtgatgggcaattacggggaccgattggctgccgctttttgtgtgtccagacgagagcatgatgagttcgcaattcgatcccatactttagccgacaaagcttttagag

SEQ ID NO: 47864 - DNA, 688 bp, Heterodera glycines
  SCN-specific regions: Sequence locations=1-688
ttgcttatctaatggaagtgagagacgcgtaccattttaaaaatgccagtgccattgtttacgaatatttcccaaaagggacacttttggatcttaccaatgtctacaaaaagaacggaacggtggtgggcggtcttcttgccacttttttcggcattcatttggcacgtgcgctgcgccaagtccacgagacggccaacataattcacgcggatgtcaagccggacaacgtcatgctgttgacggctgccttgaatgcacatgattcgctggacaatttgctcaaaacccccgtgctgaagctaatcgactgggggcgatccatcgacatgaaccatttccaaggagtcgaatttcacggaaaagcgggcaccgaaaatttcgattgtgtcgaaatgaagacgggcatgccatggactttccagactgatttctacggtttctgtgccacaatgtacgtgatgatgaatggcgaatatctggtgaccttcaaatactcacaaacggacaaagttgttcccgtgaagcagctgaagaggcgcatggctctgtacgacgtgtggacgcagttgttcgaccagttcctgaacattcccaactgcaaacagctgccaaaatggttaaatacattggaccaaatggaaagccgactggccgaggctgtgaaaacggagcctttggagtggaa

SEQ ID NO: 47865 - DNA, 445 bp, Heterodera glycines
  misc_feature (422)..(422): n is a, c, g, or t
  SCN-specific regions: Sequence locations=1-186,209-419
ggacagcaaaagattggaaatggcacggaaagggctgaacgttcacatggttttcctcccccaatttcgccccaatgtttggcattatcgccggcctttccgttgttcttatcattgccattgttttcattgtcgtcggattgctcagcatggaacccgcgaaggattcgattatctatcggatgacaacaactcgcctaaagaaggactgattgtgagcaaagtgtgggagagagtgccgtgccgaaaaggaaaagtccgtcccccattaaatgatttgtttcatttgatagtgaatggtcacccaccctttgtcggtgttgcaatccgcaacgaatcatcaaaacatttaattttatagaatgtctatttcttcccattcattgtaatcatgtagagaataaattttttattttcagaanaaaaaaaaaaaaaaaaaaaaaaa

SEQ ID NO: 47866 - DNA, 649 bp, Heterodera glycines
  SCN-specific regions: Sequence locations=1-189,211-534,556-649
gaagataacgatacggaaagtatttgcggtgaaattgtggctcaagaaagtggcgaaaacactgcaaatcaacagaatcagactcaacagaatacaaccttcgaggaattgggggtcaatgatgaactttgcaatgcatgtgagagcctcggatggactaagccaatgcctattcagcaaaaagtgatccctttggctctaaaaggccgcgacataattggattagcagaaacaggttcggggaagactggtgcgttcgctctgccaattcttcaagctttgatggattctccgcagcatctttttgcacttatattggctccaaccagagaactcgcttttcaaattagtgaacaatttgaagcccttggggccacaattggacttaatgtttgtataattgttggcggcatcgatatgacatcacagacactttctttggcaaaacgtcctcacattatcgttgcaactcccggccgtctcgtcgatcatttggaaaataccaaagggttcgacctgcgcactgtcaaatttcttgtattggatgaagctgatcgaatcttaaacatggattttgaagtggaacttgacaaaattttgaaagtattgccaaaggctcgtaaaacttatcttttctcggcgacaatga

SEQ ID NO: 47867 - DNA, 660 bp, Heterodera glycines
  misc_feature (18)..(18): n is a, c, g, or t
  SCN-specific regions: Sequence locations=1-556,578-660
gacctgcagttttagcangaatggggcattttaactggcttcgaaagtatgcactttgccacggctttcttccgctcgctctatgacttggtggtggggcccggagaaaaacaatgggcgcgaagttgttggccccactttccacggggatgaattttaccaagatcgtcttgaccgttggtacccgtccattcgatttcgcaaaaatgacgaagtgatcacgcccattcgccacaaggaattgggagattggaagaagttgagcattgaggagaagaagcttatctaccgctactccttccgtcaaactttggccgagtttgaggcattgacgccttatggctatctcacagtcactttgttcttttctatgcttgggcttactattctgtacgcttcgtttgttaggacttacgtgacaaaattcaatgaccgattgcctgacactttcgatgatgaatataaagaaagtcaggccgagcgccgtgtggtactggaaaggggcaatccttatggaccggcctactactacgattacgagaaaaatcgttggaaggactgaagtggacggaaaagtcctactcgaaattcgttggagtgttttttaattttagggggatttttaatggacatttcaaatttgcacattttttcgtaaat

SEQ ID NO: 47868 - DNA, 714 bp, Heterodera glycines
  SCN-specific regions: Sequence locations=1-323,345-488,516-714
ccaatgactttgactcgtccgcaaaatcccaccgacgaattgagtccttatgggcccgaattggagccgggaaaagcaccggaagtaattgcccgcacagtcgcgtcaatgcctcccgaaaaaatgttcgaattgatgcgatccatgaaggaaacggtgaacaacaatccgcaaatggcgcgccaacttttgatggaaaatccgcagctgtcgtatgcattgctgcaggctcaagttgtgatgcgagtggtggacccgaagattgcctaccaaatgcttcatcgtgaacatgctcagccgcttgtaccgccgacttccatccccactcatatccctcaacaatttgctggcaaaccccctcaattgcctccccaattcaacatacctccgccctccgtcccctctcatcagtttcaaatgcaacctcctcccttggtgccaggccaatttcaccacggatttccatccatgggcatggctccgccttcgctactgcaacagcagcagcaacagacgccttttacacaacaaaagccgacacccatcgctcctttggcagtgcctccggcagcgaccgctccgcaacagcagcaggctgttactccacctccgcttagccaacaagcacagcaaagcaacagcgacaatttggacgatgagcagcatgcgcaaatgcttatccgcgtgctgcaactcaccgatgagcaaattcgt

SEQ ID NO: 47869 - DNA, 569 bp, Heterodera glycines
  SCN-specific regions: Sequence locations=1-98,122-569
tatttcgttgctctgatcaagttaactgtcttctactgctgtacaacaaaatgccccgtcatcgtgcaaagcctcgttcttttcatgccggattgaaattccccgtcggtcgtgtccatcgcaagatgaagaagggtccgtatgccaaacgtctcgcgaacggagtgccggtctacatgactgctgtgctggaacacatcacgggcgagctgctcaagaaaattggcgagatcacgcaggccgaaggcatgaagcgtctcagtgcatttcacatccgaactgcagcgcgcgatgacgacgagttgaggaagctgttctctggcgtctctcttgccgaggtgtgcgtgctgccggagctcgaatcggatgtggagcaatcatcggaaggaagtggcgagtccgactccgatgaagaaagtacggaagggagcgcgagcggaagtcaggagggtggcggtgctgctgctgcgcagcaatgagaggaggattgaattctcgagaccgccgtgataacattgactgccaatttaaaagaggatagattgtgtctctgtctgtgatatatacat

SEQ ID NO: 47870 - DNA, 612 bp, Heterodera glycines
  SCN-specific regions: Sequence locations=1-572,597-612
cccaaaaactgataaaaaaaaatggcgttcctctcccgtctctccatccttccaaattcgccaatttcgctgcttgcagtttctttggccgttttggctttcgtcgctttggcatcggccaatccgccgacggcacgcgaaacggcgccaaatgcacagcaaaacaatgccaattcagtggcaactggggaaattgcgaaaaatattgcggaaaagatggagcggatgaatgagttcattaaggcgaagaagttcatcgatgcacataatttggcatttgagaagggcgaagtgtcgttcaaagttgcgccaaaccatctgatgcattttacacctgcccaatataatcgaattcgcggcttgcaaatgcgcagcaaccgacaacggcacaacatggcaactctggcgggaaacagcagtactttgccggaaaagttggactggcgcgagaaaggggcggtgaccggggtcaaagatcagggggactgcggctcgtgttgggcattcagtgccaccggtgccattgagggagcattggcacagaaaaaagcgtcgaaaattatttcattgtccgaacaaaacctggtcgactgttcgtccaagtacggtaac

SEQ ID NO: 47871 - DNA, 592 bp, Heterodera glycines
  SCN-specific regions: Sequence locations=1-169,210-262,287-298,342 -432,454-468,495-592
tctaaatttcttcgctttttaatttttgctctccaaacaacaaaaatgtccggacgaggaaagggcggcaaagcgaaaacgggcggcaagcagaagacgcgttcatcacgggctggacttcaattccccgtcggacgtctccaccggctgttgcgcaaaggtcactacgcggaacgcgtgggcgccggcgcgcctgtctatctggcagcggtgttggagtacctggcggcggaagtgctcgagttggccggcaacgcatcgcgggacaacaagaagacgcggatcaacccacgccacttgcagttggctgtgcgcaacgacgaggagttgaacaagcttctctcgggcgtcaccatctcgcagggcggtgtgttgccgaacattcaggcggtccttctgcccaagaagacgcagcacgacgaaagtcagtgagcggaggcgaggagagaaagcatcaaacaaaactatcccaaacggccctctttagggccacaatcattcaaatggacggattgacatgctttttaatttttttgttttggattttcaatgatgtgtataaaaaacgatgcgaaaaaaaaaaaaaaaaaaa

SEQ ID NO: 47872 - DNA, 595 bp, Heterodera glycines
  SCN-specific regions: Sequence locations=1-595
gtggttggaggtgttcacacggactggtacactcgcttggacaagcagcgaaagaaatgggcatgtcggtgaacaagcgcaaggagggcatggcattgcacgccatttacatcagcacattgcacgactatgacgagggatttttcggcgacgaccgcgtgttggccgccgccgtgtggcgctcatttttccttcagcagccggacgtgagcccggcacaaatcaaccgggtggtccgttacatgagggcaacgatgacctcgctggcacggatggacgacactcgcctgttgaccgacggcattgagcgctgggatgtggcggaagagttggcacgcctggtgagcgcggaacagtttggcaccattccggcagcgccgccttcgtcctcgatggatgatgatggccgcaactcggcacaaccggcgccaaaagtggcggcatcaaattaactcattacttgtaataagcagacccatttaaaaaaacattgtttattatttgttttgtttgttgttagtgttattattattctctgtctcttctcttttgtttttgtgaatttcaattgtgccgattaaacttgtaaattttg

SEQ ID NO: 47873 - DNA, 540 bp, Heterodera glycines
  SCN-specific regions: Sequence locations=1-298,334-336,358-500
cataacttagaagctccaatcgccaaccatagaaaatgtgcaaccaaaaatttgctgatctcatggtggacaatgggctccgattgttcaaggaccagtttctccggcgatgactgcgccccgctcggtttttacttccattgcgggcctgccccgtcatcaaagcttgatggtcagcatgggacaaatgactattcgtaggagactatgtgtactgcaatcaccgtatcctgacaacccaactacccattgtgatcacgggatgggctccaactgggacgacctgtacaatatcttgaaccacaccttctacaacgagctgcgtgtcgcccccaatgagcaccctgtgctggtcacaaatgtcccgctcaactccttatgccaacattataaaagatgaccctgatgatgttccaaacgttcaatacatcgtctatttacgtggtcttacatacacaagcttttcctttactccttcggccgtaccatcaatctcgtgatggactccggcgatggtgtcacccacaccgtgcccatcta

SEQ ID NO: 47874 - DNA, 643 bp, Heterodera glycines
  SCN-specific regions: Sequence locations=1-472,640-643
tcaagcttgcccggtacgcattggcctgagggcgtttggcgaaacatgcgaaagtcggctgctgagttgtcaatgcttggcatgttcctccttacgggcataatgcttttctccaccgccatttacttcttcgaacgcgacgaacccaactcaaaattttactctatcccttctgcttggtggtggtgtgttgctacaatgactactgtcggttacggcgatttggtgccggtgactacgggcgggaaggtcgtcgctgccattgcctcagtgtgtggcatcatcgttttggcctttcccatttcaatgatcatcgacaaatttgccgagtccacaggccatggccaacgcgtttttgacgaaacggtggcacagggcgaagttccgttggaggccaacaaaagcaatgttttgttggggtcgccgacggggcgaggaatgagcaggaggaggaaaagcgaaacggaaagccaaaggaaagcgaaaggaaaagccaaaggaaagcgaaacgaaaagccaaaggaaagcgaacgaaaagccaaaggaaagcgaaacgaaaagccaaaggaaaagccaaaggaaaatccaaaggaaagcgaaacgaaaagccaaaggaaagcgaaaggaaaaaaaaaaaaaaaaa

SEQ ID NO: 47875 - DNA, 649 bp, Heterodera glycines
  SCN-specific regions: Sequence locations=1-439,462-649
accacggaaatgatccattgcgttgtttgggccaagagtttgttaatcaactttttggcgagagtgaccctgatgacgatgtttctcctgagacggtcacttccgatggaatgggcgaccaaaaaaactcacaaacaatggataatgatgggacgaccaccaatggaagtgttatttttgctgacaatgggaatagtagtgctaatgatgcgattacaaaaaatggaaaaatgagcacacggcaatttgcggaagcgacggattacggaccaaaacaaatttttgagaagttgttctttgatgacattaattatttgctttcgatggccgatctttggaaggagcggaagaaaccaacgccaattcactttatgcaagttattgacgaatgacttggtgggagtcggccgaatgaggacgagaacgagcattggggcgtatcgaaatgggctgaactgtttgaggactctctttttgcgcttgcggaaagataccgaggagctgtcaaggaaaagcgaatgctcatctgggacaatgacgacgagcatgcaatgcaatttgttgcggcctgtgccaatctacgggcttacatttttggaatcggcacataaccattgtttgacctgaaagctatggctggcaacattat

SEQ ID NO: 47876 - DNA, 739 bp, Heterodera glycines
  SCN-specific regions: Sequence locations=1-212,234-477,520-739
tttctcggacctggctcggtcggagttatcggattccagcagccgacttaacggttaaacaattgactcaaacactgaaggaaatgcatgccaaaaaaatgtacggcgaattgacattttatctcgaagcatgcgaatcgggctcaatgtttgaccacacattggcgcagagtttgaaaatttacgcagtcaccgcggccaatggcgacgaatcgagctggggctgtttttgcgacaccaaatttttgcccggaaattgtttgggcgatcttttttcagtgaattggatgcaagactcggaccaggaaaatttacgcaccgaaactctgcggaaacaatttggcattgtgcgcgaagaaacgaacaaaagccacgtgatgcactacggcgacttgcaaattcaggacgaacacgtttctgagtttatgggcaaagagcaggcgcaaaagcgcaacgaacgcccaccatcaccgcacaaatttccaatgtttccttctcgagacattcccatgttcatgatggcacgccgtcagaatgagtctaagcagattcagcacaatctccgcgtggcgtggaaaaaaagaagctttctcgagcaaacgattaaacaaattgtgcaccaacttgtgcacgacatgaacaaccggcgacagattttgacgacttatccgcaacaaattcgcgacttggactgtcaccatgatgtggtgcacacgttcagcaatttctgcttcaaatt

SEQ ID NO: 47877 - DNA, 471 bp, Heterodera glycines
  SCN-specific regions: Sequence locations=1-42,187-318,340-471
tgaagagatgtgagcaaatcgccgccgaatgcggctaaggctgagaagagacagcgaaaggaagcggaggaggtgagtaagacggaggaggacgaagccagagaggaggaagaggatgaggagggccagcagcaggagaagccggaagccaacaccaaggatgaagaaaagcggaggaaaaagaaggtcaaacttctgttccacgacattcaaacgcttgacgtcagtacgagcgatgtgtacgtttgggtgttcgacccgactccgttgtggaagaaatgtgttggcattctgatcgtcctcggcaccatcggaggctgtctgttcccgctgtggcctgattggctacggcttggcatttattacctttctgtgattgggattgccctctttggacttttgctcggtgtcgcatttgctcggacaattctttttggcctcgtttggttgttcactctgggccgtcatcgc

SEQ ID NO: 47878 - DNA, 561 bp, Heterodera glycines
  misc_feature (492)..(492): n is a, c, g, or t
  SCN-specific regions: Sequence locations=1-561
gaagggttggcacgtgtgacattgcgccggatggacaccgtccgctcgcggctggcagccgccggttcactcgtccaattccgtaagcatttgcgccaggcgctgcgccagcgcttggaccgtctgtacagtgacaaaatggcacgcgcagacgtggcatttgacaccgatgccgcggcaagggaaggcattgacgaagtgttgcgcaattacatggacgctcaatattatggtgacatttctattggctctccaccgcaaaacttcaccgtgattttcgacaccggttcctcaaatctttgggtgccgtccaaaaaatgctcatttttcgacctcgcatgccgctaccatagtaaatatgaccacaaaaaatcgtccacctatcagccggacggacgcgaagtggcaattgaatacggtaccggatcaatgaaaggcttcgtctccaaggacacggtttgcattatggacggtatgtgtgtggaaggtcangagttcgcggaggcgacaagtgaaccaggcgacacttttgtaaacacaaaagctgacggcattctcggc

SEQ ID NO: 47879 - DNA, 460 bp, Heterodera glycines
  SCN-specific regions: Sequence locations=1-102,134-198,224-363,387 -417,444-460
attgaaactttggccttttagatctacacaaggcaaacaagccccatgttcaagtgaaagtcggtaacgaggataagcaatttgcggcggaggaggtttctgctatggttctgacgaagatgaaggaaattgcggagtcttacctcggtcacgaagtgaaaaatgccgtcgttactgtgccggcttactttaacgatgctcagcgacaagcaacaaaagatgcggggaccatcgctggactgaacgtggtgaggattatcaacgaacctaccgctgccgcaatcgcttatggtctggacaaaaaaagaaggcgagcgtaacattctcgtgtttgaccttggcggtgggacattcgatgtctctcttctgacaattgacaacggagtgttcgaagtgttggccaccaacggagacacacatttgggaggagaagacttcgaccagaggacaatcgaatact

SEQ ID NO: 47880 - DNA, 385 bp, Heterodera glycines
  SCN-specific regions: Sequence locations=1-106,130-155,184-253,281 -347,370-385
ccggagtgtttacacccttgagaacgcatctgctcatcttaaaggcggcgccaagaaggtggtcatctccgctccgtctgcggatgcgccgatgtacgtgatgggcgtcaacgaggacaagtacgacccggctaaggacgacgtgatcagcaatgcgtcgtgcaccaccaactgcttagctccgttggccaaagtgatcaacgacgagtttggcatcatcgaaggactgatgaccactgtgcatgcggtgaccgccactcagaagacggtggacgggcccagcggcaaacaatggcgagacggacgtggcgcggcgcataacatcatcccggccagcaccggggcatccaaggcggtgggcaaagtcatcccggatctgaacggc

SEQ ID NO: 47881 - DNA, 327 bp, Heterodera glycines
  SCN-specific regions: Sequence locations=1-154,180-194,218-254,281 -282,308-327
tattttcttccctttcctttgtcttccattattccgcttttccctccccatttctcaattgttcttctccgcttcttctctccccgatgaatcactttgggctgacttttctgttcgtcgccgtttctctgctggtaattgcgcccggctgcgatggcatgcaaattttcgtgaagacattgacgggcaaaacgatcactttggaggtggagagctcggacactgtggacaatgtgaaggagaagatccaagagaaggagggcattccgccggatcagcaacggctgatcttcgccggcaaacagctcgaggacggacgaacgttgg

SEQ ID NO: 47882 - DNA, 524 bp, Heterodera glycines
  SCN-specific regions: Sequence locations=1-524
cagctgaaacttcgcgctagtgctatgactgttcagtgtcagacgatcttgcgcagttacggagagccggtgatggacaagcatcgcacccttcttcagatcatcacgtattttgccagtgcgtacaactccaccattgagggcacatcgcgtaacattgaaaccaccgaactttgtggcggtgctcgaatcggttacattttccacgaaaccttcaaaagagctcttgagaagctgaatcccatcgagaatttgagcacttatgacattttgacagcgatcaaaaatgcgacgggtacgagacccgcgctttttgtcccggaagtgagttttgagttattggtgaagcgtcaaattcagcggttggaagagccgagtttggaatgtgtcaatttggtctatgaagagatgttgaggatcgtgcagcactgtggtttcgaaattcagcaagaaatgcaaaggtttccccgattgtatgagaaaataagcgaagtcatctcccttttgttgagcaatcgtttgtc

SEQ ID NO: 47883 - DNA, 633 bp, Heterodera glycines
  SCN-specific regions: Sequence locations=1-393,416-610
tgtggaaaatttcccacctaaaaacatcgacgacattcgtggagaactgacaagaaccttaaattggcttaacactcctttcgccgagcaccaaaaacgattgaatatggacgaatttcgcgtgcgaatgtctgacttcgaatgggcccttcgcgtggtcaaaccatcggcgaaacgagagggattcgcgacggtgccggacgtgcgatgggaggacattggggcattgaacgcagtcagagaagagttgaaatgtaccccatacaaaagcccgaactgttccaacactttggcacttccgcacagccgcaaggcattttgctgagcggaccgcccggttgtgggaagactttgttggcaaaagcggtggccaatgagacgggcatgagttttatcagtgtgaaagggcccgaactgctgagcatgtacgttggcgaaagtgaaagggccgtcaggacagtgttccaaagggcgcgtgattcggcgccgtgcgttgttttcttcgatgaaatcgacgcgctgtgcccaaaacggtcgcaaagagagaacagtggtagttcacggctggtcaatcaattgctcaccgaaatggacggattggatggacggagaaatgtttttctgatcggagcc

SEQ ID NO: 47884 - DNA, 482 bp, Heterodera glycines
  misc_feature (481)..(481): n is a, c, g, or t
  SCN-specific regions: Sequence locations=1-23,49-482
cactttcttccgttccttagcaacctttctccctttcctttaatcctaattcactttctttctcccattttcacaatctgatgctcctctccactagacacatttatcctgcattcagtcgattaatctttctttcttcatattgcaaaaccatcggaacatcgccaatttgcattttcaataaaaatctgtcgtcgacaatgagtgcttatcaaacaattgaaaagggttctcttcatacccttaactatcgcgtattttttaaaaattcggatggaaaattgatttctccttggcatgacattcctctctatgcgtccgagtcaaacaaattgttcaacatggttgtcgagattccgcggtggactaacgctaaaatggagattgccactaaggaagtgatgtctccaattcgtcaagacgagaaaaagggtcttccccgcttcgtcaacaatattttcccgcaccgcggatacatttng

SEQ ID NO: 47885 - DNA, 594 bp, Heterodera glycines
  SCN-specific regions: Sequence locations=1-594
cataaattaaaaaagatgcgagatctgttcatcgaagacaacagcccgatcactccggcccggcttgccgaactgatcagacatttctacgcgttgggatggatgcgcgataacggcggaggaatggcggtcctttgcaacggcgccgtgttcggttcgcccacttcggtgcagaaggagaaagtgtccgaaaatgatctgtttgtaattgatgctacgaccggcacagtactgaaacggccgcaaaacgcggcgagtgttccgagtgccacctgcggactgttaatgaacacaggtctgaactgcgtaattcacacccactccaaatacgcaaatcttgtctctcagttggtcacgggcaacgaattcgccatccaaaaccaggagatgattcagggggtcgagaatcgtagcagcggactccgtctcgacaacgtcgaccgcctcgttgtgcctatcgttgattctgagttaaacgaacaaatgctcagtcctgttttgctccgaactttggacaaatacacagaagcatcggccattttggtgcgtggccaccgcttttttgtgttcggctctcactgctggcagtctacc

SEQ ID NO: 47886 - DNA, 686 bp, Heterodera glycines
  SCN-specific regions: Sequence locations=1-155,185-190,212-221,245-686
caagaaggttttgtctgttccaaagccaaaaaatcaaaaaagcattcgttgacaaaatgggcatttccgacaacgatgtccaaaagcagcttcgccatatgatggcatttattgagcaggaagctaacgaaaaagcagaagaaatcgacgcaaaagcggaggaggagtttaacattgagaaggggaaattggtgcaacagcaaaggcagaaaatcatggaatattacgagaagaaagagaagcaagtggagctgcagcgcaagattcagaggtcgaatatgcaaaatcagagtcggttgaaatgtttgaaggcgcgggacgaccatttgaaaaatgtgttggaggaggcacgcgccaatctcagcaaaatttcggcggacagagagcgctatccggccattctcaaaggacttttgcttcagggccttttccaattgctcgaaagcaaagttgtgttgcgatgccgcaagaaagacgaggaaatggtggcgaggattttgcccgaatgtttggaggaattccagcggacgtggggcaatcgaagcgaagtgaaaattgacaatgagtactttttgtccccggaaagtgcgggcggcgtcgaattgttggccaaagacggcaaaatccgcgtctcgtccactttggaagcgcgtctcgacctcattgccgacaaaatcactccccaa

SEQ ID NO: 47887 - DNA, 422 bp, Heterodera glycines
  misc_feature (182)..(182): n is a, c, g, or t
  SCN-specific regions: Sequence locations=1-422
tcttctaaaaatggtcctgctttttctccattggcactgatttttctctgttcgctgtttgcttttattgtaatgatgcgcaaacatcgcaagtactggtccaaccgtggcatttcgtcctcatccccgcagctgatcagtggcaatttcggctcgctgaacggcaatcacctgagcatgtnccagctgatggattggaccagacagtacggcaagcagtacggtgtccagtacggttggcgcaacgcgttggtgactcctgacccggcaatggtccacgagttgcttgtcaccaaatttgaatattcccacgcaagaaatctttcgcccatctttggcaattgggacacaaacaaatggatcagcatgttcttggccacgggaggccggcggaaaaggctccgaacgattgcgaacccggc

SEQ ID NO: 47888 - DNA, 545 bp, Heterodera glycines
  SCN-specific regions: Sequence locations=1-61,95-175,197-281,313 -463,485-545
gaatcgccatgaccggggaaccgaaaacgccttcctacgtggctttacaccagactcgggcgagcgcctgatcggagatgctgcaaaaaaccagttgactctaaacccggaaaacaccattttcgatgccaaacgactcattggacgggaattcaccgacaaaaccgtccaggacgatatgaaactttggccttttaagatctacaacaaggcaaacaagccccatgttcaagtgaaagtcggtaacgaggataagcaatttgcggcggaggaggtttctgctatggttctgacgaagatgaaggaaattgcggagtcttacctcggtcacgaagtgaaaaatgccgtcgttactgtgccggcttactttaacgatgctcagcgacaaacaacaaaagatgcggggaccatcgctggactgaacgtggtgaggattatcaacgaacctaccgctgccgcaatcgcttatggtctggacaaaaaagaaggcgagcgtaacattctcgtgtttgaccttggcggtgggacattcgatgtctctctca

SEQ ID NO: 47889 - DNA, 693 bp, Heterodera glycines
  misc_feature (60)..(60): n is a, c, g, or t
  misc_feature (84)..(84): n is a, c, g, or t
  misc_feature (90)..(90): n is a, c, g, or t
  SCN-specific regions: Sequence locations=1-281,304-475,497-693
gtgtatggatgacaaagaaaccagacccaaaacaaagggggcgaatgaatccaagcgtgnaaatttggaccgggagtatggtgnctgcancttcctcaaaaaggagtgcataacggcagccattccttatttggaacacgttatttacgaatggagtgatgagagtccccactttcacggggaattgttggagcaatacgtgctcaggtgcaatacgttgctcgggcagttcctccattcgctctcctctccgtcgattggtgttccatcttttgtcgccgaagatgatgaattatctatattgagaaggaaattacaatattttttggcgaccgaccagcattattcgattgaaagtgcaagagatctaattggggaagaccaaaatttgatggaggagagagcgatcattatggggaaattaggacagcatttaaacgcattgaaaatttatacggaaattttgatggatttcaatggcgcagaaagacactgccaaacttattacgatgaaagaaatgcatcgactcgcaacattttcttcgaccttttccattattatataaaaggcgaaatgcctcaaaaagaggtaattcaagttgaaagtgattacgaaattcggcgcaaaccaaacatttcggaggcgctgaagttgttcaaaaggcatccgaccaaaatagacacagtgggcgc

SEQ ID NO: 47890 - DNA, 457 bp, Heterodera glycines
  SCN-specific regions: Sequence locations=1-371,393-457
cgccgggtggcaaagatgtttatgaaggcgtaaaaatcgactacagcggaaccgaggttaaccctgaaaatttcgaagcggtccttttgggcgatgagcagcgatcggagggaaagccggtgctgaaaagcactgaaaaggacaaagtgttcgtgtacttctcggaccatggcgcggtcggagttatcggattcccagcagccgacttaacggttaaacaattgactcaaacactgaaggaaatgcatgccaaaaaaatgtacggcgaattgacattttatctcgaagcatgcgaatcgggctcaatgtttgaccacacattggcgcagagtttgaaaatttacgcagtcaccgcggccaatggcgacgaatcgagctggggctgtttttgcgacaccaaatttttgcccggaaattgtttgggcgatcttttttcagtgaattggatgcaagactc

SEQ ID NO: 47891 - DNA, 677 bp, Heterodera glycines
  SCN-specific regions: Sequence locations=1-95,117-677
cacttttttagggtttaattgtgtgattggtttaagtaaatttctcctcgtccgtcatgttttatcacgacttgcacgacaacgaaaatagccatgataaagagttaaaacagttggtacaaatggacgatcttgcaattcccaaatttgtaatgcctccgctcggcattaagccaattttttttgtgcgcaaacattttgggccgaacagtcggcttccaatggcgcagtttctgaagggcactaccacactgtcctttgtgtacaagccgaagacaccgcaagacaaaggcggcgttattgtggcggtcgattcgcgtgcaacgggcggaacttacatcagctccaaaacggtagagaaaatcattccgatcaacgaccaattggtcgcgacgatggcaggcggtgcagcggactgtcagtattggacgcgggtggtgagcaaatattgcaatcttttcgaacttcgcgagggtacgcaaatttcggtggctgcggccagtaaatattttgccaatgttatgtacgactatcgtggccaagagctgggtgttcactcgatggtttgcggggttgacaagttcggcccttccatttacatggtcgaagctgaagggactcgcgtgaagattgacaccatttgttcactcggttcgggcatgttgcacgccatgtcc

SEQ ID NO: 47892 - DNA, 583 bp, Heterodera glycines
  misc_feature (192)..(193): n is a, c, g, or t
  SCN-specific regions: Sequence locations=1-583
acagaaccgcatgcctggtatgggcggaggccatcagcagcaaggaatgcgttaccagggacagccgagaggaatgcaacaacaacagcaggctcaacagccacaaattgcctattcgtcgtatccgcagcagcagagccgtggcggcatagcaccgcagatgggtggcggagcgagtggcggtggagccannacgctggccactgtgatcacttcttcaacacaccaggagccgttgaacacacagctgcttaccgaggctaacataaccgcacaaaagcaaatgcttggtgagcgtctgtacgcgatggttgcgcgttgcttccgggatggtgatgtcgagaaaatcggcaaaatcacgggaatgcttctcgagatggaaaatgccgagattgtgttgttgcttggagacgaggaaatgttgcgtttgcgcgtggacgaagcagcaacagtgctttaccaggccacgggtcagaaggaggcgcagtaggataaatgaagtggatggattggatgaataaattgatgagtaaaaggaaaatcaaaaaaattgatatgttatttggcttctttgtctgagtaa

SEQ ID NO: 47893 - DNA, 404 bp, Heterodera glycines
  SCN-specific regions: Sequence locations=1-404
tatctgacctgcagttttagcagaatgggcattttaactgcttcgaaagttgcactttgcccggctttcttccgctcgctctatgacttggtggtggggcccggagaaaaacaatgggcgcgaagttgttggccccactttccacggggatgaattttaccaagatcgtcttgaccgttggtacccgtccattcgatttcgcaaaaatgacgaagtgatcacgcccattcgccacaaggaattgggagattggaagaagttgagcattgaggagaagaagcttatctaccgctactccttccgtcaaactttggccgagtttgaggcattgacgccttatggctatctcacagtcactttgttcttttctatgcttgggcttactattctgtacgcttcgtttg

SEQ ID NO: 47894 - DNA, 342 bp, Heterodera glycines
  SCN-specific regions: Sequence locations=1-221,243-342
cacattgccctatttgaaagtcaaaagtgctaagaatgtgcgcctttttcttggccatttacaatttctctcttccatgagttcctacagttacatgcgttctgagtggaagaaaaatgccatggattctgctgtgggacaattcattcttcaaaatggacttccgcgcgttgcgccaatggctgatcgtaatcgacaatttgatgaccaacgacaaaacatggttcaaggaattgcttactcggatcaccacctccacgtcgaccactctgtcaacactgatcaccagcaaggagcacgagtacgatatgcgtgcccattacctgaagcggctggcgttcg

SEQ ID NO: 47895 - DNA, 561 bp, Heterodera glycines
  SCN-specific regions: Sequence locations=1-242,266-561
cccctgttgtggtgttggccgggtctttgttggacgctgcagaaaaacttcttgccaaggaattcatccgaccaccatttccgactcattccaacgggcggccacattttctgaaaaagttctcgaggaaatggccacacccattgacattaacgatgacgacgagttggtgaagctcgccatgacgagtttgaactcgaaggtcgtttcgcaatattcccatcttttggcaccaatggcggtgcaggcagtgaagaaactgatgagttcaccggaggactcaagtgtcaatctgaagttgattaaagtcgttaaaaagttgggcgaaacggtggaggagtcgcagctcattgagggggcgctgatcgatcagaaatcgatgggccacggaggccccgcgcgggtggagaaggcgaagattggcctcatccaattccaaatctcaccaccaaagcccaacatggaaaatcaagtggtcatctctgactatgctcaaatggaccgtgcgctgaaggaagaacgaaattacattttggaactgtgcaagcaaatcaaaaaggc

SEQ ID NO: 47896 - DNA, 597 bp, Heterodera glycines
  SCN-specific regions: Sequence locations=1-83,106-145,167-267,289-597
cacaattgaggagatcttgcgcaagcgccaagtggaaatgacatcgttcagcgacgaagtggagcaccgttaccaggccaagctgcaggaacagctgcaggccatgcgggacgactttgacaatcgcattgcgcagaaccgtgccgaggtcgatgagctgtaccgcaacaagctgggcgaggcggctgaaaacgcgaacagaaaccgtgacttggcggccaaggcgcgcgaggaagcggcaatgtggcgcgtccgtgttcaggacttggagaactccagcaaagaccatcagggcatcgtcgagtcgctgaaccgtcgtgttaaggacttggaggcggcgttgcgccgcgcgcacgaggacgccgacattcgcattcaacagcgcgacgaacagattgagcaactgcagaaggaaattgcgttgatgatcagtgactaccaggacttgttggatgtcaaagtgcagttggacaccgaattgcaggcgtaccagaagatgttggagcaggaggagaccagattgcacattacgccgtcgaccagtccgaacacgtcggttgtcgggcagaacatcagcacgcctaacatggtcatttc

SEQ ID NO: 47897 - DNA, 621 bp, Heterodera glycines
  SCN-specific regions: Sequence locations=1-621
tgggaggatgtgctgccgttccggcatcccttcgccgtgttgggcgattatttgcgcaaatggcaaggggcaactgacatcgaaccgcgtacaattgggtcgggtgctgttatgacagcaacgcctttttacgaagtcgcgatttacgtggacaaacagcaaattgttggacaatcgggcggtgaattcccttgggttgcgttggatttggccgctcataatggactgcttcgcctgtggcgagtggctgaccatccgcgcgtgttcccattcaaatttgaggaagtgtacgcgacccgatttgagcatgcccagcagagaaaccatcggttgagcgacgtttgcggagaaaacaccgacttgagtctgtacacgcccgaagaactggccagagacccaattgacatggtcgacatgtgcaaccagtactacacgaagatacggcccgatgtgggcattcccctgcggcgaaggcaacggcataagttctcccgtgggacgatcagtcggctgagtaggcgatttttggtcaagcccaccattttcaatatctgaacacaacccgacacacttttgttgatctgcgacgaattatgatcattttgctttttgtttgaattc

SEQ ID NO: 47898 - DNA, 607 bp, Heterodera glycines
  SCN-specific regions: Sequence locations=1-607
aaataaaaaagatgcgagatctgttcatcgaagacaacagcccgatcactccggcccggcttgccgaactgatcagacatttctacgcgttgggatggatgcgcgataacggcggaggaatggcggtcctttgcaacggcgccgtgttcggttcgcccacttcggtgcagaaggagaaagtgcccgaaaatgatctgtttgtaattgatgctacgaccggcacagtactgaaacggccgcaaaacgcggcgagtgttccgagtgccacctgcggactgttaatgaacacaggtctgaactgcgtaattcacacccactccaaatacgcaaatcttgtctctcagttggtcacgggcaacgaattcgccatccaaaaccaggagatgattcagggggtcgagaatcgtagcagcggactccgtctcgacaacgtcgaccgcctcgttgtgcctatcgttgattctgagttaaacgaacaaatgctcagtcctgttttgctccgaactttggacaaatacacagaagcatcggccattttggtgcgtggccacggcttttttgtgttcggctctcactgctggcagtctaccaaagtgatgttggagtg

SEQ ID NO: 47899 - DNA, 630 bp, Heterodera glycines
  SCN-specific regions: Sequence locations=1-630
gtgattttaagaagcttctctcttttgatacaaatggacttcgaaaatggtggccgtgatacaggggcgagttcgggcctcggcaaagcaacggccgttttgttcgctcggaatggctaccatctctcactttgtggccgtaatgaaagagcgttggagggagtggcgtcgaattgtttggcagagggcggactgacccgagaacaggttctgacaataattggcgacgtttgtgaggagaaaacgcttcaaaacattgtgaaacgaacggatgaaagctttggacgaatcgatgttttggttaattgtgccggtgttattgcgtccggaggagccgaaaacactccgacttcagttttggatggtttgatgaatgtgaatgtgaaaagcatgatcagactaagtcaattggttgttccgtatttggagaagacgaaaggaagcattgtgaacgtgagtagcatcgctggcatttgcgcgtttcctgctgtgacttactattgcatttcaaaagctgccgttgacaaatttacggaatgcctttccatggaattggcaccgaaaggcatccgagtcaatgccgtcaaccctgcactaatcgtcaccgaattgcatttgcgttcgggaatg

SEQ ID NO: 47900 - DNA, 637 bp, Heterodera glycines
  SCN-specific regions: Sequence locations=1-346,368-637
caagaaattgtccgttaagcgcgttgacattattcctgcaaataccttaacaattattcgtaactatgagcgattccgggcggtcatctattattcgaaaaagctcatcttccaagctcatccgacaatttgccgagatgaacattcccaccaacggcgatgaatatttggaccgaggcgagtcggctaaaagggagaaacgattcgtattcgaatgtgcgtgggaagtggtgaacaaagttggaggcatttacactgtcctgcggacgaaggcgccgattagcacagacgaactgggcgaccagtattacatgatgggtccctacgtggaggaaagagttcgcctggaagtggaggtgttggagccggagactgcaaatctcaagtacacgttggaccaaatgtatgactggggtttccgcgttgtgtacgggcggtggctgattgacggatatccgaaagtgttgctgttcgatgttgggtccgccgcttggaaattggatacatggaaacatgagttgtgggaaaagtgcagtatcggtgttccgttcctcgaccgcgaggccaatgattgcatcattttcggctttttagtggcaatatttctcaaatcgtttttggactcatccgaaaattt

SEQ ID NO: 47901 - DNA, 560 bp, Heterodera glycines
  SCN-specific regions: Sequence locations=1-146,183-368,396-464,486-560
tgggctttcttaaacttatggaagaggctaaactgcatggaaagtcgacatttgcttccttctctacaaaatgggttaaagatgcacgtttcaaggcagtagagaaaatgcgtgaccgcgaggcttacttcaaggattacgttgaagaactctacaagaaggaaaaggaggagaaaaggaaggagcgcgaaaaggccaaggatgaattcaaagctcttctgagtgagcaaaatgatctgagacgcaattcaatctgggctatcgtgaagaaacggctggacaaagaagcgcgctacaagaacaaacatttggacagtgaaacgcgtcaacgccttttcgaggagcacgtgaaagactgtccggagccaactgaggaagaggaggaggaagccaaacggttggcggctgaatctctcgaggcttcaaatggcaagcggcgaagtgatcacgacggagtggaaaatggggagaaaagaaaacggaaagaaccgctgactgcggaagaaaaggcattggaagagcggaagagagaagtggcggaggaactcggagagcatcta

SEQ ID NO: 47902 - DNA, 593 bp, Heterodera glycines
  SCN-specific regions: Sequence locations=1-80,102-102,126-441,463-593
ctgccttctgtgactgttgttcgcctcccctttgctcatctgtgacgacgacacttcgtgaacgaacatgacggacactgcaaatcgacagcgacgcggccgaggcgagagacgcacacgagtgcttctacgcgacagtgccaagaaaatcaccaaagcgtccattcttcgtctggcccgacgcgccggtgtcgcccgaatcaacgcaagagtctacgacgaggtccgtgccgcgctgcgctcgtacttggaaaccatcattcgagacgcggccatctactgtcagcacgagaggcgcaagaccatgaagagccgggatgtggtacacgcactgaagcgccagggcaatttgatgtacggcttcgaacaataagcgcaaggaggaggaggatggatatatttggaaccggcaccatatgatattttcggataatattattattgtacatatgtgtgtatatgcctatattgtatattgttatgtcgatgctattgtacaccatttatccgtgtagttgtgacccgttattattattgtctttgtgtattgatattgtgtatttggtacgataaagactggcgattttgaaaaa

SEQ ID NO: 47903 - DNA, 640 bp, Heterodera glycines
  SCN-specific regions: Sequence locations=1-318,341-640
tttcctattttattatctgctgaaacgcttacaacagattagcgatgattccgctcaatttgcaaattgctgagtctgctctgaaggtcctccaaacaaaaacgcccgggggagaaattgagcaaagtgcgacggcgggagctctctgtacaaacaatacgtgcaaaaaagtgttcaccggtcccgatatctattccgaagagtgcgttttccacccgggcaatgccgtttttcacgaagggctcaaatactggtcgtgttgtgggcgcaaaaccaccgattttaccacatttttggaccaattgggttgcactcggggcaaacactgctggaaaaagaaggaaattgtcacaaatgcgcgcgaagattggttccaacgaggtggccaagtgcacatcacaatttactgcaagggagcacttccgagcgaaacatccgccaaatcggacggtctgacattggaagtgaccatcaacgggtccaccaaacggtacgaactgttcggggaaattgcgccgtccgaaagtgtggtcattatcagcgaacgcaaagtggaaattgtgttgaagcaagtggccaaaattgggtggacaaaacttctaaaggaacaaacgacgggattggcacaatcttcggactg

SEQ ID NO: 47904 - DNA, 682 bp, Heterodera glycines
  SCN-specific regions: Sequence locations=1-593,615-682
ccttaagttattttactggcctgcacaacatactcaaaaggttctttgcgcatgtttcgccttcgcttttaaagaagcccctcaacgacccatttccgattgctgcgtggcgctcgcacccggccaacatggccaaaggtgtgaagttcgatcacgacaacgcgttcgtgcgattctgccgctactatctatggcattactgttggagtgggcgtcagtacggtcttcaattctacgaccaggcattcgaaccgcatcccgtagtccaagaggcactgcgccggctccgtcttaaggacccctaccagtacgaccttcgtctgcagcgtattcttttggccagtcaattgggctcaaagaatgagcgactgccgaagaacatgtggacaaaatgggacgacgagacattctatctgaacccgtattttaacgaaattgaggaggaaaagctggagcgtgaagccagcacgggcatgaagccgggataccaactcaaagagcagatttaggggacagacattgtgttgtgaacgattagtcgcggaggaaaagcacattgcgtttgttgatactgttgccggagagaaattgatttgatgagtgattgttcacaacttttaggacgacatgtgttatgttcatttaacgtgaagtaataaagcgattattctcaaaaaaaaaa

SEQ ID NO: 47905 - DNA, 363 bp, Heterodera glycines
  SCN-specific regions: Sequence locations=1-334,356-363
agagacgcacacgagtgcttctacgcgacagtgccaagaaaatcaccaaagcgtccattcttcgtctggcccgacgcgccggtgtcgcccgaatcaacgcaagagtctacgacgaggtccgtgccgcgctgcgctcgtacttggaaaccatcattcgagacgcggccatctactgtcagcaccataggcgcaagaccatgaatagccgggatgtggtacacgcactgaagcgccagggcaatttgatgtacggtttccaacaataagcgcaaggaggaggaggatggatatattaggaaccggcaccatatgatattttcggataatattattattgtacatatgtgtgtatatgcctatatt

SEQ ID NO: 47906 - DNA, 495 bp, Heterodera glycines
  misc_feature (478)..(479): n is a, c, g, or t
  SCN-specific regions: Sequence locations=1-347,369-495
ccctgatttggccccctatttatacgtcaaaatgggattccgccaaggttatttggacaaattgcgtgccgaagtgttcgagccgggagtcaagcacattttgccactgtttgagaaacttttgaaggatctctggtcagggtacatgctcaagtccggcctctcaatggtggacttcctgcggccaaccttctgtcttttttaccaagttggagccggagactatcaatgcgttcccggagctgatcaaatacgttgaccgtgtccatgcgctgccccaactgcagcagtatttgaagcagcgtccgcaggaccgctgatcagtgatcagaaaagtcgagattgaatgagaaaagaaaatcaatcattgagattaattcgataagttatgataagacaaagctttttttctttaaacagaatattgaaaaatatttgatctttttaatcatataaagaaattaaatctggccaaccnntcccccaaaaaaaaaa

SEQ ID NO: 47907 - DNA, 698 bp, Heterodera glycines
  SCN-specific regions: Sequence locations=1-622,650-698
ggatgtaagcccttagtttttctaaacacacggttaaaattgagcctactgcccttggtagagattttactgaggcgttggtggagcgtttaaatcgtcaatttgctaattacgttataccaaatgtcgggctgtgcattactttttacgactttaaaaaatacggcgcttcttacatattgcccggtgacgcatcaacgcatacgcctgtcctattccgttatgttgtttttcaaccaatgataaatgaaattcttgagggcaacatactgcgctcgaaccaggaagggatcacaatcagtatgcagtttttcagcgacataacagttgcgccagacaaattgcctgcagtttctaaatttgatgagtctgttcaagtttggagatgggagtatcaaaatgaaaatggtgatatcacgccattctatatggatccaggaaaacgcgtaaggtttgttattgttttttggtatagcaatgatttgaatttttctatattttcccgcgtgtgctaggcattcatttttcccggctcgtctattagctccgccgggaccctccctcaccccttctcccggtctcaaattttaagaaattatccaatgctttaaaaacttttggtgtaaaatcaacaacaacaaaaaatatgcgcggcacattcaacataaagaatagtccggcggtgcagataagctatt

SEQ ID NO: 47908 - DNA, 641 bp, Heterodera glycines
  SCN-specific regions: Sequence locations=1-641
ctacaggacgcgttcacagacatgagctcgcctctgactcgttcccgatgaagttggtcgacgacctgatctacgagttcaagggtcgccatgtcgtgcgaaaggagggcgaaattacgatgagcggggcaaatccgtcagcggaggaaattgacgagggcactgaagaggcggtggaacgcggcattgactttgtgctcaaccatcgactacaggagatgaattgttacgagaaccaggcaacatttaaaggctacgtcaaggacttcatgaaaaagatcattgagtacatggagaaggagcagaagtcggctgacgaaattgctgcgttcaagaagaagatccaggcctgggttgtctcattgctggccaaagaccgtttcaagaatctcgcattctttatcggcgaaaacatggccgagggcaagggcgaaggacaggtggccattgttgagtaccgtcaggagaatggtgaggaagtgcccactctgatgctgatcaaggaggcgctcattgtggagaagtgctgacgacgacgacaagcgatatacgagaaatgcgcgcgatattattattataacttttttgctttaatatgatatggtgacacaatgtccagttactattacatattgttgttg

SEQ ID NO: 47909 - DNA, 661 bp, Heterodera glycines
  misc_feature (658)..(658): n is a, c, g, or t
  SCN-specific regions: Sequence locations=1-661
catcggaaaaacgatgaatttgaaagcgtgcccaactttggccaccgccaccgttttcttccaccgcttttatatgtttcacacgtttgacgaacatcatttgcatatgactgcgttggcctgcttttttttggccggaaaagtcgaagaaacgcctaaaaagtgcaaagattttttgacggtggcccgagaattatacccccaccatttcacagcaaaagtaacgccggacgatttgatgcttatggagcgagttctgctccaaacaattcgctttgatctccacgtggaacatccctacacttttttggtccaatatgccaagggctttcgcatggacaaggaatacatgagcaaaattgtgaccaacgcatggacatttgtcaacgattcgctcggcacaacactgtgccttttgtgggagcccgaggtcattgccattgcccttttgtacatgtccttcaaaatggagcgcatggaggagcagcaaatcggacggacattccattttgacgcgagcacagagtggtggaatttgtatgtgcaaaatttgaccgtgcccatgatggacgacatttgtcacaaagtgttggattccatcgcaccagcgaacggagaggacgcgccaatggcaaacggaacaaaaaattgacagatntaa

SEQ ID NO: 47910 - DNA, 615 bp, Heterodera glycines
  SCN-specific regions: Sequence locations=1-253,279-354,377-437,459-615
gtatcgcaatctgctgctccgcttttgcttgaaggacgagaaggcgcagcgcatccttttaggaggcattgaacaacttgtgcaaaacaacaaggacattctcatgtcgaagactgcccacatcataaaagcgctttatgacaacgacatttgcgaggaggacgtcattttagcttgggggagcaagccgagcaagaaatttgcggacaaggaagtggtgaaagagatgatcaaagttgcccagcccgtgcttaaatggctcaaggaggcggaagaagggtcggacgagtcggaggacgacgatttggacgttgcatttgacgatcgaagccgcgacattgggatgacagtggaggtggaaaagggagcaaaggatggggtcacccgtgtacagaacggccaaattgcaaccaatggcaaaatggacgatgggaatgcagacgacattgacattgacaatatctgattgtgagtgcatggcgcggtggacggtaattcagtgatgttgcaagaatttgtgatcgtatgccgaagactttcacccaccccttttgttcattgcgataccaccacatttttgttcgcttttatcgtaaaaaacttattgtagatgtt

SEQ ID NO: 47911 - DNA, 560 bp, Heterodera glycines
  SCN-specific regions: Sequence locations=1-560
gagaaggcgcgacgttacgacgacatggtggaggccatgaaaaagctgatcaagttggacccaaatctgaccctggaggagcgcatttcgttgtcaacggcttacaaaggtgcgatggcttctcgtcgtacgtcctggcgtgctttggtctccatcgaggaacggaccggcgcgagtttgagcgatgcacaacaacaggtgttggagaactatcgtgagaaggtgcagaatgaactggtgaacacttgccaagaacttttgacatgcatcaacgaagtgctgtttccgaaggcgtccgacgtggagcagaaggtgttctatctgaagatgaaagccgactactaccgttacatttccgaagtcgcgacggacgaagaccgatccggtgttgtcgaactcgccaaagttgcctaccaggaagcgattgacatggccggcgacaaaatcccagcgaccaatccgactcggtttggtcttgcgctcaacctcgccgtgttcaactacgagatcttaaattcggtgaccgaggcacgcaaagtgatccaaactgctctcgactt

SEQ ID NO: 47912 - DNA, 578 bp, Heterodera glycines
  SCN-specific regions: Sequence locations=1-539,569-578
cgttcttgtgggcgtacccgtaccgactggtgatgagtttggcactggcactgctcgtctactggacaccgtcatttcgcgaacccacggggagtatccgtacttttattacgccatttggattggtgcctactatttgcaacaagtgtcctcctattgcattttcctctcaatgatggcgttcaatgcacaaatttcggaccccaaaattggcggcacttacatgaccctgctgaacacgctgaacaacttaggcggcaattggcctgtcacactgtccctgagcatcaccgattttttcaaccgtaaaaattgtgtggccaaaggcaccaaaattgtgctgggcgtatgcaccagcaaacatgacgaggagttgtgcaaagcgggcggtgatgcgtgcgaatttgtgatcgacggttattacatttctgtggcaatttgcgtggtcgtcggtctgctgtggtatcgaattttctaccggcgcatcaaatacttccagaagattccccgccaagattggcgcgtgatcaaaacaaaatgatgtgtgtctgtctgtctgtctgtatgtgatgatgaac

SEQ ID NO: 47913 - DNA, 593 bp, Heterodera glycines
  SCN-specific regions: Sequence locations=1-23,45-593
tgagctctgcatttaactaaaacttttaaccaaacagaaaaaatgttcgtaaaaacattttcgaataaaaccgttgttttaatgtggacccgactgaactgtccgtcgagcaactgaaggcactgatcgctgaggaggaggaaattgctgtgccggaccaaagacttgtctttgctggttgccagcttgtggatggaactctgctcaggacttatggagttgatgctgattcaaccatccaccttgacctcagattgcttggtggtgggaagaagcgtaagaagaagcaatacactggcccgaagaagcagaagcatgttcgcaagaaggtcaaactcgccgtgttgaaactttacaaggttgttagacattacaattgagagaaaaggtaaaattttgaagattgatgacaatggaaagattcatcgacagcgtttggaatgcaattcggccagctgtggagccggaattttcatggcgaagcacaaagatgggcgtttctactgcggcaaatgtcatcaaacattgaaggaaaagaaatgagtgcttgttgagaattattgaatggatagccgttgatgctattttggttt

SEQ ID NO: 47914 - DNA, 733 bp, Heterodera glycines
  SCN-specific regions: Sequence locations=1-454,492-701,725-733
attcgctgacagatgcgaccccgaatccgagaaatcaaggaagctcggcgcaggaaattgccggtgttgttgccttcatgggtttttgctgccaattccatggaccgccgtttaaaggacactttaaatgtcatcacttcagagaaacaccttgacactcataaaactccactttttgctggatgtgaaatcacagtgtccggcttccccggcgccgaccgcgttgacattggccgtctcgtcgagttgcacggcggggtgttcaccggacagatgaaccgttcttcgtgtacgcatttaatcgcagccacaaattcgggcgaaaaattccgtaaggcgcgcgaatggggcactgtttgggtggtgacgagccgatggcttcgcaaatgcattgaaacgggatatcgtttatcggagagtcgttttgcgcattcacacgacgaagacacacagcaaagggtttccccaagtttttctctgataacgaaaaaatgaaagatatttgaattcgtatttgccgttcgaattaagtcgaaagagaaattaggatcggattccccgacactggaaccccagaaaaactatatcaaaaatcttttttcggaaagagagcccattacattattcccgaccatttttattgagttttatagccattggattgttgtgctaaatatcaaaaattgctaattatatcattgtttttattttttaaaattattttgtgcttaat

SEQ ID NO: 47915 - DNA, 658 bp, Heterodera glycines
  SCN-specific regions: Sequence locations=1-470,494-658
ttatggctgtcggacagaacagaagatggggaaaaagggagcaaagaagaaggccgtcgactccatttacgcgcaaggaatggtacgacatcaaagcgcccgcaatgttcacacaccgaaacgttggcaaaactttagtgaaccgcacccagggaacacgcatttcaagtgactttaggaagttccgattgatctgcgaagaagtgcaaggcaaaatttgtttgaccaatttccgcgggatgacattcaccagggacaaactgtgctccattgtcaaaaagtggcatacactcattgaggccaatgtggcagtgaagaccaccgacggtttcttactccgactcttttgcattggctttaccaaacgaaatgccaatcaaatcaagaagacgagctatgcaaagacatctcaagtacggatgattcgtgccaaaatggtggaaataatgcaaaaagaggtctcttccggcgacttgaaagaggtggtcaataagctgatcccggactccatcggcaaggacattgagaaggcgtgctccttctactacccgttgcaggacgtttacatccgtaaagtgaacgtgttgaagaagccgaagttcgagctgggcaaattgctggagatgcacggcgagggtgccggaacggtcgccactat

SEQ ID NO: 47916 - DNA, 597 bp, Heterodera glycines
  SCN-specific regions: Sequence locations=1-597
ccttcggcagcagaattgtcacccccgaacactttcctcggcgtttctctcgcttctccgtttgactatgcggctgctcgagaatacaccgcttacacccaaggaccggacatttggatcaccacggcatatgtggtgacaatctttggcattcaatggtacatgaaggaccgcaaaccgatgcaactgacgctgagcctcagactgtggaacctttggttggccatgtttagcactgccggctgtctggtgaccagctacgcgctgctcagagagattggcacctacgggctggtcagctcgtacacgaactgtcgcgacttcttcgagggattcaccggcttgtggacctggtggttctgcatgtcgaaatttgccgagttgggcgacacttacttcatcgtcctgcgcaagaagcccctgatgttcctgcattggtaccaccacgtggccacgctcaactacggtctgatgtcctacgtggacaacaccgcgttcaacacatggattgtgtggctgaacttcagtgtgcacgccgtcatgtacacctattactttttggccgcctgccgcatccgtctgcccgcttggttcgcc

SEQ ID NO: 47917 - DNA, 488 bp, Heterodera glycines
  SCN-specific regions: Sequence locations=1-488
ggagaccatcttaacactcgaaccggatgtgatgcttaaacttaattacaatttgaccgtccacacgccctaccgccctttcgaaggccatctgattgaaatgaagactaaaattggcagacaattgtcagaaattgagttcgacttggaatcaatcagaccaatgtcaagcgaatttctgaagaactctctgctgagtgatgcgatgtttctttactccccttcacaaattgccttggcagcggtgaaattcggcatggataaagcattgggagaagtccgttcctccactttaatggtcgactttctcgccgctttgctcgacgtggacatcggcgacgctggcggaagacgcacagcagacattttgcagttggagaaactgcaagttcggcttgaccaaatctgcaaattggttctacaacaatttgcccagggcgtaagtgccgaagaaagcgcatcccttcaaataaaaaaaaaacaaaaaa

SEQ ID NO: 47918 - DNA, 726 bp, Heterodera glycines
  SCN-specific regions: Sequence locations=1-113,135-138,165-168,207 -213,237-317,339-384,420-437,473-726
tcctttgtcttatagttatacggaactacataaaatggcggatcagctaaccgaagagcaaattgccgagttaaagaggctttctcgctgttcgataaggacggggatggcacaattaccaccaaggaattgggcacggtcatgcggtcgctgggtcaaaaccccacggaggcggagttgcaggacatgatcaacgaagtggatgcagacggaaacgggaccattgactttcccggattcctcacaatgatggcacgcaaaatgaaggacacggacagcgaagaagagattcgggaggcattcagagtgttcgacaaagacggcaatggcttcatctctgcggccgaactgcgtcacgtgatgacaaatttaggagagaaactgacagacgaagaagtggacgaaatgatcagggaagcggacattgacggggatgggcaagtcaactacgaagaattcgtaacgatgatgacgacgaaataatcgcttcggcacagccctcaacaccgtcactgcatcgatcttttcatttccttcgttcatttaaattatctcctctccacccatccattcattcaccgaccatttttcccgtggattcgattgattttatgtattctataattttttatttgcttttccgtgttcttttgagcagatactgagaatatttgtattgcgttttcttggtctccatcccatcaatcgtctcgtacacctttaatt

SEQ ID NO: 47919 - DNA, 600 bp, Heterodera glycines
  SCN-specific regions: Sequence locations=1-29,51-52,76-86,109-366,388- 600
gaaagggatttgctttacattgactttaattttaaattttacaagggaaattactattaagtaataacttgtcctaaaaaatggtccaatacaaattatattattttgatgggcgcggtttgggtgaatcaatccgtctgttgcttcactatgttggccaaccgtttgaggacatccgaattaaagacgttgaagaatgggagaaaacgtacaagccgaaatttttttacggaaaggtcccagttttggaggttgacgggaagccattgggacaaagtgctacgattttgcgctaccttgccgaaaaatttggcttggccggcaaagatgaatgcgaaaaggcgaaggctaacgaaatcatcgactttcaaaaggatgctaacactgatttggccccctatttatacgtcaaaatgggattccgccaaggcgatttggacaaattgcgtggcgaagtgttcgagcctggagtcaagcacattttgccactgtttgagaaacttttgaaggagtccgggtcagggtacatgctcaagtccggcctctcaatggtggactttcaagtggccaactttctgtacacgtttaccaagttggagc

SEQ ID NO: 47920 - DNA, 682 bp, Heterodera glycines
  SCN-specific regions: Sequence locations=1-124,147-202,224-682
cacgtattccgcagcaccgacagcaaagttcaatgcacggcatccaacaacaccacagcgagaggccactcgtgcggggaaagacgtcgccctatgggtttttcgtcaaaatgtgttatgaggaacacaagaagaagtacccaaacgaatgtgttcaggtcaccgaaatctccaagaaatgctcccagaaatggaagacaatgaccgacgacgagaagaagcgtttctttgagttggcacaaaaggacgccgagcggtaccaagcggaagtggcggcgtatgggggcgaagacgttttgaagcgaaaaaaacgggccaaaaaggacccaaatgcgcccaaaagagcgctgtcggccttcttctttttctcgaatgagaagcgtcaggaagtgtccggagagcatcccgaatggaaagtcgggcaaattgcgcaggaactcggcgttcgttggaaggcactttcggacgaagagcgcgcgatttacgaaaagaaggcccaggaggacaaagagcgatacgctgaggaaatgcgtgcctatcgcaacgattctgctctgtcgtccggcacttgtcagaagccctcttacctggagggagggccgtccatgaccactgctgagcatgtgctgcagtcgcagggcggtgctcacgtggtgagcacatcggcgggcggacagccgca

SEQ ID NO: 47921 - DNA, 627 bp, Heterodera glycines
  SCN-specific regions: Sequence locations=1-627
agggtattggagtccgtcatttttatttgtttgttatttatttgctgacatggctcaattagctgttgcagctcctctgccgccaacgacaaatgcaacagcggccactgctacaccggcggcaccgtcttacccaatggcttcgctttacgtcggcgaccttcaccctgaagtcactgaatcgttgctcttcgagaagttcagcgtcgtcggtcccgtcctctcaatccacgtttgtcgtgatgctatcagtcgtcgttcgctcggctatgcttatgtgaacttccagcagacatcggatgccgagaaagccttgaattcgatgaattttgactgtgttttgggcaaacaaatccgcataatgtggtcgcagcgtgacccgagcattcgtcggtcgggatccggcaatatttttatcaaaaacttggacaaggacatcgacactaagaacttcttcagcactttttcggcctttggtcgaattttgagttgcaaagttgccacagactccgacggcaaaagcaaagggtacggcttcatacattatgcgagtgaggacgacgcaaataaagcaattgagaagattaacggaatccatgttgacggaaagacagtgtttgccgggaa

SEQ ID NO: 47922 - DNA, 578 bp, Heterodera glycines
  SCN-specific regions: Sequence locations=1-41,63-129,164-239,261 -264,287-298,320-341,411-413,437-488,555-578
acctctttcggccggacaatttcgcttttggacagagtggcgcgggaaacaattgggcaaaaggccattacacggagggtgctgagttggtggacaatgtgctggatgttgtgcggaaaaaagcggaaggctgtgactgtctgcagggctttcaactcactcattcactcggaggaggcaccggctcaggaatgggcactctactgatttcgaagatccgcgaggaatatccggaccgaattatgtcctctttctcagtggttccatctcctaaggtctctgacaccgttgttgagccatacaatgccactctttccgtccaccaacttgtagaaaacaccgatgagaccttttgcattgacaatgaggccctctacgacatttgcttccgcacattgaaacttcagaatccgacttatggcgatctcaaccatctcgtgtctgtgacaatgtctggcgttacaacttgcctccgtttcccggggcaactcaatgccgacctccgaaagttggccgtcaacatggttccgttcccgcggctccactttttcatgccaggatttgcgccgctttctgcc

SEQ ID NO: 47923 - DNA, 636 bp, Heterodera glycines
  SCN-specific regions: Sequence locations=1-357,379-636
tggagaaggaatgcatccaatacaaaaagtcgttggaccatttgttgcgccggcgtgcggactgtccatttgacgtggaggcatcgcgcatcaaattggacgctttaaaatcagaagagcgcgacctattggaacaactgacgctgttggaagacgaggaacggacactgcttcatgaattggatacaaaacaggaggagcgcaagaaaattggtgaacgagacgagcaactttatcgacagttgcgagacaaccacagtatactcattgaacaatcggatgagcagcggtcatttaaattgcaaatcaatcaggccaatgaacaaattcgacgtctgtctcgcatgaatgtgcttgatcttgtgttccacatttgggtggatggagagtacggcacaataagcggcttccggttgggtcgactgcggcatgaccaagtggaatggagtgagatcaatgccgccttgggacagacggcctttttgttaaaggtcatcgctgaacggctcggtctcgattttgttggctacgagttggtcccatgtggaagcacatcactcatccgaattctgcccaaaaatggtggcactaccactgcttcatcaacaactgctccagccgcacatgccgtcgagg

SEQ ID NO: 47924 - DNA, 565 bp, Heterodera glycines
  SCN-specific regions: Sequence locations=1-565
cacttttcgtggtggcgagaacgtcgtcgacttttgttttgctccatttaatagacagattttgtattccctggcagtcggtggtgctgtgaacactttcgacttggccaggtgcactggccaggacacattcttcgaccagggctgtgtccgtgccacgtgtctttcgtgcagtccttcgggccaattcatcgcctgcggttctaacacgggaattgtcaatgtttacgacctgacaaaactctctccgagtttggccaagtcgaatgcaccaagaccagtacggatgttcgaccagctgaccactttggtgtcattcgttcgctttaacaacgactcgcaaatgttggcatttggttctgcagtgaagcgtatgtccggtcgcgtggccaattgttcttccggaagcgtatttcaaaatttccctgctaaacaagagcacttcgccagcgacaaattcacaacttgcgatttttccccgaatagtgcctttttttcctttggcacaaaacaaggaaagatgagactttaccagttacaccattctgatgtttactaaattttg

SEQ ID NO: 47925 - DNA, 612 bp, Heterodera glycines
  misc_feature (610)..(610): n is a, c, g, or t
  SCN-specific regions: Sequence locations=1-362,385-533,555-612
gccttgttgatcgacatatgacacacaatgaagaaacctactgggttccttccttcgtagagacaacgttttgccaattggttgcgtgatgcgagggattggtgcgtgagcagaaatcgcttctggggcacaccgattaacctttgggtgagcgacgacttccaagaaatggagtgtccaggatcaatcgacgaattggagcgattgacaggcacaaaagtcactgatcttcaccgagagaacattgaccatcttcaaatcccctcaaaaacgggccacggaatgctcaaacgtgtcactgaagtcttcgactgttggtttgagtcgggttccatgccttatgcccaacaacattatccatttgaaaactcagaagtttttgagcacaatttccccgctgattttattgcggaaggcattgaccaaacccgtggatggttttacactttgttggtcatttccaccgctctgttcggccgtcctccattcaaaaatttggtctgcaatgggctcgttttagcctcggacggaagcaaaatgtcaaaaagcaaaaagaatttcccaaatccgttggatgttgtcagaaagtacggagcggatgccttacgtntg

SEQ ID NO: 47926 - DNA, 708 bp, Heterodera glycines
  SCN-specific regions: Sequence locations=1-128,150-350,390-422,446 -470,498-572,620-708
gaattcttagccgggcaagggattctcgctgctgacagagccaggttcgattggaaaacgcttcgatactattgggttggagaatacggagaacaatcgccgtcgctaccgccaacttttgttaccacaccgagctttggacagaatcttagcggtgtcattctttttgatgagacattccgtcagtcaaccgacaacggagtccgatttgttgacgtcatcaaaaaggcgggagccgttgctggcatcaaagtggacacgggagttgtgccattggccggcactctcgatgaggggacgacccagggcctcgataaattgtcggaccgctgtgccgagtacaaaaagggcggctgtgactttgccaagtggcgttgtgtgctgaacatcggtcccacaaaccgtcccatttggcattgatggagaatgccaatgtgctcgcccgatatgcgagcatttgtcagcagaacggacttgtgcccatcgtggagccggaggtgctttgtgacggcgaccacagcttggaacgatgccagaaggtgactgagttgactttggcctacacctacaaagcattggccaaccaccacatttacctggagggcactctgctcaagccgaacatggtcacccccggccaatcccactcgcccaatgccacgcccgaccaaattggtctcgccaccgtgactgccctccgccgttctg

SEQ ID NO: 47927 - DNA, 570 bp, Heterodera glycines
  SCN-specific regions: Sequence locations=1-361,383-570
acgctcttaaattgcttacaataccgtcctgaaactcgccaggcgaagaaagaacgtcttcgtcaacgagctcaggatcgagcagatggaaagcaagagaaactgacgaaacgtcctcctgttgtccacttcggcattaaggatgttgtcaaagccgtggagaacaaaaaggccagcttagttgtcattgcacacgacgttgacccaatagaaattgtgatttgcctgccggcaatttgccgcaaatttggagtgccgtatgccattgtgaagggaaaagcatttctcggtcaagttgtctaccgcaagactacttctgccgtgtgtctttgcgacgttaatccggaggacagaaacgcgcttaaaaatttggctggtgttgcggtcaccaatttcaatgaacgcggtgatgaacttcggaagaattggggaggtgcgatcatgtcccagcgttcgcaagcacgacaggctaagattgaaaaggctcgccagaaggatgttgggcagaaagtttgatgttagttatcaaaaattgttgtttctctgttgatgataaaatttgttgacttc

SEQ ID NO: 47928 - DNA, 626 bp, Heterodera glycines
  SCN-specific regions: Sequence locations=1-112,134-626
tgggatgtgatctgatcgtcgatgcacgcggagtggtcccaactctgaccatggaagagcgattgtccagagctttctcttgccgaagattatggcattctggtcaacgaacagatgaggacaaatattgaagacgttttcgccgcgggcgatgtttgcacagcgaattggacagcaaaaagtccccattggaagcagatccgactctggacacaagcgcgacagatgggcttgttctgtgcccgatgtatgctcattgacaacgttttgctcgacatcgctttcgaacttttcacccacgtcacttctttttttggcttcaaagtgattttgcttggcgatttttcgggcgaacgattggaaaaaccctttgagaagaattatcggatcactgaaggctgtgaatatgtgaaggttctgacaaaggatcaccgtgtgcacggggcggtgttggtcggcgagactgacttggagggagcggttgaaaatctgattctgaaccaaaccgacattggtcaaattgagcaagtatttctagatcctgatttcgatcttgaagatttttttgattaatcccaattattttgcatttaatataccaaaactatatgataaattcaattttg

SEQ ID NO: 47929 - DNA, 660 bp, Heterodera glycines
  SCN-specific regions: Sequence locations=1-123,152-305,332-344,371 -473,503-503,545-545,593-635
gctccttaagcttaaaaaacagacatcattcagtattatttataagaacaccaaaaatgcgtgaagtgatctctattcatgtgggacaagcgggcgtgcaaattggaaatgcttgttgggaattgtactgcttggaacatggcattcagcccgatggaaaaatgccatccgaccaaaacaaccaagacgattcgttcagcaccttcttctcggaaacaggcaatgggcgtcatgttccgcgtgcggttatggtcgacttggagccaacagtgatcgacgagatccgcactgggacttacaagcatctcttccaccctgaacagctcatcactggaaaaggagacgcggccaacaactacgctagaggacattacacagtcggcaaagaaatcatcgaccccgtcttggatcggattcgtcgcatcgcggataactgcaccggacttcaaggctttctcatcttccattcgttcggtggtggcactggctctgggttcacatcgctgcttatggaacgtctctctgttgactatgggaagaagtctaagctcgagttctccatctaccctgctcctcaagtgtccaccgctgtcgttgagccgtacaattcggtgcttactacgcacacgactctcgaacactctgactgtgcatttatgg

SEQ ID NO: 47930 - DNA, 557 bp, Heterodera glycines
  SCN-specific regions: Sequence locations=1-378,400-557
tggttttcgtggcggtggtgaaaaaccgaccaggtcagagatactgttcatcagcttaccgtttcgttaggcaaactgtacaacggatgcaccaaacacttgcgcatcacaaggcatatcctttgtccgaaatgtaatggtgtcggcggcgctaaggaaggggtcaaacaatgcgaaaattgtcgtggacgcggactggagattacaacatgcaaattggtccgggaatgattcagcgaattcaaagagcttgttctgaatgtggcggtgagggggaaataaatcgcaacccgtgcaaacactgtggcggcaaaaaacggatcaaatcagaagagacaatcgaagtgcatattgagaaagggatgcgcgacgggcagcgactgatgttctacggaaagggcgaccaacagccggggctggagcctggcaacgtgatcattgtgctggacgaggaggagcatcccgtgttcacgcgaagaggcaccaacctcaccctgagcatgaaactgacgttgacagaggcattgtgtggctgcactaaacatgtggtgacgttg

SEQ ID NO: 47931 - DNA, 570 bp, Heterodera glycines
  SCN-specific regions: Sequence locations=1-109,138-326,348-459,481-570
gcgcgttgtcgtggcgggaacattaaacatcgcggacttcgtcttgataccggaaactttgcttgggcttctgaagggtgcactcgcaaaacgcgtatcatcgacactatgtacaacgcttccaacaacgaattggtgcgcaccaaaacattggtcaagggaatgatcgtctcaatcgatgccattccgttccgccaatggtatgaagcgcattacgcactgccattggcgcgcaaaaagggacaaaagttgaccgaagatgaggaggcgcggattggaggagcacagaaacgctcaaagtcgactctgaagaaatacacggaacgccaaaaaaccgccggggtggagccgcatcttctggaacagttccaggccggacgacttctcgcttgcataagctcacgaccaggccaaagcggacgctgcgatgggtacattttggagggcaaagaactcgagttctacaacaagaaactgaaggctaaaaaggcgaagtgatgccgcaccgaagcttggaattgcgtttccaattttgttgtccgttccttttgagtgaatgataaattttgt

SEQ ID NO: 47932 - DNA, 666 bp, Heterodera glycines
  SCN-specific regions: Sequence locations=1-132,154-666
agcttggcctggctttggcgcaaaggaattcaattcggcagctgatttctgttttcttgcagtaaatttgttgtacggattcgattgcttccaagaacaacaatctgatgaaaatcaccgccgtacaattcgtctgatcagcgccactttgcctgacgatggggcaaattcattccttacgcgttttggctggtctattttggattatcaggcgaccgaactgttcgatttcgccctgcaattagccaacccaaacagtcccactttgttgtccaaatcccattattatgcaaaggttcgtcttcaatacgcgcaattgttggatgaattgggcggattcaaacatgcggttgagctctatcgactcgagaattccaaccattcgaagacaccgtcgcctcctccactcgttccttctgttcacaaaaccaaattagctcatctcaaaaggcaggaccatgagccaacacctgccgttgctcctgctccacctacttttctaccagtgcagttgcagtcggcatccaaagaggaccatgcgccaaccccttttgccgttgctcctgcttcacatactttccaaccagtgcagtcggcctccacgcagggccaagagccaacggcttttgcagttgctcctgcttcacaaactttcctaccagtgca

SEQ ID NO: 47933 - DNA, 574 bp, Heterodera glycines
  SCN-specific regions: Sequence locations=1-422,454-518,540-546,568-574
tgattaatacgaattggaattggccaaatcgctgcacgcgatggccaccaataccaatgtgataaagaacttcttcaaaaaaattcgtatcgcggaacaaaattatatgaaaatgttcacggacgaagtggaagcattcaaagaccgtctgagaaaacgcgcgcgggacaaaagggaggcgatgctaagcgaaacggaggtggaggagaagaaaaagcgtgtggcccagtcgccaggagggcttgacccgcaagaagtgttcgactcactgcctgcggaaatgcaagaagcgttcgaaacacagagcatggcaaagatatttgaagtggcgaagagcatggactccgaggtgttcaagtaccatttggatcgctgcactgcctccggactttggattccaaacgcaaaggaagccgagggacatggacaagaggaggaggagaagaaggaaacggaggagaaatgaccgatgctcaactcaaagatatggtaaaccatgagaatacgtttaagtcgacttataatatttaattatttatgaccatttaaatgcaaataaagatattttcccatc

SEQ ID NO: 47934 - DNA, 710 bp, Heterodera glycines
  misc_feature (647)..(647): n is a, c, g, or t
  SCN-specific regions: Sequence locations=1-366,388-589,611-710
atcgaagagaagatccactgaacagctcgagattgccggaggaaacgcgggacttttttgccacctctgtccccagtgcattttattttaacgtgtcggctgacggacttcccagtatgaccatcgaagacgactccatcctgataaaatacacaaccgaattgctgccgaagttgagaatccaacaattggagagagcggacagaagaaaacggccatcgatctgacactttctctggccgtgcaactgatcccacaagtgcgggacggtattttccacacgcagctgaacctgaaggagcgcaaaattgatatgaaaaacaagacagcatttccgaaacagatgaagccggtggtggaggaactgctgcaggatatgatcaaggacgatgtatggccggctgtaaagcgcggcattgagccactgatttacgtgaagggcgtggagttgccagcaaactgcggagtggaccctaagtctgcccaattgcactttggacaccgcaaaatcggcgcctctgccaaactcaacatcaaagagatttccctcagtcactgcgtcgaacagttcaagagcaaattgcctgacccggccaccctgttcaagatcaacgggacatctttttagtatttaaaatgatctcttncgccttcatgtgcatttactcccacttgattgtttattgtacattgcatcgcctattactgtg

SEQ ID NO: 47935 - DNA, 557 bp, Heterodera glycines
  SCN-specific regions: Sequence locations=1-557
cactttcgccggtggagggggaattgccgaactgctgacaagaatacactccgtcttcgtccgcccttttctcgccgcccccttcggcgtcggccccttcctctgcaatcaaaggggggagcgatttgacctccgacgaaatgttcaccggggaaggcttttcccagcaaggcttgcttaattacgctgtcggattcttcaaaaaaggtcgtctttttttgttaccggtggacaaaaccttcgaaatgcgaaagcccttgcgggggaccattgagcgcgagtcgacggcgcgtaccaccgcattaaagccgtcttcgtccgtctcctccacttcgacacgttccgttgccgctgattctgctccttccggcactgcgtccgcttcgtcgtcttccgtcgctgttgccgcgccgttgcgcattcgctttgcacgtgccgaaaatgacttgcaacgacgccgccgagagcagtcgtccttctacaagcagaagctggtggagcaggaccagtggattccgctcaaagtggagcacagagatttgttggaaatgtacgaa

SEQ ID NO: 47936 - DNA, 523 bp, Heterodera glycines
  SCN-specific regions: Sequence locations=1-217,239-523
ttgcaaagtgaacgggatgcttttggatgggaagaaagtgtttgttggaaaatttttgccacgttccgctcgtgacagcaaattggtgatccgtccagtcgtttcaccaatgtttatgtgaagaattttggtgatgcaatgaattcggagaagctgagcgaattgttttcacagtttggcgaaatcatcagtgcaaaggtgatggaggatgacagcggcaagtccaaggggttcggcttcgtcgcttacaaggaccatgaaagtgctgcgagggcggtggagaagatgaacgaggtttcggtgcccggcagtgagaaggtcgagcaaaagtttacggtgtgccgtgcgcagaagaagagcgagcgccaggctgagctgaagcgtcgttacgagcagtacaaagctgagcgcatccagcgttatcagggagtcaatctgtacgtcaagaacctgcacgataccatcaatgatgagacacttcgaagcaattttgaatcctacggaaacatcacaagtgcaaatg

SEQ ID NO: 47937 - DNA, 556 bp, Heterodera glycines
  SCN-specific regions: Sequence locations=1-556
ctaaaaggttctttgcgcatgtttcgccttcgctttaaagaagcccctcaacgacccatttccgattgctgcgtggcgctcgcacccggccaacatggccaaaggtgtgaagttcgatcacgacaacgcgttcgtgcgattctgccgctactatctatggcattactgttggagtgggcgtcagtacggtcttcaattctacgaccaggcattcgaaccgcatcccgtagtccaagaggcacttcgccggctccgtcttaaggacccctaccagtacgaccttcgtctgcagcgtattcttttggccagtcaattgggctcaaagaatgagcgactgccgaagaacatgtggacaaaatgggacgacgagacattctatctgaacccgtattttaacgaaattgaggaggaaaagctggagcgtgaagccagcacgggcatgaagccgggataccaactcaaagagcagatttaggggacagacattgtgttgtgaacgattaggcgcggaggaaaagcacattgcgtttgttgatactgttgccggagagaaatt

SEQ ID NO: 47938 - DNA, 559 bp, Heterodera glycines
  SCN-specific regions: Sequence locations=1-482,504-559
caaaaagcccttcgaccacaaacagcttctgactttgttttgtcgacgaagtctacacttttggttcggaaatctcgtcacaatgaaatggtggtccgatctttggctcaaggagggttttgcttcattcacgcaatatttgttcaccgacaaaaactaccctgaatttaaaatttggtccgatttcgtcgacgcggaagtggtcagagcgatggctttggactctctgcgcagtacgcatccaatcgaggttcctattgataacccaaatgaacttgaagaaatttacgattcgatcacttacgcaaaatcaaattcaatcattcggatgctcttcaatcatttgggcgaagcgactttccaaaaggccattcgcgattacttgaaaaagcaccaatacgcaaatgcagagaccaacgacctgtggaagagtttgtccgacgcttctgggattgatgtcaaagcactgatgtcttcctggacccaacagatgggcttccctttggttactgtcgaggaaaaaattttggatggagaccgtattgaattgcacttaaaa

SEQ ID NO: 47939 - DNA, 634 bp, Heterodera glycines
  misc_feature (548)..(551): n is a, c, g, or t
  misc_feature (598)..(598): n is a, c, g, or t
  SCN-specific regions: Sequence locations=1-186,208-213,236-298,337 -551,631-634
tcatgagacggcgcgtgccatcaactatgccgttgaagcgtgccatccgctttctggagaatgtacgggagaagaaggagattgtgccgttccgccacttcaacggcggcgtgggacgcaaagcgcaggcgcaagcgtggggcacaacacagggacgttggccgaaaaagtccgccgagttccttctccaacttctcagaatgcggagagtaatgccgaggtgaagggcctggacgtcgaccatttggtcattgaccacatcgtcgtgcaagcggccgccaaaatgcgtcggcgcacttaccgcgcgcacgggcgcatcaatccgtacatgagttcgccgtgtcacatcgaagtgattctgaccgagaaaaaggacgtcgttgcgaagccggccggcgcattggtcaaagtgaagaaagagtcgaagaagaagcagcgacggcaattggcacgtggcgaattctgagtgacccgaggacatccccgaaccacactctctttgtgcggcttgttttgttatttggtggcgataaaatttgttgaacccnnnnaaaaaaaaaaaaaaaaaaaaaaaaaaaaaaaaaaaaaaaaaaaaaanggaaaaaaaaaaaaaaaaaaaaaaaaaaaaaagtcc

SEQ ID NO: 47940 - DNA, 744 bp, Heterodera glycines
  SCN-specific regions: Sequence locations=1-744
caaaattcttattgcaaattctccgatggaccaggacaaaataaaagttttcggaagcagaattcgagtggattcagtggcaaaaattgccgaattggaacaagcggaaaaagacaaaatgaagcagaaagtggagaatatttgcaatcacggcatcaatgtgttcatcaatcgtcagctcatttacaataccccgaacaattgttcgctgatcggaaagtgatggccatcgaacacgccgactttgagggcatcgaacgattggcacttgtattaggtggcgaaattgcttcaacatttgacagtccatcggaggtgaaattgggtagctgcaaactcattgaagaagtcaccgttggcgaagacactttgctccgcttttccggtgtcccgcttggcaatgcgtgttccgttgtgcttcgtgggtccacccagcaaatcattgatgaagcagaacgttcgttgcacgacgcgctttgtgtgctgagtacgcatgtgaaagaccaacgcgtggtgcccggggcgggcgcatcggaaatgctcatggcaatggcagtgatgggcgaaagtcaaaaggtggccgggaaggagtccatcgcaatggaagcattcgcacgggcactcgccaaattgcccacaatcatttgcgacaacgccggactggacagtgccgaaataatttcgcatgtgtgagccgaacacagcaaatggaatcgccaatttggcattgatgttgaaaatggt

SEQ ID NO: 47941 - DNA, 550 bp, Heterodera glycines
  misc_feature (500)..(500): n is a, c, g, or t
  SCN-specific regions: Sequence locations=1-550
acaaaagcccttcgaccacaaacagcttctgactttgtattgtcgcacgaagtctacacttttggttcggaaatctcgtcacaatgaaatggtggtccgatctttggctcaaggagggttttgcttcattcacgcaatatttgttcaccgacaaaaactaccctgaatttaaaatttggtccgatttcgtcgacgcggaagtggtcagagcgatggctttggactctctgcgcagtacgcatccaatcgaggttcctattgataacccaaatgaacttgaagaaatttacgattcgatcacttacgcaaaatcaaattcaatcattcggatgctcttcaatcatttgggcgaagcgactttccaaaaggccattcgcgattacttgaaaaagcaccaatacgcaaatgcagagaccaacgacctgtggaagagtttgtccgacgcttctgggattgatgtcaaagcactgatgtcttcctggacccaacagatgggcttncctttggttactgtcgaggaaaaaattttggatggagaccgtattgaatt

SEQ ID NO: 47942 - DNA, 630 bp, Heterodera glycines
  SCN-specific regions: Sequence locations=1-181,210-265,296-630
gacgcgaagaggtgttgcccaatggaagttgtgcctggtcggtgctgccatttttctctgttttgccttgctttacccgagcgtcttctcaccgatgctttccaatttgttcggcggcggtacccagcggcaacagccggcggccgcggaccgaccgatgcatccgtcgatgatggggccgaaccaacagcagcagcagcagagggaacgtgcccatcgccctcccccacaccatccaggcgcatccatgcgaatgccggacatgcacaaccaacagcagcaacaacaacagggcgggttttggagtggaaaaagcggtggttcgatggcatggatgttgcccttctacaccgttggcgttgtgtgctttttgctctacacattgttcaagtcgaagaccaaacggcaaaaacgacgtcgcgaccgaccgcttgaccttttgtatggcgacgacgacgacgatgaaggaacggaggacggcttggaatatggtgttcgtggtgcgaaactccgctcggtgcagcacagactgcgcaaaacggagcaggcgatggcggacattctcagccaattggagcaaatttcggcccattcaaaggacattaatgatgacgacacaaaagcagcgga

SEQ ID NO: 47943 - DNA, 647 bp, Heterodera glycines
  SCN-specific regions: Sequence locations=1-339,361-395,421-432,454-647
gatgatatggacgacctgaagtatgttgtggaattcgacttcctcggcaaagactccatccgctattacaaccgtgtgccggtggaaaagcaagtgttcaaaaatctgaagctttttatggaggagaaagacccgggggacgatttgttcgaccgattggatacgagttcgttgaaccaatacctgaatgaactgatggacggactgaccgcgaaagtgtttcgtacgtataacgcgtcgatcactctccaagaacagctggacaaactgacaaatccttccgattccgtccacgagaaaatgctttcctacaatcgtgcaaatcgtcaggtggccatcctttgtaaccatcaaagggcagtgccaaaaacgcacgaaaagtcgatggaaaatttggagaataaaataaaagagaagaagcaggagtacaaggagttgaaggatcagctgaagaagatcaaatcggtggacgagaaaatggcaaaaaaatacgaaagattgaaggaacagatcgccaaactgaacacacagcgcacggacaaggatgaaaacaaacaaattgcactgggaacctcaaaactgaactacttggatccgaggatttcggttgcatggtgcaaaaagaatgacgtgcccgttgagaaaat

SEQ ID NO: 47944 - DNA, 668 bp, Heterodera glycines
  SCN-specific regions: Sequence locations=1-171,193-668
atatggaatgccgaaggacgaattatgcacggagaatgccattatgctcaggcggttcaaccgtttcccattgatcatcgaccccagcggacaatccatcgaattcatttgcaaagagttttcccagcatctggcaaggaacatcaaaagggaggatcggtggcaacaacggttcaactgactagttttaatgataattcgttcagaaagaatcttgagtcagcgcttcgttttggcacaactttgcttgtgcaagatgttgagtcctatgatccgatcctcaatcctgtgttgaatagggaggttaagcgaactgacggacgtgtactgatcacaattggtgaccaagacattgacttgtctccagctttcaaaatatttctctttacgcgcgattcttcggttgaattcccggcggatgtgtgctcacgtgtaacttttgtgaactttacgataactcgtgctagtcttgaggcgcaatgccttcaccaagtgctgcgcagtgaacggccggacatcgacaagaaacgaaatgatcttctgaaattgcaaggagaatttgcagttcgactgcgacatcttgaaaaggctttgctaaacgcactgaacgagtgcaagggtaaaatactggacgatgactccgtgatcgcgacgctggagaaactgaa

SEQ ID NO: 47945 - DNA, 400 bp, Heterodera glycines
  SCN-specific regions: Sequence locations=1-400
aaaatgatactatcttcacttgactgctcgtctcgacactttgccaccgcatcagcggcggccaaatgggggccggctgttgagccaattcaggaaaaaactacgcttctgcccaatgggctctctgtggcgtcggtggaactgcagggcccaatttcccaattgatgtttgctttccgttccggtgcgcgctttgagcaacacgactaagccgggctgacccatcagttgcgcaacgcaatcggcaccgattcgattaattacttgggtgttcgccttttgtgggtgacgggtcaatcgggcgcaacgctgcaggccaaactctctaaggatttgatgttggtgcatatgtcggtgcctcgtacaatgtctcccgttgccatctccgttctcggcgact

SEQ ID NO: 47946 - DNA, 593 bp, Heterodera glycines
  SCN-specific regions: Sequence locations=1-373,395-593
tcccctcggatgcttctaagggccggaagttccaagggtttgaagagaattggtgatttgcccacggagacgtcgtttgtgcggttacaatggcgcggaatggtcgccacgtgttcaccggagggaaaggcgccgtcaaaatgtgggacatcggagagcgtattggccttgcttcgtctgtcggtggttccatttccccctcctcgtcgaccatcgccgatggaaccaatggccgagtgggcagtgccgagccgtggacacccgtgaacacttttccatgtctgaaggacagttacgtccgctcttgcaaactttttccggatgcatcaacgcttattgtgggtggagagacgaggaccatttgtgtgtgggatttaaacagtgaaaaggtgaaagccatgctcgactgcgatgctgaggcgtgctacgctttggccatttcggccgactgtcgcttgtgcttcgcctgctgttcgagcggttccattgtcatttgggacttacaaagtgaacaaaaagttgcccaactcgatggacacactgacggggcgagttgtgtggatttgaatggcgatgggttgcgactttggact

SEQ ID NO: 47947 - DNA, 670 bp, Heterodera glycines
  SCN-specific regions: Sequence locations=1-16,43-99,125-251,304 -309,331-332,367-541,563-670
ctacatggtcgacccgattgacgagtactgcgtccagcagctcaaagaatacgacgggaagaagttggtcagtgtgaccaaggaaggccttgagctgccagagagtgaggaggagaagaagaaatttgaagaggacaaggtcaagttcgagaagctgtgcaaagtcattaaggacatcttggacaagaaagtccaaaaggtttctgtctcaaaccgtttggtctcttctccgtgttgcattgtgaccggagagtacggatggtctgccaacatggaacggatcatgaaggcccaggcattgcgtgactcctccacaatgggatacatggcgtccaaaaagaacctggagatcaaccctgaccattcaatcatcaagtctttgcgcgaccgtgttgagaaggagcaggacgacaaaactgcaaaggacctcgttgtgctgctgtacgaaacttctctgctcacctccggcttttcattggaggacccgcaacagcatgcgtcgcgaatttaccgaatggtgaaacttggacttgacatccccgacgaggaggagccggccgagcaacagccgagcacttcgggcgagccgacaattgcggagaaaattgctggtgccgaagatgatgcctcgagaatggatgaagttgactgaatggtgacatcgtctatc

SEQ ID NO: 47948 - DNA, 485 bp, Heterodera glycines
  SCN-specific regions: Sequence locations=1-144,166-334,356-399,421-485
caaattgcagccgcatgaatttcaaggaggaacattcaccgtgtctaacttgggaatgtttggaagtgtcgaccattttacggccatcataaacccacctcagtcctgcattttggcaattggctctgcgcgtcgaatgctcgtccctatggaagaggaagacaaatcggatttttctaacgtttccgcgcattctcttcgctgaaagtaactttgagctgtgatcaccgagtggtggacggtgcagtgggcgccgtttggcttcagaatttcaagcagtttatggaagagccatttacgatgatcctttggggcacaccggggaatgtctttttaattgtttctcctcattctcggcccaattattaggcttccgtggttgactctctcctagcgatgacttacaataggataaaaataccttacaattagcgggtgaaaattgtcattgtttttgttagagtgaatgataaattataattttg

SEQ ID NO: 47949 - DNA, 732 bp, Heterodera glycines
  SCN-specific regions: Sequence locations=1-732
ggcattctctctcctctgtttttactttccttaaaagcggcaatgaccagtcgaattttgagctgcaatttgcgaaggtacttctccaagatgaaccaacacatcgagttcggcacaacgaagagcgcttcgtccgacaaacaatcgccgccttcccctacaaacaatcaaacgcaacacgagggaatgagtcaggaatgtcgggagcaaatcgagcagatggaaaggctgaagagcgacaacgaaatgctgaccgacaaatacaaaagaacacttgcggacatggaaaacttgcggaagagaacgcagcggcaaattgaggaggcaaaactttttgcaattcagccattttgcaaggatttgctggaggtggctgatgtgcttgacttggcgttgaattcgttggaaaaaatgaaaacggaggacggtgccgcctccttggacagtggagtgaacaaagggatcaaaatgacgaaggaagtgttgctgaagacgttcaaaaagcatgggcttgtaccggttcaacccgaaggacagaagttcgacccgaatttgcacgaagcggtgtatgaaataccgaaggaccagtcagataggcctgccggtcacattgcgcatgtgttgaacattgggtacagtttgcacgaccgtccgattcgaccagccaaagtgggcgttgtgaagatggaatgatggccaatgtcagcgtcattttgtgtctacgtgcctttg

SEQ ID NO: 47950 - DNA, 636 bp, Heterodera glycines
  SCN-specific regions: Sequence locations=1-152,178-192,216-252,279 -280,306-324,354-636
cattttcttccctttcctttgtcttccttcattccgcttttccctcccatttctaattgttcttctccgcttcttctctccccgatgaatcactttgggctgacttttctgttcgtcgccgtttctctgctggtaattgcgcccggctgcgatggcatgcaaattttcgtgaagacattgacgggcaaaacgatcactttggaggtggagagctcggacactgtggacaatgtgaaggagaagatccaagagaaggagggcattccgccggatcagcaacggctgatcttcgccggcaaacagctcgaggacggacgaacgttggccgactacaacatacagaaggagtccacgctccacttggtcctccgtctccggggcggaaatgggaagagaaacacgggtaagaacaagaaaagcaacaaaaagcttgatcagaattgatcagcagcgaacgcaccatcacatgattgattggcacagtgattttccaccaccaaattcacaacacttttcccttttccgggttatctttgatttccattttcggttattgttttctgtttttctcctctatcttttgtaaaattctgttactttgatctttagttttatcatttatcatcgcatatatag

SEQ ID NO: 47951 - DNA, 666 bp, Heterodera glycines
  SCN-specific regions: Sequence locations=1-9,31-363,385-666
tgtcggtggagtgatgacaaaactgatacctcgcaacactgtcattccgaccaaaaagtctcagatattttctaccgcggcggacaatcagccaactgtgactattcaggtcttcgaaggagaaaggccgatgacgaaagacaatcatttgttggggaaattcgacttgaccggcattcctcctgctccccgaggcgttcctcaaatcgaagtcacttttgagatcgatgtcaatggaattttgcacgtgactgccgaggacaaagggactggcaataagaacaaaattacgatcaccaatgatcacaaccgactgtcgccggaagagattgagcgaatgatcaacgacgcggaaaagttcgcagaggaggacaagaaaaccaaggaagtggtcgaagcgaggaacgagtttgagtcgtacgcctactcactgaagaaccagctcggagacagtgaaaagttgggaggaaaactcagtgcggaggacaaaacgaccatcgaaggagctgtggatgaggccatttcgtggttggactccaacaaggacgcgccacctgaggagcttaaggagcggaagaaggacctcgaggccaaagtgcagccgatcatcagcaaactctacgcagggcagtcgcctccgcccggcagcgaaccgccgccgactga

SEQ ID NO: 47952 - DNA, 672 bp, Heterodera glycines
  SCN-specific regions: Sequence locations=1-56,78-531,554-672
agcgcgttcctaattttgccatttctaagggtctttttcaagtcgaggatgtcttcgcctccttcctcagtccttccccaggatgttttcattctgtccgctgtgcgcactccgatcgcttcttttcgctcatcctttgccagccttaatgccgttgatttgggcactttcgttgctaccgaagcgatccaaagggccggcttaaggcctgaccaagtggaagagacggtgactggctgtgtgctcagcgctgggtcgggccaaaatgtgtcacgccaaatcgcgattaaatccggtatccccgaggcgaggcaggcgtacactgtgaacaaagtgtgctcttccagtcttaaggcattgattttgggtacccaatctgtgcagttgggacaacgttccatggttttggtggttggcgttgaaagtatgagtcaggcaccattttacttggcgcgtggtgacaacaattacggggatatcaaacttttggattccatccaacgcgatggcatttcggacgcaatgctcggccaaccgatgggtgtttgtgctgagaaaacggttgctgaatttggcttcacgcgtgagcagcatgacgcgtatgcactcgcctcctatgctcgtgcgactcgcgcgtgggcgggcggcgcttttggtgcggaaattgtgccg

SEQ ID NO: 47953 - DNA, 704 bp, Heterodera glycines
  SCN-specific regions: Sequence locations=1-165,191-205,229-293,319 -337,367-704
tcgccgctcctcattttcttctcctacctttgtcttccttcattccgcttttccctccccatttctcatttgttcttctccgcttcttctctccccgatgaatcactttgggctgacttttctgttcgtcgccgtttctctgctggtaattgcgcccggctgcgatggcatgcaaattttcgtgaagacattgacgggcaaaacgatcactttggaggtggagagctcggacactgtggacaatgtgaagacgaagatccaagagaaggagggcgttccgccggatcagcaacggctgatcttcgccggcaaacagctcgaggacggacgaacgttggccgactacaacatacagaaggagtccacgctccacttggtcctccgtctccggggcggaaatgggaagagaaacacgagtaagaacaagaaaagcaacaaaaagcttgatcagaattgatcagcagcgaacgcaccatcacatgattgattggcacagtgattttccaccaccaaattcacaacacttttcccttttccgggttatctttgatttccattttcggttattgttttctgtttttctcctctatcttttgtaaaattctgttactttgatccttagttttatcatttatcatcgcatatatagaagttatcatagtccacatttctgtccctttttatttatttttttgactataaaa

SEQ ID NO: 47954 - DNA, 569 bp, Heterodera glycines
  SCN-specific regions: Sequence locations=1-237,266-454,476-569
tttcccaagacagatggcacaagcggcgaaagactggggggaagcgaaaccccattcacaaaaaacgaaagttcgaaatgggacggccggcagcaaatactaagattggtcctaaacgaattcatttggtgcgttgtcgtggcgggaacattaaacatcgcggacttcgtcttgataccggaaactttgcttgggcttctgaagggtgcactcgcaaaacgcgtatcatcgacactatgtacaacgcttccaacaacgaattggtgcgcaccaaaacattggtcaagggaatgatcgtctcaatcgatgccattccgttccgccaatggtatgaagcgcattacgcactgccattggcgcgcaaaaagggacaaaagttgaccgaagatgaggaggcgcggattggaggagcacagaaacgctcaaagtcgactctgaagaaatacacggaacgccaaaaaaccgccggggtggagccgcatcttctggaacagttccaggccggacgacttctcgcttgcataagctcacgaccaggccaaagcggacgctgcgatgggtacattttg

SEQ ID NO: 47955 - DNA, 545 bp, Heterodera glycines
  SCN-specific regions: Sequence locations=1-545
catcccaaaaactgataaaaaaaatcggcgttcctctcccgtctctcctccttccaattcgccaatttcgctgcttgcagtttctttggccgttttggctttcgtcgctttggcatcggccaatccgccgacggcacgcgaaacggcgccaaatgcacagcaaaacaatgccaattcagtggcaactggggaaattgcgaaaaatattgcggaaaagatggagcggatgaatgagttcattaaggcgaagaagttcatcgatgcacataatttggcatttgagaagggcgaagtgtcgttcaaagttgcgccaaaccatctgatgcattttacacctgcccaatataatcgaattcgcggcttgcaaatgcgcagcaaccgacaacggcacaacatggcaactctggcgggaaacagcagtactttgccggaaaagttggactggcgcgagaaaggggcggtgaccgaggtcaaagatcagggggactgcggctcgtgttgggcattcagtgccaccggtgccattgagggagcattggcacaga

SEQ ID NO: 47956 - DNA, 593 bp, Heterodera glycines
  SCN-specific regions: Sequence locations=134-134,222-222,296-322,367 -593
gaattaaaaatgtgtattcgaaggtctacgatgtgccaagacgtccgttcgagaaagagcggcttgaccaggagttgaaattgatcggcgagttcggcctgcgcaacaagcgtgaggtgtggcgtgtcaagctgtcgttggccaaaattcggaagcgtgcccgtgagctgttgacgctggaggacaaggacccgaagcggttgtttgagggcaacgcgctgttgcgccgtttggtccgcatcggtgtgctggaggaggacaagatgaagctggattatgtgctcggcttgcgcgtcgaggacttcatggagcgtcggctgcaaacccaagtgttcaagctgggcttggccaagtccattcaccaggcccgtgtgttcatccgtcagcgccacattcgtgtccgtcgtcaagtggtcaacatcccatcatttgctgtccgtctcgactcccaaaagcacattgatctgtccgcaaagtcgccgtacgctggcggtcggcctggtcgtgtcaagcgaaagaatgcgaaaaagggtgccggaggcggcggctcgggtggcgaggaggaggactgatcaatgaaaaattgtttttgt

SEQ ID NO: 47957 - DNA, 706 bp, Heterodera glycines
  SCN-specific regions: Sequence locations=1-706
caccggcggtggcggacggaggaaaaataaaactctgttcggcatttcacaagcagtgcatgccgaacatcctcaacagcaattgtccgaattcgctggtggcatttcgcctgtcgacgccgtgccaatgccaaccgcggccaatgactgcaacaataattccatcgaagacattcaatcggaccgccgaaggggcccaattgatccgacaaacttcgaccatttggtccgtctgagtgagctcatccgttccatggccgaccttggcactttgcagcccgagttcggcataatctgtggctccggattgggcgcaattgccgaccaaatggagggggcgcggattttgcctttctccgaggtgcccggctttccacagccgagtgttattgggcacaaagggaatttggcgttcggtcggattggtggtcacttttgcatgtgtcttcagggccgtttccacccctacgaacacaaaatggacatggcattgtgtacgatgcccgtccgtctgatggcttttctcggcgttcgcacaatgatcgtctcaaacgcagccggcgcactgaacggcgacttccaaacgggcgacctaatggtcatcaaagatcacatctttctgcccggactgtccggttactctccgctgcttggcatttccgacccccgtttcggctcgcgttttgtctctcttcataatgcgtac

SEQ ID NO: 47958 - DNA, 580 bp, Heterodera glycines
  SCN-specific regions: Sequence locations=1-81,103-358,395-550
aaatggacaacagcaagcgataacgaagaagcgtaaagctgtgcaagccggaattttcaaggccgaattaaacaactttctcatgaaggagttggccgaggacggttattccggtgtcgaagtgcgtcgtgcaccttcccgtactgaagtgatcatcatggcgacgcgcacccaaagtgtgctcggcgagcgcggcaagcgcatccgcgaactgaccgcactcgtgcagaagcggtttggctattccgctggacaaattgagctctatgccgagaaagtgtccagccgtgggctttgcgcggtggcccaatgcgagtcattgcgttacaaattggtcggtgggctcgccgtgcgtcgtgcgtgctacggtgtgctgcgcttcatcatggaaagtaatgcccgtgggtgcgaaattgtggtcagcggcaagttgcgcggtcagcgtgccaaggcgatgaagtttgtggacggagtgatgatccattcgggtaacccggtcaccgagtacatccaagaggcggttcgccacgtgcaaatgcgacagggcgttttgggcatcaaagtgaagatcatgttgccg

SEQ ID NO: 47959 - DNA, 611 bp, Heterodera glycines
  SCN-specific regions: Sequence locations=1-611
ccttttctaatccttttctttctggggattgatctgcagaaattcgtgaattcagcttttacccaagacaccgaagagaaatattgtgtggaaaacattgaaagcgacgaaaaagttttaatggaacgaattcgcgacgcgaaagattgggcactgactaatgggctgacttttccggtgccaagaaggaaactgaaatgtgacgcatgtgacaaaatcaatgagaatgttgttttggacgacatggcacagtttgtgccctttacactttacccttcgccattcccacgcgaattgttcgaccaggcgatggatgtcaacaaaacccttcttttgatgtatttccgtgcgtcgttaccgtctaattttgaatttttgaaagaattgcataaaagtgttctggctgtgagtccgtcgctaagaagtactgctgatctaatcgaaagaaagcataaggagggcattcgacagccattgatgttgatttgcataagagcggattatatggccagcgaagaaattgatgaaaaaagcaatgagaaaaaatatgcgctaaaacagattgaattgaatggcggctcaattggcggctacggcactcctcagcccct

SEQ ID NO: 47960 - DNA, 548 bp, Heterodera glycines
  SCN-specific regions: Sequence locations=1-58,80-174,196-436,459-548
cagacaccatttatgacgaggatgaagttctatgtggcatgtggccgaacaattcggggaatttcactccgttggttggcggacctgagtatgtacactgtttgctgccgccacttgaaaatttggcgaacattgaggagactgtcgtgcgtgacaaagcggtggaatcgttgcaaaaaatagcagaaaaacacagtgcagctcaactcgaggaatatttcattccgatggttctgcgattgtcagctggtgattggtttacttcgcgcacctccgcttgcggattgttcagcgtggcatacgctcgtgccaatcctgctcaaaaaactgaattacgtgccgcattccggtgcctctgtcgcgacgatacaccgatggttcgccgtgctgccgcatccaaattgggcgactttgccaaagtgcaggaggaggactatttgaaaaatgaaatcacccaaatgtttgaggacttggccaaggacgaacaagactctgttcgactgctttcagttgaggctggcattgtgatcgttggtctgttgtccgaa

SEQ ID NO: 47961 - DNA, 690 bp, Heterodera glycines
  misc_feature (638)..(638): n is a, c, g, or t
  SCN-specific regions: Sequence locations=46-69,94-105,129-225,262 -474,496-507,530-560,583-690
gagactggtgttctcaagcctggaatggtggtcacttttgctccgcaaggcatttccactgaagtcaaatcagtggaaatgcaccacgagtccttgccagaagcgcttccaggagacaatgtgggcttcaacgtgaaaaacatctctgtgaaggacattcgccgtggttcggtcgcgtccgactcgaagaacgacccggcaaaggagaccaagagcttcacagctcaagtcatcatcatgaaccacccgggtcagatcgctgctggttatactcccgtgttggactgtcacaccgcgcacatcgcgtgcaaattcgccgaactcaaggagaaggttgaccgtcggtctggaaagaaagtggaggacaacccgaaggcgctgaaaaccggcgatgctgggatcgtcgatttgattccaaccaagccgatgtgtgtggaggcattcacggactacgctccgcttggtcgtttcgccgttcgtgacatgaggcaaaccgtcgctgtcggtgtgatcaaggcggtggagaagactgaaggcggtggaaaggttaccaagtcggcgcagaaggctgctgcccctggtgggaagaagaaatgagaaacgctgataattggaatggattcgatttttggatttgnttgtgtttttttggccgtggaataggcccgttaactttgggttttgttggat

SEQ ID NO: 47962 - DNA, 606 bp, Heterodera glycines
  SCN-specific regions: Sequence locations=1-361,384-606
ggcgctaatgagatgaacctgaggttgatgggaatgcctccacaattgagcagtattttaacaacaaatacggtcgtcgtctggactacccaaaccttcctttgattgcaatgaattcgagatttgccaatgagaagcgagtgaattactacccaatcgaggttttggacatcattgacaatcagcgagtcaccactcagcaacaaactccgacaatgattcagcagtcaatcaaaaagtgtgccattccaccattagtcttcaagcgtcaggttcacaacactgcgaagtctattcatctctgggacagtgaatatctagacgaggcagggattaaattgactaccgagccaattgccctcagagctcaccagctcaaccatcctgaagtcaaagctggcgacggtaacatgcagaggccgatggtggaaggttctgctgcttggcgaatcaacagtgcgctggtccctcaatcggtgtttgctgacggtacttacagttggatgttggcgtgctttgttcaacttggtggtcgcggtcttagcgagccagaccttcacaaatttatccaactgcttgaagaccaggcaaaaagacgaagcctta

SEQ ID NO: 47963 - DNA, 731 bp, Heterodera glycines
  SCN-specific regions: Sequence locations=1-83,107-498,523-731
attgtccttcgactacacatttaatctcacgaacggacgtgccctggtgcaacaatggcaaaggaggaatactgtttcgatgcaaaggcggcggcagcggcggggcaatctcgtcgtccttcgacaacggcatcagtacttgtgcaaggagatggccagtcaagcagatttgtggatgcgatcatcagaaaagtcacgcagccgcctcttcaacgcttcacggatgagatcaccgacgaggaactcaaacaactctgcaaggcggccacggacgtcttccggatgcagccgacgctcgtcaggatccgcccgccggtcgtcgtcgtcggagacatccacggacaattctcggatctgcagaggatcttcacaacgcatggccccccgccggagcagcagtacatgttcttgggcgactacgtcgacagaggagcacactcgatggagacaatcatccttctcttctgctacaagatcaagtacccatcgaacttcatgctgctgcgcgggaaccacgaatgctccaacatcaacaaagcttatggcttctacgaggagatcgaccgccgttacccgcgaccgggcgctcgtcgactcttcgacctcttcaatcaagtcttcgcctggatgccattcgtcggactgatcggcgagaagatcctctgcatgcacggcggcatctccgacaagatgcgcagcctcgatcaactcagcaccctgcgtcgacacac

SEQ ID NO: 47964 - DNA, 725 bp, Heterodera glycines
  SCN-specific regions: Sequence locations=1-725
acctgttttggacatcggtcgcacacgaccattgccgtgcccaacgcacaactgatcaaagcgccccttatcactggcgaaagtgcgcttttggctcccgtcctttaccgcggcattgcgctggtcgcggatgaactgggccctttgcaaatgattttgatgaccgcttcatccaccgcgtactcacataaccccaacaaaacggttgaagagcatccttcggctgttggcaagtcgacaattcttttgggagctttgcaggcccggaacaatgcccgtgtcattttgtccgggtctttggactttttttcgaacaaattttttactgcgacggtgaaccaagcggggggccacactgccaatgccgtaaaaagtgggaatcagcaattggctgcgtccgtcctcaaatggttgctcaaagagtccggagttttgcgcataaaatcagtgaaacatcacactgttggccaaaagtccccgcccgccgagtacacaattatggacgatgtgcgatatgaaattggcattgaggaattgcagaacggaaaatgggtgcccttccaaggcaaagatgttcagttggaatttgttcgaattgacccatttgtgcgcgtcactctgaaaaacaacaatggcaaattctcagctgaattaaaatccccgacgtttacggcgtgtacaaatttttggtggattaccaccgaatcggatacactcatttgact

SEQ ID NO: 47965 - DNA, 608 bp, Heterodera glycines
  SCN-specific regions: Sequence locations=1-269,291-608
acatgttgatgttcagcgattggcttgttgacattccaggactttgtccaccgagtggacaatgcttccgtcgccggtcggacgtcgcactttggttgtggccaacagaggcgaaacgcgagtgtacttcaaaaatgggcatttggccaccaatttccattcacttttgccgggaggaaatgccaaaacgaaaggttctctgaccattttggacgccatttttgacgcgaagaagcggaagttgtacctgcttgatttgctctggtggaacaagctgctgtacacggacatggaattcaccgcgcgtcgcttctttctccagtcgcgcattgacgaaatgaacgaggacattgagcggaaaaacagcagggccagcatcagcaaaaatcaggaacgaaatggttgcaaaattgcggagcaggacaaaatgtcgtcttccgaaatctcgccgtacgaaatgtcaccgccgagcgacacgtcgccggaacaaaacgccgtcgagccaaaatctcgccgtgacattaaatttgtgcctgtgccctcttgcgcttgttctccggacgaaattggccaatttatgcgcaccctttttccattccgtctcgacg

SEQ ID NO: 47966 - DNA, 696 bp, Heterodera glycines
  SCN-specific regions: Sequence locations=1-114,141-153,186-282,312 -312,354-354,402-444,495-617,639-696
gcgttcagcaccttcttctccgaaacaggcaatgggcgtcatgttccgcgtgcggttatggtcgacttggagccaacagtgatcgacgagatccgcactgggacttacaagcatctcttccaccctgaacagctcatcactggaaaagaagacgcggccaacaactacgctagaggacactacacagtcggcaaagaaatcatcgaccccgtcttggatcggattcgtcgcatcgcggataactgcaccggacttcaaggctttctcatcttccattcgttcggtggtggcactggctctgggttcacatcgctgcttatggaacgtctctctgttgactatgggaagaagtctaagctcgagttctccatctaccctgctcctcaagtgtccaccgctgtcgttgagccgtacaattcggtgcttactacgcacacgactctcgaacactctgactgtgcatttatggttgacaatgaggccatctacgatatttgtcgtcgaaatttggacgtggaacgcccttcttacaccaatttgaaccgtttgatttcgcaagttgtctcttcgataaccgcttcacttcgatttgatggtgctttgaatgtcgatctcactgaattccagaccaatcttgttccttatcctcgaattcactttcctcttgcgacttattctccagttatctcagctgag

SEQ ID NO: 47967 - DNA, 600 bp, Heterodera glycines
  SCN-specific regions: Sequence locations=1-600
ttagaaaaatggacaaaaagatgaaggaaatggagcagaaaacgacaaaaacaaaacggcgaaagaaagagaaagacacagaaaatggaggaacaaatcgggaaaagccaaaggacagtgaaaaggaaaatttggatggacgcatttcgaagagaaacaaaatgcaatcggaggaggcgacggtggacgccgaatgtgccgaattgcgggggaatgccaaagtgttcgtcgatgggaagggccgttgctacgacgtaatgctcagccaaacgaacattcagcagaacaacaacaaattctatctgatccaattgctgtgcaaccaaacggcggccaacaaattttgggtttggtttcggtggggccgcgtcggattcaaaggacagacgaatttggtgccttttgggacggactttgacggagcgttggaattatttcacagaaaattcactgacaaaacgcaaaatgatttcctaacggacattaaaaagttcaaaaaagtcgccggcaaatacgacctaatcaaaattgaccactcgcgagaagtgacgacggaaaccgaaagggacgcaaaagtgagaagaaaagttgcaaaaaccg

SEQ ID NO: 47968 - DNA, 551 bp, Heterodera glycines
  SCN-specific regions: Sequence locations=1-290,319-507,529-551
agaacttaatttgaggatacattgaaaatattaattagacttcaaaatgggtatttcccaagacagatggcacaagcggcgaaagactggggggaagcgaaaccccattcacaaaaaacgaaagttcgaaatgggacggccggcagcaaatactaagattggtcctaaacgaattcatttggtgcgttgtcgtggcgggaacattaaacatcgcggacttcgtcttgataccggaaactttgcttgggcttctgaagggtgcactcgcaaaacgcgtatcatcgacactatgtacaacgcttccaacaacgaattggtgcgcaccaaaacattggtcaagggaatgatcgtctcaatcgatgccattccgttccgccaatggtatgaagcgcattacgcactgccattggcgcgcaaaaagggacaaaagttgaccgaagatgaggaggcgcggattggaggagcacagaaacgctcaaagtcgactctgaagaaatacacggaacgccaaaaaaccgccggggtggagccgcatcttctggaacagttcc

SEQ ID NO: 47969 - DNA, 459 bp, Heterodera glycines
  SCN-specific regions: Sequence locations=146-146,200-200,234-234,308 -334,379-459
caatggtggggagaattaaaaatgtgtattcgaaggtctacgatgtgccaagacgtccgttcgagaaagagcggcttgaccaggagttgaaattgatcggcgagttcggcctgcgcaacaagcgtgaggtgtggcgtgtcaagctgtcgttggccaaaattcggaagcgtgcccgtgagctgttgacgctggaggacaacgacccgaagcggttgtttgagggcaacgcgctgttgcgccgtttggtccgcatcggtgtgctggaggaggacaagatgaagctggattatgtgctcggcttgcgcgtcgaggacttcatggagcgtcggctgcaaacccaagtgttcaagctgggcttggccaagtccattcaccaggcccgtgtgttcatccgtcagcgccacattcgtgtccgtcgttaagtggtcaacatcccatcatttgctgtccgtctcgact

SEQ ID NO: 47970 - DNA, 246 bp, Heterodera glycines
  SCN-specific regions: Sequence locations=1-77,99-204,241-246
acaaccggtgttgctcttgagcacgatggaccgtgcgctgctcgaacttagcttggccggaggaattgttccagacattccagcgcattgtggagaacatcaacgtgatcattgccacttacggagatgatgatggaccgatgggtccgatccaagtggacccgtccattggcaatgtcggctttggctctggacttcatggtcgggctttcacattgaagcagtttgcggagatgtacgctgaca

SEQ ID NO: 47971 - DNA, 630 bp, Heterodera glycines
  misc_feature (546)..(546): n is a, c, g, or t
  SCN-specific regions: Sequence locations=1-630
gccgattctcgtaataacaatggatccaccggcggtggcggacggaggaaaaataaactctgttcggcatttcacaagcagtgcatgccgaacatcctcaacagcaattgtccgaattcgctggtggcatttcgcctgtcgacgccgtgccaatgccaaccgcggccaatgactgcaacaataattccatcgaatacattcaatcggaccgccgaaggggcccaattgatccgacaaacttcgaccatttggtccgtctgagtgagctcatccgttccatggccgaccttggcactttgcagcccgagttcggcataatctgtggctccggattgggcgcaattgccgaccaaatggagggggcgcggattttgcctttctccgaggtgcccggctttccacagccgagtgttattgggcacaaagggaatttggcgttcggtcggattggtggtcacttttgcctgtgtcttcagggccgtttccacccctacgaacacaaaatggacatggcattgtgtacgatgcccgtccgtctgatggctnttctcggcgttcgcacaatgatcgtctcaaacgcagccggcgcactgaacggcgacttccaaacgggcgacctaatggtcatca

SEQ ID NO: 47972 - DNA, 379 bp, Heterodera glycines
  SCN-specific regions: Sequence locations=1-94,116-379
aagacgctaaaaaatggcacaacagcaagcgataacgaagaagcgtaaagctgtgcaagccggaattttcaagggccgaattaaacaactttctcatgaaggagttggccgaggacggttattccggtgtcgaagtgcgtcgtgcaccttcccgtactgaagtgatcatcatggcgacgcgcacccaaagtgtgctcggcgagcgcggcaagcgcatccgcgaactgaccgcactcgtgcagaagcggtttggctattccgctggacaaattgagctctatgccgagaaagtgttcagccgtgggctttgcgcggtggcccaatgcgagttattgcgttacaaattggtcggtgggctcgccgtgcgttgtgcgtgcta

SEQ ID NO: 47973 - DNA, 274 bp, Heterodera glycines
  misc_feature (2)..(2): n is a, c, g, or t
  SCN-specific regions: Sequence locations=1-41,64-102,124-218,240-274
cnttgggcgttgaacacacgcgcaaagaattttgattaatctccttacagacaccatttatgacgaggatgaagttctattggcattggccgaacaattggggaatttcactccgttggttggcggacctgagtatgtacactgtttgctgccgccacttgaaaatttggcgaacattgaggagactgtcgtgcgtgacaaagcggtggaatcgttgcaaaaaatagcataaaaacacagtgcagctcaactcgaggaatatttcattccgatg

SEQ ID NO: 47974 - DNA, 511 bp, Heterodera glycines
  SCN-specific regions: Sequence locations=1-42,88-111,136-147,171 -267,304-511
tttaagatcgggggcattgggacagtgccggttggccgcgtcgagactggtgttctcaagcctggaatggtggtcacttttgctccgcaaggcatttccactgaagtcaaatcagtggaaatgcaccacgagtccttgccagaagcgcttccaggagacaatgtgggcttcaacgtgaaaaacatctctgtgaaggacattcgccgtggttcggtcgcgtccgactcgaagaacgacccggcaaaggagaccaagagcttcacagctcaagtcatcatcatgaaccacccgggtcagatcgctgctggttatactcccgtgttggactgtcacaccgcgcacatcgcgtgcaaattcgccgaactcaaggagaaggttgaccgtcggtctggaaagaaagtggaggacaacccgaaggcgctgaaaaccggcgatgctgggatcgtcgatttgattccaaccaagccgatgtgtgtggaggcattcacggactacgctccgcttggtcgtt

SEQ ID NO: 47975 - DNA, 571 bp, Heterodera glycines
  SCN-specific regions: Sequence locations=22-381,404-571
taaggggctggaaagaaaaggcgctaatgagatgcaaattgaggttgatgggaatgcctccacaattgagcagtattttaacaacaaatacggtcgtcgtctggactacccaaaccttcctttgattgcaatgaattcgagatttgccaatgagaagcgagtgaattactacccaatcgaggttttggacatcattgacaatcagcgagtcaccactcagcaacaaactccgacaatgattcagcagtcaatcaaaaagtgtgccattccaccattagtcttcaagcgtcaggttcacaacactgcgaagtctattcatctctgggacagtgaatatctagacgaggcagggattaaattgactaccgagccaattgccctcagagctcaccagctcaaccatcctgaagtcaaagctggcgacggtaacatgcagaggccgatggtggaaggttctgctgcttggcgaatcaacagtgcgctggtccctcaatcggtgtttgctgacggtacttacagttggatgttggcgtgctttgttcaacttggtggtcgcggtcttagcgagcca

SEQ ID NO: 47976 - DNA, 517 bp, Heterodera glycines
  SCN-specific regions: Sequence locations=1-517
tgttttggacatgggccgacacgaccattgccgtgcccaacgcacaactgatcaaagcgccccttatcactggcgaaagtgcgcttttggctcccgtcctttaccgcggcattgcgctggtcgcggatgaactgggccctttgcaaatgattttgatgaccgcttcatccaccgcgtactcacataaccccatcataacggttgaagagcatccttcggctgttggcaagtcgacaattcttttgggagctttgcaggcccggaacaatgcccgtgtcattttgtccgggtctttggactttttttcgaacaaattttttactgcgacggtgaaccaagcggggggccacactgccaatgccgtaaaaagtgggaatcagcaattggctgcgtccgtcctcaaatggttgctcaaagagtccggagttctgcgcataaaatcagtgaaacatcacactgttggccaaaagtccccgcccgccgagtacacaattatggacgatgtgcgatatgaaat

SEQ ID NO: 47977 - DNA, 467 bp, Heterodera glycines
  SCN-specific regions: Sequence locations=1-282,304-467
aacccgtacaggacatgttgatgttcagcgattggcttgttgacattccaggcactttgtccaccgagtggacaatgcttccgtcgccggtcggacgtcgcactttggttgtggccaacagaggcgaaacgcgagtgtacttcaaaaatgggcatttggccaccaatttccattcacttttgccgggaggaaatgccaaaacgaaaggttctctgaccattttggacgccatttttgacgcgaagaagcggaagttgtacctgcttgatttgctctggtggaacaagctgctgtacacggacatggaattcaccgcgcgtcgcttctttctccagtcgcgcattgacgaaatgaacgatgacattgagcggaaaaacagcagggccagcatcagtaaaaatcaggaacgaaatggttgcaaaattgcggagcaggacaaaatgtcgtcttccgaaatctcgccgtac

SEQ ID NO: 47978 - DNA, 625 bp, Heterodera glycines
  SCN-specific regions: Sequence locations=1-137,164-176,209-305,335 -335,377-377,425-467,518-625
gcctccgaccaaacaaccagacgattcgttcagcaccttcttctcggaaacggcaatgggcgtcatgttccgcgtgcggttatggtcgacttggagccaacagtgatcgacgagatccgcactgggactacaagcatctcttccaccctgaacagctcatcactggaaaagaagacgcggccaacaactacgctagaggacactacacagtcggcaaagaaatcatcgaccccgtcttggatcggattcgtcgcatcgcggataactgcaccggacttcaaggctttctcatcttccattcgttcggtggtggcactggctctgggttcacatcgctgcttatggaacgtctctctgttgactatgggaagaagtctaagctcgagttctccatctaccctgctcctcaagtgtccaccgctgtcgttgagccgtacaattcggtgcttactacgcacacgactctcgaacactctgactgtgcatttatggttgacaatgaggccatctacgatatttgtcgtcgaaatttggacgtggaacgcccttcttacaccaatttgaaccgtttgatttcgcaagttgtctcttcgataaccgcttcacttcgatttgatggtgctct

SEQ ID NO: 47979 - DNA, 545 bp, Heterodera glycines
  SCN-specific regions: Sequence locations=1-14,53-545
tctttttggcacttcctcccccactttttctgccttctcccccactttcttccgccaatgctctcatcgtccccaaaggaatttgttgcgcctgtgggagaggtgcatgcgtttgtggtcaaatgtatgcaaagtgtcggcacttcggcggcgcacgccgcgcaattggcggaccttttgttggatgccgacatcgttggccattacagtcatggccttaaccgcctttgcatttacattgaggacgtcgcctcgggcgtaaaaggcgacggtgaaccgaaggtgctcaagcagaagggtgccaccgcttgggtggacgggtgcgatttgcttggcgccgtcgtcggtaatttctgcacagaattggccataaagttggccaaagagcacggcatcggctgggtggtgtgcaagcggtcgaatcattacggcatttgccaacattatgccaaaaagatagcaaatgccggcttgttgggactgtcgttcaccaacacttcgcccatcattttccccactcgctcttcccaaattggccttggcac

SEQ ID NO: 47980 - DNA, 551 bp, Heterodera glycines
  SCN-specific regions: Sequence locations=1-551
attgtgggatatatgcaggctcccccagccgaagtctttcccgtttttttcggcgaaatggaccttcaagggaacacgcaggcgacggttctgcaccaaattggcaactttcgtggcaaatttcaaggccaaatccagcaaaacatgttggcagccgctcaattttcactggagcaccgtggacgactttccacgtacggattgacatttgccaacccgtcggtgagtgccaacaattgccagggcactttggttgcgcaaatgttgcggcgtgtcaccaaaaatctcgaccttggcgccgaatacatttaccatagggacgaacggtttcctggcaaacagtcgaacactctcagctacgccttgcgctacattcagcccacttggatattttcgggaactcttgcgccaaccgaactccatttgtgttactaccacaaacagagtgaacacttgcagttcggcgttgaatttgaggcgaatttcaagcttcaggaggtgaacacgaccttcgcctatcaaattgaagtgcccgactctctgactctgag

SEQ ID NO: 47981 - DNA, 493 bp, Heterodera glycines
  SCN-specific regions: Sequence locations=1-228,259-493
tcacactcgtcaaagtaatcttcgggagtgcatagggtcaaattcaaaaacgaattggaacgaaacatcactatcaaattgggctatgcaaatgcaaagatctttcgttgctccaatatcaaatgtccccggccgcattgctacaggtctgctgggtccagcactcccgaccgtttcccatgtgaacggcccaattgcggtggtgactttgtgtgtgttcgccatgtttctttcgtcgactgtcctggccacgacattctgatggccacgatgcttaatggtgctgctgtcatggatgctgcgcttcttctggtggccggcaatgagccgtgccctcagccgcaaacttcggagcatttggctgctgtggagataatgaagcttaaacaccttctgatcctgcaaaacaagattgaccttatcaacgagtctcaagcaaaggaccagcatgatcagatcaagagttttgtggaaggcactgtcgccgactcgg

SEQ ID NO: 47982 - DNA, 378 bp, Heterodera glycines
  misc_feature (15)..(15): n is a, c, g, or t
  misc_feature (50)..(50): n is a, c, g, or t
  SCN-specific regions: Sequence locations=40-357
ggggggggggggggngtggggggggcgggaaggggcgggcggacgcggcncggcctcgaataactgcgagggcgggggcgattcccaacgagggttcggtgccaggcagtgataaggtcgagcaaaagtttacggtgtgccgtgcgcagaagaagagcgagcgccaggctgagctgaagcgtcgttacgagcagtacaaagctgagcgcatccagcgttatcggggagtcaatctgtacgtcgagaacctgcacgataccatcaatgatgagacacttcgaagcaattttgaatcctacggaaacatcacaagcgcaaaggttatgtgtgatgagcatggtcgctccaaaggattcggttttgtgtgctttgaaaagg

SEQ ID NO: 47983 - DNA, 311 bp, Heterodera glycines
  misc_feature (211)..(211): n is a, c, g, or t
  misc_feature (217)..(219): n is a, c, g, or t
  SCN-specific regions: Sequence locations=1-74,101-110,137-169,192-311
ccattctgaacggtgactgtggcgtttcaacgtcgacggctgttaaatcgcagcaaatcaatgagatgacgagtaaagactactactttgactcatacgcacattttggaattcacgaggaaatgttgaaagacgaagttcggacggtgacttatcggaacgcaatttaccacaaccgtcacctcttcaagaacaaagtggtgatggacgntcggtnnntccgggacgggtattctttcgatgtttgctgctcgcgccggggcaaagaaagtttttgcggtggaatactcgaaaatggccacccaatcgaa

SEQ ID NO: 47984 - DNA, 627 bp, Heterodera glycines
  SCN-specific regions: Sequence locations=1-11,41-489,512-627
taattcttcgacaccaactacaacaacaacagcagcacattgacaacgacttggtgtcgcagagccccgggacgctgtcggaggagcgttttgcgagcgactacgaactggtgtcgctgagccctgggacacgagtgtgcggccgatggaccatcatcaaagagcttggacagggcgcgtttggcaccgtcttcttgtgcaaggacaccaccaccgggcgacaggcggcgatgaaaacggagtcagcagacgcggaaccattcctttggcaggaggctgcaatcatgcgaagcgtgcacagtcgaggggcccaggcacggagcatttttgtcgctgttttgacgagggcaaggacatccaacgggacgcaaaacgcgggacattggtctcgttcaactacattgtgatgtcgctgattggacgtgggctatttggactcctgagcaaggcgaacgacaaattcagtcccgggacagcgattggcgtgtccatccagctgctgcaggcactgaagaccctgcacaacatcggctaccttcatctggatgtcaaaccggagaatgccgtcattggacgacgggaaaagcaatgagcgccaactgatcttcttaatcgactttggacttg

SEQ ID NO: 47985 - DNA, 531 bp, Heterodera glycines
  SCN-specific regions: Sequence locations=47-375,397-531
ggggggggggggggggggggggggaggggaggggccggggggggggaccttgcaatgactttgagtcgtcctcaaaaggcaccgacgaattgagtccttctgggcccgaattaggagccgcggaaaagcaccggaagtaattgcccgcacagtcgcgtcaatgcctcccgaaaaaatgttcgaattgatgcgatccatgaaggaaacggtgaacaacaatccgcaaatggcgcgccaacttttgatggaaaatccgcagctgtcgtatgcattgctgcaggctcaagttgtgatgcgagtggtggacccgaagattgcctaccaaatgcttcatcgtgaacatgctcagccgcttgtaccgccgacttccatccccactcatatccctcaacaatttgctggcaaaccccctcaattgcctcccgaattcaacgtacctccgccctccgtcccctctcatcagtttcaaatgcaacctcctcccttggtgccaggccaatttcaccacggatttccatccatgggcatgga

SEQ ID NO: 47986 - DNA, 682 bp, Heterodera glycines
  misc_feature (614)..(614): n is a, c, g, or t
  misc_feature (639)..(639): n is a, c, g, or t
  SCN-specific regions: Sequence locations=1-246,293-409,451-682
atagcgagtcttcacgcaaggagtggacaaggagaagcagttcttgaagttcttcgccatgaatttggcttcgggcggtgccgctggcgccacttcgctgtgttttgtgtaccctttggactttgcgcgaacgcgtttggcagcggatgttggaaaggccgatgcccgtgagttcaaaggtttggcggactgcatcatgaaaatcctcaagtcggacggtcccatcggtctctaccgcggcttcttcgtctccgtccagggcatcatcatttaccgcgccgcttacttcggctgcttcgacaccgccaaaatgctcttctccccggagggcaagcagatgaacttcttcgtcaactgggccattgcgcaggtcgtcaccgtgtcgtccggcgttctctcctacccgtgggacaccgtccgtcgtcgtatgatgatgcagtcaggccgcaaggacatcatgtacaagaacactttggactgtgccatcaaaatcatcaaaaacgagggactgctcaagggcatgttcaagggtgctttatccaatgtgttccgtggtactggcggtgcccttgttcttgcgttctacgacgaaatccagaaatatatccactganttgtgtgtgatcttcttagtatatnttgttttgtgttgcgtcatattcggtcatttgggtaatgataa

SEQ ID NO: 47987 - DNA, 564 bp, Heterodera glycines
  misc_feature (26)..(26): n is a, c, g, or t
  SCN-specific regions: Sequence locations=1-564
tgaagatctgatcaaccttacaaaangaggcggttaaattgcccgactctgagcagcatcgaccggacgacgccgtgtccattataaacagtgcattcagcaacagaaaatcgttcagctgtccaaaaactaaaagcgaccttctaaccggcacttcgacggcaaatttaagtcccgaggacattggcattatcgcatcaatgggcgactcattggccaccggtgccgggctttggccgcggacggacatcgaattccgcggtgccgcctttcccattgttggtgatgcgacaattgatggtctcgtcaccgtccccaacattctgcgcgagtttatcgactccaatttgctcttcggagtttctcacggaatgggccaacgcgaccaattgcccgaaaaccaactgaatgtggcagtcagtggggcgagcagttcttcgatgcctggacaggccgtcgaattggtgagacggatgaagcgacttcgggaattggatgtgttcaacacttgggctttgattattgtcaccattggaaccgaagaggtctgcaaaaattgcacgg

SEQ ID NO: 47988 - DNA, 689 bp, Heterodera glycines
  SCN-specific regions: Sequence locations=1-689
tcccgcatttgtcaattattcgaaacccgcaaggcccaactttcgcacttcagagttgaaaaatattcgttggcacgcgacgtgctctctgtgcagaagagaccggtcatctacgaagaactgttccaacacgcgcctttggtggtgatgaatgggttttccagtgaagacggcagcaaaaaaacatttacaattggtgcagacggtggtgcagaatatgttcccttccatcgacgtggacagagtgaaactcgcgtccattcgtcgcactttgctattaaactacgacacagaggacggactgatggagttcagacaatactccataaagtcagtgcccgcgggcgtttctcgttcggccaaaaaactgatgcagagcaaagtcccagacctgtccaagtacaaagacatcagtgacttcatgctcaaaccggagcagttgagtgacagcgaatttgaaggcgaacagacggaattggagctcacgcaggatattggcggacggggcaaaaaacgaggacagcaaaccaaattgaggttgatggaaattggaccacggatgacattacgtttgatgaaaattgaggaaggcgtcaacgcgggcactgctctttggacacactcttcaacttaacatcagattcatattccaaacacgtttattttgtttttatgcaagtgcgagaacc

SEQ ID NO: 47989 - DNA, 438 bp, Heterodera glycines
  SCN-specific regions: Sequence locations=1-250,272-417
cacataattcaatgttggaagttgttctggaatatttgccatcgtggattcgcactcttaattcgttcatcgattatgagggtcagcgtaagtctgaacgtttttttccaggttattttgattgtccacggtgtgcttgggttttttgctggttatctcactcaacagctgtcggtgactatgtacagcgtcggagttggatttctgacctcttgtctgattgtgcttcccccttggccgttttaccgtcagaaccctttgaattggcaaccaaatagtccggtagaggaagacaaagctgcgaatccgtcatcatcatccggcaataagaattcaaaaaagactcgttgagtgtgatcataattcgatacggtttccttgtacactttcttattgttgataaaccgcttctgttgcaaaaaaaaaaaaaaaaaaaaa

SEQ ID NO: 47990 - DNA, 578 bp, Heterodera glycines
  SCN-specific regions: Sequence locations=1-312,339-578
tgttatgggcttgtggcgcgcacccctcagccggtcactgcttgcactcaaagcgatgttgagattaaagtgcacaaatttttcattgtctcgcaagcagagcctcggcttccgcttcaacttgaagacgcggttcggcccgacaacgaccaagaggaattggccgtagtcaaattggacactcgtttggacaacagagtgctcgacttgcgaacgccaacgagtcaggcaattttccgtttgcagggcggagtttgcgacgcctttcgcaagattttgtcctctcgcggtttcatggaaattcacactcccaaaatcatttctgctgccagtgaaggcggtgcaaacgtttttgaggtttcttacttcaaaggccatgcttttctggctcagtcgcctcaactttacaaacaaatggcaattgctggtgactttggccgcgtgtttaccattggctccgtttttcgggctgaagacagtaatacgcatcgtcatttgaccgagtttattggccttgatcttgagatggctttcaatttccattaccacgaagttcttcaaactattgctgagatgtt

SEQ ID NO: 47991 - DNA, 400 bp, Heterodera glycines
  SCN-specific regions: Sequence locations=1-400
ctgtggttgggtgactccattctgaaggtgctcgccgaaaacactacgaaccggacctgaagctgaacttgcgttttgaaattgaagtgctctgcagggagctgaacgttaacctgagaagcattgaggttggcggctacctgaaggagcagcgacgtttgcccagattggtgccgccctccaaacttggcacagccgcagcatcttcaacattggcacaatgtcagttgccgccaatccaaccaccgcacattggcgctgggatttcgtcacacagcacggcagattatacgccaactgacatagcgaacatcctcgctgaaatgagcatctcccggaaatattcaccggccagttatacgcccggcggatcgcaacaacaagtttcatcaataacagc

SEQ ID NO: 47992 - DNA, 427 bp, Heterodera glycines
  SCN-specific regions: Sequence locations=1-427
cctcgaagacattcaatcggaccgtcgaaggggcccaattgatccgacaaacttcgaccatttggtccgtctgagtgagctcatccgttccatggccgaccttggcactttgcagcccgagttcggcacaatctgtggctccggattgggcgcaattgccgaccaaatggagggggcgcggattttgcctttctccgaggtgcccggctttccacagccgagtgttattgggcacaaagggaatttggtgttcggtcggattggtggtcacttttgcatgtgtcttcagggccgtttccacccctacgaacacaaaatggacatggcattgtgtacgatgcccgtccgtctgatggcttttctcggcgttcgcacaatgatcgtctcaaacgcagccggcgcactgaacggcgacttccaaacgggc

SEQ ID NO: 47993 - DNA, 664 bp, Heterodera glycines
  SCN-specific regions: Sequence locations=1-26,50-242,266-569,591 -625,647-664
acatgctgtctattttcttgcagaatatggcacgaaccaagcaaacagcccgcaaaacccaatcccaaaaaggcttttcgtcgagcagtggcagccaacacatgcagagtcaactgcacaacttgagaaaacagttggctacgaagcgtcccaacccaaaacgagggatcggatacaaagaattgcctcctgttaaaatagcccaaaaacgtcatcataagaaaggagcattggcacttaaagagatccgcaagtaccagaagagtgtgaatctgctcatcccgcgccgtcctttcatgcgtttggtccgcgaagtcacccaggacatgtcgcagtcgaccgacctgcgctggcagggcttggcactgctggcgattcaggaggccgccgaactgtacttggtctcattgttcgacgacaccaatctttgcgccatccatgccagtcgagtgaccataatgccgaaggacatgcaactcgtgcgcaaaattcgtggagagacttttcttaagccgttgtcctcgcagtactgatcgaagaaaatggtggtggttgatttcatagtcgatgacaatttgaatatgatatttttcgcaaatctcttttgtattctcgacccattccattttcactattatcctactttgtccaaaccccaaaatct

SEQ ID NO: 47994 - DNA, 729 bp, Heterodera glycines
  SCN-specific regions: Sequence locations=1-133,157-304,328-333,356-729
gattgtcactgccctcttccaattgaaaagaatggacgagccgcttctgcaggaaaacccaaatcgttttgtcattttccccatcaaataccatgacatatggcaattttacaagaaggcagttgcttcattttggacagttgaggaggttgatttgtcaaaggatatttccgattggaaaagcttaactgataatgagcgattttttatttctcgagtacttgcattcttcgcagcttctgatgggattgtcaacgaaaatttagtggagcgctttgctcaagaagttcaagttccagaggctcgctgtttttatggtttccaaatagccattgaaaacattcattctgaaatgtattcgctgttgattaactcttacgttaaggatttggaggaacgtgctaagctttttaatgccattttcgagttcgaatttatcaaaaagaaggccgactgggcccttcgttggatcgcaagttccgaagcgtcttttgcggagagactcgttgcatttgctgcggttggggggattttcttctcggggagttttgctgcaattttttggcttaaaaaacgaggccttttgcccggtctgacgcacagcaacgaattaatttcgcgtgacgaaggtttacaccgtgactttgcctgtcttctctacacccacctcaaaaacacgccacccaaagaacgcatctacgaaatcatctcggacgcggtaaaaattga

SEQ ID NO: 47995 - DNA, 735 bp, Heterodera glycines
  SCN-specific regions: Sequence locations=1-318,340-483,511-735
tgactttgactcgtttcaaaatcccgccgacgaattgagtccttatcggcccgaattggagccgggaaaagcaccggaagtaattgcccgcacagtcgcgtcaatgcctcccgaaaaaatgttcgaattgatgcgatccatgaaggaaacggtgaacaacaatccgcaaatggcgcgccaacttttgatggaaaatccgcagctgtcgtatgcattgctgcaggctcaagttgtgatgcgagtggtggacccgaagattgcctaccaaatgcttcatcgtgaacatgctcagccgcttgtaccgccgacttccatccccactcatatccctcaacaatttgctggcaaaccccctcaattgcctccccaattcaacatacctccgccctccgtcccctctcatcagtttcaaatgcaacctcctcccttggtgccaggccaatttcaccacggatttccatccatgggcatggctccgccttcgctactgcaacagcagcagcaacagacgccttttacacaacaaaagccgacacccatcgctcctttggcagtgcctccggcagcgaccgctccgcaacagcagcaggctgttactccacctccgcttagccaacaagcacagcaaagcaacagcgacaatttggacgaggagcagcaggcgcaaatgcttatccgcgtgctgcaactcaccgatgagcaaattcgtatgttaccacccactgaacgtgccca

SEQ ID NO: 47996 - DNA, 690 bp, Heterodera glycines
  SCN-specific regions: Sequence locations=1-61,83-638,661-690
ggccatgctttcgccaattcctaaaagaattggagggataaacattggtgcggatgcgcagaaagaaaattttgcgctgaatgaattggtcagtgagggcgacttgcgcgagtgccttttgctcgcggggggcgacgggactgacacggacgactcacagatggcctatgggttggccggagaattgcttaaggcggttcgaaatgaagccgaacagcgcatttcggcgcgcatggcattggaggacaaagacaaagcggacctttaccagaacatcacaaagttgaagtcccaattggccataaaacgtgaacaagtctcatctctccgttctgttcttcgttccaacaaaagttcgaccgaaagtgtgctccaatgtttgcgggaaaaatttgagtccgaatttcgactgaaagacgaggccaacgaagtgttgcgcaaccaactcaagcagttcaaagaggacgccgccactttcgcctctcatcgcgcgactttcactgcacgctccgaggagttacagcagcaagtggaaagtctgcaggactcattgaaaatggcggaggaagagaagaaaactatcaatcagctgctcagaatgagcatacaacagaaattggcactcactcagcgattggaggagttggagatggacagggaacgacagatgcaacaagccaacagccgaag

SEQ ID NO: 47997 - DNA, 645 bp, Heterodera glycines
  SCN-specific regions: Sequence locations=1-36,79-645
gattgtcctttcgtccctttcttttccttccgccctctttttggccacttcctccccactttttctgccttctccccactttcttccgccatgctctatcgtccccaaaggaatttgttgcgcctgtgggagaggtgcatgcgtttgtggtcaaatgtatgcaaagtgtcggcacttcggcggcgcacgccgcgcaattggcggaccttttgttggatgccgacatcgttggccattacagtcatggccttaaccgcctttgcatttacattgaggacgtcgcctcgggcgtaaaaggcgacggtgaaccgaaggtgctcaagcagaagggtgccaccgcttgggtggacgggtgcgatttgcttggcgccgtcgtcggtaatttctgcacagaattggccataaagttggccaaagagcacggcatcggctgggtggtgtgcaagcggtcgaatcattacggcatttgccaacattatgccaaaaagatagcaaatgccggcttgttgggactgtcgttcaccaacacttcgcccatcattttccccactcgctcttcccaaattggccttggcaccaacccaatcagttgttgtgccaattcacgcgaaaaaggcgacggattcatttttgacatggcggcgt

SEQ ID NO: 47998 - DNA, 561 bp, Heterodera glycines
  SCN-specific regions: Sequence locations=1-561
tcggcgcgaccatgtgggattatgcaggcgaccccagccgaagtctttcccgtttttttcggcgaaatggaccttcaagggaacacgcaggcgacggttctgcaccaaattggcaactttcgtggcaaatttcaaggccaaatccagcaaaacatgttggcagccgctcaattttcactggagcaccgtggacgactttccacgtacggattgacatttgccaacccgtcggtgagtgccaacaattgccagggcactttggttgcgcaaatgttgcggcgtgtcaccaaaaatctcgaccttggcgccgaatacatttaccatagggacgaacggtttcctggcaaacagtcgaacactctcagctacgccttgcgctacattcagcccacttggatattttcgggaactcttgcgccaaccgaactccatttgtgttactaccacaaacagagtgaacacttgcagttcggcgttgaatttgaggcgaatttcaagcttcaggaggtgaacacgaccttcgcctatcaaattgaagtgcccgactctctgactctgagg

SEQ ID NO: 47999 - DNA, 583 bp, Heterodera glycines
  SCN-specific regions: Sequence locations=1-217,248-583
caaagcaatttcgggagtgcatagggtcaaattcaaaaacgaattggaacgaaacatcactatcaaattgggctatgcaaatgcaaagatctttcgttgctccaatatcaaatgtccccggccgcattgctacaggtctgctgggtccagcactcccgaccgtttcccatgtgaacggcccaattgcggtggtgactttgtgtgtgttcgccatgtttctttcgtcgactgtcctggccacgacattctgatggccacgatgcttaatggtgctgctgtcatggatgctgcgcttcttctggtggccggcaatgagccgtgccctcagccgcaaacttcggagcatttggctgctgtggagataatgaagcttaaacaccttctgatcctgcaaaacaagattgaccttatcaacgagtctcaagcaaaggaccagcatgatcagatcaagagttttgtggaaggcactgtcgccgactcggcccccataattccgatttctgcccaacttaaatacaacatcgacgtcatttgtgagtatttgtgtaagaaagtgcccattcctccgcgtgacttctcttct

SEQ ID NO: 48000 - DNA, 578 bp, Heterodera glycines
  SCN-specific regions: Sequence locations=1-142,164-164,187-195,222 -278,304-430,483-488,510-511,546-578
ctctagactttctgcggtactacacttcggcctccggcgaggaacctgcagcttcaggactatgtttcgcgcatgaaagagaaccaaacatgtatctattacatcaccggcgagtccaaggacgttgtccaaaactcctccttcgtggagcgtgtgaagaagcgcggcttcgaggtcatctacatggtcgacccgattgacgagtactgcgtccagcagctcaaagaatacgacgggaagaagttggtcagtgtgaccaaggaaggccttgagctgccagagagtgaggaggagaagaagaaatttgaagaggacaaggtcaagttcgagaagctgtgcaaagtcattaaggacatcttggacaagaaagtccaaaaggtttctgtctcaaaccgtttggtctcttctccgtgttgcattgtgaccggagagtacggatggtctgccaacatggaacggatcatgaaggcccaggcattgcgtgactcctccacaatgggatacatggcgtccaaaaagaacctggagatcaaccctgaccattcaatcatcaagtctttgcgcgaccgtgttgagaa

SEQ ID NO: 48001 - DNA, 475 bp, Heterodera glycines
  SCN-specific regions: Sequence locations=1-290,312-475
cagggcggtggagaagatgcacgaggtttcggtgccaggcagtgagaaggtcgagcaaaagtttacggtgtgccgtgcgcagaagaagagcgagcgccaggctgagctgaagcgtcgttacgagcagtacaaagctgagcgcatccagcgttatcggggagtcaatctgtacgtcaagaacctgcacgataccatcaatgatgagacacttcgaagcaattttgaatcctacggaaacatcacaagtgcaaaggttatgtgtgatgagcatggtcgctccaaaggattcggttttgtgtgctttgaaaaggcggatgaagcaaccaacgctgttgtggaaatgaacaacaaaatcatcgaaaacaagccgctttacgtcgcgcttgcgcaacgtaaggaagaccgcaaagctcaactggcctcgcagtacatgcagcgcttagccgcgatgcgcatgcagaaccctgctggcctc

SEQ ID NO: 48002 - DNA, 709 bp, Heterodera glycines
  SCN-specific regions: Sequence locations=1-122,149-158,185-217,240 -486,537-629,660-709
cttaagaggaagtttataatacaaatatattttgaatgagccaaacacacattctgaacggtgactgtggcgtttcaacgtcgacggctgttaaatcgcagcaaatcaatgagatgacgagtaaagactactactttgactcatacgcacattttggaattcacgaggaaatgttgaaagacgaagttcggacggtgacttatcggaacgcaatttaccacaaccgtcacctcttcaagaacaaagtggtgatggacgtcggttccgggacgggtattctttcgatgtttgctgctcgcgccggggcaaagaaagtttttgcggtggaatactcgaaaatggccacccaatcgaaaaaaatcatcaaagacaatcagatggacggagtcattgaggtcatccacagcaaaattgaggacattgagcaattgccaggcggaattgaacatgtcgacgtcattgtttccgagtggatgggctactgcttgttctacgagtccatgctcaacactgtgatctatgccagagacaaatggttggcatccgacggcattctcttcccggacaaagccacgctgtttttgtgtgccattgaagaccgtcagtacaaagatgagaagataaactggtgggataacgtgtacggcttcaacatgtccagcattcgtcagcttgccattactgagccgttggtcgatgtggttgaccg

SEQ ID NO: 48003 - DNA, 634 bp, Heterodera glycines
  SCN-specific regions: Sequence locations=1-634
aggaatcgttaagtacatgcgaggacaagccggacccagctcgaaagaactcaaaagcatcagtgactttgacaaatttgtggatggcgatgacgttagcgttattgggctgtttgaaggagaaagcaagctgaaggactcctttcataaagtggccgacaccgagcgtgaccgtttccgctttgcgcattcctctaacccggatttgctgaagaaaaccggatacaccgacgacattgtggtgtttgtctcgaagaagttgcacaacaaattcgaaccgaacgaatttcattacgatggcaattatgacacggacaaaatcaaaaacttcctcctctacgaaaccaatgggttggctggaattcggacccaaggaaatctcttccaatttacgcatcgtccattggttgttgtttactacaccgtggactacttgaaggacccgaagggttctaactactggcgaaaccgtgtgctcaaagttgcgcaggattacaagcgcaaagtgcactttgccgtcagcgacaaggaggaattcgctcaggaagttgaacaaaatggccttgcggaccgtaaggaaagcgacaaaccgttggtggcggcaatcactgtcgatggaaagtacccaatgaac

SEQ ID NO: 48004 - DNA, 453 bp, Heterodera glycines
  SCN-specific regions: Sequence locations=1-35,73-109,142-160,182 -203,295-324
acatgtgcgacgaagaagttgcggttctcgtggtggaaacggctccggcatgtgcaaggctggtttcgctggcgatgacgcgccccgtgcggtgttcccgtcaattgtgggtcgtccccgtcaccagggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgcgtgtcgcacccgaggagcatccggtgttgctcacagaggctccgctgaacccgaaggctaacagagagaagatgacccaaattatgttcgagacgttcaacacgccggccatgtacgtggccattcaggccgtgctgtcgctgtacgcctctggccgtaccaccgg

SEQ ID NO: 48005 - DNA, 495 bp, Heterodera glycines
  SCN-specific regions: Sequence locations=1-495
caagcggagaagacttcgccgcctgtctcgtcgaggcaatccgagccatcaatcgagggactaaccccgaacgaattcctcagggctcttcgggctatattttgtaaaaacttacaaggggaagtgatcggtgtgttcaagccaaaaaatgaggagccttacgggtcattaaatccaaaatgggttaaatgggcgcacaaattgctctgtccttgctgttttggtcgttcgtgccttgtcccgaatcagggttatctctcagaggcgggtgcttcgctggtggaccaaaaattgggcctggacattgtgccaaggactgcgattgtggcattggcagcacccaccttttactatggacgaattgataggacggtgacgaacacaaaagaacaaattgccaggaattatcccgacttgggccggcacttcaagcgcatcggattgccaccaaagcggggcagtttccagctgtttgtccgtggcttcaaagatgcc

SEQ ID NO: 48006 - DNA, 613 bp, Heterodera glycines
  SCN-specific regions: Sequence locations=1-14,45-493,516-613
acattaattcttcgacaccaacgacaacaacaacagcagcacattgacaacgacttggtgtcgcagagccccgggacgctgtcggaggagcgttttgcgagcgactacgaactggtgtcgctgagccctgggacacgagtgtgcggccgatggaccatcatcaaagagcttggacagggcgcgtttggcaccgtcttcttgtgcaaggacaccaccaccgggcgacaggcggcgatgaaaacggagtcagcagacgcggaaccattcctttggcaggaggctgcaatcatgcgaagcgtgcacagtcgaggggcccaggcacggagcatttttgtcgctgttttgacgagggcaaggacatccaacgggacgcaaaacgcgggacattggtctcgttcaactacattgtgatgtcgctgattggacgtgggctatttggactcctgagcaaggcgaacgacaaattcagtcccgggacagcgattggcgtgtccatccagctgctgcaggcactgaagaccctgcacaacatcggctaccttcatctggatgtcaaaccggagaatgccgtcattggacgacgggaaagcaatgagcgccaactgatcttctt

SEQ ID NO: 48007 - DNA, 496 bp, Heterodera glycines
  SCN-specific regions: Sequence locations=1-269,291-434,462-496
cccgaattggagccgggaaaagcaccggaagtaattgcccgcacagtcgcgtcaatgcctcccgaaaaaatgttcgaattgatgcgatccatgaaggaaacggtgaacaacaatccgcaaatggcgcgccaacttttgatggaaaatccgcagctgtcgtatgcattgctgcaggctcaagttgtgatgcgagtggtggacccgaagattgcctaccaaatgcttcatcgtgaacatgctcagccgcttgtaccgccgacttccatccccactcatatccctcaacaatttgctggcaaaccccctcaattgcctccccaattcaacatacctccgccctccgtcccctctcatcagtttcaaatgcaacctcctcccttggtgccaggccaatttcaccaccgatttccatccatgggcatggctccgccttcgctactgcaacagcagcagcaacagacgccttttacacaacaaaagccgacacccatcgctc

SEQ ID NO: 48008 - DNA, 706 bp, Heterodera glycines
  SCN-specific regions: Sequence locations=1-274,321-437,479-706
ggcgctgaacttcgccttcaggacacttataagcgagtcttcacgcaggagtggacaaggagaagcagttcttgaagttcttcgccatgaatttggcttcgggcggtgccgctggcgccacttcgctgtgttttgtgtaccctttggactttgcgcgaacgcgtttggcagcggatgttggaaaggccgatgcccgtgagttcaaaggtttggcggactgcatcatgaaaatcctcaagtcggacggtcccatcggtctctaccgcggcttcttcgtctccgtccagggcatcatcatttaccgcgccgcttacttcggctgcttcgacaccgccaaaatgctcttctccccggagggcaagcagatgaacttcttcgtcaactgggccattgcgcaggtcgtcaccgtgtcgtccggcgttctctcctacccgtgggacaccgtccgtcgtcgtatgatgatgcagtcaggccgcaaggacatcatgtacaagaacactttggactgtgccatcaaaatcatcaaaaacgagggactgctcaagggcatgttcaagggtgctttatccaatgtgttccgtggtactggcggtgcccttgttcttgcgttctacgacgaaatccagaaatatatccactgattgtgtgtgatcttcttagtatatttgtttgtgttgcgtcatattcggtcatttgggtaatgata

SEQ ID NO: 48009 - DNA, 493 bp, Heterodera glycines
  SCN-specific regions: Sequence locations=1-493
ctaagacaacattattgattgtgttgcccaactcgtcgccaattgtgctgttgcacaaccttggaaaacagtcggtgaacgcgcttgcgcttggtcgtaaatcagtgcacaacgatgtccaattgcccaactttgacgcgtacccgaacgatattgaccaaagacccggctcaacggttccatgtgactgaggacaggcgcaaaggcgtgtcaagcttcatcttttatggagtgggcggcgccattacgttgatgacagcaaagttcggcgtccgaaaagcggtcacttacaaatggatgccacgggaccaagccgcaatggcatcgaccgaaatcgaccttagcttggggccattgggcaagacaaagacatttgattggagtggtaaggccgtgtttgtcaagcatcggacggacaaggaaattgagcgcgaacgtgcggtggaagtgggcaaactgcgtcacccggaacgggacgaggaccgtgtgctga

SEQ ID NO: 48010 - DNA, 656 bp, Heterodera glycines
  SCN-specific regions: Sequence locations=1-282,304-656
cagtgaagaaaggaaccctgaagatctgatcaactctgagctttctgcggttaaattgcccgactctgagcagcagcgaccggacgacgccgtgtcgattataaacagtgcattcagcaacagaaaatcgttcagctgtccaaaaactaaaagcgaccttctaaccggcacttcgacggcaaatttaagtcccgaggacattggcattatcgcatcaatgggcgactcattggccaccggtgccgggctttggccgcggacggacatcgaattccgcggtgccgcctttcccattgggggtgatgcgacaattgatggtctcgtcaccgtccccaacattctgcgcgagtttatcgactccaatttgctcttcggagtttctcacggaatgggccaacgcgaccaattgcccgaaaaccaactgaatgtggcagtcagtggggcgagcagttcttcgatgcctggacaggccgtcgaattggtgagacggatgaagcgacttcgggaattggatgtgttcaacacttgggctttgattattgtcaccattggaaccgaagaggtctgcaaaaattgcacgggtccaaatacaaaggcactcgtccaggcattggacattttgaaccgtgggattcacaaagcactggtgattttgt

SEQ ID NO: 48011 - DNA, 376 bp, Heterodera glycines
  SCN-specific regions: Sequence locations=1-348,371-376
gagttgatgcgctcgaacgatgtagtcgatgccgagcgggttgcgcacgctctcgaccacgtccgcgccgaacatgacgccggctcctctgttgttcggggcgacgcctgtgatgctcgtcgacgggtcggcccaaaggaggtcaatttccagcgaacgaagcagtggctcggtctgcgggcgaagcaagttgctgagctggtccaggctgcagatctgattggagatgccaccgtgcatgcagaggatcttctcgccgaccagtccgacgaatggcatccaggcgaagacttgattgaagaggtcgaagagtcgacgagcgcccggtcgcgggtaacggcggtcgatctcatcgtagaagccatacactctgttc

SEQ ID NO: 48012 - DNA, 654 bp, Heterodera glycines
  SCN-specific regions: Sequence locations=1-654
aactttcccgcatttgcgcattattcgaaacccgcaaggcccaacattgcacttcagagttgaaaaatattcgttggcacgcgacgtgctctctgtgcagaagagaccggtcatctacgaagaactgttccacacgcgcctttggtggtgatgaatgggttttccagtgaagacggcagcaaaaaaacatttacaattggtgcagacggtggtgcagaatatgttcccttccatcgacgtggacagagtgaaactcgcgtccattcgtcgcactttgctattaaactacgacacagaggacggactgatggagttcagacaatactccataaagtcagtgcccgcgggcgtttctcgttcggccaaaaaactgatgcagagcaaagtcccagacctgtccaagtacaaagacatcagtgacttcatgctcaaaccggagcagttgagtgacagcgaatttgaaggcgaacagacggaattggagctcacgcaggatattggcggacggggcaaaaaacgaggacagcaaaccaaattgaggttgatggaaattggaccacggatgacattacgtttgatgaaaattgaggaaggcgtcaacgcgggcactgctctttggacacactcttcaacttaacatcagattcatattcc

SEQ ID NO: 48013 - DNA, 476 bp, Heterodera glycines
  SCN-specific regions: Sequence locations=1-288,310-455
gagattgataagcaactactattctaaattctttattccacataattcaatgttggaagttgttctggaatatttgccatcgtggattcgcactcttaattcgttcatcgattatgagggtcagcgtaagtctgaacgtttttttccaggttattttgattgtccacggtgtgcttgggttttttgctggttatctcactcaacagctgtcggtgactatgtacagcgtcggagttggatttctgacctcttgtctgattgtgcttcccccttggccgttttaccgtcagaaccctttgaattggcaaccaaatagtccggtagaggaagacaaagctgcgaatccgtcatcatcatccggcaataagaattcaaaaaagactcgttgagtgtgatcataattcgatacggtttccttgtacactttcttattgttgataaaccgcttctgttgcaaaaaaaaaaaaaaaaaaaaa

SEQ ID NO: 48014 - DNA, 566 bp, Heterodera glycines
  SCN-specific regions: Sequence locations=1-340,367-566
aaacattcccaaagaatcaattgtcgatgtttatgggcttgtggcgcgcacccctcagccggtcactgcttgcactcaaagcgatgttgagattaaagtgcacaaatttttcattgtctcgcaagcagagcctcggcttccgcttcaacttgaagacgcggttcggcccgacaacgaccaagaggaattggccgtagtcaaattggacactcgtttggacaacagagtgctcgacttgcgaacgccaacgagtcaggcaattttccgtttgcagggcggagtttgcgacgcctttcgcaagattttgtcctctcgcggtttcatggaaattcacactcccaaaatcatttctgctgccagtgaaggcggtgcaaacgtttttgaggtttcttacttcaaaggccatgcttttctggctcagtcgcctcaactttacaaacaaatggcaattgctggtgactttggccgcgtgtttaccattggctccgtttttcgggctgaagacagtaatacgcatcgtcatttgaccgagtttattggccttgatcttgagatggctttcaatt

SEQ ID NO: 48015 - DNA, 481 bp, Heterodera glycines
  misc_feature (480)..(480): n is a, c, g, or t
  SCN-specific regions: Sequence locations=1-60,102-144,177-195,217 -238,330-375,474-481
ttaactttctttctcgtgctcaattcgtggacaaaaatgtgcgacgaagaagttgcggctctcgtggtggacaacggctccggcatgtgcaaggctggtttcgcgggcgatgacgcgccccgtgcggtgttcccgtcaattgtgggtcgtccccgtcaccagggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgcgtgtcgcacccgaggagcatccggtgttgctcacagaggctccgctgaacccgaatgctaacagagagaagatgacccaaattatgttcgagacgttcaacacgccggccatgtacgtggccattcaggccgtgctgtcgctgtacgcctctggccgnt

SEQ ID NO: 48016 - DNA, 380 bp, Heterodera glycines
  SCN-specific regions: Sequence locations=1-380
ctgaaggtgctcgccgaaatacacaacgaaccggacctgaagctgatcttgcgttttgaaattgaagtgctctgcagggagctgaacgttaacctgagaagcattgaggttggcggctacctgaatgatcagcgacgtttgcccagattggtgccgccctccaaacttggcacatttttagcatcttcaacattggctcaatgtcagttgccgccaatccaaccaccgcacattggcgctgggatttcgtcacacagcacggcagattatacgccaactgacatagcgaacatcctcgctgaaatgagcatctcccggaaatattcaccggccagttatacgcccggcggatcgcaacaacaagtttcatcaataacagc

SEQ ID NO: 48017 - DNA, 674 bp, Heterodera glycines
  SCN-specific regions: Sequence locations=1-48,72-264,288-591,613 -648,670-674
atttaaaaattttgggttgtacacatgctgtctattttcttgcagaatatggcacgaaccaagcaaacagcccgcaaaacccaatcccaaaaaggcttttcgtcgagcagtggcagccaacacatgcagagtcaactgcacaacttgagaaaacagttggctacgaagcgtcccaacccaaaacgagggatcggatacaaagaattgcctcctgttaaaatagcccaaaaacgtcatcataagaaaggagcattggcacttaaagagatccgcaagtaccagaagagtgtgaatctgctcatcccgcgccgtcctttcatgcgtttggtccgcgaagtcacccaggacatgtcgcagtcgaccgacctgcgctggcagggcttggcactgctggcgattcaggaggccgccgaactgtacttggtctcattgttcgacgacaccaatctttgcgccatccatgccagtcgagtgaccataatgccgaaggacatgcaactcgtgcgcaaaattcgtggagagacttttcttaagccgttgtcctcgcagtactgatcgaagaaaatggtggtggttgatttcatagtcgatgacaatttgaatatgatatttttcgcaaatctcttttgtattctcgacccattcccattttcactattatcctactttgtcca

SEQ ID NO: 48018 - DNA, 603 bp, Heterodera glycines
  SCN-specific regions: Sequence locations=1-114,138-285,309-314,337-603
caattgaaaagaatggacgagccgcttctgcaggaaaacccaaatcgttttgtcattttccccatcaaataccatgacatatggcaattttacaagaaggcagttgcttcattttggacagttgaggaggttgatttgtcaaaggatatttccgattggaaaagcttaactgataatgagcgattttttatttctcgagtacttgcattcttcgcagcttctgatgggattgtcaacgaaaatttagtggagcgctttgctcaagaagttcaagttccagaggctcgctgtttttatggtttccaaatagccattgaaaacattcattctgaaatgtattcgctgttgattaactcttacgttaaggatttggaggaacgtgctaagctttttaatgccattttcgagttcgaatttatcaaaaagaaggccgactgggcccttcgttggatcgcaagttccgaagcgtcttttgcggagagactcgttgcatttgctgcggttggggggattttcttctcggggagttttgctgcaattttttggcttaaaaaacgaggccttttgcccggtctgacgcacagcaacgaattaatttcgcgt

SEQ ID NO: 48019 - DNA, 711 bp, Heterodera glycines
  SCN-specific regions: Sequence locations=1-323,345-488,516-711
ccaatgactttgactcgtccgcaaaatcccaccgacgaattgagtccttatgggcccgaattggagccgggaaaagcaccggaagtaattgcccgcacagtcgcgtcaatgcctcccgaaaaaatgttcgaattgatgcgatccatgaaggaaacggtgaacaacaatccgcaaatggcgcgccaacttttgatggaaaatccgcagctgtcgtatgcattgctgcaggctcaagttgtgatgcgagtggtggacccgaagattgcctaccaaatgcttcatcgtgaacatgctcagccgcttgtaccgccgacttccatccccactcatatccctcaacaatttgctggcaaaccccctcaattgcctccccaattcaacatacctccgccctccgtcccctctcatcagtttcaaatgcaacctcctcccttggtgccaggccaatttcaccacggatttccatccatgggcatggctccgccttcgctactgcaacagcagcagcaacagacgccttttacacaacaaaagccgacacccatcgctcctttggcagtgcctccggcagcgaccgctccgcaacagcagcaggctgttactccacctccgcttagccaacaagcacagcaaagcaacagcgacaatttggacgatgagcagcatgcgcaaatgcttatccgcgtgctgcaactcaccgatgagcaaatt

SEQ ID NO: 48020 - DNA, 578 bp, Heterodera glycines
  SCN-specific regions: Sequence locations=1-345,367-578
acgcgtaaaaatcgactcagcggaaccgaggttaaccctgaaaatttcgaagcggtccttttgggcgatgagcagcgatcggagggaaagccggtgctgaaaagcactgaaaaggacaaagtgttcgtgtacttctcggaccatggcgcggtcggagttatcggattcccagcagccgacttaacggttaaacaattgactcaaacactgaaggaaatgcatgccaaaaaaatgtacggcgaattgacattttatctcgaagcatgcgaatcgggctcaatgtttgaccacacattggcgcagagtttgaaaatttacgcagtcaccgcggccaatggcgacgaatcgagctggggctgtttttgcgacaccaaatttttgcccggaaattgtttgggcgatcttttttcagtgaattggatgcaagactcggaccaggaaaatttacgcaccgaaactctgcggaaacaatttggcattgtgcgcgaagaaacgaacaaaagccacgtgatgcactacggcgacttgcaaattcaggacgaacacgtttctgagtttatgggcaaagagcaggcgca

SEQ ID NO: 48021 - DNA, 637 bp, Heterodera glycines
  SCN-specific regions: Sequence locations=1-51,73-637
cagaatttcctaaaagaattggagggcataaaaattggtgcggatgcgcagaaagaaaattttgcgctgaatgaattggtcagtgagggcgacttgcgcgagtgccttttgctcgcggggggcgacgggactgacacggacgactcacagatggcctatgggttggccggagaattgcttaaggcggttcgaaatgaagccgaacagcgcatttcggcgcgcatggcattggaggacaaagacaaagcggacctttaccagaacatcacaaagttgaagtcccaattggccataaaacgtgaacaagtctcatctctccgttctgttcttcgttccaacaaaagttcgaccgaaagtgtgctccaatgtttgcgggaaaaatttgagtccgaatttcgactgaaagacgaggccaacgaagtgttgcgcaaccaactcaagcagttcaaagaggacgccgccactttcgcctctcatcgcgcgactttcactgcacgctccgaggagttacagcagcaagtggaaagtctgcaggactcattgaaaatggcggaggaagagaagaaaactatcaatcagctgctcagaatgagcatacaacagaaattggcactcactcagcgattggaggagttgg

SEQ ID NO: 48022 - DNA, 695 bp, Heterodera glycines
  SCN-specific regions: Sequence locations=1-61,83-287,309-441,463-695
gcaaaaatgcctcgctatgatgcgaccgatgacttgtcaggagcggaatatttggccagcatttacggcacagaaaaggacaaagtgaattgttccttcttcttcaagattggcgcatgtcgacacggggacaactgtttgcgggcacaccacagaccgaccttttcgaacacagtgctgctcaagcacttctaccagagtcccattgtgaacccggcacaggcggacgctttcgacaaggtcggtaaaaaggatgagcttgagcagcgccattttgatgagttttacgaggaagtgttcaccgaacttcaacgcacttatggtcctgttgaggaattgaacgtttgtgaaaacattggcgagcacatgattggcaatgtgtacgtgaagtttgtttatgaggaggacgcagaaaaagccgtacaaggcctggagaatcgatggttcaacgggcagcccatctacgccgagctgtcccccgtgtccgactttcgcgaggcgcgttgtcgccagcacgaaatttccacctgttcaaagggcggattttgtaatttcatgcacctgaaagatgtgtcggatgaagtctacgaacgttgttacgcaaatcgtggtgcgcgctaccgcagcacacgtcgccacgaccgcttttatgctgatgatggctacgaccgtcgcgaagggggcaacagggatcg

SEQ ID NO: 48023 - DNA, 726 bp, Heterodera glycines
  SCN-specific regions: Sequence locations=1-84,106-336,370-451,475 -544,567-726
aacaacaaacctacctaaaaatacgtcctactttgtttcttacgtttctgtctgataaaagggaaaataaagaaaatggcgcaagcagttgctgctgttgctcccgcacctaatgcaaacgcagcctcggctcaggcaacccaaccgcaggttatggcaccatcctatccgttggcttctctctatgtcggcgatcttcatccggatgtcactgaggcaatgctctttgagcggttcagcaatgctggtcctgtgctctccattcgtgtttgtcgtgacgcgatcactcgtcgttcgcttggctatgcctatgtgaattttcagcagccggcggatgccgaacgtgctttggacaccatgaactttgatatgatcctgaacaaaccgattcgcatcatgtggtcgcaacgtgacccaagcattcgtcgctcgggtgctgggaacattttcatcaaaaacttgggcaaggaaatcgacacaaaggccatctacgacaccttttccatgtttggaagcattctgagttgcaagatttccactgacattgatggaggaagcaaaggatatgggttcatccattttgagactgaggaagcagcgaacagtgcaattgcgaaagtgaacgggatgcttttggatgggaagaaagtgtttgttggaaaatttttgccacgttccgctcgtgacaagcaaattggtgatccgtccagtcgtttcaccaatgtt

SEQ ID NO: 48024 - DNA, 342 bp, Heterodera glycines
  misc_feature (306)..(306): n is a, c, g, or t
  SCN-specific regions: Sequence locations=1-143,166-342
ggtcctggaggagttttggcccggccagaatgtgaagatcggccatatgacaatgaattcttttcgagaagtgaacagacattcagaattgccaattgcacgcataaagaaaataatgaaaatcgaggaaggcgtgaaaacccagatgatcagtgccgaagcgcctgtactgctcgcaaaggcggccgaactttttatcgaagaattgaccctccgcgcttggctgaacaccaacgacaaccgccgtaaaaccatccaaaagtcggacatcgccgccggggcggccaaaagcgaaatgttcgactntctcattgacatcctcccgcgcgacgagctgcaaaa

SEQ ID NO: 48025 - DNA, 541 bp, Heterodera glycines
  misc_feature (519)..(523): n is a, c, g, or t
  SCN-specific regions: Sequence locations=1-449,472-541
ccacttaaacattgaaattatgcgagaaaacccgaagctgctccgtgtgcggaaatggtttggcatccgcaaagagttggccgccattcgcacagtgtgttcacacattgaaaacatgatcaaaggcgtgactgttggatttcggtacaaaatgcgctcagtgtacgcgcattttccgattaacatcacgctgcaggagaacaacaccgtcgtcgagattcgaaacttcttgggcgagaaatttgtgcgccgtgtcggactaccgcaaggcgttagcgctgtaatgtccaccaagcagaaggacgagttgatcatcgacggtaccgacatccaaaaagtgtcccaggccgctgctcgtatccaacagtcaacgactgtgaaaaacaaggacattcggaaattcctggacggcatttatgtgtccgagaaggtggccattgccgatgaatgagcacacaaagacaaaaaacccattgttaccccttttttgttggtcagaatggataaagaaatgttgcnnnnnaaaaaaaaaaaaaaaaaa

SEQ ID NO: 48026 - DNA, 601 bp, Heterodera glycines
  misc_feature (594)..(594): n is a, c, g, or t
  SCN-specific regions: Sequence locations=1-526,548-601
cgcgcagataaggctagatggcttcggccgcgccgcccctcggcccttctttggggcagcgaggcgtaaacgtggcgaacttctgcaaggagtttaacaatttgacttcgactattcgatttggtacaaatttgcctgtgtctatccacgtcaaaccggacagaacttacgaaattgacattagcactccgaccaccgagtggcttctgcaacaagcggcggggatacgacgtaaccggcaggaggaaggagaaatcgtcggaatgatttcggtgaaacacgtatacgaaattgccaaagtcaaatctcaagacaaatctctcattggagtgccgttaaaagaaatttgtcaattggtcattgagagagcggattcgattggcatcaaagtgcaaaatgaagatttagacccggaagaatataggaaattcctggaacatcgtcaggaagttgtgcaaagacaattggaggaaatagcgaagcaagaagaggccaagctggccagaacatgatcggattttgattcattgttttctttttctcttcagcttatgaatgaacgtcaagttgtgtaattacactcattcgttcgcnaaaaaaa

SEQ ID NO: 48027 - DNA, 682 bp, Heterodera glycines
  SCN-specific regions: Sequence locations=1-327,349-373,395-424,446-682
atgtgattgacagtggcgaggtcgatgtgttcgtcatggcgagttcgtgttgagcattaaggagggaggttcatttggcgagttggcactgatttatggcactccgcgcgcagccaccgtagtcgcgaagacgaacacggtcaaactgtgggccatcgaccgcatcacttaccgcgccattcttatggggtcgacgatgcgaaagcggagaatgtacgacgaattcctgagcaaagttcagattcttgccgacttagacaaatgggaaagggcaaatgtggcggatgcgttggaacagtgccaattcccctcgggcacccacgtggtggagcagggacatcctggggacgaattcttcatcattgtggagggcgaagctgaggtgctgcagagaccgaacgacgacgcgcccttcgaagtggtcggaaaattgggaccctctgactatttcggggaaatcgccctccttctcgatcgccctcgtgccgccaccgtcgtggccaaaactctgctgaaatgtctgaaattggaccgggcacgatttgagcgcgtgatgggtccggtgcgtgagattctcaagcgcgacgtgtccaattacaattcgtacgtgaagctgatgacttgacgagccggcagatctttggcggccaaagaattgatcgccgatcactctcccccccac

SEQ ID NO: 48028 - DNA, 566 bp, Heterodera glycines
  misc_feature (544)..(544): n is a, c, g, or t
  SCN-specific regions: Sequence locations=1-396,418-540
ccagatcgtcttgaccgttggtacccgtccattcgatttcgcaaaaatgacgaagtgatcacgcccattcgccacaaggaattgggagattggaagaagttgagcattgaggagaagaagcttatctaccgctactccttccgtcaaactttggccgagtttgaggcattgacgccttatggctatctcacagtcactttgttcttttctatgcttgggcttactattctgtacgcttcgtttgttaggacttacgtgacaaaattcaatgaccgattgcctgacactttcgatgatgaatataaagaaagtcaggccgagcgccgtgtggtactggaaaggggcaatccttatggaccggcctactactacgattacgagaaaaatcgttggaaggactgaagtggacggaaaagtcctactcgaaattcgttggagtgttttttaattttaggggatttttaatggacatttcaaatttgcacattttttcgtaaatttcttattcagtttttacgattgataaagttgggtttcagtaaanaaaaaaaaaaaaaaaaaaaaaa

SEQ ID NO: 48029 - DNA, 616 bp, Heterodera glycines
  SCN-specific regions: Sequence locations=1-153,178-253,275-616
cattctcttctcgccaagccttctccgcatttggttaagccgccggttctcctcaacaaataacacacaaccatcatgtcggaaaagaaggtcaaaaaggtgaagaagaagcccaggaccggctccgaggcgagctccttcgaccagaagaccatccaggagttcaaagaagcatttggcattatggaccaggacaaagacggagtgatcagcaagcaggacctgaaggacttgtacgccacactcggagttgtggcgagcgactcgcagatggacaacatgctcaaggaggcaccggggccaatcaatttcaccgttttcctgacactgttcggagaacgactgactggcactgaccccgaggcgacaattatcggcgcctttcaaatgttcgacaaaactgactgtggcgaaatcacagaagagacattgatgaaaattctgaagaacaaacggggggagccattgacggaggacgaagtgcaagggatgtacaagggaaccctccaattagtggaggcaaagtggactacaaggcattcgcgcatttgatcacgacaggcgcagcggaggagttggccaaagtgggctaagcggggccatggacggacggtgg

SEQ ID NO: 48030 - DNA, 636 bp, Heterodera glycines
  SCN-specific regions: Sequence locations=1-381,417-420,442-636
gtgcgcccgtcaaattcatactgtccgttcccggcatttgaggcggcgcccgcggacggaggcaacgcgacggttgaaaaggcccccgacttttccccgccgtcccccgacgtagtcgaactgagcgccttcctgggccaggaactgtccaagtcggagcggcctgagttgggcggtgccaatattgtgatcagcggtggccgagggctcaaatcgggcgaaaacttctcattgctctatgcacttgccgatgtgatgggcgccgcggtgggcgcctcccgggcggcggttgatgcgggctatgtgcccaacgacatgcaagtgggccaaaccggcaaaattgtggcaccgcaattgtacatcgcggtgggcaccatcggtgccatccaacacttggccggcatgaaggacagcaaagtgattgtggccatcaacaaggacaatgacgcgcccattttccaggttgccgactttgggctcgttgcggatttgttcaaagctgtgcccgagctaacggaacagctcaaaaaggcgaacaaataatttgggtcagcaattgaaaaaataatagacaaatggaaatatcaaatatatatttaaaattcacaattttgtatgtgtacacaaaatcatcaa

SEQ ID NO: 48031 - DNA, 719 bp, Heterodera glycines
  SCN-specific regions: Sequence locations=1-208,235-719
cagaaaaagttattctcatgttgacctcgtggtgatgtgcgacggatttgacggagagagaggcaccaatgtggcgggaggacgaggctattttctgaaaggaccgttggtgttccttgaacaagcgctcatcgcattggcattgcaaatgctcaacaaaaagggcttcacgccgctttacacgcccttttttatgcgcaaagacgtaatgcaggaggtggcacaactcagccaattcgacgaagagctttacaaggtgaccaccgcaaaaaagacggacgcagccaatgaagacggctctcccgacgagaaatatctaatcgcaacttctgagcagccaatcgccgcctttcatcgtgacgaatggcttaacccatcggatttgccaatcaaatatgccggaatgtccacctgttttcggcaggaggtcggaagccatgggagagacacccgcgggattttccgtgtgcaccaattcgagaagatcgaacaatttgtcatctgttccccatttgacaacgaatcgtggaagcacatggacgaaatgattgacaatgctgaagagttttgcaaagtgctcggccttccctaccgaattgtggccattgtttcggccgaactgaacaacgcggcggcaaagaaattggacctcgaggcgtggttcccgggcagcggtgcatttcgggagctggtttcatgctccaactgtacagattacc

SEQ ID NO: 48032 - DNA, 698 bp, Heterodera glycines
  SCN-specific regions: Sequence locations=1-99,121-135,157-390,421 -502,526-698
tcaaaaaaaaaatcgacaaattataaaacacaaaaaaaattgacaaaacaacaaaaaactacctaaaaaacacacatccaactttgttcctcgcgtttctctctgataaaaggaaaataaaagaaaatggcgcaggcagttgctgctgttgctcccgcaccaaatgctaacgcagcctcggctcaaacaacccaaccgcaggttatggcaccatcttatccgttggcttctctctatgtcggcgatcttcatccggatgtcactgaggccatgctctttgagcggttcagcaatgctggtcctgtgctctccattcgtgtttgtcgtgatgcaattactcgtcgttcgcttggctatgcctatgtgaattttcaacaaccggcggatgctgaacgtgctttggacaccatgaactttgacatgatcctgaacaagccaattcgcattatgtggtcgcaacgtgatccaagcattcgtcgctcgggtgctgggaacattttcatcaaaaacttgggcaaggaaatcgacacgaaggccatctacgacactttttccatgtttggaagcattctgagctgcaagattgccactgacattgagggaggaagcaaagggtatgggttcatccattttgagactgaggaagcggcgaacagtgcaattgcgaaagtgaacgggatgcttttggatgggaagaa

SEQ ID NO: 48033 - DNA, 765 bp, Heterodera glycines
  SCN-specific regions: Sequence locations=1-765
ggattggcgcagtgcactgggtcattgatacgatgattatggtcggacattctttcggtggctatttggcctcgtcctatgcccttgagcatccgtcgcgggtgcgacatttggtgctggtcgacccttggggtttccctgaaaggccacaaattgaacaattgcacatcccaatttggatgcgtgtcttcggcagattgctctctctgttcaaccctttggccactttgcgtgcggctgggccttttggcgctcggctggtgaaaaaattgcgttccgaccttgggattcgctatgctcaccaggacccggacgccatttacgaatacatttaccaatgcaatgcgatggaacccacgggcgaaattgcatttggaacaatgtccaagaattttgggtgggctaagcgaccgatgattaatcgtttcggtgggataagtccatctgtgccggtcactttcatttggggtggaaaatcgtggatggacccgggcccggcctatgaaattcaatacaggaggcaagatgcctatgtggatgttcagattgtcacccgtgccggccatcacgtctacgccgatgcgccagcggacttttgccgactgttggcccacgtttcggacatggtcgacggcgactcggacttggccggctcggcggatatggaagatgcgatggaccgaatggcagatactttgccatcgatggcgtcgcaaaaaatggcatggctaatgcaacagagtacaacagcaacagaagcagcga

SEQ ID NO: 48034 - DNA, 817 bp, Heterodera glycines
  misc_feature (686)..(686): n is a, c, g, or t
  misc_feature (776)..(776): n is a, c, g, or t
  SCN-specific regions: Sequence locations=1-194,216-817
agggaaattacctcgcggctgaaacccggcattgaaaattcggagcgtcgtttcgatgtgcacaaattcacttgcgccgctttggaattgcccgacttttcggacttcgcccgactccgtccgttaattgacgcactcattgctgaattggatctcaacgatttcctcggctgcaccgcggcgctcgaaatgctggcggagacggccgccacggcgccaaagtgtgtgcctttttttggccaaattggcctcctggacaaagtgtacgcgctgttcatccgaaccaaggaggagccggacatgggcatcattcacattgcgtgcattcgcttcttcgcctatctgtgcaccaccgatgacaacgcattgaccaaatttcccaaattcacggccgatgttttcgacgcggtgttcagatttgatgcattcgacgtcacgcgtcgtcagttggccttcgaaacgttggcagtgatcagttcgaccagcggggccaagcagatattctcgcagaacgaaactctctacaacatgcaacgggcgatgagcaatttggctgtggcggtggcaacggccgccgagccgtcgctgaaggcgcgtcatttggaagcagttcggatgttttttgatcggattgccgacgaaagcggttgccaacccgaacagaaatgcaccgccgcgtccgctgnagctgaagagcagctgctccaccggtggttccgctggttgggcgaaccgttcccccggctgttgctccaatgtgtcagggatcccatctncgaagttcagttggccgctctccgcgtgctgatggcactga

SEQ ID NO: 48035 - DNA, 738 bp, Heterodera glycines
  SCN-specific regions: Sequence locations=1-689
caatttccgtcgggaaggtgtccgagtgatcaagacatcggaaaaacgatgaatttgaaagcgtgcccaactttggccaccgccaccgttttcttccccgcttttatatgtttcacacgtttgacgaacatcatttgcatatgactgcgttggcctgcatatttttggccggaaaagtcgaagaaacgcctaaaaagtgcaaagatttgctgacggtggcccgagaattatacccccaccatttcacagcaaaagtaacgccggacgatttgatgcttatggagcgagttctgctccaaacaattcgctttgatctccacgtggaacatccctacacttttttggtccaatatgccaagggctttcgcatggacaaggaatacatgagcaaaattgtgaccaacgcatggacatttgtcaacgattcgctcggcacaacactgtgccttttgtgggagcccgaggtcattgccattgcccttttgtacatgtccttcaaaatggagcgcatggaggagcagcaaatcggacggacattccattttgacgcgagcacagagtggtggaatttgtatgtgcaaaatttgaccgtgcccatgatggacgacatttgtcacaaagtgttggattccatcgcaccagcgaacggagaggacgcgccaatggcaaacggaacaaaaaattgacagatttaaatttttgtattttttttgttttattttaaaaaatatttttttg

SEQ ID NO: 48036 - DNA, 680 bp, Heterodera glycines
  SCN-specific regions: Sequence locations=1-53,81-110,132-133,163 -175,199-226,263-343,367-680
taaaacttggcaaaactcttattaattgccgttaaagattgatttgaagaatggctgccatgaatcctgaatatgactatctcttaaattgctgttgatcggcgattctggtgttggcaagtcgtgtctgttgcttaggtttgcggatgacacctacacagagtcgtacatttcgaccatcggcgttgatttcaaaattcgcaccattgagcttgaggggaagacgattaaacttcagatttgggacaccgccggacaggaacgcttccgcacgattacgtccagttattatcgcggagcacacggaatcattgttgtttacgacattacagaccaggactccttcaacaacgtcaagcaatggctccaggaaatcgaccgatacgcatcggagagtgtgaataaacttcttgtcgggaataaatgcgatttgaccaccaaacgtgcgatagagacgaatgttgccaaggagtatgccgaccaattgaacattccattccttgagacttctgccaaaaactccactaatgttgaacaggcgttcatcacaatggccactgaaatcaaaaatcgcatgggccctcttcaacaggccggtggcaatgcgtccgccgtgcgcattggtccgtctcagccggtgcaggacaaaaaaacgggcggatgttgctgagttagccaac

SEQ ID NO: 48037 - DNA, 703 bp, Heterodera glycines
  misc_feature (660)..(660): n is a, c, g, or t
  SCN-specific regions: Sequence locations=1-406,428-703
caattgttgttgcaatcgccgcgacttgctgattcgccaattaccgggagctaatcggacgcttaccaaagattatggcaaatgatgcaaatatctttgtcgccgcaagtgccaccaaatgtgtgatgcttttcgccaaaggattgcgtgccgaattcacgcctcacgtgtcgttggttgtcccggtgatcttcgacaagttcaaagtggagaaacggttgctcagagatgctctcgtcgagtgcatcgatgtcatcgcagcatataccagtttcgaccacctaagcaaggccttgctcgaggctatgacctccaaacagaatccgagtcagaaatcacagacggatttgttcatctaccgcctgttccgttctcttccggccaaagacgttcccaagggtttgctgaaggatttggtggccattctgagcaaacatggctttgatgccgcttccgaagtgagggactcttcttttgctgcgttgggtgccattatgaaatgcattggggaaaaggccttgggctgtttcatttcacccgaattggccaaagatgcgaacaaaatggccaagattgctttaaaacgtgacactgcttaggtatttttttatttgcttagaaattttcccatatttttgttaaattttagaccatttattntctattttttttaccccattttccatgtatttgataaatgaga

SEQ ID NO: 48038 - DNA, 677 bp, Heterodera glycines
  SCN-specific regions: Sequence locations=1-677
gaattggcactgattttgctctgttcggtgtttgcttttattgtctgatcagtggcaatttcggctcgctgtacggcgattatccgagcatgttccagctgcgggattggaccagacagtacggcaagcagtacggtatccaatacggttggcgcaacgcgttggtgatttctgacccggcaatggtccacgagttgcttgtcaccaaatttgaatatttccacgcaagaaatctttcgcccatctttggcaatttggacacaaacaaatggatcagcatgttcttggccaggggaggccggtggaaaaggctccgaacgattgcgaacccggcattttcggtagcgaatctgaaaaagtgcatgtggctcattgacgattcagttaaaaatgccatcaattttctggaaaaagcgcgcaacgaaggcaaatcttttaacattcaaaggcatttcgtagaaatgagtttcgatgtgatcgcccgtgtggcgttggggcagcgcgagtcgcgacagtttgagactgaaatggcacacctggcgattgagtcgatgcaaaaatacaataacactccgttcgattacgtcggcttcgctttcccgtggttcggcattcattttttggaaccgttcatcagttggagcggaatattgcgcaaagacccgctaattatactg

SEQ ID NO: 48039 - DNA, 719 bp, Heterodera glycines
  SCN-specific regions: Sequence locations=1-636,658-695,718-719
caaaaaatgaaattggccatcaaacggttgcattggaatgaaactgatgggatttggtatgactacgacttggagagagaagctcattccaatacctattacgtgtccaatgcattgccgttatattcaaaatgttacgacgacgaggatgacgtcacgccgtacaaagttttcgagtatctgaagcgtgaaggtgtgctcaacttcaccagaggcatcccaacttcgttggcaatgggcagcatccagcaatgggacaaggagaacgcatggccaccgatggtgcacatggtagttgaagcatttcgaacaagcggtgatctaagtcttatgaaagccgcggaacaaatggcaactcaatggttggtcgtcaattataaaggttatgtatcaacctatgcgatgttcgagaagtacaacgtttccatgatcaatgaagagggcgttggtggttcaggaggtgaatatgaggttcagaagggatttggttggacaaatggtgttattttggatttgttggacaagtacgggtccaaaatctccgtctccggtgcggctgtccccaacggcgttcgttttcttcctctcgctttggttgtgcttttgttcatgaccgtagttgaaattgctattgcacaatgtttttgatgtatttctgggtaattctctgatactgacgtaattcatcttttttgtatcatcatgcattatcataaact

SEQ ID NO: 48040 - DNA, 643 bp, Heterodera glycines
  SCN-specific regions: Sequence locations=1-643
ccgtcttcgtcttccttttactatatttccttgcatattcgtcgtcattgttcaactgcgctgattcgcatggctgatgctgaacatcccactgatgccgctgttgtggacaacttcgagacgcgcgctcgccgcttcttcgacctgatcaacgacggcaacatccaacaacttcgtgtgctgatcgatgcgctggacgccgacgagctgaacattttgctgcggtggatggttgatccagtggagcgcgactacacccgatcacgatcagcactttggagtgccttttttcgacaacacatcgacattgttgatctcttgttggagaagggcgccgatccgaatgagccggtggttggccgtgagaacgacattaacacgaacttgacgcctcttttcgttgctgccctccatgcacattttccgctgtgccgtgtgctcgtcgaccgtggtgccaacgtggacttgggatcggactttgccacaacgccgctgatgatggcttgcaaaagatcgcaaatggaaattgtcgcatttctcatcgagaatggtgccgacatcaatctgcagaatggtgacggcgaaacggcattgatgatcgcctgttcaagggcaaatgtggacattgtgcgcttgttgctgt

SEQ ID NO: 48041 - DNA, 661 bp, Heterodera glycines
  misc_feature (624)..(624): n is a, c, g, or t
  SCN-specific regions: Sequence locations=1-27,201-218,240-426,464-661
caagtctattgacgttgcaaactgacccgggctgtcgggtcgcattgcgagcggacagttacgcactgcacatgattttgccaaacaaagtggacccattggtcagtctgatgatggtcgagaaagtgcccgactcgacgtacgaaatgattggcggattggacactcaaatcaaggagatcaaagaggtcattgaactgcccgtcaaacatcccgagttattcgaggctttgggcattgctcagccaaagggcgttcttctctacggaccgcccggtactggtaaaactttgttggcgcgtgccgtcgcccatcacaccgaatgcactttcatccgcgtgtccggctcggagctcgttcagaagtttattggggaaggtgcccgcatggttcgcgaactgttcgtgatggcaagagagcactccccttcaatcatttttatggatgaaattgattcgattggatcgtcccgtgtcgagggaagtcacgggggtgactccgaagtgcagcgcacaatgctcgaattgcttaaccaactcgacggttttgagcctaccaaaaacatcaaagtgataatggcaacgaatcggatcgacattttggacccggcactgctcaggccangtcggattgatcgtaaaatcgaatttcctgcacccga

SEQ ID NO: 48042 - DNA, 377 bp, Heterodera glycines
  misc_feature (139)..(139): n is a, c, g, or t
  SCN-specific regions: Sequence locations=1-300,322-377
aatagaaatgctttgcaatttccgcaacttcaattgttcgtcctcgcggcacttttcgctcgcttctgttttacttcagcagcaaaaattcgctgctgtttcttcaccgcccaataaaaattggaatgctgtgcttatncgaagcgatgcgtttgaagtcaaccagcatcgtccaggatgatgcaatcactgaacatggccatgatgaccacgggcatggacaccacgcagtcaattatgggccgccgattacctatgactacactcctataccatctcaaccttataagaaggtctataaggaactgaagcagaaattcatcacgtatttggcgatgagcttcgtctttttcatgttttgctgttacgttggctat

SEQ ID NO: 48043 - DNA, 615 bp, Heterodera glycines
  SCN-specific regions: Sequence locations=1-615
ttttcctttgatgaaagccgccgttgtgggcgaaggcgccgttggggcgagcgttgcattggccatccgtcgagcacatcccaatgccaatatcactgttttctcggaccgggactttgaaaagaccaccagttacggaccggaaggcatttttcgggttgatgtgccgggaacggagcgattggccaaagagtcattcgaattttgggcgaaaaccgaaagggacgagttggcccacaaaactggcgttcgcctcatttcgggctattgccaatccaacgacagaaaatggatcgaagcgcaagaaagttcaatgtccgacattgtgtacaattggaagtggctcagtgagcgcgaattgcgcacacttttcgtccgtccgtattgttatggcgcccattacaccacttacgcggcggagggtcggctgtatgtgccgtggctccgtgcccaattggtggccgaaagtggccaagggcttttgcatttccaacgccaacgaattgaatctttggagcagttgatcgactcaggtcagttcactttggtggtgaattgtgccggattggaagggggacgattggccggtgacgatggcacttccgtttacccaaa

SEQ ID NO: 48044 - DNA, 678 bp, Heterodera glycines
  SCN-specific regions: Sequence locations=1-53,78-194,219-678
caacgagactgaaacaaggacctgcctgcactgccgcagtcgaaccgcttaaccaggaagagaagaaaaaggaggaatcgtcgggtccttcggaggtggaacatgcgcagaatatggaaaatgtgcccgaaaagtatttacctgagactgaaataaaaggcctgacatttactgtcgcgatcgaaccgcttgaccaggaagagaagaaagatgaaagtgtgacagatgagcgtgagcccagggctgataaagaggaattgtcaggtccttcggaggtggaacatgcgcaaaacgacgtggaaaatatgcccgaaaactgcttgcttagcgacgatactgaaacaaagggcttgaccaacagccacaagactccgttattggcaggatgccaaatcaccgcttccggtttcatgggcactgaccgtgttaaaattggacgtttggtcgagttgcatggcggtgttttcactgggcagatgagtcgtgccacttgcactcatttgatcgctgctgcgagttcgggcgagaagtacaggcgagcacgtgaatggggaactgtcaaagtggtcaccagtgagtggctgttcaaatgcgacgaaatgggctatcgtttgcgtgaggaccattttctgttggacaacgacggtgagaaacgacgttcgtcagcggacatcgaat

SEQ ID NO: 48045 - DNA, 702 bp, Heterodera glycines
  SCN-specific regions: Sequence locations=1-137,159-702
actttattattctattgcgctattcttcttctgcaacacattaaacaacgacgcatgccggaagaactggtggcgctcagtcccggaacgcgtgtctccggccgctggaccatcatcaagaagcttggggcgggtgcgtttggagccgtctacttgtgtcaagaccgagatggaaggacaatggcagcactgaaaaccgaaccgatcgacgctcagcgaccactgctgtatatggaggcccacgtgttgctcagcctgaacgaacttcgatcaaacagtggacgccatttttgccgttgtctggaccttggacgcgatgaacaaccggatgccgattctggacagacgatggagttcaactacgttgtcatgtcgttggttggccgtccaatggacaaactccttcacgaatccggtgaccgcttcagccccggaactgcgatcggcacttcaattcaacttctcaaagcgcttaaggcgttgcacagcgttggatacctccatcgtgacattaaaccagcaaactcggccatcggcacgcctgagacgaacgaacagcgccttctctacctcctcgactttggaatggcgcgcaaatatgtcagagaggacggcacacaccggcgtcaaagggacaccgcccgcttcagatggacgccaatctacgcaccaatctctgcgcacatcaaacgcgactacagc

SEQ ID NO: 48046 - DNA, 630 bp, Heterodera glycines
  SCN-specific regions: Sequence locations=1-21,44-301,323-630
taattgtcctaaaaaatggtccaatacaaattatattattttgatgggcgcggtttgggtgaatccatccgtctgttgcttcactatgttggccaaccatttgaggacatccgaattaaagacatggaagaatgggagaaaacgtacaagccgaaatttttttacggaaaggtcccagttttggaggttgacgggaagccattgggacaaagtgctacgattttgcgctaccttgccgaaaaatttggcttggctggcaaagatgaatgcgaaaaggcgaaggctaacgaaatcatcgactttcaaaaggatgctaacactgatttggccccctatttatacgtcaaaatgggatcccgccaaggcgatttggacaaattgcgtgccgaagtgttcgagccgggagtcaagcacattttgccactgtttgagaaacttttgaaggagtccgggtcagggtacatgctcaagtccggactctcaatggtggactttcaagtggccaactttctgtacacgtttaccaagttggagccggagactatcaatgcgttcccggagctgatcaaatacgttgaccgtgtccatgcgctgccccaactgcagcagtatttgaagcagcgtccgcag

SEQ ID NO: 48047 - DNA, 423 bp, Heterodera glycines
  misc_feature (32)..(32): n is a, c, g, or t
  misc_feature (388)..(388): n is a, c, g, or t
  SCN-specific regions: Sequence locations=1-128,165-423
caccgaatgttaccggcactttgcacttgggncacgcactgtccaccgctgttgaggacaccatcgcaagatggcatcgaatgtgcggtcggactgtgctgtttgtgcccggctgtgaccatgcgggaattgccacccaagtggtggtggagaagaagctgaagcgcgagcggggactcagtcggcacgacctcggccgggccgactttgtgaaggaagtgtggaagtggaagaacgaaaaagggcacataatttatgaccaactgaaaaaaatgggcgccggcgtcgattgggaccgagtggtgttcatgatggacccgaaaatcatgcgcgctgttactgaagcatttgtgcgaatgcacgagaagggtgtcatttaccgaagcanacggctcgtcaattggtcatgcgcattaagttcag

SEQ ID NO: 48048 - DNA, 762 bp, Heterodera glycines
  SCN-specific regions: Sequence locations=1-44,68-265,287-416,438-762
catggcaccccgaagtggtgcagaaaattgggcatacccaattgtgcgactggtggagtgtcggcgttattctctacgaaatggtctacggacgaccgccgtttttgtcgcagcgcgacgacccggcggaaacgcaatttatgatagtgcattggagacgctttttggacttgcgaaacgcgatgggtgtgcgtttgtccaaacagtgcgtggattgtgtggccaaattgtgctgtgaccaggagaaccgactgggacatcgcaacggggccaaggacatcaaagcacacccgtggttcaagggcatcgattttgccaatttgcgcaacactttccccgaatatgtgccacgagtgcagaatcccgaggacacgtcaaactttgacacctttgaagtggagaacgaggaattgatcagaacaaatggaaatggaaacgaccgattaaaatgcgcggcgtacggcggcgggaagccattgggaccgaatttcatcgatttcacttttcggcacttctttagcgagggaatgtgccctccggcacggggccggtctccgcaagtcaggccaagtttggccccgcttatggagagttcgactgaaggaggaaacgcagcaaaatcgccggcgggcgaagtcttcgccaaaccgaaacaaattgtgacgattacgggtaaagcaaaagtggtgccattcacatcatcaaaacgtgtgccggcaccttcgattccttctgattcgtctaaagcaacaacagtcaatc

SEQ ID NO: 48049 - DNA, 704 bp, Heterodera glycines
  SCN-specific regions: Sequence locations=1-543,579-580,603-704
cctcttctgtagtccttaagtaagccccgaaaatggctgatgaagccaatctccgcccaagatggtggtggtaaaaacatgcaatggatgtacgagggtgccaaatcggtggtcaatcgggaggactatttgctgggcaaaaagatcgacaagaatttcgagatgttctctgatgttgttgtccatgaccaggaggaggagaagcgggatgcattcttccagcagagccttctcaagccgtccacatccgcccacactgctccttccgccgctcgtaatcagcacaaagtgtccgctttggacacgcgtgttgtacgaactgaagacccattggtggctctgaaattccaagaagagcatcgacggcgtcaacttttggagaatccgttgctcaaactgaaggcgcaacgtgtgcttcgcaaagcgtttgagaaagagttgaaaaaggcggtcaaaaagaagagcagcaaaaggaagaaacgaaaacggtcgtcatcaccgtcttcctcatcgtccttttcatcgccagaacgaagaaaggaggaacagaaacgacggcggcaccaccaccaccaccgacggagtgaggggaggaaaagtggggacagtgaaagagaagggagggcaaaaaggagcagccgaagcagtagcagaacggagcgacacagacgacgacggtcatccgccgggtcgtcgaggcggag

SEQ ID NO: 48050 - DNA, 723 bp, Heterodera glycines
  misc_feature (722)..(722): n is a, c, g, or t
  SCN-specific regions: Sequence locations=1-30,59-723
gcgcaatttaggccggaccgggtctgatgctgttggacagaagtggccaaggcaaagtttaccatctgatcactcgccgtcgctttgaccaaatgtccgtcatggagggacagaacattttggtgacaatcagcggaaagaaacggcgcgtccgcgtttattacctctcgtggctgaagcaaaagattctgcggactgaagggttgcaacagacggagaaaaggaacggatggacaaatgtcggcgaattccaatgcgccactcatttcaaaatcgtgcgctatgagcgcatcaaatttttggtgattggcattgaggactccatttccatttacgcgtgggcacccaaaccttacaacaaattcatggccttcaagagttttggccaattgtcccatgcgccggtaatcgtcgatttgaccatcgaagagaacgcgcgtctgaaggtgctttacggcagccttgccggcttccacgccatcgacttggactcggcgtccatttacgacatttactcgcctcaacagagcacaatgtgccaagggatgtgcccgcattgcattgtgattctgccgaataccaacggaatgcaattactgttgtgctacgataatgagggcgtctacgtgaacacttacggcaaaattgtgaagaatgtccaattgcaatggagcgaaattccctcttccgttgcttacatttccacaaaccaaataatgggnc

SEQ ID NO: 48051 - DNA, 734 bp, Heterodera glycines
  SCN-specific regions: Sequence locations=1-218,241-734
gcacacattcgacgctgcccgtgcccgaatcgatgttggcaccgccacgggcatccgaatgaaaactttgccaaccagtgggcgcggcgcgaaagagcatttggagttcactgaacggaatgaattcggagcagcgacagttgtttttcggacgcattctccacgtttggccctacccgtgggaacgccgtgccatcacattgccccagacgacgcttgctttcaccaacatttgttgttccggatacattacggccaaagtgtgcggcgatgtctttttggtggatccgaaaatcggctggctgagttcgttgcggtcggtgcccacgttgatcccgaatgtggtcgttgccttctccaccgtggtcgcctcttctctgctcttccaccgttttgtgtacgtcccgttcattgaacacgagggccttctccataccaaaagtatcttctggcgaactttcggcatcaactttatgactgccgctgctgtgccgtgtatgttcgcaccggtggcagcgcattaccacaacatccgcattttggcggctgccggcaaaccgcccatcccggccaacgcggtgttggaccttatcgtcacctgttgggaatccactcgctctgtctggcgcaaattgcctctgatagtggccataaattttacaacggttttgctggcaactgttgcgatggcatggggttgcgaccggcttcataccacaatgcatttggactcg

SEQ ID NO: 48052 - DNA, 650 bp, Heterodera glycines
  SCN-specific regions: Sequence locations=1-305,327-650
aatttcttccaaatggccgggagtccccaactgtccgcgtctttgtcgacaactttcaggcgctttcgtcccgtgtttttctcccgactcgaaggcgcttggaaaacgtatgccgaagaacaggaagaaagggtgatttccgatttggaagcctttgatctcttttacatttgtcgtaaagaggcagaacataaccaaaatgttgactctcttgagctgatgaaacatttccccgtactttcaacctttgacaaaatgctgctcctcagttcagaattgttcaacattgagtttagggaagtcacaaatgattatgaaaatcagagttttgagcgttgcgacccatcggttcgacttttcgatgtgactgataatgcaacaaattcaagaataggctttttgtacgttgacattttttcacgcgaaactaagaaaatcggccgtggtcaatggctctctatgcttggaaggcctcctaatcaactccgtgacttggacgctttggtttattttttgggtgcccatccccactccgaaaatgaacacgaatcgttcctccatcatgaagaattgagtgaaatgctgtccgcttttggccgtgctcttcaacttttactctcccgggctccgtgccatttcctttcgctttc

SEQ ID NO: 48053 - DNA, 764 bp, Heterodera glycines
  SCN-specific regions: Sequence locations=1-189,211-360,382-602,640 -693,716-764
accttatgccggaacatgcatgttttcttctgcgcttccctccgctcggatggacggttatttgactgctcagattcaattccccgcttggtttggcaaacgttcgaccggacagaaaaggcaaagattgatgcgacaacctttgctccatacccatctaaaaatcaccgggagcagtcaagcacttgtccaggattatctgagcattttgcgagaccgactttaccgtccattggtcgagaaggaaagcgggggcgttaaggatgtgttggaagtgttcaacaattatttccttcttcgcgaagacaccgaagcgatcagtgaattgggcgtttggccattggcaggcaaaacgcggaaggatttggcagcgatggtcagcacaaaggcaaagtcggcactgacgcgacagctgaacaaggagaagagagtgcttcccttcagccagggagtgatggtcaaaacgggggcgaggagaaagggtggcggagagagcagcaaaggaggaggagtaatggaattaaaagaggaaaagaatgacgacattgaggaagaggaggaatttaacaacccagacgaggaggaagatgaagcattgctaattggccttgatttctgaagaaattaattttgcaatctccggacattccgtcgaaaattgagactcactgttgtcacatttgtagcacatactagcattgttttccaatgtactattcccatttgtcagctcatcgattatttatttgatttttcttaataaa

SEQ ID NO: 48054 - DNA, 722 bp, Heterodera glycines
  SCN-specific regions: Sequence locations=1-70,92-722
gcctaagtggaagtttccccgaaaagcgattcgaatgcatttgattcgaaacatcggcaaaagacgtgcacaatttcaaaacaaagacagcccgaaaaagggattcgccaaaattctgagctgaacaaattcgaacggaggaatgattcgctttttgggttttacaaaaagcaacgcatcgttcccgactcggaatgggaccgtttctgtgagatttttgccacggagttgccctcgtcgtttcgcattcaacgaagtcttccggagagggattgccttgccaatttccttgagcaacactttttcaagcaaatcgcttccattgcggcgacttcggagagtgacggcgttggcattcatccgccaaaatctgtcccttttgtgccctatgcctaccagactaaaatgccgcgctcaatgcttagacggcacccaattctaaaggaattccacgagtttttggtcaatgaaactgaattggggaacatgagcagacaggagacgtgcagcatggtcccaccacttttgttggatgttcagccccaccacagagtgctggacgcctgcgctgccccgggcagcaaaaccatgcaaataattgagctgatgcacgagcactgtcccaacccagaatggtttgtgctggccaatgactccgattacaaacggtgctatttgttggttcggcaaacattgaagcgaatgccaaccgcaaatgtggc

SEQ ID NO: 48055 - DNA, 619 bp, Heterodera glycines
  SCN-specific regions: Sequence locations=1-341,363-619
gtgattgacggtgcttctccgctcgccatctgttgcccttccgcatttgtattggtccttcgcgttgccgttgctccgtttctcgtggctgctccaatccgtccaatttgtgtgccaaatgcggcacagtttttacgatatccatcgccagagggcattggtggagcagtgttcgttggcattgcattggtcgttggtgctcgttcagctgtactttttgccggacaatttggcccgtctccaatatttcctcgtctccaatctgttcgccggtttcctcatcgcacacgtggtcacctacaaccactactccaccgacaaattcgcatatgacgacccaatcctggagaactttgcctgtctgcagctgtacaccacgcgtaacatgcggcccggcccgttcatcgattggctttggggtggtctgaactatcaaattgagcaccatttgttcccgacaatgccgcggcacaacctgaagaaggtgatgccgttggtgaaggaattctgtgccgaaaatgacatcccttacatggtggacgattatttcacgggctttcgactggtcatcgaacatttgcgccgagtggcggaagcggccacagaaacgctggtcagc

SEQ ID NO: 48056 - DNA, 578 bp, Heterodera glycines
  SCN-specific regions: Sequence locations=1-55,77-80,107-110,149 -155,178-259,281-326,362-379,415-578
gcaattgccgagttaaagaggctttctcgctgttcgataaggacggggatggcacaattaccaccaaggaattgggcacggtcatgcggtcgctgggtcaaaaccccacggaggcggagttgcaggacatgatcaacgaagtggacgcagacggaaacgggaccattgactttcccgaattcctcacaatgatggcacgcaaaatgaaggacacggacagcgaagaagagattcgggaggcattcagagtgttcgacaaagacggcaatggcttcatctctgcggccgaactgcgtcacgtgatgacaaatttaggagagaaactgacagacgaagaagtggacgaaatgatcagggaagcggacattgacggggatgggcaagtcaactacgaagaattcgtaacgatgatgacgacgaaataatcgcttcggcacagccctcaacaccgtcactgcatcgatcttttcatttccttcgttcatttaaattatctcctctccacacatccattcattcaccgaccatttttcccgtggattcgattgattttatgtattctataattttttatttgc

SEQ ID NO: 48057 - DNA, 322 bp, Heterodera glycines
  misc_feature (241)..(242): n is a, c, g, or t
  misc_feature (246)..(247): n is a, c, g, or t
  misc_feature (321)..(321): n is a, c, g, or t
  SCN-specific regions: Sequence locations=1-322
cggaggacaagagcaatgagcaaaacatccccccagggactgttgtcgacactgtcgttgttcaccccaaacgctccgagttcttccttaacagtcacgtggcgatcaagggcactgctcgtacgccacattacactgttctgcgggacgagaacgatatgtcgatggacacacttcaaacaatggtccattacctctgctttgggcatcaaattgtcacaaagccgacctcattgccctnncgcnnccgtgtacatcgccgatgaatatgcgaaacgcggtcgaaacatctactcacactacgccaagaacggtattganc

SEQ ID NO: 48058 - DNA, 593 bp, Heterodera glycines
  SCN-specific regions: Sequence locations=1-481,503-593
ccgtgctttattcggatccaccctttttctgacttccttttatgaatgcgaacagaaagagggtgactctacgaagtgcgacgatattgaatacagaatcaaagacgcgctcccgcaaactcaactcaacgcctatttgacaattgagaaattcaggcagaaactcagcgagcaaaagaactttgttcctttcggagaactcatcacaaagttttgccttaaaggtggggaaagtgaagggaatggtgacacaccgtctgaactcatcaaactcacagttttttcttaattttttcgttttataattcaaatactaatttcagattcagagattgaacataactttatactttataaattcgagaaaaaacagcaaaacgatgctcaatttgaccagggctgtaaatttctggagcgagtgcaagcgttggcccattggtacatcgatgcggtctcttacactgacaatgatgaccatcgttatttcaattattttctgtttgccgtgcgtccatcttccgatggcgatggttcttccgtccatcgattcgccggttacgtcaatttgtaccgtttttaccaccatccggaca

SEQ ID NO: 48059 - DNA, 750 bp, Heterodera glycines
  SCN-specific regions: Sequence locations=1-750
gttttttgcaatgtttgttatttttgccaattttcgcaaatcaatctacaattacgatacctatttttaacttgcactaaaatttacgcaatatgtcgttgaacacggcgaatacgccggacggacgtggggttatcatttacagtggtgaaatgattttgcttttcgttcgcgaggttaatctttcttttgacaaattcactaacgccgcgttcaaaggcacaaagaagggcaacctttacctaaccacgcacagaatcattttcaataacactgaaacttcgtctcgcggcaatttcaagtcgttgtcaatgcctttcggatgcattcgaaatgtgaagttggaacagcccacctttggcgccaattatttggctggcgaattggtcgcacagccggacggaaattgggaaggaggagtgaattggaaattgacgttcaatcggggcggatgcatcgaattcggccaagctttgcagaaaaccagcgaaatggccaataacttttgtcctcggcccgcaaatgcgccgccgccgtacgctccgccgcctggcgcttattactcaccaccacccgcttattattggagcggaggccaattcaacggataccaggcgccggtccacgcgtttccagaccaaccgccgccggaaagtgtgttcatgtacgagcaaccacctccatatgcgggggattgggccaattcgtggtcaaaatccggtcccatacccgtcgaatacgcccctgtat

SEQ ID NO: 48060 - DNA, 678 bp, Heterodera glycines
  SCN-specific regions: Sequence locations=1-47,69-329,351-540,565-678
ccgcattataatgatgaatgtaacgaaatgcttaatcggcgaccaagaaaatttgaaaacaaactcagtgcatgtggtgatcagaagaattttaaggccatgcttgagaatttcaactctttacgcgttaacaggcaattgtgcgacgtcgaaattgagtgccagggaaaatcgcttttggtacataaagttgttttggccgcgacaattgattattttcgcggtttatataattttggaatggtcgacgcgcaggcggacaaaattgaaatcaaagaagtgtcattcataggactaagtcaaatcattgacttcgcttatacttacgaggtgaaaatcaacgaggaaaacgtcagagaattgttacacgcagcaaattatctcggagtaacttttgtgaaggatggctgtgagcattttttgataaaattgatgacaattgaaaactgtctcgggttgcgagaactctctgatcagcacagttgcgaacaacttcttgccgcaattgaggcatttatgcttgaacattttatggaaatttgccacaaagaagaatttatggcattggattcggtgacaacattagagcgactggcgaaaagtgacgatctaaacataacagacgaacggtttttgttcgaattcctcgtcaaatgggttgagatggacaaaaccggg

SEQ ID NO: 48061 - DNA, 654 bp, Heterodera glycines
  SCN-specific regions: Sequence locations=1-107,129-654
gggcaaatactcctcgcgctgggcacaagttggcacgtgtggtgcttcaaatgtgccgaatgtgccgccgtccttcagggcgaatatatggcacacagcgggcgcccattgtgtttgagggattacaaccaaatgtttggggtcagatgctgtgaatgcgaccgattcattgctgggagagtgctcgaggccggtggctacaaattccacccgacttgcgctcgctgttcacgctgtcagctgcccttcgacgacggggccgagatgtacatgcagggcaacgagatatggcacccgaattgtgagcactaccggacgacggagaacattgcaatttcgaagcccagcgtaaagggcagcaaattccaatcgcaatttggccagcacctcacttacatgtatatgttgccggagactgaacagactttgctgaaacatccgatcgcgccgaatccgccccagccaactcagtaccacacgccgcaggggccggtgatcaaaatacggaagtcgcgctattcaatgctgaagacggggatgcagcggctcaccgaagacttggaacggactcggccccgttctcgctcctcttccgtggacaacgacgaacccattgaattggctcatttccccggcgccaaagtgcccgacaaa

SEQ ID NO: 48062 - DNA, 260 bp, Heterodera glycines
  SCN-specific regions: Sequence locations=1-55,77-80,107-125,149 -155,178-260
acaattgccgagttcaagaggctttctcgctgttcgataaggacggggatggcacaattaccaccaaggaattgggcacggtcatgcggtcgctgggtcaaaaccccacggaggcggagttgcatgacatgatcaacgaagtggacgcagacggaaacgggaccattgactttcccgaattcctcacaatgatggcacgcaaaatgaaggacacggacagcgaagaagagattcgggaggcattcagagtgttcgacaaa

SEQ ID NO: 48063 - DNA, 710 bp, Heterodera glycines
  SCN-specific regions: Sequence locations=1-319,355-502,525-710
tggagggttacctccgtggcccaacggatgggtcacgcaaattgccaccaacccattgtataagaatatgttggtgtcggcctcaagagacaaaaccatcatcgtttggatgcttgatgagagtgggtcggtgctaaacggcaaaccgatcaaatcattgcacggacatggacactttgtttccgatgttgtcatgtcctcggatggacagtacgcactgtccggctcctgggacaaaacattacgactgtgggacttgaacacaggacaaacgactcgtcagttcgtctcccacacccaggatgtgctgtccgttgctttctccgccgacaaccgtcagattgtgtctggatcgcgcgataagaagatcaaactgtggaatacacttgcccagtgcaaacacaccatcgtggaggagtgccattccgattgggtgtccaccgtgcgcttttcgccttctcatgcgaacccagtgattgtatccgccggctgggacaaaattgtcaaggtgtggaacttggccacttgccgactgaagaccaaccacttcggacacaccggctacatcaactcggtcaccgtatcacccgacggctcactttgtgcttccggaggaaaggacggctcggcaatgttgtgggacttaaacgacggcaaacacttgtacacattgggcggcaatgacgtgatcaacgctttggcgttttcgc

SEQ ID NO: 48064 - DNA, 670 bp, Heterodera glycines
  SCN-specific regions: Sequence locations=1-397,420-670
gcaaataaatgcatttgattaacttaatcgccctctttttcatgcttttcggcccatccgtccagcaatacacaaaaacgccaacgaatgaggacaaagaagcggctgtaattgtacaacaaattccgatcgcaattggccctgggcaatgccgacaataaattgggcggcaacaaaatgccaaaggcgggcaacatgcgcaagtttgaatgggacgaaaacttggccaaacttgcggatgaatgggccaacaaatgcacattatcgcactcgtggaacggctgggcaggcgaaaatttggcaatgaatggcggaacattttcgaacaaggatggcttcgagtacgcttgcggtcgctggtgggacgaactgaaccgttacgggttcaacccggatctgattatgaccggggaaaacttcagtggcatcggccattggactcagatggcgtgggccgacaccgaccgaattggctgtgccatggcacaaaactgcccaaataccaattggaaaacatatgtggtctgctggtattacacgggtggtaattactttggtgcgcctgtctatttggccggggagccgtgcagcaaatgcaaagcaaatgacaaatgtgacaaagccacgggactttgctctcaatgaaggatgaaatattatgaaaattgaa

SEQ ID NO: 48065 - DNA, 161 bp, Heterodera glycines
  SCN-specific regions: Sequence locations=1-21,43-161
ttaaactgttctaaggaaatggctcaacttcttgctggagagaaagttgtgctgagtgacggttcgaaggtagaagcggaagtgttccttaaggacaaagtggtcgctgtttacttctccgccgggtggtgcccgccgtgtcgcgcgttcactcccaaact

SEQ ID NO: 48066 - DNA, 678 bp, Heterodera glycines
  misc_feature (672)..(672): n is a, c, g, or t
  SCN-specific regions: Sequence locations=1-250,272-272,294-295,319 -407,451-678
gattaaattggcatttggcgcgttgggaagtcaccgcccatacaaaaaaagaaagaaaaaatccttttaatcactccgatttacccattcccttactttatccattctaaagttctttgctgtttcgctttttgctctccaaccaacaaaaatgtccggacgaggaaagggcggaaaagcgaagacggaggacggaaagaacaaatcgcgctcatcccgggctggacttcaattccccgtcggacgtctccaccggctgctgcgcaaaggtcactacgcggagcgcgtgggtgtcggcgcgcctgtctatctggcagcggtgttggagtatctgacggcggaagtgctcgagttggccggcaacgcgtcgcgagacaacagaaagacgcggatcaacccacgccatttgcagttggctgtgcgcaacgacgaggagttgaacaagcttctctcgggcgtcaccatctcggagggcggtgtgttgccgaacatcaacccggttcttctgcccaaaaagtcgcagcacagcgaagtcagtgaatgagcggagatggacgagggccaacagacgaaagaaaaaccagcccaaacggtgtcctttttagggccacaatgactcaacctttattgaatctgactaatgcgtttttttgtattttaatgacataaatntttatt

SEQ ID NO: 48067 - DNA, 703 bp, Heterodera glycines
  SCN-specific regions: Sequence locations=1-207,252-256,280-359,381 -548,570-645,678-681
aaaaaaagttatttctgatgaagctcattcagcttcttcctttctgtttctccatttcggcacttttgctgccgttccaaaccgatggcatgcaaattttcgtcgaaacataattggccgagtaatacactggaggtcgagagttcggacagtatcgagaatttgaagcggaagatcactgacaaggagggcattcccgctgatgaccagcgtttgatctttgccggcaagcagctcgaggacggacgaacgttagccgactacggcgtgcagaaggaggcaaaaattcatttggtcctccgtcttcggggcggaatgcaaattttcatcaaaactttgaccggcaaagtcatcacgctggaggtggacagcatggacagtgtcgagaatgtgaagcggaagatcactgacaaggagggcattcccgctgatcatcagcgattggtttttgccggcaaacagctcgaggacggccgaacgttggctgactacggtgtgcagaaggaggccactgtacaccttgtgctgcgcctacggggcggcggatcgatgatgaactttgatgatgatgtgctctgatgatcagcagaattgatcaataccctgacaattatacaaacatatagctcggtttgatcgaaatcaaatcaatagtttaataataaacctaacaggtagcgtaaaaaaaaaaaaaaaaaaaaaa

SEQ ID NO: 48068 - DNA, 707 bp, Heterodera glycines
  SCN-specific regions: Sequence locations=1-205,232-707
aaaaagttattctcatgttgacctcgtggtgatgtgcgacggatttgacggagagagaggcaccaatgtggcgggaggacgaggctattttctgaaaggaccgttggtgttccttgaacaagcgctcatcgcattggcattgcaaatgctcaacaaaaagggcttcacgccgctttacacgcccttttttatgcgcaaagacgtaatgcaggaggtggcacaactcagccaattcgacgaagagctttacaaggtgaccaccgcaaaaaagacggacgcagccaatgaagacggctctcccgacgagaaatatctaatcgcaacttctgagcagccaatcgccgcctttcatcgtgacgaatggcttaacccatcggatttgccaatcaaatatgccggaatgtccacctgttttcggcaggaggtcggaagccatgggagagacacccgcgggattttccgtgtgcaccaattcgagaagatcgaacaatttgtcatctgttccccatttgacaacgaatcgtggaagcacatggacgaaatgattgacaatgctgaagagttttgcaaagtgctcggccttccctaccgaattgtggccattgtttcggccgaactgaacaacgcggcggcaaagaaattggacctcgagggcgtggttcccgggcagcggtgcatttcgggagctggtttcatgctccaactgt

SEQ ID NO: 48069 - DNA, 605 bp, Heterodera glycines
  SCN-specific regions: Sequence locations=1-302,324-605
ttcttccaaatggccgggagtcccaaactgtccgcgtctttgtcgacaactttccggcgctttcgtcccgtgtttttctcccgactcgaaggcgcttggaaaacgtatgccgaagaacaggaagaaagggtgatttccgatttggaagcctttgatctcttttacatttgtcgtaaagaggcagaacataaccaaaatgttgactctcttgagctgatgaaacatttccccgtactttcaacctttgacaaaatgctgctcctcagttcagaattgttcaacattgagtttagggaagtcacaaatgattatgaaaatcagagttttgagcgttgcgacccatcggttcgacttttcgatgtgactgataatgcaacaaattcaagaataggctttttgtacgttgacattttttcacgcgaaactaagaaaatcggccgtggtcaatggctctctatgcttggaaggcctcctaatcaactccgtgacttggacgctttggtttattttttgggtgcccatccccactccgaaaatgaacacgaatcgttcctccatcatgaagaattgagtgaaatgctgtccgcttttggccgtgctcttca

SEQ ID NO: 48070 - DNA, 630 bp, Heterodera glycines
  SCN-specific regions: Sequence locations=1-545,567-630
caacacgcatccaaaagtccgcggctgctaaggaattcttaatgggaaggaaccgtcccgcggcatcaatcccgacgaagctgtcgcctatggtgcggccgttcaagcaggagtcatttcgggggaggagaactcagaaattgttctgttggatgtaaccctcttacaatgggcattgaaactgtcggtggagtgatgacaaaactgatcactcgcaacactgtcattccgaccaaaaagtctcagatattttctaccgcggcggacaatcagccaactgtgactattcaggtcttcgaaggagaaaggccgatgacgaaagacaatcatttgttggggaaattcgacttgaccggcattcctcctgctccccgaggcgttcctcaaatcgaagtcacttttgagatcgatgtcaacggaattttgcacgtgactgccgaggacaaagggactggcaataagaacaaaattacgatcaccaatgatcacaaccgactgtcgccggaagagattgagcgaatgatcaacgacgcggaaaagttcgcagaggaggacaagaaaaccaaggaagtggtcgaagcgaggaacgagtttgagtcgtacgcctactcactgaagaaccagctcgga

SEQ ID NO: 48071 - DNA, 611 bp, Heterodera glycines
  SCN-specific regions: Sequence locations=1-445,467-611
acaaaaaacgttcattttcctcgacacggagtatatgagaccgtctttctacgaaaatgtgctgaaagtgtggaaatcggtgaccaataatcagtcgcgtgcgattttcggcttcaccggggaggactcaatgggaaagtcggccttcccggccatagaggcggcgccctgcttcagcagctccttccctgagattttcaatgggcgaagggacattccttgtcttatcccttgcgccatcgaccaggacccctattttcggatgagtcgcgacgtcgcccctcgtcttaaatacccaaagccctccctcatctacagcactttcctgcccgcgttgcaaggcgctcagagcaaaatggcggcgagtgaggccaattcgtgcatttatttggacgacactccaaagaaaatcaaagagaagatcaacaaatatgcgttcagtggcgggagggacacaaaggaagaacaccgccaatttgggggcgactgtaccgtggacacttccttccaattcctgcgctttttcctcgacgacgacgaaagattagaagatataagagagcaatacgcaagtggtgctatgttttccggcgaactcaaggcgattgcta

SEQ ID NO: 48072 - DNA, 730 bp, Heterodera glycines
  SCN-specific regions: Sequence locations=1-324,358-588,611-730
ataagagatctctaaaatgattatacgcagcaaagccgtccaacttttgacttgctacagaaataggatcaccagaaaactacaatattcgactacggagaatgtgccggtgaatgtgcctgagccggtcatttcctcctccaacatggcacagttccgcaagggagcgggcggtcgttccagcttctcgggcaatgtcattacagtttttggcaacaccggatttaccggccgaagggtggtcaatcggttggccagacacgcaaatcagctaattttgccgtaccgctgcgattcgtattttctcagagaattgaaagtgccttgtgaccttggccaagttctgttttttcctttccaattggacgacgatgaaagcattcggaaggcagtcaaatacagcaacgttgtgatcaatatgatcggcacatatgtcgacacaccgaattattccatttatgacgccaatgtggagggtgcgtggagaattgcgcgcatttgtcgggaaatgggcgtggaacggctgatccatgtgagcgcattgaacgcggacccatcgtacaaaacgcaattcatcaaaaatggcgcctttctgaaaagcaaaggcatggccgagcatgcggttcatgccgaattcccaagtgccaccatcattcggccctctgtgatgtacggcgacattgaccgtctcatttataatctgatcacccgttggcgcgttgacccgttc

SEQ ID NO: 48073 - DNA, 795 bp, Heterodera glycines
  SCN-specific regions: Sequence locations=1-100,122-532,572-795
ccagtttgaggagggacaaattaattttgaatttctccctgtgcatttaaacataacaatgcggtctttttgcacgagtaattcgctgagtgttttctccaattttcgtttcattcaaaaattgctgtctgtgctgcgaaaagttgcaggaaaatgtcatctgagtcaaatatggagaatttccccgtcaaattggacatggattatatcaaacggttggcacgcatcgaacggaccggccctatcacttttaggctatcgcaaggcggtgaatagggacgttttcgggggacaaatgttcgcgcaggcaattgccgcggcagaagcaacggtggacggcgacgaatttgcaccgaacgcggcccattcgatgttcattagaaaagcattcattgaccatcccatcgaatatattgtcaccagaacgcgcgacgggcgttcattttgcactcggacagtcgaagcgcgacagaacggcgaagccgttttctgtgcgcagatttcactttgcgttaaggaacgctcttccattgaacaccaaacagaaatgccagcggaagtgccggagcccgaggagttggtgccgttcttcgagacggtccgtcgagtggtcaccgaacacgacgagggcaggacggagcgtaacggacggaccatcgctaaccttcgcgcggtgctcgaggacgagcagcaaccgtccgtcttcgagttccgacccattcattccgacatttttcttggcattcgaccccattcgcccacgccgattcgttactggttgaaatgcgccgttcc

SEQ ID NO: 48074 - DNA, 581 bp, Heterodera glycines
  misc_feature (560)..(561): n is a, c, g, or t
  SCN-specific regions: Sequence locations=1-442,468-556
gaagtcgcctgctccgcctacagctgtgcgcgacacttcacgtgttgaaatggactgctgccgcggttggctcacggacggactttctcggcacgaaggagcgcatcgaacagggcaatttcttcagggatgttctcgacaaggcattggccatcaacccggaggagtacaccctgcttcacatgcgcggcaggctcgtcctctcggtggcttctctgtcgtggattgaacggaaggcggccaccgtccttttcggcccgccgcccgaagtttcactcaacgaggcgaccagagacttcacggcggtgttggagttggcaccggattggctggagaacactctcttcctggccaaggcgtatttggccaacagcgacagggaaagtgcggtgcaccatttgaaacagctgatcgattcctaccagcagaacgaaaacgacaaggaccagcccgaggcactgaaggaggccaaggcgctgctcaagaagcacgggagaaaatgacctcaatgaaactcacccatagatcttcttaatggactcattaaaggatttgcaaannaaaaaaaaaaaaaaaaaaaa

SEQ ID NO: 48075 - DNA, 668 bp, Heterodera glycines
  misc_feature (76)..(76): n is a, c, g, or t
  SCN-specific regions: Sequence locations=1-668
aattgcgtgtccatatgagaaggagcagaaattctaacataaggcacttcttggtgacgaaaaagcgaggttgggncctttctttcatgtacgatgcgcccgctggcattaacaaaaagaaggaggaagggccggaaccgaaattcgaatggcaaaggaaatacaatgcaccgcgtgaagaatgggcgaaaggaaatgaactcatccaggaccaacctttcggaattcaggtgcgaaacgttcgctgtgtcaaatgtcgcgcgtggggtcatttgaacacggaccgcgaatgcccactgtatggtatgagtggaaatgctgaagaccatggctatgcaaataatccctccgatatcattcgtgatttaaatgtcgaaaagaaaacaaagactgtctctgatgtcacgaccaatgagcagattgatataaaaccgaaaattgaggtgcgcaaaagccacgaagagaagaaaaagaagcgacgccattactcatcggaagaagaggaagaggggacggaagaagaagaaaagaagccggaaccgatcgatcaggaacaattgctggtgaacatgcgtgaggagcacaatttgaagttcaagaccggcattctgattggtcttcgagcggacgaacacataaaaaaaatgtcagcgatggttggaggatgg

SEQ ID NO: 48076 - DNA, 368 bp, Heterodera glycines
  SCN-specific regions: Sequence locations=1-272,294-320
aagggaccgcaagaaagtcgagaacgtgaagcacagcggcaacctgaccattgaacaagtgatcaacatcgctcgtcagatgcgcccccgttcaatcgcacgaaaattgcaaggcaccgtcaaggaaattttgggcaccgctcaatcggttggctgtaccgtcgatggacaacaccctcacgacattgtggacatgaccagggcgggagagattgaagtgccagaagaatgaacggaccggtgatacgctgagaaagtttggagaaagaatcaaatttgttgttgtgttttggacttttccgttaaatttgatttattttaaaaaaaaaaaaaaaaaaaaaaagaaaaaaaaaaaaaaaaaaaaaaaa

SEQ ID NO: 48077 - DNA, 527 bp, Heterodera glycines
  SCN-specific regions: Sequence locations=1-527
tatgcaaattgaaacggacgaacttcgcgaagccgaacaaagggaatttatgatgtgttcagcctgaaggcatcagttaataccagcaacatggtcctatttgacgctgccggatgtctaaggaagttcgactcgcccgagcagatttgcctggaattcttcgagtgccgcagggaattgtacaagaagcgcaaacgctacctcgaaggaatgctgcaagcgcaaagcgaccaactcagtgaaaaggcacgcttcatcgtgatgaagatcaaaaacgagatacacatcgaaaacaaacggaaatcggctatcgtagagcagctgcagaagcacaagttcagaccggatccggtgaaacggtggaaggacgaacagaagcggaaagagttggagctgtgcggagaggcaaatgtgtcagacgacgaagaggacgaagacgaacatgcggaccaagcagttgatgaggccttggagaagcgctgctctgattatgactaccttgttgggatggccatctggaaactctc

SEQ ID NO: 48078 - DNA, 722 bp, Heterodera glycines
  SCN-specific regions: Sequence locations=1-253,277-660,687-722
ggcgatggtacacccctgttgtggtgttggccgggtctttgttggacgctgcagaaaaacttcttgccaaggaattcatccgaccaccatttccgactcattccacgggcggccacattttctgaaaaagttctcgaggaaatggccacacccattgacattaacgatgacgacgagttggtgaagctcgccatgacgagtttgaactcgaaggtcgtttcgcaatattcccatcttttggcaccaatggcggtgcaggcagtgaagaaactgatgagttcaccggaggactcaagtgtcaatctgaagttgattaaagtcgttaaaaagttgggcgaaacggtggaggagtcgcagctcattgagggggcgctgatcgatcagaaatcgatgggccacggaggccccgcgcgggtggagaaggcgaagattggcctcatccaattccaaatctcaccaccaaagcccaacatggaaaatcaagtggtcatctccgactatgctcaaatggaccgtgcgctgaaggaagaacgaaattacattttggaactgtgcaagcaaatcaaaaaggccgggtgcaatgtgctgctaatccaaaagtccattttacgcgatgccatcaacgaaatggcgctgcattttttcgcaaaaatgaaaattatggtgatcaaagacatcgagcgggatgacatcgaattctatgccaaaatcctcgggtgtcg

SEQ ID NO: 48079 - DNA, 493 bp, Heterodera glycines
  SCN-specific regions: Sequence locations=1-493
gaagatgttgaacacgggcccgtccaggccccctaatcataaattgttggcatgggacgggcagaaggaaatgaagggccgatcaagaatgcccgagccatttctgacgagcaagcccatcggctgatctacgagaaggagttggcaccgttcggtgccaatccgatgattgcgcaggacgcggtcagccaaatgttggacgtcagcgtggacaacgcgctggggccaaatgtgcgcgagaatttgctgaagaatttgagcggcaaacaattggcacagcttccgttggcgcctctgcccaaaatgaagaagtcggactcggacaaattggcaaagcgcaagcaccaaatcacacatttggccaccgtggctgtttcgcgtgaggaacaactcaaagacaaatgggcggacagcaaacagaccaaaaagatgagccgtcagaagctcggattctgaattcagatcagtctgtcctcctcaaatttacggtgtt

SEQ ID NO: 48080 - DNA, 684 bp, Heterodera glycines
  SCN-specific regions: Sequence locations=1-481,503-684
cccccgcggactggtcggcctgttgggcctcttggtggtcccggcttacacatggctgccgacaaaacattcaaaaacaaagttgctcagttccgttatttgtgctattcaaacagcgtgcctaaccatgtgaaaatttctgtgacaagaaacaatttgttcgaggattccttccaagaaataatgagaaaaaaccccttcgacttgcgtcgtcggttgtacattcagtttaaggcggaagatggactggattacggtggaattgctagggaatggtttttcttgctctctcacgaagtacttaatccgatgtattgtctgtttatgtatgccaattcgagcaactacagtctgcagattaatcccgcttcttttgtaaatcctgaccacttgaaatattttgagttcatcggtcgcttcattgctatggcacttttccatggaaaatttatctacagtggtttcacgctcccattctacaagaaaatgcttaacagaaagatcactctcaaagacttggaatcggtcgacactgaattttacaattccattgtttggattcgcgacaatgacattgatgaatgcgacatggaattgttctttgtggttgattatgacctacttggtgaggtcaaaacgcatgagctgaaggagaatgggactgaaattgctgtaactgaggcc

SEQ ID NO: 48081 - DNA, 599 bp, Heterodera glycines
  SCN-specific regions: Sequence locations=1-14,37-599
ggttattacccagttgagctggtttctttctattataaaatgacactgccatcgtccacatttgatccggcaaagggtggaactggacgcaatgaaggcgatttagcgaagctttctaacaatattctagcagggacatgccttcgcatatgacattgaagtacagacaaaaaggacaggcccaccccgaggaagtcgttgcaaagaacctccgccgtgacattgaggaacgtgagcagcattcgcgtgagcgtcgttcacgggattctctggacagttttggcacgggtcccacaaacaaaaaacaacgcgttgaggacacttcatctgcacgtaatcttgacgctgatgaaccatttgatgagctcaacgaggacgacaccgacttggacgaagactctgataacgaggccgaacttatggcggaactcgagcgcattcgcaaagaaagagctgcggaaagggcctcaaaagaggcgaaagaacgcgaagaacaggaacgcattcgagaagagaacattctccatgggaatccgctgctgaaccccgcatcgtcggagtttaaggtcaaacgccgttgggatgacgatgtcgtcttc

SEQ ID NO: 48082 - DNA, 716 bp, Heterodera glycines
  SCN-specific regions: Sequence locations=1-358,380-716
ggcacgcgactccatgacaccttttttctttaagaccggcactttaacagaattcccggaagattaccttgaaagtgtcagaaaagtgcattctgagggcggtttcggttctattggctatcgctacgattggaagttggaagaagcgcagaagaatttgctgaggacgcacaccaccgccgtttctgcccgtcagctttaccttctcgcacaaaaacctttccaaccgtccaaaatgttcagcatcgaccgcgtgttccgcaacgaaacattggatgccactcacttggccgaattccaccaagttgaaggtgttgtggcagaacgaaacctctcactagcgcatgtcatcggacttttcactgaattcttcaggaaatgcggaattgaaaatctacgcttcaaacccacttacaacccgtacaccgaaccatccatggaaatttacgcttttcacaccggactgaacaaatgggtggagattggcaattcgggcatgtttaggcctgagatgtcgcttccgatgggacttccggaagacgttgccgtggctgggttcggtctctccctcgagcggccaaccatgatcagatacggcatttccaacataagagagctttttggacataagattgatctcgaaatgatctacagaaaccctttgtgcaggttggagcagaaaaactagtgacgaaatgggagtgccaataaacatt

SEQ ID NO: 48083 - DNA, 738 bp, Heterodera glycines
  SCN-specific regions: Sequence locations=1-13,35-174,196-230,256 -267,289-738
gagttcgttgaaccatacctgaaggaactgatggacggactgaccgcgaaagtgtttcgtacgtataacgcgtcgatcactctccaagaacagctggacaaactgacaaatccttccgattccgtccacgagaaaatgctttcctacaatcgtgcaaatcgtcaggtggccatcctttgtaaccatcaaagggcagtgccaaaaacgcacgaaaagtcgatggaaaatttggagaataaaataaaagagaagaagcaggagtacaaggagttgaaggatcagctgaagaagagcaaatcggtggacgagaaaatggcaaaaaaatacgaaagattgaaggaacagatcgccaaactgaacacacagcgcacggacaaggatgaaaacaaacaaattgcactgggaacctcaaaactgaactacttggatccgaggatttcggttgcatggtgcaaaaagaatgacgtgcccgttgagaaaatattcagcaaaacgcaacgcgacaaattccgctgggctctcgacatggcgaaggaggacttcattttctgacacttcctcgcaaccctttccgatttcccttcacccccttttactcgctgttccttacttttggagagtgcccctttcctctcaatcactctcttctgctggacctaaactagtagttgtttatatcttgtcatgcctagtttgtgtgagcgtttgttttcatatgtctgatgattggttcgtatt

SEQ ID NO: 48084 - DNA, 651 bp, Heterodera glycines
  SCN-specific regions: Sequence locations=22-277,299-651
catttgaaaatctttcttccgtctctttaacaattgttttgcatttgtcgtgttatgcttgtaaaatcatttcttggtccgacgaaactttgtcaatttcgtttgtcgttctttcacaattcggtggtaaaaatgaattctgataatttccgcgttgaacgcgacactttcggtgaactacgtgttccttctgatcgctattatggagctcaaacggcaagatcgatgcaattcttcaaaatcggaggacccgaggagagaatgcctttgcccgttattcatgcatttggccatctgaagaaggctgcagcaacagttaaccaagattttggattgaattctaaagtggcagcggcgatttgtgaagctgcggatgacgttatttctggcaaattggatgagcattttccgcttgttatttggcaaaccggaagtgggacgcagtccaacatgaatgtgaacgaagtcatctcgaacagagcaattgaaattctcggaggcgaacttggctcgaagactcccgtacatccgaatgaccacgttaatatgtcccaatcgagcaatgacacttttccgactgcaatgcatgtcgcggtggccgttgagataaacactcgtcttttgccttcgctgcgtttgcttcacgacgaa

SEQ ID NO: 48085 - DNA, 294 bp, Heterodera glycines
  SCN-specific regions: Sequence locations=1-50,92-161,183-204
aaatgtgcgacgaagaagttgctgctctcgtggtggacaatgggtccggaatgtgcaaggccggtttcgcgggcgatgacgcgccccgcgcggtgtttccgtccattgtgggccgcccccgtcatcatggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgcgtgtct

SEQ ID NO: 48086 - DNA, 525 bp, Heterodera glycines
  SCN-specific regions: Sequence locations=1-168,218-314,337-358,391-525
atatttgaaaaatgtctggacgcggaaagggtggcaaagcaaagtcagggggcaaggccaagtcgcgttcttcacgtgccggactgcaattccctgttggtcgtcttcatcgccttttgcgcaaaggtcactacgccgagcgtgttggagctggtgcccctgtgtatttggcagcggtgttggaatatctcgctgctgaagttttggaattggctggcaatgcttcgcgtgacaacaaaaagacgcggattaatcctcgtcatctccaactcgctgttcgcaatgacgaagagcttaacaaacttctttctggtgtgaccatcgcccagggtggcgtgctgcccaacattcaagcagttcttctgcccaagaaaacccatggagaaagtcagtgaggggcaactggcattgtgacggccaatacgaaaatcgcaattgagaaacaggacgacgatatttcctttccattttttggttgtaaattcacatttttccagtatgatgaatgatggtctgaaaaaaaaa

SEQ ID NO: 48087 - DNA, 416 bp, Heterodera glycines
  SCN-specific regions: Sequence locations=1-203,226-256,279-374,396-396
gcgtgcaaattcgccgaactaaggagaaggttgaccgtcggtctggaaagaaagtggaggacaacccgaaggcgctgaaaaccggcgatgctgggatcgtcgatttgattccaaccaagccgatgtgtgtggaggcattcacggactacgctccgcttggtcgtttcgccgttcgtgacacgaggcaaaccgtcgctgtcggtgtgatcaaggcggtggagaagactgaaggcggtggaaaggttaccaagtcggcgcagaaggctgctgcccctggtgggaagaagaaatgagaaacgctgataattggaatggattcgatttttggatttgttgttttttttggccgtgaaataggcccgttaactttgggttttgttggataaaatttgtttcaaaaaaaaaaaaaaaaaaaa

SEQ ID NO: 48088 - DNA, 479 bp, Heterodera glycines
  SCN-specific regions: Sequence locations=1-89,111-133,155-479
catgttcgtttttgctaatcggttagcaactttacgagggccgatggaactacaaagaaggatgcaccgctgaaaaaatggccagggcaggtttcttctgcactgagaagcgaaagaagccctctgacgcagcgaaatgttacatttgccactgcacgaaatgtattgggacccggaggacgaaccgtgggaagagcacaaaaagcaccgcccggactgtcctttggtgaccatcggcaaacaaaatgaggaggaattcactgtgcctgaagtgctccttttgcttgcatatgaacacagcaccaaaatgtacccagttgcggatgcgtcaatgaaagaattggacgtgttgatgaagcaattgttggcggacacgcaaaaggcagtggaagggatttgaaagcgaatgccacggatctcaaacaacaatttctctcatcaccttttgtgtgacattatttacgaaaaagtttgacctc

SEQ ID NO: 48089 - DNA, 556 bp, Heterodera glycines
  SCN-specific regions: Sequence locations=1-74,444-472,512-512,550-556
atcgctgtggcggaaaacgtcgaaattttgccaaaggagccaaactaaagggttcattttctcgacttgattttaaatggatcgccgaggttcccgtcaacctgtcatcaaaaactttaagacaattttgccggctgcatccaatgacatttattatcgagatgagatcggcaacatctccacctcaaatgtttatccccgtgccgatcgtgttgaggttgagctccgcccgcgtttcccattgtatggcgggtggcgtacaaattacattttgggttacaacgttccaagtacgtcctttctccgtcattccggctcgaattttgcgatcaaaatgaaactgatggatcgtctctacgataatgctgttgtggaaaaactgtgtgtcaaaatcatattgcctgaaacgagcaagaacattaagctggtcaccccttactctgactaagcgccttcccgacgaggtgcacaaaacgtacttggacacttttggtcgccctgtgattgttctcgaaaaggagaatcttatcaacaaccatatccagcccttcactct

SEQ ID NO: 48090 - DNA, 662 bp, Heterodera glycines
  SCN-specific regions: Sequence locations=1-296,325-513,535-662
ataagaacttaatttgaggatctacattgaaaataattaattagacttcaaaatgggtatttcccaagacagatggcacaagcggcgaaagactggggggaagcgaaaccccattcacaaaaaacgaaagttcgaaatgggacggccggcagcaaatactaagattggtcctaaacgaattcatttggtgcgttgtcgtggcgggaacattaaacatcgcggacttcgtcttgataccggaaactttgcttgggcttctgaagggtgcactcgcaaaacgcgtatcatcgacactatgtacaacgcttccaacaacgaattggtgcgcaccaaaacattggtcaagggaatgatcgtctcaatcgatgccattccgttccgccaatggtatgaagcgcattacgcactgccattggcgcgcaaaaagggacaaaagttgaccgaagatgaggaggcgcggattggaggagcacagaaacgctcaaagtcgactctgaagaaatacacggaacgccaaaaaaccgccggggtggagccgcatcttctggaacagttccaggccggacgacttctcgcttgcataagctcacgaccaggccaaagcggacgctgcgatgggtacatttttggagggcaaagaactcgagttctacaacaagaaa

SEQ ID NO: 48091 - DNA, 666 bp, Heterodera glycines
  SCN-specific regions: Sequence locations=1-84,106-394,417-666
ctatgccctcgtcgatttggcactccgtcgaccgatatttcgtccacagacactctgaatgcgttgggtttgttgttgactgggcttccttcctccttccaagccttcttcttggatcgaattgaggagtccttcgaatggtcccaaatcgcctctgccgacgctgacccttcgcaattgttcgagtcgcttagccacgaagtttacctccactcggacagtcgcattctctcgatgctggccctaatccattcattttgtcaacatggcggcaataattcgctttcgattattcccgatttcgtgatcaaccgacttgcccacaaagtggacaatgaggcacagctggtgtatttccttcgcattgtggtgccgtatttgcagagaattcacgaaaaggagcggaacaaacacatgcccgaggtgtcccatgggcacaatgttcgattagggcagctgcaaatttcagctactccctatatcatttccatttacaacgttcttgccgatttggtgcagaaggtcggccgacttcactacgaggacagcatttgcgacttgctttaccagttcaaatatatgtttgtcggcaccacgctcaaagaacaaaccgagattttcattctaaattttccgtattcgatgcgtgaaaaattgaaattttta

SEQ ID NO: 48092 - DNA, 697 bp, Heterodera glycines
  SCN-specific regions: Sequence locations=1-247,269-454,476-697
ttgagatgaatgacattttggccaggtggcgacgaatacggaaacgacgaaaaatgttggcaatgccattttatatgaaacagtattgactctaatggaaacaaaaagtgaaagcggcttgcgagttttggccgtgaacattttgggtcgttttttgcttaacaccgacaaaaacattcgatatgttgcacttaacactctgctcaaaactgttgcaattgatttccaagcagtgcaaaggcatcgcaccactgtggtggaatgtctgaaggatgccgacatttccatcaaaaagagggctcttgaactttgctttgcccttatgaaccaaacgaacatcgcgagcatgtccaaggagattataattttcctcgaaactgccgactccgatttcaaagctgagtgttcttctaaaatgtacgttgcgacggagcgcttctccccgagtcttgtttggcatttggacacaatgataaacgtgctgcaattggcagctaaccatgtacctgatgaagttgtcagtgcgatgattcagctcatctcttcccagcaggaactgcagcattacgcaaccgtccaattgtttcatgcctccaaacgggaacacatagtaaatgctcagcccttaatgcaaatcgcattttggagcattggcgaattcggtgatttacttgtcactccgggaaatacggaggat

SEQ ID NO: 48093 - DNA, 603 bp, Heterodera glycines
  SCN-specific regions: Sequence locations=1-603
agcccatcccaaaaactgataaaaaaaatggcgttcctctcccgtctctccatccttccaaattcgccaatttcgctgcttgcagtttctttggccgttttggctttcgtcgctttggcatcggccaatccgccgacggcacgcgaaacggcgccaaatgcacagcaaaacaatgccaattcagtggcaactggggaaattgcgaaaaatattgcggaaaagatggagcggatgaatgagttcattaattattttagggcgaagaagttcatcgatgcacataatttggcatttgagaagggcgaagtgtcgttcaaagttgcgccaaaccatctgatgcattttacacctgcccaatataatcgaattcgcggcttgcaaatgcgcagcaaccgacaacggcacaacatggcaactctggcgggaaacagcagtactttgccggaaaagttggactggcgcgagaaaggggcggtgaccgaggtcaaagatcagggggactgcggctcgtgttgggcattcagtgccaccggtgccattgagggagcattggcacagaaaaaagcgtcgaaaattatttcattgtccgaacaaaacctggtc

SEQ ID NO: 48094 - DNA, 586 bp, Heterodera glycines
  SCN-specific regions: Sequence locations=1-586
acgagttttgagcgttgcgacccatcggttcgacttttcgatgtgactgataatgcaacaaattcaagaataggctttttgtacgtcgacattttttcacgcgaaactaagaaaatcggccgtggtcaatggctctctatgcttggaaggcctcctaatcaactccgtgacttggacgctttggtttattttttgggtgcccatccccactccgaaaatgaacacgaatcgttcctccatcatgaagaattgagtgaaatgctgtccgcttttggccgtgctcttcaacttttactctcccgggctccgtgccatttcctttcgcttccattggctccttattacgcttcggacttcgacgcaaatgattttatgcctgcttttatgaagttttgcatatacaagccaagatttcttggacttttgagtagtccgaattcgcaaaatggacaacaattatgtgacgaaaaggcaacaacttatgccaaagcgctgcagcgcgcgactttttgggattcgcaccgtatccttttctggaccgatttcgacctaacgatccacaacatgcaagactggagaaaaaaat

SEQ ID NO: 48095 - DNA, 291 bp, Heterodera glycines
  SCN-specific regions: Sequence locations=1-291
ccacggctgaaattgtcgcattttctcttttcccgtcgcctttcccgcgccaactttttgaacaagcgaaaaatgtgcagatggattttaatttgttatattttcgcgtatcaaatgactacgaatttttggtagaaacttatgtagaactggcaaaaacgaacgaacaaatccgaatgcatttgcaaattttgaagaaaacgcacgaagaaggcatcaaacaaacaaaatccattatgttggccacagtcttcggattatatgtgccatgaggcaaaaaataatgacgaa

SEQ ID NO: 48096 - DNA, 691 bp, Heterodera glycines
  misc_feature (211)..(211): n is a, c, g, or t
  misc_feature (534)..(534): n is a, c, g, or t
  SCN-specific regions: Sequence locations=1-691
gcatggacttcgaactgtttgatgagaaggcaaaagagaagcggtctttgcgtctctcccgtgaccaattggacctgttgaacttgaactacgggtcgaacgacgcgcggttcagcatcacatcctattatcagggaactgcttggtgttcttgtcacattaataaaactccccctgcctgacaaattggtcatcttttttatcgacggcncaatcacaaagagcgacgtgcttggccatgtcattccagcaattggtggcacttgggcccattccggggttgcagagctgtatactggcatcaaaaagaacggatatcaaatggtttatttgtcttcgcgtgccattggacagtcccactacacgaaaacgtacctgcagaacttcgcccaggggtccaggactttgcccgacggacccgtccttctctcgccttcttccgttctgatggcattcagaaaggaggtcattgaacggaaacccgaggagttcaaaatcgcatgtctcaccgacctgaaatcgctgttccccgtnggacagccattctttgccggatttggcaatcgcgaaacggacgttaaatcgtctcttgcggtccaaattcccccggaaaggatcatgattattgacccgcaagggtcgctcagaagggcggacaacaaagcgggtggttacgtgtccgattacccaa

SEQ ID NO: 48097 - DNA, 720 bp, Heterodera glycines
  SCN-specific regions: Sequence locations=1-720
tgagcgtctccaatgatcgtttgttccgaacacttcacacatggcagtacaacggctggcgactcagtatatgtaccttcccccaatggattgatctgaaagggcaggattcggttccggaaactgtacaccaggttgtctgtatggtcgatccatgtgaggacaaaagttggattcggcttcgttcaaagcctggccaatcagttcagaccgattctgtccacgcacgtgatcagcttcggcccggaagcgacaacccagaaacactgtcggaggcggtcaaagtgttaaaaggggaatatttggtgaaagcagtcgaagagcacaaaatggaccaagcgatcgttttctgtcgaaccaaattggactgtgacaacatggagaagtttttggcgccacgcgggtacaaatgcgtttgtttgcacggcgaccgaagcgcggacgaacggacgcggaatttgctttcgtttaaggaaaagatagtgcgctttctcatctgcacggacgtggcggcacgaggcctcgacatcaaaggggtgccctatgtggtcaatgtgacattgcctccggcggaagaaaaggcgaattacgtccaccgaattggacgagtcggccgagcagaacgaatggggctggccatttcgctggtgtcgacagtgcccgaaaaggtgtggtaccaccaatgtcggagtcgaagagccaactgcaacaacacgcggg

SEQ ID NO: 48098 - DNA, 558 bp, Heterodera glycines
  SCN-specific regions: Sequence locations=1-190,237-245,275-299,328-558
cattttgcttttagaaaatacatctttgcttctctaacaaatcttctctcttctttcattcaaataaaatgccaccaaagccatcgggaaaaggggcgaaaagggcagtgaagtccaccaagacggtgcgcacggctgacaagaagcgtaagaagtctcgcaaggagtcgtactcagtctacatttaccgtgtgctgaagcaggtccaccctgacaccggcatctcgtccaaggccgtgtctattatgaactcgtttgttaatgatgtgttcgaacgcattgctgccgaagcatcgcgtctggcccattacaacaagcgctcgacaatctcttctcgtgaaattcagacggcggtgcgtctcatccttccgggcgagttggcaaagcatgccgtttctgaggggaccaaagccgtgaccaaatacacctcgtcgaaatgagaccgtcgaaaggacgtgaccaaaacacacacacccatcccaaacagttctctatataactataagaaaaaagaaaaaccgttttctctgtattatgactctttgattttttcttttg

SEQ ID NO: 48099 - DNA, 757 bp, Heterodera glycines
  SCN-specific regions: Sequence locations=1-757
ggacagtgcgaagtcttcgccgcctcttccgacctgttccccagcgaaacgatggaagttgttccccaacaaccggcggatgtggcggaggagcacaaagccattggcggtgctgaggaaattgcggtgaacgatgttcagccctccgctgccggggacgcgcagcagcagttcaattccgagcagttggaggagtgcgatcggccgcccgacgctgaggacgacgtcagcgccttttgggtggacggcgactcgcacgaattggtcgcgatgacaattgtcaatgagttgcttttcacgcagaaaatttcgcctggaggagcgcctgtttttgccacaaggtatgacgtggacacaattgtttggcagctcgacccaaacgtctcgccaagtgatcagaaacagaacaatgttttggtcaaccatctcttcactttgaacgcctttggctacattcaggcaggtcaccaggacaaacgctttttgggctgttctcccgacgggcgctatgccgcactgatcaatcggaccaaccattgcttcctctactttcaaaattcggccatttcgagcgagcacgaactgaagaatcgtcggacgggcaaacgagcggaacacatcgccaaacaattggtgctttcgatgtccgacttggacaaggagttcgacccgaacgattcgtccaacgaattcatcgcatttcatgcgacggcggaaaccctctttctgcttactcgctgcgcaatttatgccgtgg

SEQ ID NO: 48100 - DNA, 692 bp, Heterodera glycines
  SCN-specific regions: Sequence locations=1-692
caatgcccttgcatgcgtgccacaatgtggtggggccaaggatgggcggggctaattcgtcgcttggccgtgcttacacgcccgggggaggaggtgccaaccacaacaacggaggaacgtccggacaatcggtcgcacggcacgctgaccattccggcattggccagccgtgctccatccacttgcgcgaactgcccacgctgaacacccatttgacttctcccgcagcagccgtcgctctcggcctcatttatctgcgaacgggcgattgttggatcagagaaacgctggcaattgctgacacattttacgagattgaccaaattcgtcctgacatgctaatgattcgcactttttcgcgttgccttgtcgatttcgaagacattaaatgcacgagagaatgggtcgatgcccaaattccgcagataattcgtaaatatgtcaaacgctttttggaagtcaagtccaaggaggacatgtggtggtccgatttcaatgacatggccacagttgcaaaagcttatttctatggttttgctggtgcttctttcgcaatggctttacgttttgcctcaaaatgggaaattaaagcacttcaagtcattcaaagtttttacgaaattctcaaaactgacacgagtgaacttgccacgtcaacggagggacattcaccagtcgatctggcacatcaa

SEQ ID NO: 48101 - DNA, 617 bp, Heterodera glycines
  SCN-specific regions: Sequence locations=1-21,43-292,339-455,491-617
tgttactttccgactcacgcgctgaacttcgccttcaagacacttataagcgagtcttcacgcaaggagtggacaaggagaagcagttcttgaagttcttcgccatgaatttggcttcgggcggtgccgctggcgccacttcgctgtgttttgtgtaccctttggactttgcgcgaacgcgtttggcagcggatgttggaaaggccgatgcccgtgagttcaaaggtttggcggactgcatcatgaaaatcctcaagtcggacggtcccatcggtctctaccgcggcttcttcgtctccgtccagggcatcatcatttaccgcgccgcttacttcggctgcttcgacaccgccaaaatgctcttctccccggagggcaagcagatgaacttcttcgtcaactgggccattgcgcaggtcgtcaccgtgtcgtccggcgttctctcctacccgtgggacaccgtccgtcgtcgtatgatgatgcagtcgggccgcaaggacatcatgtacaagaacactttggactgtgccatcaaaatcatcaaaaacgagggactgctcaagggcatgttcaagggtgctttatccaatgtgttccgtggtactggcggtgccctt

SEQ ID NO: 48102 - DNA, 547 bp, Heterodera glycines
  SCN-specific regions: Sequence locations=1-547
ccatcccaaaaactgataaaaaaaaatggcgttcctctcccgtctctccatccttccaaattcgccaatttcgctgcttgcagtttctttggccgttttggctttcgtcgctttggcatcggccaatccgccgacggcacgcgaaacggcgccaaatgcacagcaaaacaatgccaattcagtggcaactggggaaattgcgaaaaatattgcggaaaagatggagcggatgaatgagttcattaaggcgaagaagttcatcgatgcacataatttggcatttgagaagggcgaagtgtcgttcaaagttgcgccaaaccatctgatgcattttacacctgcccaatataatcgaattcgcggcttgcaaatgcgcagcaaccgacaacggcacaacatggcaactctggcgggaaacagcagtactttgccggaaaagttggactggcgcgagaaaggggcggtgaccgaggtcaaagatcagggggactgcggctcgtgttgggcattcagtgccaccggtgccattgagggagcattggcacag

SEQ ID NO: 48103 - DNA, 641 bp, Heterodera glycines
  SCN-specific regions: Sequence locations=1-641
cactttcgctccgcgcgcagttcgcccctcggcaccgcccttctcccgcctttcccgtgccgtccttcgctccatttgcttttcttctgtttggctttttggtcggcctctgccttttgttgactttcgctgttccctttcgctgttggcttctcaaaaagaaaggcattccttcgggcgtcgttggctcctcatcctccaccgattcggccatcgcattgttgaagcagttccaacagaagcggcacagcccggcgcccctccagcgacaagcgccgcttggtttcgagcaaagctgttcagcatccgtcgatggggtgactctcgtccaacggagtatcgctttggacctccaacttatggaagtgttcgcccgggggcgatacggcgagttgcgaaaggcattttacagggggacggtggtggcggtgaagatattttatacgacggaggaggaatcgtggcagaacgagcgcgacatttaccagtgccaaatgctcaaccacgagaacattttgcaatttgtggcggcggacattctcagcagcgtcgagtcacttacccaaatgcttcttatcaccgacttccaccctttgggcccgctttacgactttttgcgtgccaacggtcgtctcagtttg

SEQ ID NO: 48104 - DNA, 692 bp, Heterodera glycines
  SCN-specific regions: Sequence locations=1-692
agtggaccttgtcgcgcaaagcctcactgttaatccgaacatggccatcttcatacaatgaatccggggcattctggacggtccaacttaccggacaatctcatgcaacagttccgttctcttacgatgacatctcctgatcgtgggctgatcgctgaagtcatgcttttttctcaaggatttcaatctttcgagagactcgcaaacaaaattgtcctattatttactctctgcaaggaacagctttcgaaccaatgtcattacgactttggattgcgtgctttgaaatatgtgcttgtttcggccgggaatatcaaacgcgatgcgattcaacgttcttacgatgaaccaagccagagcggggatggagctggagaacaggcagtggcaagccaaatgtctgaacaacaaatgctcttccaatccgtgtacgacactttgacaccgaagcttgtctctgaggatatcactctttttaaatcgcctttgcatcaatttttccctgacaacagcccaaaacaagtggaaagcctcaagaacgaagttttgagcatctgcaaaaccgaacacttctcatgttcacctatcactggggagaagggaaatctttggctggagaaagttcttcatgtttaccaaatcaccaatcgcaatcatggcctaatgcttgtcggtgcgagtggatcgggcaa

SEQ ID NO: 48105 - DNA, 701 bp, Heterodera glycines
  SCN-specific regions: Sequence locations=1-130,152-152,174-701
acatggctttgtgcaagcatggactgcgccttccgcagttcatatcttcaacgaaatacggcgatggctcggaatgcgtccaaatcaccgcagctgttggtcctttactgtgatcagcttttttttataagtgcacgcaacatggaggacgagaagatggatgagaacctggatgctttgatgaccgtcttcatttacatcgacgacaaggacatgttccaagcgtttttccacaagtttttgtgcaagcgcctcgtctacgacacgtcagccagcgaggagcaggagcgatgcatgatcgcaaagctgaagcacatgtgcgggttcgagtacacctccaagttggagcgattgctgactgatgtcgcgctgagcagggaccactccgagcaattcaagcagcagccgaggacatccaacgttgacttctccgtcattgtcgtcatgtcgagcgtgtggccactgcagcagccggtcaaattcgaaatcccgcgtcctctcctcgactgcattgactcctacactcagtactacaccaaccgtttcaatggccgtaagctgacctgggcgttgcaaatgtgccgcggtgaattggtctcgacgagcaacactttcccgtcgaaatactcatttttgtgcaacacgcaacatattgccgtcctcatgcagttcaacgaacgcaacacgtacacacttggcga

SEQ ID NO: 48106 - DNA, 374 bp, Heterodera glycines
  misc_feature (347)..(347): n is a, c, g, or t
  SCN-specific regions: Sequence locations=1-11,68-146,172-259,286-374
cattcgccgtttggctcgtcgtggaggcgtcaagcgcatctccggcctgatctacgaggagactcgctcagtgctgaaggtgttcttggagaatgtgatccgtgacgcggtgacgtactgcgagcacgcgaggaggaagactgtcgccgccatggacgttgtctacgcgctgaaacgccaaggccgcacgttgtacggatttggcggttgagcgggacgggaagaacggaggaggagaggaatcatcaaacaaaactatcccaaacggccctctttagggccacaaccattcaaatggacggatatgctttatcaacttattttaacgataaatttgatcttttgtnaaaaaaaaaacaaaataacaaaaaaaa

SEQ ID NO: 48107 - DNA, 541 bp, Heterodera glycines
  SCN-specific regions: Sequence locations=1-10,35-170,215-220,246 -275,309-353,384-541
cagcgcacatttctctctctccatttcttctcttctttaacaacaaaatgccaccaaaaccttccggcaaaggggcgaagaaagcggtgaagtccaccaaagcggtgcgaacgggcgacttgaagaggcgtaaggctcgcaaggagtcgtactctgtgtacatctaccttgtgctgaagcaggttcacccggacaccggcatctcctccaaggcgatgtccatcatgaactcgttcgtcaacgacgttttcgagcgcattgccgcggaagcctctcgtctggcccactacaacaagcgatcgaccatctcttcgcgcgaaatccaaacggccgtccgtctgattctgcctggcgagttggccaagcacgccgtgtcggaggggaccaaggcggtgacgaagtacacctcgtcaaagtcgacttcggtgtccggcaagggagctcggcgcgtgaacaatcgagacgtgtcacagaaagacagcacggctcatgcctctaatcattcggcggaaacgttttccgactcattggtgacggaaga

SEQ ID NO: 48108 - DNA, 525 bp, Heterodera glycines
  misc_feature (24)..(24): n is a, c, g, or t
  SCN-specific regions: Sequence locations=1-525
aagcatagtgctagttttccgctnatctctgcttttacactcttatttagtaaaaatgtttccggctacaaaattgttgaccacactttcgatgccattgtggtgggcgcaggcggcgcctgtcttcgagctgcgatgggtctttcggaggggggaatgaaaacattcgctactaccaaactgttcccgactttttcacacactgtggcggcccaaggcgggataaatgccgcattgggaaacatgaacccggatgattggcgatggcactcttatgacactgtcaaaggaagcgattggcttggtgatcaggacgctctcccttatatgaccagggaagcgccccgggcggccatcgactcggaaaactacggaatgcctttttcgcgcacggaggagggaaagatttaccaacgcgcctttggaggacaaagcaatgattttggacgcggtggtcaggcgcacaggacgtgttgtgtcgcggatcggaccggcccttctctgctgcacactctttacggcgct

SEQ ID NO: 48109 - DNA, 350 bp, Heterodera glycines
  SCN-specific regions: Sequence locations=1-350
cctccgtttatgcgaccacgcatttcgtctttatcgtcaatttttcgtgctcgacgattcggccggcacgcgggcttcgatgactcccacaacgcccgcctcgctgcttttctccttttggcccgttcagccccattccaaccatttcgaggcgttcattgagggtctctgccgcgtgctttacgacactctccgtccgctggtcgtccacaacccgcacctcgaaacactggcacaactgtgcactcttttgaaggtcgaaatgatcgacgagcgctgtgccgcgcttccgtcgtcccatccgaacgcttttccgccccctttctccgcgacttcgccaaccgacgcaa

SEQ ID NO: 48110 - DNA, 639 bp, Heterodera glycines
  SCN-specific regions: Sequence locations=1-273,295-419,445-497,520 -563,586-639
tcgcgacatggttgtctgttctgcgtacgggcacgagttgcccaaatatgggataaaggttggactgacaaactatgccgcagcttacgctaccggacttttgttggcacgtcgccacctgaacaaattgaaattggacagcgtttataaaggcaaagaaaatgtggacggagaggactttgacgttgagcaggaaggggacaatccgaacccgttcacatgtgtgctggacactgggctcgcccgcacaaccaccggcgcaaaactgttcggagtcatgaaaggagttgcggacggtggcattcacgtgcctcatagtgagactcgtttctttggctatgacccggaagagaaaaagtacagcgcagaagcccacagagaccgcatttttgggaaacacgtggctgactacatggcccacctgaaggaagaggacgaggaagcgtacaagcgtcagttctcccagttcatcaagaatggcatcgagtcgggaacgttggaagaaatgtataagaaagcgcacgatgccatccgcgcggatccgtccttcacgaaaaaggaaccaaagaagccaaaggagcaaaaacattggaacaaaaagaagtacacactgaccgagcgcaaacaccgtgtggccaa

SEQ ID NO: 48111 - DNA, 593 bp, Heterodera glycines
  SCN-specific regions: Sequence locations=1-82,106-593
caacttcaactgtctgctactgctgtacaacaaaatgccccgtcattgtgcaaagcctcgttcttttcatgccggactgaaattccccgtcggtcgtgtccatcgcaagatgaagaagggtccttttgccaaacgtcttgcgaacggagtgccggtctacatgactgctgtttctgttcacatcacgggcgatctgctcaagattatcggcgatatcacgcagtccgaaggcatgaagcgtctcagtgcatttcacattcgatctgcagcgcgcgaaaacgacgagttgaggaagctgttctctggcgtctctcttgccgaggtgtgcgtgctgccggagctcgaatcggatgtggagcaatcatcggaaggaagtggcgagtccgactccgatgaaagtactgaagggagcgcgagcggaagtcatgagggtggcggtgctgctggtgcgcagcaatgagaggaggattcattctcgagaccgccgtgataacattgacttccaatttaaaagaggatagatctctctgtctgtgatatatatgtctattgcaaatatgtccatgtctctgtgacattgccttcttgctgct

SEQ ID NO: 48112 - DNA, 556 bp, Heterodera glycines
  SCN-specific regions: Sequence locations=1-179,202-556
caaaggcgaagaatggtcggacattccgataagcgaatgccgaatggccgagttggtccggcactttttcgccttgggttggatgtgcgacaacggcagcggaatggcggtccgagtgaaagactatcggacgggcgaacatttgattctgaactcgtccaattcgttggatattgatattttttcggaaaacgatttatttgtgatgaaaatgaacggcgaaattttgaaaagcccgtcaaaatcggaccgatctccgacggcgccgttttatttactgcgcgacaatccggatttggcctgtgtcattcacactcactcaaaatgggcaaatctgatcacccaactgatcagaggagacgagttcaaaatttcaaaccaggaaatgattcagggttgtgaaaatcgtctcacaaaaggccgtctggataacattgacgtgctagtggtgccaattgtgcagacagagatcaatgagcatctgctttatccaattctgctgaggacgctgaagcaaaacgcgggggcaagtggcattttagtgcgtgggcacggc

SEQ ID NO: 48113 - DNA, 643 bp, Heterodera glycines
  SCN-specific regions: Sequence locations=1-114,156-225,247-268
ccaaaagcgcttcttctcatcgccttcgccttcaaaacttagaagcaccaatcccaaccagaaaaaatgtgcgacgaagaagttgctgctctcgtggtggacaatgggtccggaatgtgcaaggccggtttcgcgggcgatgacgcgccccgcgcggtgtttccgtccattgtggttttctcccgtcatcagggcgtcttggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgcgtgtcgcccccgaggagcacccggtgctgctcacagaggccccgctgaacccgaaggccaacagagaaaagatgacccaaatcatgttcgagacgttcaacacgccggccatgtacgtggccatccaggccgtgctgtccctgtacgcctccggccgtaccaccggtctcgtgttggactccggcgatggtgtcacccacaccgtgcccatctacgagggttacgccctgccccacgccatcctccgtttggacttggccggccgtgacctcactgactacctgatgaaga

SEQ ID NO: 48114 - DNA, 496 bp, Heterodera glycines
  SCN-specific regions: Sequence locations=1-5,28-496
cgaggagtacgacccgaccattgaagactcgtatcgaaaacaggtacttattgacggtgagacttgtttgctggacattttggacaccgcaggacaggaagagtattcagcgatgcgggatcagtactttcgcacgggtgagggctttctgctggtcttcgcgctgaacgatgtccttttcttcgagaacatccatgcctaccgtgaacagatcagacgggtcaaggacagtgacgaagtgccgatggtgttggtgggcaacaaatgtgacttggcacagcgcgccatggaccagcgctccatccaggagttggcccgctcatttggaattccgttcattgaaacgagcgcaaaaacgcgacggcacgttgacgaggcattccatgcattggtgcgcgaaattcgtaaacacaaggacaaacaccgggagaggccgaaacggagaaagcgctgtgccgtcctctgacgaaagaaggggaaaatttaaaccaaaaaa

SEQ ID NO: 48115 - DNA, 680 bp, Heterodera glycines
  SCN-specific regions: Sequence locations=1-680
ccttccggctgagtgggacggtcggctcggcactttgagcgtggagcaactcggcggtgacaatttcgaatggaccgtcgcggttcagaaaaagttcaccggggttggtaaggctagtgcgatcgacttggacttggcctgctccgtccccgttggctccgatcacttggccgatttggtcgacctttgctacaaatttcgacatacagactctgcgggagatttgctcccttccactgaatacactctgtgccgtcttttactggaattcggcgaatttggcgttttcatgaatttgcttaatgacccgatcaactacggcatctttcccaatgagcacatttgctgcatgttcctcgaccattttctcggctccgctcagttgcaatatgcggccaaaattgccatttatgtgatgctgcaggaaatgttcgacttccctttgctcacttttctcgccactcgcgcccttctcgagtggacgcaaggggaacgaaaactcgatgagcaaatccatccgaaaatggcaccttctctggaggacgagactaacttcaatgaggagaacgtgcgcctttttcgctacccttttctgaagaaccctttttgggatggacacttcgatgagaatgactccgaccgaatggcaggcaaagccctcgaatggctttcataccatt

SEQ ID NO: 48116 - DNA, 767 bp, Heterodera glycines
  SCN-specific regions: Sequence locations=1-305,334-381,408-555,577-767
gatgacacggaggagcagcgggtgatacgcaatgtgaagtcatgggagcaggatccgcactatttcaaggaagtcaaaatttcggccttggcccttgtcaaaatggtgatgcacgcgcgcagcggggggaacatcgaaattatgggtttgatgcagggccgggtggacgccaacacaattattgtgctggacgcttttgcgctgccggtcgaaggcaccgaaacgcgggtgaacgcgcaggcccaggcctacgaatttatgaccaacttcagcgaaagttgcgaggcggttggccgtttggaaaaggtggtcggctggtaccactcccacccgggctacggctgctggctgagcggcattgacgtgaacacgcagtccatcaaccagcaattccaggagccctttgttgccattgtgattgacccgattcggaccgtcagtgcaggaaaagtggacattggcgcgtttcgcacttacccaaaaggttataagccgcccgatgagccgccctccgagtatcagacaattccgctgaacaaaattgaggactttggcgttcactgcaaacagtattattctttggatgtcacttatttcaagtcatcactggactccaaaatgttcgacgctttctggaacacttattgggtgagcacattgtgtgccaatccgttgcggaccaacgccgattacatcacggcacagttggccgatttgggcgccaaattgcagcatgtgaacacccgtcatggagcgtcatttcgtga

SEQ ID NO: 48117 - DNA, 587 bp, Heterodera glycines
  SCN-specific regions: Sequence locations=1-328,350-587
ataggagaaaaagctggaaaacatcgagaaagagttgcgtcaagtgaaggagttgtacgacaccaacaaagagtttaagtctttcattgacaacccaattctgaataagcaaaagaaaaaggaggccgttgaggatgtgctgaagaagcagggcgtctcacaacaagttcagaacttcttcggccttttggcggagaatgggcgaatcaacaaattgaccggtgtcgtgagctccttcgaaacaataatgcgagcgcatcgcggagaacttcacgtggaagtcgcaagtgccgagcccctcgacaaaaaacacgaacaatcgctgaacgacgccctgcaaaagtttgccacgcgtggacagaagctgaacttgactttcactgtgaagccggacttggttggtggactggtggtgaacatcggcgataaatatatcgatttgtcaatggcaacacgccttaagaaaatggacgcggtggtaaagggatcgatctgatcaatttttgttagcacgacagaattagccgatgacttgacagttccgaatgttcttttgtttttattgtctcaaataccatattattact

SEQ ID NO: 48118 - DNA, 641 bp, Heterodera glycines
  SCN-specific regions: Sequence locations=1-641
catctcccgctcttccggtctaccaatttacgactccgccaaccgccgagtggaggatttggaatgtcgtctgtgcaacaaattcatccttaatcgcataaaggcttccacatcctttggcatctgaacaccgacctcaacatcgtccgttacggctgcaaacactgcaacttcaagcatgaccgtcctcaatcggtcgctgcgcatggcattcgagagcacggcgacgaagcatcgtgtgaagatttgctgtacaacttcgaggacgagctcaagcaaatgtccaaggcgtgctttggcgtggagcgtttattcgaaaaggaaatacgccgacgcaatcgcttagaacgttttgcgcgatgttcgactgaaaattcctcggcgggccgtgccgaggacgacgacaattcccagcacggaaacaacgagtccaaactgtcacagcaaattgttcgccgccgttctcaacagcatatcatgaatctgagagtctcgttgaagtctgaaaatgttgatcgcgactggacgcccaaagagccggtgaggaaacgacgaagcgggggtcgtcgtttcttcggatcgaggggtaggaagccaatgtcgcgtaaggcgcgggatgtgatgatcaaactgcgcgatgt

SEQ ID NO: 48119 - DNA, 728 bp, Heterodera glycines
  SCN-specific regions: Sequence locations=1-728
gattatttgctggttcctgccttgtgcagaacggctccgctatcagccactcgggtgggccaattcgtacgagttcaccgacgcagacttccgagtcgcgtgcgatactctcgattccactgttgacatggtcgcacagaacagggcgaatgttaagccggataaattaccatggctggctctccggactctgctctctcagtgcatttacggaggaaaaatcgacaatgattttgatcaggtgcttctcgatactcttctcgacaaactgttcacatcaaattcatttgacgctgactttattctcattgaaaacatcggagtgaacgccttgaacatgccagacgaaactaactcaaaggatggtttgatcaactgggttattaacatcaaagccttacaaaagcctaattggattggacttccaaacaacgcagaaaaagtgcttatcgccgaaagagggtaagaatttatacggaagatgatcaaaatgtcggacgatgaacttgcatacgaagcggatgatttggaacgtaacaagcaagcccctacctggatggttcaattttctggacagtgcaaatcttggctcgatgctttgccacaacaactacagcgtcttcgacggactaaagaaaatgtgcgcgatccgttgttccgattctttgaacgtgaaatcaacttgggcgccagacttttgtccgatattcgacgtgacctcaacgaat

SEQ ID NO: 48120 - DNA, 652 bp, Heterodera glycines
  misc_feature (592)..(592): n is a, c, g, or t
  SCN-specific regions: Sequence locations=1-128,150-652
caatctgtacgtcaagaacctgcacgataccatcaatgatgagacacttcgaagcaattttgaatcctacggaaacatcacaagtgcaaaggttatgtgtgatgagcatggtcgctccaaaggattcggttttgtgtgctttgaaaaggcggatgaagcaaccaaggctgttgtggaaatgaacaacaaaatcatcgaaaacaagccgctttacgtcgcgcttgcgcaacgtaaggaagaccgcaaagctcaactggcctcgcagtacatgcagcgcttagccgcgatgcgcatgcagaaccctgctggcctcatggggacaatgtatgcgcctgccagcggtggatttttcctgccacaggccatccagaaccaacgtgctgcgccgttcatgcaaacaccgaatctgtccggggcacaaatgcgtggcgctgtccctcgctggaacaatatgggcggtttcaaccatccaatgcaaggctacatgatgggtccagctgttggcggtcagttcggcggtgctaatcaaattgctcgtggaggacctcgctccggtggatgggtggtggcggtgggaatgcgtcagtacggnggacaaccccgtcagcaacagaaccgcatgccgggcatgggcggaggtcatcagcagcaa

SEQ ID NO: 48121 - DNA, 595 bp, Heterodera glycines
  SCN-specific regions: Sequence locations=1-595
acaccgacatttctctcctgaacatgtccgagaaatttgtcggcaaatggaatttggagtcgtcggagaactttgacgacttcatgaaggaggtcggcgtcaactttctcacccgcaaggccgccggctgtgtcaaaccggtgctggaattcgaagtgtccaacgccggcgagcactggaagatgacgtccacgtcgacgttcaccacctggaactgcgagttcgacctgaacaaggagttcgaggtgaagacggccgatggacgcacggtgaagaccatcttcgcctacgaaaacggcaagctgaccgagaagcagtccaagctcaaggacgacgagaaggacagctactacgagcgctacatcgatgaaagcggcaaactcgtcattacgatggaagccggctcggtgaaggccaagcgcgtgtacacgaaggcggcctgagaaccgaagaagatgacgccgatctccgaagacgacggacgcttctgacccgttttcgtcattcttgaggccttttgatccgcaattcttaatttccatcttctaatttatttaatgcgatcaataaaagggttctctctgagaaaaaaaaa

SEQ ID NO: 48122 - DNA, 747 bp, Heterodera glycines
  SCN-specific regions: Sequence locations=1-550,581-747
gagtccgaacactgaaaaaaaaagaaaattgggaaaggctgcgcggaagcgattggcagttgaacgaacgatcgaatcggacataatattcgacaatttggaagaacaaatgctctttcagcattcttccgactttcctttcttccataccccgtcgaatcagaaatcgaaaaatcttcgaaattccattctttgcgccgcgacggtcgaatatttcgccctttccgtcgcgtttgccttctctccgtcgaccaattcctccaattcgcttcgtccgtcgttcgttcgttctccgtttgaccgccattcattgcgtaattacacaaaagatcagaacaatggcgggattgacggcggactgatcggcgccccccggagcgaatactcagccgatgcaatgcgaagcgggggacaattggcggcccgggagggcgagcagctcctcggtctgctgagaatgtgccgtcagaaatcgctgaaacgttcgcaacacaatttggaggggctttgctccgcacttttccaaatggccaaagaacagcgaaggcgaaaacggagggacattttggggagggaaaggcaccaaaatgaaatggcaacgaaacgtccttttttgccaattggggaggacgaagagcaatggctatggtggtagcagaaaaggacaggacaaaaaggagagattctgctgatcagtcggaacggagagagattcaaatcgaagcgatcggaaaaagaaaatcagaa

SEQ ID NO: 48123 - DNA, 682 bp, Heterodera glycines
  SCN-specific regions: Sequence locations=1-31,59-682
aactgcctcgggaccccgccggagaagaaatcctgttcctgggcgactacgtggaccgtggcgcgcaatccgtggagaccatatgctgctgctttgctacaaggtcaaatatccgacatcgattgtgctgctgagagggaaccacgagacgagcaacatcaacgcaacgtacggcttcaaaaaggaactggaggaacgctatccggcccattcgcaagccctgttcgacagcttcaatgacaccttcgcgtggatgccgctgaccgggctaatcggccaaaaaatattatgcatgcatggaggcatcagcgacaaaattcgaagcattgaacagctcaaacaattggaacgcccgatgctgctaccgccgaccgatagtctgcacattgaccttatgtgggccgacccgatggaagcgcaaggacaactaccgaatccacgaggcgcaggtgtcctgttcggcgaagatgtggttatcagaacttgccagctgctgaagatttcgtgcatcatccgagcgcaccaattcatccaatccgggtatgagccaatgttcaaccaacgactcatcaccgttttctctgcacccgcctacacaggccaaacaaacacgggcgcggtactggaagtgaagacgtcgagccactttaccactcactttttcccgccccaatcccagtga

SEQ ID NO: 48124 - DNA, 608 bp, Heterodera glycines
  SCN-specific regions: Sequence locations=1-608
ggtggaattggcactgattttgctctgttcggtgtttgcttttattgtctgatcagtggcaatttcggctcgctgtacggcgattatccgagcatgttccagctgcgggattggaccagacagtacggcaagcagtacggcatccaatacggttggcgcaacgcgttggtgatttctgacccggcaatggtccacgagttgcttgtcaccaaatttgaatatttccacgcaagaaatctttcgcccatctttggcaatttggacacaaacaaatggatcagcatgttcttggccaggggaggccggtggaaaaggctccgaacgattgcgaacccggcattttcggtagcgaatctgaaaaagtgcatgtggctcattgacgattcagttaaaaatgccatcaattttctggaaaaagcgcgcaacgaaggcaaatcttttaacattcaaaggcatttcgtagaaatgagtttcgatgtgatcgcccgtgtggcgttggggcagcgcgagtcgcgacagtttgagactgaaatggcacacctggcgattgagtcgatgcaaaaatacaataacactccgttcgattacgtcggcttcgctttcccgtg

SEQ ID NO: 48125 - DNA, 752 bp, Heterodera glycines
  SCN-specific regions: Sequence locations=1-310,332-561,584-625,648-752
acacttaatttcggtgattttccttattttttggcgcttgacaatttttggctggcaatgacaacgaaaagtgagggggatgaaaataattctgtggatgagaatggcgagccctctggcaatcacgcggagaattgcagcaccgggccctcttcgcctgccccgtcagtgtcctgcgaggcgtgcggtaccaatttctcacaacttgagaaggatgcttttgccgcagtacgcgaaatggcgccgtacgtcaaaaccatcgccatttccgaaatactatcccgcactcccgagctcatattcctcaacattgtcactttggaaaatgagagttattgcgtggaactcactcaacgaggctggcgggtgagttccgaccgtctcgactgtatgaacggagacattcaaaagttggaaatgcacgtcacttactacgacgccattgagcagctgttggacagcttaagcgagcagtaccgcgagaattttggcgccgcactctcttcaaaactggccgctctgcagacggaacagaagcaaagacagcaggacggagaatcagagggaaacggcggaggggcggcagagagaagcgacgcggggcaaaggacggacgacgagccgaactgacaatgagcggagcaaagaaaggcacagaatgtttgtccattttgattgtcccacccttcgttggtctgttactcatttacacttctccgaggcgagtgtcccatttctcttccattcccttc

SEQ ID NO: 48126 - DNA, 534 bp, Heterodera glycines
  SCN-specific regions: Sequence locations=1-452,474-502
ccgtccccctttcattgcgcgggttgtgcgctatgtgaaaaagccggtaatgagaagaaactcgtcgtctgtgttggctccgtgacggacgacaagcgcatttacaccgttccggcgatgactgtctgtgcgttgcgcttcaccgacgcggctcgcgcgcgaatcatcgctgcgggcggcgagtgcatcactttcgatcagttggcattgcgtgcaccaaagggcgagaacacgctgctgttgcagggacgacgaaaggcgcgcgaggcggagaagcacttcggaccgccaccgggagtgcctggcagtcacgcgaaaccgttggttcgcgcgaagggaaggaaattcgaacgtgcacgcggtcgccgaaagtctcgcggttacaagaactgaggaattcctgtttcgctttgttgagatatattcccttgtcatgttacctttttgttatggaagtgaaatctttcttatccataatcaaagaaaaaaattgttgatttccaaaaaaaaaaaaaaaaaaaaaaaaaaaaaaaa

SEQ ID NO: 48127 - DNA, 630 bp, Heterodera glycines
  SCN-specific regions: Sequence locations=1-589,611-630
taaatcgaaagggccgtgcactgtgctgttcagggtccgaatacattgttcatgccgtacatttggctattctggcccatcaattacgtttgctgatgaccgtaccaaaagtgtccgatgagttgttgaccaccgatgtgcatgagccgagtgtttgtcgactgaatttggcccgtcttttgcttctctttgtcaaggactttgaattgagcaatatcgaatacgcaataaattactgtttttttgcgcgcgactttaagttggacacaccttccgcggacaatgccacaattagacaagaaggtcggagtgtttttgtggctgctgtcagccgaatagtgttcatgtccggccatcgggaagcgattttgggccgattggactctcaggggaacagagtccccggtctcattgacaaatttaaagacgccatggacatttgcgaattgattgccagcattgccttcgacactcatgtccagggacactctcttgctgcgtgtcacctttacgcattggcaaagtgtcacgaaaaagccataaaattggcaaattgccaactctccatgtgcgtgtccaatccaatggccaaagaaacttgtgagatggtcgaatgtgccaaatggttgg

SEQ ID NO: 48128 - DNA, 600 bp, Heterodera glycines
  SCN-specific regions: Sequence locations=1-15,37-126,150-159,183 -282,319-324,350-360,382-600
caattggcaacgaaagcggcgcgcaagtcggccccgtcccggggggcgtgaagaaaccgaccgataccgtccgggaccgtcgcactgcgtgaaatccgccgctaccaaaaaagcaccgaactgctcatccgcaaattgcccttccaacgattggtgcgcgaaattgcccaggacttcaaaacggacttgcgctttcaatcggctgccatcggcgctttgcaggaggcttctgaggcttatttggtcggtctttttgaggacaccaatctttgtgccatccatgcaaagcgcgtcaccatcatgccaaaagacattcaattggcccgtcgtatccgtggagaacgtgcttgaaatggtgggcggtgcgtccgctgctgctttggtggaggatgagcaatgaatgactctgattgagctgaccttcgttcgatgattccaatgattgcgttcccctggcgatgtcttttcccctaaatgttccatcccttttaacttttggtgagcaatgtttctcttcttttccatttttgcttctttctttccattgctctgtaaatttgtcagctgtttcctttctgcataaaaaggggagccaacaca

SEQ ID NO: 48129 - DNA, 631 bp, Heterodera glycines
  SCN-specific regions: Sequence locations=1-17,471-471,499-499
ctctttccttttgtgttacgacaactttcattgctctctctccaatggcacgaaccaagcaaactgctcgcaagtcaacgggaggaaaggcgcctcggaagcagctcgcgaccaaggccgctcgcaagtcggcaccggccaccggtggagtcaagaagccgcatcgttaccgccctggtaccgttgcgcttcgcgaaattcgccgttaccaaaaatcaacggaattgctgatccgcaaactgccattccaacggcttgtgcgtgagatcgcccaggacttcaagacggacctgcgtttccagtcaagcgcagtgctcgctctgcaggaggctagcgaggcgtacttggtcggactttttgaggacaccaacttgtgtgccatccatgcgaagcgcgtgaccatcatgccgaaagacatccagttggcacgtcgcatccgtggcgagcgcacgtgagaagtggaagcgaagaagtaggaaggagatggtggtgtgatcgtaacaaaactaacccaaacggccctctttagggccacatttggcaaatggacggataagacagtggttgtgtttttgaataaaatttgttttttcattttgctttgattgaattttgacgtttaacataaaca

SEQ ID NO: 48130 - DNA, 446 bp, Heterodera glycines
  SCN-specific regions: Sequence locations=1-45,67-356,445-446
gtgatgagaatttaacagagaaaccacccagcccgggattctctcatggccacgccgggcccaacacaaacggggtcacaattctttgttacgactgtgaagactgaatggttggacggtaaacacgtcgtattcggtcgcgtcactgatggaatggatgtggtgaaagctgttgaagctcaggggtctcagtccgggcgcgcttcgaaagacattatgatcgctgactgtggacaattgtcgtgagaatagggccaagaaaaaccggattttccaatgttatgaatggtattgaaacaagttaaggcaatctctaattttaattattgagggcgatgataaatttgtgatttattaaaaaaaaaaaaacaaaaaaaaaaaaaaaaaaaaaaaaaaaaaaaaaaaaaaaaaaggccaaaaaaaaaaaaaaaaaaaaaaaaaaaagg

SEQ ID NO: 48131 - DNA, 687 bp, Heterodera glycines
  misc_feature (646)..(646): n is a, c, g, or t
  SCN-specific regions: Sequence locations=1-406,428-687
caattgttgttgcaatcgccgcgacttgctgattcgccaattaccgggagctaatcggacgcttaccaaagattatggcaaatgatgcaaatatctttgtcgccgcaagtgccaccaaatgtgtgatgcttttcgccaaaggattgcgtgccgaattcacgcctcacgtgtcgttggttgtcccggtgatcttcgacaagttcaaagtggagaaacggttgctcagagatgctctcgtcgagtgcatcgatgtcatcgcagcatataccagtttcgaccacctaagcaaggccttgctcgaggctatgacctccaaacagaatccgagtcagaaatcacagacggatttgttcatctaccgcctgttccgttctcttccggccaaagacgttcccaagggtttgctgaaggatttggtggccattctgagcaaacatggctttgatgccgcttccgaagtgagggactcttcttttgctgcgttgggtgccattatgcaatgcattggggaaaaggccttgggctgtttcatttcacccgaattggccaaagatgcgaacaaaatggccaagattgctttaaaacgtgacactgcttaggtatttttttatttgtttagaaattttcccatatttttgttaaattntagaccatttattttctattttttttaccccattttccatg

SEQ ID NO: 48132 - DNA, 639 bp, Heterodera glycines
  SCN-specific regions: Sequence locations=1-68,92-104,140-149,171 -212,258-320,344-347,375-562,587-592,614-639
gcgaaaacaatttggttttctacgagtaagcaatgggcaaggaaaagatccatatcaatattgtggtgatcggtcacgtcgattccggcaaatcgactaccactggccatctcatctacaaatgtggtggaattgacaaacgtaccatcgaaaaattcgagaaggaggctcaggaaatgggcaagggatcatttaagtacgcttgggtgcttgacaagctgaaagccgaacgcgagcgtggtatcactatcgacatcgctttatggaaattcgagacaagcaagtactatgtcaccattattgacgctcctggccatcgcgacttcattaaaaacatgatcacagggacttctcaagctgactgcgctgtgctggtggttgcttgtgggacgggagagtttgaggctggaatttcaaaaaacggccaaacgcgtgagcacgctttgcttgcgcagactttgggggtcaagcagctcatcgtcgcttgcaacaagatggacaccactgaaccgccattcgccgaggcccgttacacggaagtgatgactgaagtgtccaacttcatcaagaagatcggttacaacccagccaccgttccattcgtcccaatctctggcttcaatggcgacaacatgttgg

SEQ ID NO: 48133 - DNA, 714 bp, Heterodera glycines
  SCN-specific regions: Sequence locations=1-450,473-652,676-714
ggaagcctgcgaaactgtttcggagccgaacgcttcgcgcaccgttccaagagacgcttgttcttatcggtcctaccgggcggagaagagaaaggccaacgacttggaatacatcaccgaaagacacaaaagcgacacattgcgcgaggctgagccaacgacggccggcggggggcgaaaagttaggacttacgaaatgagtgacgaagagagggccgagttcgaagtgtccgccccattacgcgatgcgctggagacaatcgacacccatttggcgggcggtgccaatgccaacacaaaagaggagcaggcggagatggaatgggcgtacaaatactgtcaacacgagtggatgaagctgacgataaaggaaaatgcgaatgcctacatcgtggagcaattcatcgacgcattggaggcattttcgaaccgattgatggaaaaggtggtgaacatgacggaccagaacgggaacaccgcgctgcactacgccgtgtccaacgaaaacttcgacgtcgtttccgtccttttggactccaaagtttgccgagtagacgaaatgaacaaagcggggtacagtgcgttggtgctcggcgcgttgtgtgagctgcggaacgaaacggaatgtgccattgtgcaacgactgtttcagatgggcaacgtcaatgccaaggcgatgaagcactcccaaactgctttgatgctcgccgcttt

SEQ ID NO: 48134 - DNA, 678 bp, Heterodera glycines
  SCN-specific regions: Sequence locations=1-678
cagccccggaactgcgatcggcacttcaattaacttctcaaagcgcttaaggcgttgcacagcgttggatacctccatcgtgacattaaaccagcaaactcggccctcggcacgcctgagacgaacgaacagcgccttctctacctcctcgactttggaatggcgcgcaaatatgtcagagaggacggcacacaccggcgccaaagggacaccgcccgcttcagagggacgccaatctacgcaccaatctctgcgcacatcaaacgcgactacagccgccgggatgacattgagtcgtggttctacatgctgattaaattctacaaaggctctgtcccttggaatagccttcgcgacaaaaatgagattggcctgtacaaatgtcgccggatggaggaccagccacccgaggtgcgacgccaggccatcgacgaactgactgctggatgtcctcccgaatttaccgagatcctatcctacattgacggactgcagccggaaagccgaccagactacgagatgatcgagaggttgctgcgcggatatctcaccaggaaaaacatccaggagcatccgtacgactgggaggagggacgcaaaaaaacacaaagcgcgcaatgagaggaggaagaagaaccactcgcaagaggaagtgagcagcgccgttctgaccaattg

SEQ ID NO: 48135 - DNA, 625 bp, Heterodera glycines
  misc_feature (20)..(20): n is a, c, g, or t
  SCN-specific regions: Sequence locations=1-215,237-625
tactgctcccggcgatcgantacttaatgatcacaagacctcttatgtcaaccccgagcatttggactacttccggtttgttggtcgtgtgatcgccaaggccatttatgacaacaaacaacttgattgctactttactcgtgccttttacaagcacatcttgaacaagcatgttcggtaccaggacattgagagtgaggaccccgacctcttcaaatcgctggaatttttgctgaacaatgccgttgaggacctcggagccgagctgacttttactgttgaggtggaggagtttggtgtgcgatcgactcggcagttgttggaaaatgggaacaagacaacggtgaccgatgccaataaccacgaatacgtccatttgatgtgccaaatgaaaatgacaggctcaatacggcaacagttgaacgcgtttctcgagggtttctacgaggtcatccccaaaaagctcatctcgattttcaacgagcaagagttggaattgcttatctccggcctgcccgatatcgacatcgacgacctttgtgcaaacactgaatacaaaacatacacacggacgagtccgcaaattcaatggttctggcgcgctcttaaagctttcgatgccgag

SEQ ID NO: 48136 - DNA, 609 bp, Heterodera glycines
  SCN-specific regions: Sequence locations=1-609
aagtgttttggactctcagctgaaacagtcgtcgaccgtgccactgaattgcgttacattggtggaatatatgctgggaacataaagccggctcagtttctctgtcttacactcaaattgctccaattgcaacccgacaaagacataataattgaatttataagacaagacgacttcaagtatgtccgtgctttgggtgccatgtatatccgtttggtatttaattccgtcgaagtcttcaaatacttggaaccgctgtacaacgattaccgaaaactgcgttacatgaacagaatgggaaaattcgagttgctatacatggatgaatttgtcgacaatttgttaagagaagaccattattgtgatatacagctgcctcgtctacagaaacggcaagcactcgaagaaaaggaccaactcgagttgtacgcttccgccttggacgaagacttagagcgtctttccaccgactccgaagatgagcaggagacgcggaaagcacggccaattatcgtttctcggcgccgaagtcgctcgcgcagccgtggccgaagtcggagcaaatcgagagaacggagacgccgatcactttccacggatgaccgtcgg

SEQ ID NO: 48137 - DNA, 675 bp, Heterodera glycines
  SCN-specific regions: Sequence locations=1-675
taaggccttaagcctgctaattgacatcttgaacctcaaaccttctcctgtttaaaaaacgacaaattttttgatggctgctgtagtcacaaacaatagcaaggaattcatcgtcggtgtgaagtacaagctcaagcgcaaaatcggtagcggatcttttggcgacatttacctcgccatcaatattcataatggtgaagaagtggcggttaaacttgagtcagtcaaggctcgccacccgcagcttctctacgagagcaaggtgtacaaaattctgcaaggaggggttggcattccgcacattcgttactacggcatcgagcgcgactaccactgcctggtgatggatttgctgggtccttctctcgaagacttgttcaacttttgttgccggcgcttcacgatgaagactgttctgatgcttgccgaccaaatgatcggacggattgagtacatgcatgtgaagaactttattcatcgggacatcaaacctgacaattttctgatgggtatcggtcggcattgcaacaaactcttcatcatcgattttggattggcaaaaaaataccgtgactcgcgcacgcgcatacacattccctaccgagacaacaaaaatctgacgggcaccgctcgctatgcgtcaatcaatgctcacatgggtatcgagcagtcgcg

SEQ ID NO: 48138 - DNA, 517 bp, Heterodera glycines
  SCN-specific regions: Sequence locations=1-346,369-389,411-457
tgatattcgtgatgaagccagccgtgagggcggtggaaacaatttttggggcgatgaaattccaaaaaagttgcgcgaaatgagccgtgccgagctcagtggccatattctaatgcaaaaagttcacccattctctgctccgaattacatggtccggccaaatgagcgcgtgcagcacggaaatgtcgtcaccgagctgagcactttcggcactctgctgggccatgtgaatacaaaggcggtgctgcacaacgcgcagcagggccattacgcacgctcaaaaccggaaggggcaacggagggcggcgtttacgggggcggaggcgttgtcgactcgccattcttattttaggagaaggggcggggaatgaaatgtagtattattgtatatactattatacaagtactgtattctttatttctctcttctgtcatttaatgaataaaattcatggtcaaaaaaaaaaaaaaaaataaaaaaaaacaaaaaccacaaaaaaaaaaaaaaaaaaaaaaa

SEQ ID NO: 48139 - DNA, 558 bp, Heterodera glycines
  SCN-specific regions: Sequence locations=1-453,475-558
gtggaagggcgccgatccgaatgagccggtggttggccgtgagaacgacattaacacgaacttgacgcctcttttcgttgctgccctccatgcacattttccgctgtgccgtgtgctcgtcgaccgtggtgccaacgtggacttgggatcggactgcccaacgccgctgatgatggcttgcaaaagatcgcaaatggaaattgtcgcatttctcatcgagaatggtgccgacatcaatctgcagaatggtgacggagaaacggcattgatgatcgcctgttcaagggcaaatgtggacattgtgcgcttgttgctgtcacacggtgcaaatgtggagcaaacggattacgaaggattccgtttcgcacttaagaacgctgccaatgagggccatttggaggtgtgccgtctgctggtggaggagtgggccgcagatgtcaaccaacagaccatccaagatcgaaccactgcactgatttgcgctgccagccgaggagatttggccatcgcgaatttcctcatcgaacatggtgccgaccttcaacatgttgacgtggt

SEQ ID NO: 48140 - DNA, 656 bp, Heterodera glycines
  SCN-specific regions: Sequence locations=1-47,81-132,162-168,193 -225,252-255,280-283,306-341,397-567,609-656
acaaaatttgtcttgttattcgttcgtctttacacggtcaaacccgcaaaagaaatgggaaaggaaaagatccatatcaatattgttgtgatcggtcacgttgactccggaaaatcgactaccactggtcatctcatctacaaatgtggtggaattgacaaacgtactatcgagaaattcgagaaggaggctcaggaaatgggcaagggatcatttaagtacgcttgggtgcttgacaagctgaaggccgaacgcgagcgtggtatcactatcgacatcgctttgtggaaattcgagacaagcaagtactatgtcaccattattgacgctcctggccatcgcgactttatcaaaaacatgatcacagggacttctcaagctgactgcgctgtgctggtggttgcttgtggaacgggagagtttgaggctggaatttcgaaaaacggccaaacgcgtgagcacgctttgctcgcgcagactttgggggtcaagcagctcatcgtcgcttgcaacaagatggacaccactgaaccgccattcgccgaggcccgttacacggaagtgatgactgaagtgtctaacttcatcaagaagatcggttacaacccagccaccgctccattcgtcccaatctctggcttcaatggcgacaacat

SEQ ID NO: 48141 - DNA, 678 bp, Heterodera glycines
  SCN-specific regions: Sequence locations=1-531,553-678
gtgattgtcttgctaaaattgatacccgccaagaacaacgtcgcagttcaacaaaaaaggcttcaccaaaatgcggttaatatgcatcaaacggttcttgagaaccgtcgacagcgagaacatgataagaaatttggcaaaacggtgcagaatgaagtcgttgacagaaactcaactctgaaacgggtttttagatgcattttcgtgaatattgcgtctgttctgttagtccttgctttgactttgttcattgatctgattgggccatcattcttctcaaaattcgttaagtatttgggctctttgcttctcgtccccatttttggcactgttcgtcttttatcgattctttggttcgctgatgttgccagtgcggcacttaaatatcgtggtcaatttggccagaaaatcacggatttgtcacacgccgcctccgactttgtccatgccatcttcctggaactcatctttcttctccaagcaatgtttatcattagcatcgaagtgccaattctgtccaattggtcttgctgttttgcgtcatttttgtttcatttgacctttagcctcggctttgtgtacatgtctctgctccactctttgtacagtttcgattacatttggatgagcaacggagtgactttgaattctcgactcgccctcattgagcgccggtgg

SEQ ID NO: 48142 - DNA, 682 bp, Heterodera glycines
  SCN-specific regions: Sequence locations=1-290,314-682
ggtgatggaggaaattgtgcaagtgcggcgaacggcggctaagttcgacagcgccggaccaatccagcgaaagtcgtttcaaccaattggaacggaatttggagctgttccaggaaaatgcgcgtcatatgggagtgatcgccagtgacttcacttccaaaagtcaggagccgttgaatcagaaaattcacactctcatctcgggccttcaggttcttgaccaactcaaaagccaattcaccgatgttcgtgttcccattgaattgttggactatttggaccgtggtcaaaaccctcagctgtacaccaaagaattgttggaacgcacgcggcagaggaacaaagaactgaacgggaagacggagatgtacaggaagttccaggcgtgtcttctgcaggaactccaccgcgaaatgccttcggacgtggaggaatacgtgcgcattcgaaaaccgagcggaatgaatggggcggcagcgggaaacgcaatggcaaattcggcgatggcagcggaggaaacacagcacgcgatggagtgacggactgcgtgcaaatgacggggtgagttggtcagcgaattcgccaaaaagtgagggcgcggaacgttttgtgaaggaattctggccgattatcagagagaacaacccgaacatcgaataccgactcacccgttcgcacaccg

SEQ ID NO: 48143 - DNA, 576 bp, Heterodera glycines
  SCN-specific regions: Sequence locations=1-51,88-232,258-321,345 -360,417-510,570-576
taatttttcaaaaatgtctgacacaaagaagaactcgttcagcgggctaagttggctgagcaagctgagcgctacgatgacatggctcagtcgatgaaaaaggtgacggaattgggtgcggagttgagtaatgatgagcgcaacctgttgtcggttgcatacaaaaatgtggtcggtgcgcgttgttcctcgtggcgcgttatctcgtccattgaacagaagactgagggctcggagaagaagcagcagatggccaaggagtatcgggagaaggtggagcaggagttgcgagagatctgtcacgacgtgctggatttgctcgacaaatatctgatcccgaaggctggcaacccggaatcaaaggtgttctacctgaagatgaagggtgactactaccgctacctggctgaggttgccaccggtgacgaccgaaacgctgttgtcgagaagtcgcagcagtcgtaccaggaagcgtttgacattgccaaggacaaaatgcagcccacccatcccattcgtcttggtctggcgctgaacttctctgtgttctactatgaaattctgaactcaccggga

SEQ ID NO: 48144 - DNA, 661 bp, Heterodera glycines
  SCN-specific regions: Sequence locations=1-391,413-661
acccaggaaaactctttatgagccgggtggcaaagatgtttatgaaggcgtaaaaatcgactacagcggaaccgaggttaaccctgaaaatttcgaagcggtccttttgggcgatgagcagcgatcggagggaaagccggtgctgaaaagcactgaaaaggacaaagtgttcgtgtacttctcggaccatggcgcggtcggagttatcggattcccagcagccgacttaacggttaaacaattgactcaaacactgaaggaaatgcatgccaaaaaaatgtacggcgaattgacattttatctcgaagcatgcgaatcgggctcaatgtttgaccacacattggcgcagagtttgaaaatttacgcagtcaccgcggccaatggcgacgaatcgagctggggctgtttttgcgacaccaaatttttgcccggaaattgtttgggcgatcttttttcagtgaattggatgcaagactcggaccaggaaaatttacgcaccgaaactctgcggaaacaatttggcattgtgcgcgaagaaacgaacaaaagccacgtgatgcactacggcgacttgcaaattcaggacgaacacgtttctgagtttatgggcaaagagcatgcgcaaaagcgcaacgaacgcccaccatcaccgcacaaattt

SEQ ID NO: 48145 - DNA, 586 bp, Heterodera glycines
  misc_feature (166)..(166): n is a, c, g, or t
  SCN-specific regions: Sequence locations=1-586
tcacgcagcaatcgttccaattgaagttgaggaaactgcaacgatcggcgaagtcaaacgaaagatccaacaggtcaaaggcgcagaatacccagcggagaaccaaaagctgttttttaacgggagagtgctcgaggatgccatgttggtctctgagctgtactcntcggcgccgaaattcattgtcttcatggtcatgcgaaaacccgcgcaagcatcgtcaactgttcggccagcaacatcctccgcatcgccacaaaagaacacatcgacagcggacggacaggcgccgaaggcggagaagtcggcggagaacaaagcgacgggggcgacttccaacacatcggtggcccagccgggagcagcaacgggagtgccggcagagcatgcgcaaaccgtggccaacatcgaagccatgggttaccctcgccaggaagtcgttcgtgcgctgcaagccgcgttcttcgacgccgaccgtgccgtggagtatttgtgcaatggcatccctgagggactttctctacaaaagtcaaattctgatgctgacaatgatgcggtcaatgaagaatgggaacttatggaatca

SEQ ID NO: 48146 - DNA, 638 bp, Heterodera glycines
  SCN-specific regions: Sequence locations=1-328,350-477,500-638
taacggtggaaaagaacgttttctgcaattgtgcatcgattgcaacggatgtttcgtcattcagaagttagttgagaacggttcaaaagaaaccaatcaaatgttgctcaatttggtccgtcctttcgcctttaaaatggtgctcaatcgttttgcttgtcgcattgtccatatgctcgtcgttaatttgtccgggtcccaagtccgccaattgttctgccaacagttcaaaggacacgagaacactttggtcaccgaccaaaacgggaaccattttgtgcaatgcgtagttgaccattttgcgcccgacgtgtacggaccttttatcctcgccttggccaactgtcccacccgactgagcgccgttttcgaaaataagtacggctgtcgtgtgatccaattcgtccttgaaaatgtcgtccaactcgtccatggcactgcgaatgccaacaacagcttggaaaaggaaatttccatccaaatattgcatgttctcattgaacccattctcaaaaatgcgtattcgttggcccaaaacgaattcgccaattacctcgtccaatttattatcaaatcgccctatctccgccgccaacgctgttacatcatcaaaactcacatcattcgcaacgtttacc

SEQ ID NO: 48147 - DNA, 422 bp, Heterodera glycines
  SCN-specific regions: Sequence locations=1-109,139-168,199-422
tcgttgaaaaatgggcattttcgacaacgatgtccaaaagcagcttcgccatatgatggcatttattgagcaggaagctaacgaaaaagcagaagatatttacgcaaaagcggaggaggagtttaacattgagaaggggaaattggtttctcatcaaaggcagaaaatcttggaatattacgagaagaaagagaagcaagtggagctgcagcgcaagattcagaggtcgaatatgcaaaatcagagtcggttgaaatgtttgaaggcgcgggacgaccatttgaaaaatgtgttggaggaggcacgcgccaatctcagcaaaatttcggcggacagagagcgctatccggccattctcaaaggacttttgcttcagggccttttccaattgctcgaaagcaaagttgtgttgcgatgccgca

SEQ ID NO: 48148 - DNA, 482 bp, Heterodera glycines
  SCN-specific regions: Sequence locations=1-177,203-482
caagaagaaggaggagttgatgaaaatgttggaagaacagaaaacggagctggccagtctgcaggtgtccaaggtgacgaacggggcggtgtccaaactgtccagcatccacgtggtgcgcattatcattgcccgcattctcaccgtgatcaaccaggcgcagaagatgatcttgctcaagttctacaagggcaagaagtatcgtccgattgaccttcgcttcaagaaaacgcgtgccatgcgcagagagttgaccaagcatgagctttcattgaagacacacaaacagaaggtcaaagaacgccgttgtccaacgcgtatttatgcgcttaaggcgtgaagcggccacagcctcggcgatgtgtttcgacagagagggaaatgtgacgaggattttgatggatcaaatttttttgttgttgttgaccaacttttaaatgataaaaaaaaaacaccccttcttcaacaccaccataaaaaaa

SEQ ID NO: 48149 - DNA, 384 bp, Heterodera glycines
  SCN-specific regions: Sequence locations=1-11,34-384
cgagggactccggcatttcgttggctcaatccaccacctcgcattatagctgttttgccaaaatttattttccaactttgttcgacttcgggttcaagcagtattcgcttgacaccgttgaactttcccaagttccgcacaaagccttccgcagcattaacgccgatcgattttataccctttggggtcactaacagaagaacagttccaacggcggttcattctgatcgattgtcgctatccttacgaatacgatgcgggccacatttggtactcactgaatttgtgggagaccacttccattgagaagctcttctacccagaagaggaagaacggttcggcgaaattattgtgcgaactcccatcttctactgcgagtactc

SEQ ID NO: 48150 - DNA, 304 bp, Heterodera glycines
  SCN-specific regions: Sequence locations=1-304
gcaacggagagtggcgcgtgttcagcggaaatgagatgggcattctgctgacgtggtgggcgtggaccaattggcgtgccgccaacccaacggcggactcttcgcgggtgttcgtcctccattcggccgtctcttcccaaatggtcgccacaatggccaaaaaggagggcttcaaagcggcgcattcgtcgacgggctccaaatacataagcaatttggcacacaaattgcggtcagaacgcaacaccgttattgccggctgggaggagtccattgggtttactcccggatcaacgctggacaa

SEQ ID NO: 48151 - DNA, 569 bp, Heterodera glycines
  SCN-specific regions: Sequence locations=1-569
gcctccattatttcccgaaaaggtagagagcattcgttacttgtccacaaaatcttgggaggcgacatttacgaaggattatctctccaatgaaggccaactccgttttctttctttcatgtgctacctcgcaatggcacattaccttttgtaccgtggatttttttccaaaggagttttcaaactccgaaagctcgaagatttggctatttactgtttcgatggcaacacgcgttggggacgtaaattgtcggagatgatgaaaggtatcagagaggccatcgaccaaaagtacatcaaacaagcattcgtgatgatcaacgaggacaaagaggacccggacgtcgcaactgaagttttctcagtcggtttttgttacaacgaacagcacacgatgactgtcttggatgacaaaggcaatcgtatcgtttcatttggctacaaaggggagaaggtttttcgaatgcaagtgaagcacatcatcaagaagctcagtgtggtcactaagaatctggagccgttgaaaaagggggccgtgccttatttgaaactcacttattacgagaaca

SEQ ID NO: 48152 - DNA, 630 bp, Heterodera glycines
  SCN-specific regions: Sequence locations=1-113,137-194,218-630
tgtactattcgtggcacaatttggaaatgatcaagcagtgatcctttttgtacatggaagtctatacagtcatttgatgcttgagtctcgacaaattgtgaacacattagaggaaataacatcaagaaaaatcaaaagccgcttcattaccctaaaagaggctttcagtcgtttaaaaattgaccccgttgacaaatcactgatttttgatgataaatatgtggtggctgttctggttgatcgcattggtcgagaaatttccgacgcagaattggcactttgtgttgaatttgagcgttcaacagccattaaaagtcggccgatgtcattctttgtgtctcatacgaagagaatgcaacaggtgctttcaacgcctggcattgttgagcgtttctttacgggacccggggaagaagggatggcccaagcaattcgaaaagtgcaaataaaaggctggccaatcggtgccgacgaaaacattgaggaaggcatacgacagaaagctatggaaaatccacaagattatgtgctgaaggccaatgattgtggcccaacaggaacgtattttaatgaggacatggtaaagaaattgaaaagtatggcgcccgctgagcgcgatttttactacct

SEQ ID NO: 48153 - DNA, 601 bp, Heterodera glycines
  misc_feature (15)..(15): n is a, c, g, or t
  SCN-specific regions: Sequence locations=1-233,255-274,296-601
atctccgcatttgtntaagccgccggttctcctcaacaaataacacacaaccatattgtcggaaaagaaggtcaaaaaggtgaagaagaagtccaggaccggctccgaggcgagctccttcgaccaggagaccttttatgagttcaaagaagcatttggcattatggaccaggacaaagactgatcgatcagcaagcaggacctgattgacttgtacgccacactcggagttgtggcgagcgactcgcagatggacaacatgctcaaggaggcaccagggccaatcaatttcaccgttttcctgacactgttcggagaacgactgactggcactgaccccgaggcgacaattatcggcgcctttcaaatgttcgacaaaactgactgtggcgaaatcacagaagagacattgatgaaaattctgaagaacaaacggggggagccattgacggaggacgaagtgcaagggatgtacaaagggaaccctccaattagtggaggcaaagtggactacaaggcattcgcgcatttgatcacgacaggcgcagcggaggagttggccaaagtgggctaagcggggccatggacggacggtggagga

SEQ ID NO: 48154 - DNA, 423 bp, Heterodera glycines
  SCN-specific regions: Sequence locations=1-423
ccgcaaacatttcccatttttgtcggagatctttcgcccgaaatcgacaataaaactctcaaagatgcttttgttccgtttggagatgtttcggactcaaaagtcattcgcgacccgaccactttgatgtccaagggctatggctttgtctcttttccaaagcgcgaggaagcggagcgtgcaattgagcaaatgaatggccaatggctggggcgaaggacaatccgaactaattgggccactcgtaagcctggcgcaatgggcggtggagttgaatattcgagcaaaccgacggtggacgaaattatggcgcagacgagtccagaaaacacgtccgtttatgttggtggtgttcctcccggtgcgacagaggaagacatacggtcgactttcagacgattcggaaacatcgtggacattcgc

SEQ ID NO: 48155 - DNA, 529 bp, Heterodera glycines
  SCN-specific regions: Sequence locations=1-529
gacaacattattaattatgttgcccaactcgtcgtcaattctgctgttgcacaaccttcgaaaacagtcggtcaacgcgcttccgcttggtcgtcaagcagtgcacaacgatgtccaattccccaactttgacgcgtatcgcaacgaattgaccaaagacccagctcaaccgtcccatgtgactgaggacaggcgcaaaggcgtgtcaagcttcatcttttatggagtgggcggtgccattacgttgatgacagcaaagttcgccgtccgaaaagcggtcacttacaaatggatgccacgggaccaagccgcaatggcagcaaccgaaatcgacctcagcttggtgccattgggcaagacaaagacatttgagtggcgtggtaagcccgtgtttgtcaagcatcggacggccaaggaaattgagcgcgaacgtgcggcggaagtgggcaaactgcgtcacccggaacgggacgaggaccgtgtgctgaagccggaatggtccgtgctgatcggcgtgtgcacccacctc

SEQ ID NO: 48156 - DNA, 493 bp, Heterodera glycines
  SCN-specific regions: Sequence locations=1-156,178-429,451-493
cgcattatgaggaaatcagcagcagagagaccaaaaagtggcggcgcaaaaggaggcggacaaagagaaaaagcccaaatacgcccatttgttggccaaagcgcacaaacagcgcgagctgagcaaactgttggtggaggataacacttacaaaaaggaacgcgaaaaggaggcgggccaatttgaggacgaataattgttcgtcacgggggcgtaccgacagcaaattgaggagagggaacggcacaaaacggagatggagcgggaggaggcactcgaaaagatgcgagacgtgcgggaccagaaaatgtggcggcaagcattcaatcgaacaatgcttgagaatatttcccgcggtccattgaccgaagaggggaaaatggaagaagacgacggagcggaagaaaaacggattaaaacggaggcgaaaacggaaaagatggcaaaaatgggagtgaaagaggaggcaatatataaaaaaaaaaacaaaaaa

SEQ ID NO: 48157 - DNA, 601 bp, Heterodera glycines
  SCN-specific regions: Sequence locations=1-601
taagctgatgttattttcttactcgtttttttaatcgtttgtaaggcgttttttgttcgtttggtctgactttattcatcagtggttttttaaatcatggatcacaactactggcaagcacatccgaacaacccgcttgtgaatcgacctgaacggaatggaacgaccgaacagaatggggcgatgagttcatgttcccatccccaaagagcttctggagagcctaaccaactcaatgttgtgctcgtggatgggactgaagttgttgttaagatccacaatgttttgtgctgctatgaattgcccatgcacattgacttacgacaggtcgcttatggcagcataaatgtggactataacagagcaaaagggattttgcacaaacagttgcgcaagccgtcctgttcaattcgaattgcaaacagtggcaaagtggtgattcacggctgcaaaagcgaagaagattgcaagagagtggcacgcgcaattggccgaatgatccaacgtaacacgggacggttggaccagcggatttgcatccgtaactacagggtttctaacatattggctacttgtcgaatgccttttgatattcgtattc

SEQ ID NO: 48158 - DNA, 442 bp, Heterodera glycines
  SCN-specific regions: Sequence locations=1-50,75-442
ctgtacctatttatgtcgaacctctactgactccccattttcgcgcatctccaaaaataaaatttgaaaaatacgcctccaaaagacgacagatgactgtgacatcgacaaaaaaacaattctttttctatctcatttaaggacattactctacacgacgtatgggccagcaatttgttttctcgaatttgccaaactgctcgacctcatcgacgactatccattcgtggccatggacaccgaataccccggcgttatcgctacgccggtgggccaattccgcagcaaggaggacttcaattatcaacaactcaggctcaatgtggactgcttgaagctcatccaggtcggcttcactttgatgaatgagaagggtcagttgccacccgcccgtgacattttccaattcaatttgcacttcgatccgagcaccgattcgttc

SEQ ID NO: 48159 - DNA, 574 bp, Heterodera glycines
  SCN-specific regions: Sequence locations=1-385,410-574
acataattcttttggaatggctcctgcaccagaaaaggaaaaaactgaagataagaaactgaaagacgggcaaaaaccaaatgtgaccacggatcacgcacactgtttgagcaatgtccaaccaaatcttcccgtcaataaagtggtggtgcatccgctcgttctgcttagtgtggtcgaccacttcaaccgcgtgaacaaaacgcacaaagtcaatcgagtggtcggtgttttgcttggttgtatgaagcacgacaaaacccttgacatcgcaaattgttttgctgtgccttatgacgaggactccgagaattcgaacattttctttcttgatgctgattttctggaggacatgtttgggatgttttacaaagtcgcggcacgtgaaagaattgtcggatggtatcactctgggccgcgtctttgcaagaatgacattctgatcaacgaagtcatcaaacgctttaccccgaaccccgtgctggtcataatccaagcttctcaaggccgacaggatttggcactgccgacggatgcttatgtggaagtccaggaagtgcacaatgatggttct

SEQ ID NO: 48160 - DNA, 404 bp, Heterodera glycines
  SCN-specific regions: Sequence locations=1-404
cattaatgctattttggatggtactgacggtgatgaagcgctgaatttgaatgatttggatgaaaaagaggttcttggtgatgacgaggaggaccaacaccaaaatcaacacacaacaaaagaagaagtggaagacctttacgacgaagccatggctccgtccggtgcactctctgaaaagcgcgagtcggctgaagttatttcgtcgttgccaagttcgattcagcacaaatcgtcgtttgccatgcctatgatgatcaaatctgagcccggcattgctggcgggtcgcaaagtggcaaacgctactgctgctacattggcaatatgacttggtggaccacagacgatcaactccagaaactgattcaaaccctcggcgtcgacgatatgattgacgtgaaat

SEQ ID NO: 48161 - DNA, 523 bp, Heterodera glycines
  SCN-specific regions: Sequence locations=1-371,393-523
cctttcgtctttctgccttttgctggccacaacacacacatttccctaacgaccttcgaccgactacgacacgacgcgtacgatgaacgaggaatactgcttctctacttcgactgttgttgcacagagctgggcccaaacaaacttccgaccagtggacgagcaaccgaacagccttgtggacacgctcatcgccaaactttcgtgcacgactttcgagcagttcacttccgaagtcagtgctcaggacattcacaagctttgcgatgtcaccgtcggtgttctccagcaacagtcaatgctcatccatctgcagcctcctgtggtcctttgcggcgacatccatggccaatttcgggacttgctgagaatcttcaagacgatgggctttccgccggacaagaagtacctcttcctcggggattacgtcgaccgcggcacgcaaagcctggaaacaatggtcctgctcttctgctacaaagtgaaatatccggacagtgtcatccttctgcgcgggaaccac

SEQ ID NO: 48162 - DNA, 604 bp, Heterodera glycines
  SCN-specific regions: Sequence locations=1-604
tgaaaattccgtctccgtccaaaatgcctgagttaccttttaagaccatcacgcagcaatcgttccaattgaagttgaggaaactgcaacgatcggcgaagtcaaacgaaagatccaacaggtcaaaggcgcagaatacccagcggagaaccaaaagctgatcttcaacgggagagtgctcgaggatgccatgttggtctctgagctgaactttgcggcgccgaaattcattgtcatcatggtcatgcgaaaacccgcgcaagcatcgtcaactgttcggccagcaacatcctccgcatcgccacaaaagaacacatcgacagcggacggacaggcgccgaaggcggagaagtcggcggagaacaaagcgacgggggcgacttccaacacatcggtggcccagccgggagcagcaacgggagtgccggcagagcatgcgcaaaccgtggccaacatcgaagccatgggttaccctcgccaggaagtcgttcgtgcgctgcaagccgcgttcttcgacgccgaccgtgccgtggagtatttgtgcaatggcatccctgaaggactttctctacaagagtcaaattctgatgctgacaatgatgcg

SEQ ID NO: 48163 - DNA, 657 bp, Heterodera glycines
  SCN-specific regions: Sequence locations=1-61,85-97,133-142,164 -205,251-313,337-340,368-555,580-585,607-657
caaatttggttttttacgagtaagcaatgggcaaggaaaagatcctatcaatattgtggtgatcggtcacgtcgattccggcaaatcgactaccactggccatctcatctacaaatgtggtggaattgacaaacgtaccatcgaaaaattcgagaaggaggctcaggaaatgggcaagggatcatttaagtacgcttgggtgcttgacaagctgaaagccgaacgcgagcgtggtatcactatcgacatcgctttatggaaattcgagacaagcaagtactatgtcaccattattgacgctcctggccatcgcgacttcattaaaaacatgatcacagggacttctcaagctgactgcgctgtgctggtggttgcttgtgggacgggagagtttgaggctggaatttcaaaaaacggccaaacgcgtgagcacgctttgcttgcgcagactttgggggtcaagcagctcatcgtcgcttgcaacaagatggacaccactgaaccgccattcgccgaggcccgttacacggaagtgatgactgaagtgtccaacttcatcaagaagatcggttacaacccagctaccgttccattcgtcccaatctctggcttcaatggcgacaacatgttggagccgtctgacaggatgccgtggtt

SEQ ID NO: 48164 - DNA, 617 bp, Heterodera glycines
  SCN-specific regions: Sequence locations=1-54,76-481,503-617
ccattgtggtggtgaattctctctccatctgtcctccatgcgctcttactctttccgggtttgcccgcccattccagcaaagagtgcattcttttgattgccagcttaagttccgtcgatgcgtcccctctccgccacactttcgagcagctcaaaatgcgttccgtccgctgctccatcgtttcatttggtgccgaagtgttcgcatttaaacgcctttgtgcgacaacggagggcaaatacagcgttgccctggacgaacagcatttggagcttctgcttgacgaacatgtccaaccgccgcccgtccaacgccgtccgggtcagcaggactcaatcgtccgcatgggctttccccaactccgccgcgtgaccgaaccgtccttttgtgcgtgccatgaattgaacggcgaagcggcgccaccgagtgccattgacggggctgctgatgagaaggcttcgtcctcggcactgccgcgcgctttcttctgtcctcagtgcgggtcgcgctactgccaaacgccggtggagtgccgaatttgtggtcttttgctgctcaccgccccacaattggcccgggcccaccaacacttggaggcgttgcccacatttgcgga

SEQ ID NO: 48165 - DNA, 526 bp, Heterodera glycines
  SCN-specific regions: Sequence locations=1-177,210-467,490-526
ttctcgaacatgccgaatatacagaagctcttgaactatactgagcattttaactatccctatgtcagcgaagtgacatattacgagcagttgttgaagattggacaaggaacatttggcgaggttttcaaggcgcgttgcaagcgaactggcaaattggtggcactgaaaaaaattttgatggaaaatgaaaaggaagggtttccaataactgcacttcgcgaaataaaaatgctacaaaggcttcgacatcagcacataactgaactggtggaagtgtgcacaagcaaacaaaagagtgggaaggagaaattctgcttttacttggtgttcaccttttgcgagcacgatcttgccggtctgttgagtaacacccaagtgaaaattcgactggtggacatcaaaacgatgatgcagcacattctgcgcggattgcacaaaattcactccagtcaaatattgcatcgcgacatgaaagcggccaatgtgttgattactggtgacgggggtgctcaaattggcagat

SEQ ID NO: 48166 - DNA, 511 bp, Heterodera glycines
  SCN-specific regions: Sequence locations=1-511
cagagaaagcgattatggcgaacccttttgatgacgacagtgacgaattcattcgcaaaatccgggccggccgtggaattgaaccgacaaaaagtttacaacgcccgcagcttcgcaaaacattgaggaccaaattgccgctgatgagaaggccattgagcgttacttgcaggcgtcgttggacagcacacagcgctcccgacaacagctgagctcatccgaggggttggccgagtccaccgcacgggaattgttggagcaacgggaaaagttggaacgggccgaacagaatttggacaccattcaccacaccactcagcacacacagcgcagcctgaacagcttgaagtcgtggtttggtgggctggtcagaaacaaactttcacgagcgccaaaagggttgggcacggcaaatgccaatgccaacaatcagcagcaacaactggaacagaccgtgcagcaacaacatcagcagcgtccgctgcatgcccatttggtgcagtcgtctgct

SEQ ID NO: 48167 - DNA, 520 bp, Heterodera glycines
  SCN-specific regions: Sequence locations=1-210,233-457,479-520
attgcgcgaaaatttctgctgagttagtcggagattaagatttctccaattgccgtgttcgaagtcgaacgtaattgggcttacgcaatgcaaatgaaatttgagatgatcgattcgccactttctcgcaaaaaatttcacatgagacaaaaattgcgtcgggcagtgaaaagtgctcattttttacattcgcttattgatgacaatccgctggtccacgaggtcactcgtgttgaaactgtttcttacgtgtctttcatcttcggcagtttggaactcgaactgaaaaattggaaacgagccatcgaaacttttgacagagcaagaatcggttactccgaactgcttgagcaagtccgaaacagcgatctcagcgaaacttatgctacaaagtgtcgcgaggtcgaaaatctgctcattttgtgccgggctcagacaggagatgcgaatgttctgctttcaactgtcagttcagtaaatctcaatgcttctgaagatgaccggaagccttcgcccgagc

SEQ ID NO: 48168 - DNA, 436 bp, Heterodera glycines
  misc_feature (435)..(435): n is a, c, g, or t
  SCN-specific regions: Sequence locations=1-34,56-436
attaactgcaaggtcaaagctgtttggatcttactttttatttaatttatttaatggcttttggacaaaagggaaaactgttggctgtcattggagatgaagacactgtggtgggctttctccttgggggagtcggtaagaaatggaacagtcaaaaaggcgttaatgcttgaaaattcacagaaaatggtaacaattgtcggttttaggtcaattgaacaaagcgcggaagcccaattttgtcattgttgacaaaaacacaagcgtcgccgaaattgaggacgcattccgcactttctgtacccgcgatgacattgcgattattctgataaaccaacacgtggcggagatgatccgataccaggtggaccaacacgtggccagcatcccggccgtgctcgaaatcccctccaaagaaatgccttatgacgcgtnc

SEQ ID NO: 48169 - DNA, 529 bp, Heterodera glycines
  SCN-specific regions: Sequence locations=1-155,180-529
caattctcggatctgcagaggatcttacaacgcatggccccccgccggagcagcagtacatgttcttgggcgactacgtcgacagaggagcacactcgatggagacaatcatccttctcttctgctacaagatcaagtacccatcgaacttcatgctgctgcgcgggaaccacgaatgctccaacatcaacaaagcttatggcttctacgaggagatcgaccgccgttacccgcgaccgggcgctcgtcgactcttcgacctcttcaatcaagtcttcgcctggatgccattcgtcggactgatcggcgagaagatcctctgcatgcacggcggcatctccgacaagatgcgcagcctcgatcaactcagcaccctgcgtcgaccacacacaaggccaccactccgttcgctcgaaattgatctactttgggccgatccagcgcaaggcatacgaggcgtcgtcccgagtaccagaggagcgggcatcctgttcggcgaggacctggtcgcccaaatactcactcggct

SEQ ID NO: 48170 - DNA, 500 bp, Heterodera glycines
  SCN-specific regions: Sequence locations=1-151,178-226,249-282,310 -348,384-433,459-500
taattttcccttttctgacacaaaaaatgacaataaaacctcctttcttttggacgaattcacaaaaattcaaatcaatgaaatttccaatgaatgcgaagcgacaaatttggcttgtcaaaaagaaaggacgcgaagttttaaggttatgaccaattacgaaatgatcaaagtggagagagtgggcgccgacgacgtcgtcgcactgatcactctgaaccgaccgaaggcactgaacgcattgtgcagccaattgatggacgagctcgcccattccctcacttatttggacaaagacgacggagtccacgccatcgttctcaccggcagtgaaagggctttcgcagccggcgccgacattaaggaaatggtgccgaagaaatttgccgaggttttcggtggcggctttttggagaattggtcccaagttgcgactgtacgaaagccgacaattgcggcggtcaacggacacgctctcgggggtggatgtgagttggcta

SEQ ID NO: 48171 - DNA, 678 bp, Heterodera glycines
  SCN-specific regions: Sequence locations=1-678
ctatggctttgtctcttttccaagcgcgaggaagcggagcgtgcaattgagcaaatgaatggccaatggctggggcgaaggacaatccgaactaattgggccactcgtaagcctggcgcaatgggcggtggagttgaatattcgagcaaaccgacggtggacgaaattatggcgcagacgagtccagaaaacacgtccgtttatgttggtggtgttcctcccggtgcgacagaggaagacatacggtcgactttcagacgattcggaaacatcgtggacattcgctactttaagccgcaaggatacgccttcgtgaaatacgagaccaaattggccgccgggaaagccatccacgaaatgaacagcaacaaattcatgggccaaacgcttcgtctcaattggggcaaagtcgatggcggcgggaccaagacgaccgagccgacttcttttgggacaaatacggcgccgactggcatgttcaattcgagctctaccgcctcttcccaagcagcgagtgcgcagatgcagcagtattggcagtattaccagcaatactaccagcagaacccgctttggaatggttattggcagggcggcgctaccggaaatggacaacagaagtgaaagacggacggagataaataaagcggatggattgtgttattgggtcgagcgatg

SEQ ID NO: 48172 - DNA, 658 bp, Heterodera glycines
  misc_feature (626)..(626): n is a, c, g, or t
  SCN-specific regions: Sequence locations=1-87,110-145,167-658
taaagttgaggtcgccgttgagcacccacggcgatagaccaacggtggacgacataatgcaaacgggcagatttggagacggccgattggtgaagatggaagtggactatagcgctcaagtggacagtcagttgatagtggcagacaatttggccaaggaggggaagactgccgaggcaattgagtccttggaaaagctggaaaaggacagtcgcataaattgcgacatgcgttccaaccagcgcctgttgtgccacatggtcaaattggcatttgacgcgaataattggcaattgctctgcgaaactgcgaagacattgtgcaagaagcgtctgctgatcaagtcgagcatcaagaaaatggtccaagaatgctgcgaaatggtgccaaaagcgccagacgcgtcgtccaaatcgacgctcatcgacacactccgcgcagtgactgcgggaaagatttacctagaggtcgaaagagcgcggctgaccaaacaagtggccgaaaagttggaagccgagggaaaattggacgaagcgcgcgaaatgatgatggaactgcaagtggagacgtacggcacgatggaagtggaggaaaaggtcaattatttgctgcatcaaatgcgcctntccattgccaataatcattttacgcgtgcttc

SEQ ID NO: 48173 - DNA, 488 bp, Heterodera glycines
  SCN-specific regions: Sequence locations=1-1,24-45
attaaattttttgattaaaaaagacgtggcttttgtacttattaagccttctgctgagcagaacaaaacgttccctgtgcttgtggtgatccatggcggtgcttatgaaattggctcttcggcacgttacacaaagtacgaagtgatcggccaacgatttgtgacagacgcaaattcgcgaggcattgtttttgtgagcattcagtatcgattgggagtgatgggatttgccaccaccggagatgaggaacttcccggcaatttgggcatttgggaccaaatttcggcacttcaatttgtcaaggacaacatcgcggagtttggcggcgacccgagccgagtcactgtgtttgggtacagtgccggctcgggaagcacggctttgctgagcatttcgccgaaaagccgagatctcttccagcaagcgattcgcatgagcggcacaccgttttcggtgtccggcagcggcacttttgtggcggaagaga

SEQ ID NO: 48174 - DNA, 637 bp, Heterodera glycines
  SCN-specific regions: Sequence locations=1-3,25-74,110-276,298 -376,405-419,441-453,476-637
tcctggtgatgacgggtaacggaggataagggttcgactccggagaaggggcctgagaaatggccactacgtctaaggatggcagcaggcgcgcaaattacccactctcaacgcgaggaggtagtgtaataaattcttattgtagtaaaaatgtccgaaaataagtccgaaggtggcgctgaaaagaagaagagcggtggattcaacacgaagaagtttttgttggacctcgcatccggcggaactgctgctgcagtctcaaaaaccgctgttgcacccatcgagcgcgtcaagctgttgttgcaggtgcaagatgcttccattcacatcaccgcggacaaacgctacaaaggcatcatcgacgtcctcgtccgtgttcccaaggagcagggctttctgtcgttgtggcgtggtaacctggccaacgtcatccgttactttccgactcaggcgctgaacttcgccttcaaggacacttataagcgagtcttcacgcaaggagtggacaaggagaagcagttcttgaagttcttcgccatgaatttggcttcgggcggtgccgctggcgccacttcgctgtgttttgtgtaccctttggactttgcgcgaacgcgtttggcagcggatgttggaaagg

SEQ ID NO: 48175 - DNA, 653 bp, Heterodera glycines
  SCN-specific regions: Sequence locations=1-472,494-497,524-539,566-653
ggtacgggttgtgcggcattggcggaattctctcttgcggtatcactcacaccgccattgtcccgttggatttggtcaaatgtcggattcaggtcgaccctgccaaatacaaagggatcatcggcggcttcaaagtcactctccaagaggagggcgtccgcggcttggccaaaggctgggcacccaccgccattggctattcaatgcagggccttggcaaattcggactgtacgaaatgttcaagaatgtgtacgccgggatgatcggcgaggaattggcttacagctgccgtacctatttgtacttggccgcctcggccagcgcggagttcttcgccgacatgatgctggcgccgatggaggccaccaaagtgcgcatccaaacatcgcccggagcgccgccaacgctgcgcggctgtgcgccgttcatttaccggaccgagggactgatgggcttctacaagggactgccgccgttgtggatgcgccaaatcccgtacacaatgatgaaatttgcctgcttcgagcgcaccgttgaactgctctacaaacatgtggtgcccaagccaagagccgaatgcaccaagcctgaacagttggtggtcacattcatcgccggatacattgcgggcgttttctgtgcgatcgtttct

SEQ ID NO: 48176 - DNA, 495 bp, Heterodera glycines
  misc_feature (455)..(455): n is a, c, g, or t
  SCN-specific regions: Sequence locations=1-56,82-84,131-495
ttaatggctgcgcgaaagactgttgcacgccgtgcccgaccgcaacgggcgaccagcaatgttttcgccatgttcgaccagccacaaattcaggagttcaaagaggcgttcaacatgatcgaccaaaaccacgacggatttatcgatgagcacgacctgaaggacatgttcgcttctcttgggaaggaagtctcggaaaagttcattgaaaatatggtcaacgatgcatcgggttctatcaatttcacaatgtttttaacgctttttggggagaaattgactggcactgaccctgaagaggtgatcaaaaacgcattccaatgttttgatgaggacaacagcggaacaattgcagaggatcgcttgagagagcttctcaccacaatgggagaccgatacaccgaggaacaggttgatgaactgtttcgtgatgcgccaatcaaaaatggccgctntgactacgtggaattcacgcgaatgctcaaacacgggacg

SEQ ID NO: 48177 - DNA, 535 bp, Heterodera glycines
  SCN-specific regions: Sequence locations=45-406,428-535
tccccttcctgctccttttccccttcctccgcctcctcttgctctgacagtccctcatccaaggccggccctgctaagtggccatgttttggccccccgtccattgcccacttgggaggaaatccgtgccgctgtgcccaaagagtgttttgaaaagtctctccttcgttctctgctctattcggccatggattttctcctccttggcgttgctttacgcctgtgtgccttttgtggacacagatttcggactgatcggactgtttgtctggtactgcttgctcggcatgtatgtgtcctctctgttttgccttggccatgactgcggccacggcactttttccgattggacatgggtcaacgacattttcggccatatttcccacgctttgctaatggtgcccttttggccatggcaaaaaagccaccgtcaacatcaccaattcacttctcatgtggacaaggacaaaggtcatccctgcgtgttggaagatgactacgaaggtggcggatggctgcgaaaacattttgctaa

SEQ ID NO: 48178 - DNA, 629 bp, Heterodera glycines
  SCN-specific regions: Sequence locations=1-61,83-629
aaaaaaaaatccttcctataaaaaattctatggcgaaattaattttgcatttggtagcgcattattggtggtgttgtttgtgatttgctgtgtcaattttgccgatgccactcagccaaatgaagatgataatgaagccaaagaccaacttttggccattggcgcatttgaacttaaaaggatggcacagtatgccatagaatggtgccacaacaatgcactgattttaaggcgaaaggaggatgagggcaacagaggcgatgctgccctatttcctccattgactttgtttccgtcgccattcccacgcgacgcttttgaacaagcgctgaaagcacaaaaggcgatgaatttgctttattttcgcgttgcgcgtgactatgaatttttgatgaatgcctacaaagatgtgatcaaaggggacgagcatattgccaaattggtggacattttgaagaaagtccacgaggagggaattcggcaaccgatcactgtgatgctgcagagagcggactatttattagatgttgtggagaacaatgatacaaacgaagtcaaatatgagccaaaacaggtcgaagtcaacactggtgccatcggagcaactgggctcaagcgacggaccaccg

SEQ ID NO: 48179 - DNA, 241 bp, Heterodera glycines
  SCN-specific regions: Sequence locations=29-30,107-168,191-241
ttttttttccttttttttttttttttttcgcttcttctcttcctcctcgaacttcttgcgctcctcctcgtcatgcgcttccttctgcttcttctccgcctccttcagctggtcgaaagtgtccgccgcgtgtttcttcgcgtcctccacagagtccgctaccaaaatgttgtcgaaaatggggcccgacttgacctgccaaatgtttattccgatggggccccaattttttcgcaagtag

SEQ ID NO: 48180 - DNA, 483 bp, Heterodera glycines
  SCN-specific regions: Sequence locations=1-145,167-483
tagtggagaggagaggggaagcaactccaaaggaagcggaaacgatgctacagcaacaacaaatgccaacattgaacagtgccatcagcaaaatagaccaaagcagcaacatggtggagcagtaattgcagcaataaggacgacgacaatgacaacaacaataacattaccactgcacattgctgttgaaaataactaaacaacaatgatcgagtttctattgctgaacggcgccaaaattaacggattggacggtgggaagaacacgccgctgcatttggccgccgaacgtggccatacaataattgtctatcaattgttgaaacgaaatgcagagaaaacgcaccaaaatgtgaacggacggacggcgttggaattggcggtggaacggtgccatgccgacattgtgacactgctccgactgcacgacatgaaggaggagttcaacgacgaccaaaactcgacaatggacgaaacagtgga

SEQ ID NO: 48181 - DNA, 596 bp, Heterodera glycines
  SCN-specific regions: Sequence locations=1-96,118-374,396-596
ggaccggctgatgaactgaaccgtgccgatgggtggctgaagttcgccatgagttgaccaatgttaccaaatgtatcatcgaattcgccaaaatggtcaaagagtttctggagttggagcaggaccacaaaatacacgcattgaaaaagacaacgttcgacttggcaatcattgcaatggcacaacactatcatcagcaaagtcaaacattgcatgtgaacaatttggtgctgcccgtgtaccaatttcgctgttcggacagaaaggacgaggaatttggcaaagagtttatcagtcggcttcagtacctcagctcattccaattgacttccactgaaaccgcccttttgtccgcctttgtgcttatggaccaatcccaggcgcccggcatggaagcgtttgtgggacagttgaagagctgtttggggggtcagttgcaccagcggatgccggacggggacgaggcattgcgccaactgctcgagttccttccgcgcctgcgggaattggcaaaaacgcatcgcaaatgtttgggacgcttccgattacaaatggtggaccagcaaagcgaacaccaaacggacagaggcgccgcg

SEQ ID NO: 48182 - DNA, 503 bp, Heterodera glycines
  SCN-specific regions: Sequence locations=1-369,391-503
ggcaagaaagcacaagtccaaattggaaatgttatgcctattggagaacttccggaaggtacgaccgtctgcaatttggaggagaaggccggtggccgtggacgtttggcaaggacttcaggtaattatgccattatcgtcgcacataaccccgacacgaagcgcacgcgaattcgtcttccatctggtgccaagaaggtcgttccatccgccaaccgtgcaatgattggcattgttgctggcggtggtcgcacggacaaaccgcttttgaaggcaggccgagcctaccacaaatataaggtcaaacgcaactgttggcccaaagttcgtggtgtggcaatgaacccggtcgaacatcctcacggaggaggaaaccaccagcacatcggccatccgtcaacggtcaaacgaggaacgagtgcaggccgaaaggtcggactgatcgccgcacgtcgcaccggacgtattcgcggaggaaagcctgagaagcgcggaaaggagga

SEQ ID NO: 48183 - DNA, 636 bp, Heterodera glycines
  SCN-specific regions: Sequence locations=1-154,180-194,218-282,308 -326,356-636
tattttcttccctttcctttgtcttccttcattccgcttttccctccccatttctcatttgttcttctccgcttcttctctccccgatgaatcactttgggctgacttttctgttcgtcgccgtttctctgctggtaattgcgcccggctgcgatggcatgcaaattttcgtgaagacattgacgggcaaaacgatcactttggaggtggagagctcggacactgtggacaatgtgaagacgaagatccaagagaaggagggcgttccgccggatcagcaacggctgatcttcgccggcaaacagctcgaggacggacgaacgttggccgactacaacatacagaaggagtccacgctccacttggtcctccgtctccggggcggaaatgggaagagaaacacgagtaagaacaagaaaagcaacaaaaagcttgatcagaattgatcagcagcgaacgcaccatcgcatgattgattggcacagtgattttccaccaccaaattcacaacacttttcccttttccgggttatctttgatttccattttcggttattgttttctgtttttctcctctatcttttgtaaaattctgttactttgatccttagttttatcatttatcatcgcatatat

SEQ ID NO: 48184 - DNA, 549 bp, Heterodera glycines
  SCN-specific regions: Sequence locations=1-59,92-182,215-275,299 -422,452-467,491-512,534-549
tacaaggcgaaacggacctccaacttgaacggattaatgtctactataacgaggcccatggtggcaagtacgtgccccgcgctgtgcttgtggacctcgagccgggcacaatggactcaatccgtgccggaccttacggtcagcttttccgtcccgacaacttcgtgttcggacaaagcggagcgggcaacaactgggccaagggccattacaccgagggagccgaattggtggataatgtgttggacgttgtgcggaaggaggcggaggggtgcgactgtctgcaaggctttcagctcactcattcgctcgggggaggcaccggttcaggaatgggaactctgttgatctcaaagattcgggaagaatacccggaccgtattatgtcttcgttttctgttgtcccttcgccaaaagcttctgacactgtggtcgagccttacaacgccactctttccgtccaccaactcgtagagaacactgatgagactttttgcattgacaatgaagcgctttacgacatctgtttccgcactttgaagcttcaaa

SEQ ID NO: 48185 - DNA, 632 bp, Heterodera glycines
  misc_feature (506)..(506): n is a, c, g, or t
  SCN-specific regions: Sequence locations=1-352,375-548,571-632
attttcttttttttacccctttgacgacaaacagaagcagcaatgagtggttgggatgcgtacattcagtcattgacttccagttgtgcggagattactcgcgtggccataattggcaattcggacgcgagtgtttgggccaggactgaaggggagaacgaattcaaggcgagtgaacctgagctcaagaaacttgtcggccaattcgatgatctttcgcaagttccgtccgtcggtgccgacctcgagggaattcattacattgtgccgcgaacggatgaaaatcttatctttgggaagagggacaaaacgggctttttcgctgtgaagaccaagtccgccattctgatcgccatttacaaggacgaggaaagtgtcgtcggcgccgacgtgcgaggggcggtggagaaaatggccaaataccttgaggacgccggttaccgagccgttgctcggtttcctaaacgacttttgtgttgccaaacgaaaagtgctgagaatggctntgacttattcttccaaatgcattccttttccatcccaaatgatcacttattattttattattacacattctgtgaagtgcgcgtgccgatttcttttttattatttgacctttggatgtgaataat

SEQ ID NO: 48186 - DNA, 398 bp, Heterodera glycines
  SCN-specific regions: Sequence locations=1-398
ctgcagttgctctttcgccagcgcacatgcgctgacacctgaacgggtcggctgtgctcaggcaatgggtcactgtgccgcttcgttggaccacgccgatttggtgctcaccgagttggagaacatcgccaaatgggagcacaccaaaaaaggcatttctggcggcgtcggcggggccgccggcagcggaagctcttcctcgggcggtggcattttttcatacattcgagactattcctttggtcggactgtcgacgtcgaggtgctcaatttgcgcgcgactttggtgctcagctacggctacgtggtgttctactgccccaccgagggattggtcctccgccttcagcagacggtgctgcccttcctgcgccaatacacggcaaatgcaaaaaaaa

SEQ ID NO: 48187 - DNA, 502 bp, Heterodera glycines
  SCN-specific regions: Sequence locations=1-502
taatatttgaaaataccttctctcttaattctcttctaaaaatggtcctgctttttctccattggcactgattttgctctgttcgctgtttgcttttattgtaatgatgcgcaaacatcgcgagtactggtccaaccgtggcatttcgtccccaaccccgcagctgatcagtggcaatttcggctcgctgtacggcaattatccgagcatgttccagctgagggattggaccagacagtacggcaagcagtacggtgtccagtacggttggcgcaacgcgttggtgatttctgacccggcaatggtccacgagttgcttgccaccaaatttgaatatttccacgcaagaaatctttcgcccatctttggcaatttggacacaaacaaatggatcagcatgttcttggccaggggaggccggtggaaaaggctccgaacgattgcgaacccggcattttcggtagcgaatctgaaaaagtgcatgtgtcccattgatgattcc

SEQ ID NO: 48188 - DNA, 693 bp, Heterodera glycines
  SCN-specific regions: Sequence locations=1-693
actctttttggttcctgtgctcattgtttggcctctttttgctctttttcctatgcttccgtgccggcattcgatgtttgaaacgtgttgagaatgtcacccgttcaccagtgtttgagcatttgaccacttcgctggacgcccttccgacaattcacgcgtttggccaaacccaacgctttgtggagcagctgaagcaacacttggatgagaacagtggtgctttgttcctctaccattcggcaatgcggtggcaggcggtgtggcttgacctgttggtggtcgggctgaccttcttcgtctccctgttcattgtgctgctcaccgggcgcattgacccggcggaggccggtatggccattgcatttgctatgcagatgagtggcatttttcaatttgcggtccgttctcaaactgaactggaggccaaactgacgtcagtggaacgcgtcagcttctattacaagaacatcgaggtggaatcggacaaagatggagatgacccggctgaacttggcccggcctggccccaatcgggcacattggaatttgatcatgtcattctccgttatgtgcctcaaatgaatccggcactcaatgacgtgtccttcattatttattccggacaaaaagttggcattgtcgggcgtaccgggagtggcaaaacgtcgctgtgcaatgcactgtttcgcc

SEQ ID NO: 48189 - DNA, 661 bp, Heterodera glycines
  SCN-specific regions: Sequence locations=1-173,195-661
cagcagcagcagaagcacaacacgaagatagtggagaggagaggggaagcaactccaaaggaagcggaaacgatgctacagcaacaacaaatgccaacattgaacagtgccatcagcaaaatagaccaaagcagcaacatggtggagcagtaattgcagcaataaggacgacgacaatgacaacaacaataacattaccactgcacattgctgttgaaaataaccaaacaacaatgatcgagtttctattgctgaacggcgccaaaattaacggattggacggtgggaagaacacgccgctgcatttggccgccgaacgtggccatacaataattgtctatcaattgttgaaacgaaatgcagagaaaacgcaccaaaatgtgaacggacggacggcgttggaattggcggtggaacggtgccatgccgacattgtgacactgctccgactgcacgacatgaaggaggagttcaacgacgaccaaaactcgacaatggacgaaacagtggaaagtttcatcggcgatttggcagcaaagcaacaacatttgcgcattaaaagtggacaatcggagccaaaaccaaataatgaggaagagggggaggagaaaattgtggaaaagttgtgatttgatgaataacgaccaacaaaacagtgaaa

SEQ ID NO: 48190 - DNA, 201 bp, Heterodera glycines
  SCN-specific regions: Sequence locations=1-56,90-141,171-177,200-201
cttaagctaagaaaatttgtcttgttattcgttcgtctttacacggtcaaacccgcaaaagaaatgggaaaggaaaagatccatatcaatattgttgtgatcggtcacgttgactccggaaaatcgactaccactggtcatctcatctacaaatgtggtggaattgacaaacgtactatcgagaaattcgagaaggagggc

SEQ ID NO: 48191 - DNA, 579 bp, Heterodera glycines
  SCN-specific regions: Sequence locations=1-221,243-245,268-579
atatgcaaatgttgttgagtggcgggtgggcgatgccaccggacttcagtttgacgagggcagtgttgatttggttttcactaattggttgttgatgtacttggctgatcaggaagcggtacaatttgttgccaatgctcttcaatggcttcggcctgacggttatctccatttgcgcgagtcgtgctcagaaccttcgacaaaaaaatctgctgatcactcaaccaccacaaccactaccagcacttcatcatcctcatcctcgtcgttgcacaacaattcgaagccaaatccgacccgttaccgcttctcatccgcctacatccaactgttgcgctccctccggcacacagacgtgcaaagcggaacccagtggcgcttcgatgtgcagtgggcgtgctcagtcggcgtgtacattgagcgacaatcaaactggcgtcaagtgcattggctggccaaaaaaagtgcgtgtaacatcagcagaaaacagcatcccaaaatctattggatcgttggccacccaatttgctgaccaatggcccacggaacagcgacaatttgacggacgaatggacgaac

SEQ ID NO: 48192 - DNA, 499 bp, Heterodera glycines
  SCN-specific regions: Sequence locations=1-237,260-499
taaaatgcctcgcattttggcaaaagttgaaggcaagggcaacggaataaagactgttattgcgaacatgcccgaaattgaaaggcactgtcccgtccaccgacctatccgacaaaatattttggctgtgagctgggagcgcagactaactttgacctgaagaatgagcgttatattgtcaatggggaacacgatgccaacaaactccaggatattttagacggatttatcagaaaatttgtgctttgtccgagctgtgacaacccggagactgtgctgaccgtaaagcgtcaagtgatcaatggaaagtgtaaggcttgtggacacgcttttattgtggatccaaaacagaagctgtcgacattcattctgaaaaatccaccgcctcctgacaacatagagagcgaaaaggaagtgaaaagcgacggcggattgccagctgaggagagtaacgatgtaccagtagtcgacaactcgggtggctgtgatgccgggtcga

SEQ ID NO: 48193 - DNA, 611 bp, Heterodera glycines
  misc_feature (24)..(24): n is a, c, g, or t
  SCN-specific regions: Sequence locations=1-371,393-508,530-575,597-611
ttcgtctttctgccttttgctggncacacaacacacacatttccctcaacgaccctcgaccgactacgacacgacgcgtacgatgaacgaggaatactgcttctctacttcgactgttgttgcacagagctgggcccaaacaaacttccgaccagtggacgagcaaccgaacagccttgtggacacgctcatcgccaaactttcgtgcacgactttcgagcagttcacttccgaagtcagtgctcaggacattcacaagctttgcgatgtcaccgtcggtgttctccagcaacagtcaatgctcatccatctgcagcctcctgtggtcctttgcggcgacatccatggccaatttcgggacttgctgagaatcttcaagacgatgggctttccgccggacaagaagtacctcttcctcggggattacgtcgaccgcggcacgcaaagcctggaaacaatggtcctgctcttctgctacaaagtgaaatatccggacagtgtcatccttctgcgcgggaaccacgagtgcagcaacatgaaccgagcctatggcttcttcgaagaggttgaacgtcgctatgggtagatggatgcttacgctctttggaacc

SEQ ID NO: 48194 - DNA, 539 bp, Heterodera glycines
  misc_feature (496)..(496): n is a, c, g, or t
  SCN-specific regions: Sequence locations=1-193,220-237,263-304,326 -373,412-539
aaagcaacgaatcgattaccagctctcttaacaaaaccttcgcctctcccatttcgacgacaaaatgcctccaaaaccatccggcaaaggagcgaagaaggcggttaagtcgaccaaggcggtgcgcacgggagacaaaaagcggagaaaggcccgcaaggagtcttactcggtgtacatctaccgtgtgctcaagcaggtccacccggacaccggcatttcttccaaagcgatgtccatcatgaactcgtttgtcaatgacgtgttcgagcgcattgcggcggaagcctcgcgattggcccactacaacaagcggtccaccatctcatcgcgcgaaattcagacggctgtccgactgattctgcccggcgagttggccaagcatgccgtgtccgaggggaccaaggcggtgacgaagtacacctcgtcaaaatgagcaggagatgatgaaagcggtggtgatcggacggaaaaaactatcccaaacggccctctntagggccacaatcactcaaatggacgcgaatgacacttttttt

SEQ ID NO: 48195 - DNA, 536 bp, Heterodera glycines
  SCN-specific regions: Sequence locations=1-322,344-368,390-536
caggcagcggttctttgtctacgccattgcacccgcagtggcaccggacggccatttgtattcatttgacatcgatgagaaacgtgccaaaactgttcataatgatctcaaactccacggtttgtcccaaaatgccactgtgctttgccgtgacgtgtcccagcatggctttgccgcaaccgattgtgcggagaaagagtggcgttgtgacggcgttttcctggacttgcccgccccgtggttggccattggccatgcccacaaagtgttgcttcaaaacgggcccgagcgccgtccgtctcggctggtcagcttttcgccatgcattgagcaggtgcagcgggtgtgtgccgagttggagcagcacggctttgtggacattgagacggttgaggtggtgccacgaaaactgaaggtggtcgacttgccctgcgaaagtttgtccgaatacgcagccaaaggagcgaacgcacagacattcttccagaaagaatctcagcagaacaacactgattgtgaacagcaacggcagaagg

SEQ ID NO: 48196 - DNA, 649 bp, Heterodera glycines
  SCN-specific regions: Sequence locations=1-649
gggtggattcgctccttccgaatctgctgcccctataacggtgcgaacggttctgtgccttcaggaagtaaagctggaccaactccgcaaaatggtgctaacggcgtcgccgctactggagcaaacaccgttcctctcggctcaaatggaaatgtggttccgagtgcgcccgtgccacgagttggctcctcattgcctcctccttcgtgcattgggtgggccgcgacaatcggaaaacgacacagggacgaatacattggtgactttgtctaccaggctccgcgacgtgaggagaaaattgatgtcattgcaagcgttgtcaggagatgcattgagtccttcaaaaagaacaggaacaaactaccactacgcgtggtcattttgcgcaacggatgtaccgagggacaattcgaatatgtcatgaaatatgaaattccgctggtcaagaaggaactggaggaattgggttgcaccgcaaaacttactgtgattgttccaaaccgacttcaggatgtacgctttctgcgtcaagatgccaagccggaggacaagagcaatgagcaaaacatccccccagggactgttgtcgacactgtcgttgttcaccccaaacgctccgggttcttccttaacagtcacgtggcgatca

SEQ ID NO: 48197 - DNA, 632 bp, Heterodera glycines
  SCN-specific regions: Sequence locations=1-13,35-415,440-632
agaggaaggggacaaaagaaaaagaagaccagaagatcaggagaaatacacggaggatgaagagctgaacaagaccaaaccgatttggactcgcaatcccgatgacatttcaaatgaggagtatgcggagttctacaagagcttgtcaaatgactgggaggaccatcttgctgtcaagcatttcagcgttgaaggccaactcgaattccgtgctctcctcttcgtcccccaacgcgctccgttcgatctctttgagaacaaaaagagcaagaatgccatcaagctttatgtccgtcgggttttcatcatggagaactgcgaggagctgatgccggagtacctgaacttcatcaaaggagttgtcgactctgaggaccttccgctgaacatttctcgtgaaactttgcaacaatcgaagatcttgaaagtcatccgcaaaaaccttgtgaagaagtgcatggaccttttcgaggagatttctgaagacaaggacaacttcaaaaagttctacgagcaattcgcgaagaacattaagcttggtattcatgaggactcggtgaatcgtaaaaagctctcagactttctgcggtactacacttcggcctccggcgaggaaccatgcagcttcaagg

SEQ ID NO: 48198 - DNA, 698 bp, Heterodera glycines
  misc_feature (655)..(655): n is a, c, g, or t
  SCN-specific regions: Sequence locations=1-492,520-698
catttttttttctatttcgcgttctgtcatcgtatatatttaagcgaattattttaccaaattcatttttatacgaatgttttgtcaactccaatgtttttttatacttttgtatatcaacataatgtttttcctgttgtagcataaatgagcattttaactgcttcgaaagtgtgcactttgccacggctttcttccgctcgctctatgacttggtggtggggcccggagaaaaacaatgggcgcgaagttgttggccccactttccacggggatgaattttaccaagatcgtcttgaccgttggtacccgtccattcgatttcgcaaaaatgacgaagtgatcacgcccattcgccacaaggaattgggagattggaagaagttgagcattgaggagaagaagcttatctaccgctactccttccgtcaaactttggtcacatttcgtcgtacattttctttggcattagcattatttcgattcgatagcttattattattttttctgtttaggccgagtttgaggcattgacgccttatggctatctcacagtcactttgttcttttctatgcttgggcttactattctgtacgcttcgtttgttaggacttacggcattcagttataggtactttgactcttatttatatnttttgaacagtgacaaaattcaatgaccgattgcctgacactt

SEQ ID NO: 48199 - DNA, 520 bp, Heterodera glycines
  misc_feature (502)..(502): n is a, c, g, or t
  SCN-specific regions: Sequence locations=1-520
cacatgcttttcctttgccgtctgactgaaaataccccaccactaaaaggggagccggacaaagtccttctgcgcgtgtattttaacccagaaacggaaagtcatttggtggcagagtctgttattttcacccttctctctgaacgacacctggggccgaaactctatggaatattcagcgggggccgtcttgaagaatacattccgtcacggccacttacttgccatgaaattgcgttgcccaccatggccaacaaaatagccaagaggttggctcgagtccatcaacttgaagtgccaatttggaaagaaccggaatatatttgtgacgcgcttgaaaggtggcttattcaattgaaacaaatgcccagtggttctcgtgatttcgatttgccggctgaaagtcacgaatgggctcctccgagcataaattgcgaagatttacagaaagaaattgagcacctgaggagattgattgtaaagagtcggagtctggttactntctgtcataatgatcttc

SEQ ID NO: 48200 - DNA, 443 bp, Heterodera glycines
  misc_feature (393)..(393): n is a, c, g, or t
  SCN-specific regions: Sequence locations=1-443
gaaagtgggcaattctacgtgccggatgagcccaaactcgcatttgttgtccggatcaagggaatcaacaagatccatccacgccctcgtaaagtgttgcagctgcttcgtctgcgtcagatcacaacggcgtattcgtcaagttgaacaaagcgacaatccagatgttgcgcattgctgacccgtacattgcgtggggctacccgagtcagaagatcattcgccagttggtgtacaagcgtggttatgccaaggagagtgggcagcgcattccgatcacggacaatgccattgttgagcgaaacatgggcaaatcggacgtgatctgtgtggaggacatgattcaccagatttggacagtcgggccccacttcaagcaagtgaccaactttntgtggcccttcaaactcagcaaccccgtgggcgggttcaagaagaagtcc

SEQ ID NO: 48201 - DNA, 622 bp, Heterodera glycines
  SCN-specific regions: Sequence locations=25-204,230-232,262-281,305 -383,405-573,595-622
aaaaagagattttttaaagaattacaaattaataattctgatgaagcttattgagcttcttcctttctgtttcgccgtttcggcacttttgctgccgtcccaaaccgatggcatgcaaattttcgtcgaaacattaattggccgagtaatcacactggaggtcgagagttcggacagtatcgagaatttgaagaggaagatcactgacaaggaaggcattcccgctgatgaccagcgtttgatctttgccggcaaacagctcgaggacggacgaacgttggccgactacggcgtgcagaaggaggcaaaaattcatttggtcctccgtcttcggggcggaatgcaaattttcatcaaaactttgaccggcaaagtcatcacgctggatgtggacagcatggacagtgtcgagaatgtgaagcggaagatcactgacaaggagggcattcccgctgatcatcagcgattggtttttgccggcaaacagctcgaggacggccgaacgttggctgactacggtgtgcagaaggaggccactgtacaccttgtgctgcgcctacggggcggcggatcgatgatgaactttgatgatgatgtgctctgatgatcagcagaattgatc

SEQ ID NO: 48202 - DNA, 483 bp, Heterodera glycines
  SCN-specific regions: Sequence locations=1-483
gtgaagaatgctgatggtaacacttctgccgtctgttggaccttggacgtagtgaacaacggaatgctacgtctggagatacggtgttcaactacgttgtcatgactgtggttggcactccgttggacaaacttattcgaaacgcgggcgatcgcttcagtccgggaaccgcaatcggcatgtcaatccaattgctgagtgccatcaaggctcttcacaatgtcggttttcttcatcgcgacatcaaaccagcaaacacagcgattggacgggcggagaccaacgaacaccgacttctctaccttatcgacttcgggatggcccgtcaatttcttcggcccgatggtacgcagcgacgtccgcgagcctccgcgaatttccgagggacgccaatttacgcaccgatctctgcacatatcaagcgtgactacagccgcaaagatgacgtcgaatcgtggttctatgtcatggtcaaattctaca

SEQ ID NO: 48203 - DNA, 521 bp, Heterodera glycines
  misc_feature (487)..(487): n is a, c, g, or t
  SCN-specific regions: Sequence locations=1-521
ttgtgcaagcgcctcgtctacgacacgtcagccagcgaggagcaggagcgatgcatgatcgcaaagctgaagccatgtgcgggttcgagtacacctccaagttggagcgattgctgactgatgtcgcgctgagcagggaccactccgagcaattcaagcagcagccgaggacatccaacgttgacttctccgtcattgtcgtcatgtcgaacgtgtggccactgcagcagccggtcaaattcgaaatcccgcgtcctctcctcgactgcattgactcctacactcagtactacaccaaccgtttcaatggccgtaagctgacctgggcgttgcaaatgtgccgcggtgaattggtctcgacgagcaacactttcccgtcgaaatactcatttttgtgcaacacgcaacaaattgccgtcctcatgcagtacaacgaacgcaacacgtacacacttggcgaactgcacgtcgctcttggcaccgactntcccggcgatcagctgtgcgctgctgttcaatcc

SEQ ID NO: 48204 - DNA, 496 bp, Heterodera glycines
  SCN-specific regions: Sequence locations=1-496
tttgcagaactgtggaccgaattcgtttccaaatgctattctttaaaacggtccggtcgagcagtgtccgcaccaacagcagcagaatgccgcgccgctgtcccaccgccccacggcattttccctccccgcaacttcgcctttctcaacaatttcatcggtgggctcactgccgtcggagccaacaacgcccacagaaagaatgagcacaggaaatgtgatgatgatgatgagcccgaaaagaatggacaaaggaaacggaggagagaaaggacaaagacagaaagccccgggcaaagagcggccaaaggacggcaaagagcgcgtgcacaagtgcgaccagtgccaaaaggcgttccgcttcaagtccaacctgttcgagcacaaatcgctgcatttgggcagcagcagtcggaaccctttcgtgtgccctttctgctccaaaacgtgccgtctgaagggcaatctgaagaagcatttgcaagtgcacgtcacc

SEQ ID NO: 48205 - DNA, 296 bp, Heterodera glycines
  SCN-specific regions: Sequence locations=1-296
ggtggtctggcgggtcaaaggatgggtgaccgaagtgaaaaaccgggaatgtgcggctcgtgctgggcattcagtgccaccggcgcattggagggacaacacgtgcgcgacaagggacatcttgtttcactgtcggaacaaaatctgatcgactgctcgaagaagtacggaaacatgggctgcaacggaggcatcatggacaacgccttccaatacattaaggacaacaaaggtatcgacaaagagacggactacccctacaaggccaagaccggctaaaagtgtttgtttaagcg

SEQ ID NO: 48206 - DNA, 373 bp, Heterodera glycines
  misc_feature (26)..(26): n is a, c, g, or t
  SCN-specific regions: Sequence locations=1-261,283-373
acccatcgtgtttccgatgaccaaanaggatggtcaaaagcgcagagaacgccttcatgactgtgtgggggaacataatgtgcgaatggtggccaaatattactcgcggatcactttccaacgaatggccaaacttctcgaattcggaattgagcaaatggaagcctttgtgtgcaaaatgattgtcgacggagtaatccccgaagtgaaaattcaccgcccttcgcaaattatttatttgagcccgaaaaagaacggcgcagaagtgctggacgaatgggtttttaacgttcgcaaattgaccgacacaatgaacaaagtcagccacctgatcgcaaaggaggaaatggttcacggattgcaaattcctcag

SEQ ID NO: 48207 - DNA, 548 bp, Heterodera glycines
  SCN-specific regions: Sequence locations=1-548
aacgattgaacgcactctcgaggcgcatccgaacggccgaccagtccttgatgtcattcgccaactttttcagagtcgcatcagtcaaacaatttcctgtgcaaactgcttgcggaccagtgaaacggtcggtgaataccgttctctacagattggcattgatggccatagcactctcatctcggctatccaagctttttttgcgccagaaccactgagagactttcggtgtgaccagtgccgggagactaattgtgtgactcggtccagcagattcactcagcttcccgaattgctcattgttcagcttaaccgttatgttctagcaagcaatggaaaccttcgcaaattacaaaacgccgtgcattacccacgccttttgaccgaacttggaggcgagggaatcccggactatgagctgtgtgctgtgatgattcatgaagggaagagcactaattcaggacattactacgacgtcattcgtgacccggtcatcgaccgttggtttacctacaatgacgaaacggtgaatcaaaagcgcacagctt

SEQ ID NO: 48208 - DNA, 492 bp, Heterodera glycines
  SCN-specific regions: Sequence locations=1-376,398-492
gggcattgaaactgtcggtggagtgatgacaaaactgatcactcgcaacacttgtcattccgaccaaaaagtctcagatattttctaccgcggcggacaatcagccaactgtgactattcaggtcttcgaaggagaaaggccgatgacgaaagacaatcatttgttggggaaattcgacttgaccggcattcctcctgctccccgaggcgttcctcaaatcgaagtcacttttgagatcgatgtcaatggaattttgcacgtgactgccgaggacaaagggactggcaataagaacaaaattacgatcaccaatgatcacaaccgactgtcgccggaagagattgagcgaatgatcaacgacgcggaaaagttcgcagaggaggacaagaaaaccaaggaagtggtcgaagcgaggaacgagtttgagtcgtacgcctactcactgaagaaccagctcggagacagtgaaaagttgggaggaaaactcagtg

SEQ ID NO: 48209 - DNA, 465 bp, Heterodera glycines
  SCN-specific regions: Sequence locations=1-465
acagattttggattgaattctaaagtggcagcggcgatttgtgaagctgcggatgacgttatttctggcaaattggatgagcattttccgcttgttatttggcaaaccggaagtgggacgcagtccaacatgaatgtgaacgaagtcatctcgaacagagcaattgaaattctcggaggcgaacttggctcgaagactcccgtacatccgaatgaccacgttaatatgtcccaatcgagcaatgacacttttccgactgcaatgcatgtcgcggtggccgttgagataaacactcgtcttttgccttcgctgcgtttgcttcacgacgaattgtcgaaaaagtcaaaggaatttgagcacatcatcaaaatcggccgtacccatactcaagacgcggttccgctgactttgggtcaggaattcagtgcttatgtcactcaaattggaaacggaatttcgcgtgtg

SEQ ID NO: 48210 - DNA, 503 bp, Heterodera glycines
  SCN-specific regions: Sequence locations=1-105,127-503
tgtgcgcccggagaagttggctgattgtttcgcggaaattctggagaaactaactgaggaccaaggcagagatgatgtcgatgtgcgtgtgattgtctatcagtctcatgccggagcaattattggcaagcagggcagcaaaatcaaggagcttcgtgaactgatgcaagcacatatcaaagttttccaagaatgcgcaccccaatccacggatcgcgttgttctcataaccactcaacaatccaaaatgccggatgcaattaagcacctgatggagtttatgcgcgaggtgccaattaaagggccaaccaaaccatacgatccgagtagccacgaccctcgcattgtgcagtgttatgggggcttcagcggaccaatgccaccacctccaatgggtggtccaccgatgggaatgcatggaggcggaggaggttatgcaagttttggaccacgtggcggaccgcctatgcctggtggaatgggaatgcccggtggttttatgc

SEQ ID NO: 48211 - DNA, 660 bp, Heterodera glycines
  SCN-specific regions: Sequence locations=1-7,30-660
acgaaaatttgtgctttgtccgagctgtgacaacccggagactgtgctgaccgtaaagcgtcaagtgatcaatggaaagtgtaaggcttgtggacacgcttttattgtggatccaaaacagaagctgtcgacattcattctgaaaaatccaccgcctcctgacaacatagagagcgaaaaggaagtgaaaagcgacggcggattgccagctgaggagagtaacgatgtaccagtagtcgacaactcgggtggctgtgatgccgggtcgaacggcgaagatgacgaggattgggcgcctgaacccgttgaagacgaggaaaaactttcgggacaaatcggcaaattggtcattgacaaggacttggacaaatctgtggatgagcgccttgacttgttgcatcagttcttcctcaaggcggtcaagaacaacacgattcaggacagcaagatgatgttaaacgaagctgaacgtctggaacttaaatcgaaggcaccgctgttgctggccgatgttttgttcgacaccaatgtcatcactcagatcaaacaacatcgcaatctgctgctccgcttttgcttgaaggacgagaaggcgcagcgcatccttttaggaggcattgaacaacttgtgcaaaacaacaaggacattctcatgtcgaa

SEQ ID NO: 48212 - DNA, 716 bp, Heterodera glycines
  misc_feature (667)..(667): n is a, c, g, or t
  SCN-specific regions: Sequence locations=1-558,580-716
tgaaaaaaaatgctttctaacatttattttacaataacgaaatgcgactgtatgcggctgtcattttttcccgccgttcgtcaggttcatcagatgcacacgcaatctgccgttgaaaaagcaaaaggagcgaggcctgaggagggtattccgctaaagggagaacctcacagaccgccttcactattcgacgacatcggaaagtaccacctttacgagccattgcccaaagtaccgaaggactttaaagaatttcctgaacgcgacttggtcaattttccctacccggaaaaggctgaatacccgccaagaactcgtttcgttgccatccccgactcatggtgtcgtgaaatcgaaaaagtcaccggaacttcggggccctatttgttttttggtggacttttggccttttcttctcaacaaagagattattatcatggaagagaatttctgttgctttgtgttcggatggattaacatttaccttttcttccacacggcttttcgttataaatttgaaaagtacgtatacaaagttacccgtgaacgatttggcaaaatgaaagcttacattgacaatgaattgaaggaagccgtcgagttccgcaagacttcaaaggagcacgccgactcgttgaaagcagtgcatgaaaactttcccacaatnttccaagagaatttggcgctgcaacttgaagcgacctaccgaaaaatgt

SEQ ID NO: 48213 - DNA, 747 bp, Heterodera glycines
  misc_feature (654)..(654): n is a, c, g, or t
  SCN-specific regions: Sequence locations=1-299,335-482,505-724,746-747
ccaacggatgggtcacgcaaattgccaccaacccattgtataagaatatgttggtgtcggcctcaagagacaaaaccatcatcgtttggatgcttgatgagagtgggtcggtgctaaacggcaaaccgatcaaatcattacacggacatggacactttgtttccgatgttgtcatgtcctcggatggacagtacgcactgtccggctcctgggacaaaacattacgactgtgggacttgaacacaggacaaacgactcgtcagttcgtctcccacacccaggatgtgctgtccgttgctttctccgccgacaaccgtcagattgtgtctggatcgcgcgataagaagatcaaactgtggaatacacttgcccagtgcaaacacaccatcgtggaggagtgccattccgattgggtgtccaccgtgcgcttttcgccttctcatgcgaacccagtgattgcatccgccggctgggacaaaattgtcaaggtgtggaacttggccacttgccgactgaagaccaaccacttcggacacaccggctacatcaactcggtcaccgtatcacccgacggctcactttgtgcttccggaagaaaggacggctcggcaatgttgtgggacttaaacgacggcaaacacttgtacacattgngcggcaatgacgtgatcaacgctttggcgttttcgcctaatcgctattggctgtgcgccgcgggtggcccggtggtgaaaaattgggacttgg

SEQ ID NO: 48214 - DNA, 313 bp, Heterodera glycines
  SCN-specific regions: Sequence locations=1-113,135-214,239-261,284-313
atccggagaacctttagaaagtcatcgttgttggacgtaaactcccaactgcaaatgacccaaatccgacactgcatgaaatggttatttttgccagcaaccacgtcgttgctaagtctcgcttctggtacttcactagcatgttgcgtcgtgttaaaaaaacacacggagaaattatttcatgtcaagaggtcttcgagaaaaagcctggctccgtgaagaactttggcatttggctccgctacgattctcgtactggacaccacaacatgtaccgcgagtatcgcgatgtttgtgaagcgggtgctgttac

SEQ ID NO: 48215 - DNA, 744 bp, Heterodera glycines
  SCN-specific regions: Sequence locations=1-744
caaaaaaaggcgtcgaatttgtgctggtcggccatccaaaaggtcattccggtgacagtatccatcaccagatgaaatcaacgaattgagcaccgaagtgttcacccaaagtgtgctcatttccacggtcaatcgaatcaaaaacagaagcagcggagaaacgatggagaacattgtcaacaaaacgaacgtcaaaatgggagggctaaactatgcactgccaatcatcagtgacggcatgcccatggagacattggtgatcggttttgccgtcaaccaccccgccggtggtttcggcatggattcggaccagaaaaatggcaacggaagcaatggcacaagcgacacgggcagtgacgcggcgagtgacaatggcaacggcgccaacggacacaaaccgcagaaaaagccgcaagtcttcgagaagagcgtcccgtcagtggtcgggtattccgcaaacattggagagaataacaatttcgaatttgtcggcgactacaaataccaagaagcacgacgtgacgaaaaattgcaaatcattgaccatattgtgcgccattgccttgaaatgtacaaacagcgccgaaacaacaaaaacccctcatcattgatcatctaccgcaatgcatgtggcgaaggattttaccaacatcttttggcctacgaagtgcccgttggtcaagcgcttgttggccgaacgttgcaatggcacgaagctgacactgattgtcgtcaacaaattgc

SEQ ID NO: 48216 - DNA, 463 bp, Heterodera glycines
  misc_feature (439)..(440): n is a, c, g, or t
  SCN-specific regions: Sequence locations=1-43,65-440
ttcccaaacttaagaaattctacgagggagctgaaaaaggcaggcaaaaacttcgaggttttgttcgtctcgcgcgaccgtgctgctaaagacctcgtcgaatattaccgtgaccacacggcgcttgggcctacctcgaattcggaaacccgaaaattcaggaacttctcgagaagtacgaagtgaaaaccattccgacttgcaaagtgataaaacccgacggaacgatcgttgtcaatgacgcacgaaccgaagttcaggaaaagggcgtggagaatgcacttggtctttgggaggaatggctgggattctatgaagcttgaaaaagcccattggcaagcgaaccgacgaacgaaggataatttgataaactttcctcaatgcttatttatatagccttaggcatttcaacattccccgataaagtaatcgcgtggcnnaaaaaaaaaaaaaaaaaaaaaaa

SEQ ID NO: 48217 - DNA, 214 bp, Heterodera glycines
  SCN-specific regions: Sequence locations=1-82,108-168,190-214
aagatgaaggaaattgcggagtcttacctcggtcacgaagtgaaaaatgccgtcgttactgtgccggcttactttaacgatgctcagcgacaagcaacaaaagatgcggggaccatcgctggactgaacgtggtgaggattatcaacgaacctaccgctgccgcaatcgcttatggtctggacaaaaaagaaggcgagcgtaacattctcgtgt

SEQ ID NO: 48218 - DNA, 780 bp, Heterodera glycines
  SCN-specific regions: Sequence locations=1-573,596-780
tatgcgaacttgtaccactcagaagaatttgctccattctgtgcttatgaatttgcaaagcaagcatcacttcttggcattatgtgcgttgcgattgataagacggatcatcggtttgaaggacgacacgtacattcgacacatttgtgacaagggcactttggaccaaattgtgcagtgtttcgtcgccaatgggcagcgttacaatttactcaattcgtctctcattgaacttttcgaatttataaaaagggaacggatttatccgctcattgagtacctaatcaacaaccattgggagaacacattcagcaaagtggactatgtgcaaacttttgtcaaaatgcacgacatttgggaggctcatttggccaacaaatctgacgagggcgaaaaagtgaaagaaaatggccagacgacgccattggccatgactccgccgaatgcccaatggcgcaaagagagagaacatgacgacgaggaattgttcttcagcaaggacgatgatgacgaaatgccgaccgctcagtgtcgaaagtcgggcgtcgaccccctcttcccgtctcttctcagaaagcggaaagctaatgatgaggacggaattgccagtgttttcggtgggaatatcactccgccagcgggcggcgcagtgtccgtcagcaggatatccaaaatagtgattcgaatgagcagcaaagagccatcgtcggccgctgtcccattggtaacggcgggtggggggcagtccaagcgcagcacatacaaatgaccaaaatcttc

SEQ ID NO: 48219 - DNA, 782 bp, Heterodera glycines
  misc_feature (52)..(52): n is a, c, g, or t
  misc_feature (693)..(693): n is a, c, g, or t
  misc_feature (705)..(705): n is a, c, g, or t
  misc_feature (738)..(738): n is a, c, g, or t
  misc_feature (741)..(741): n is a, c, g, or t
  SCN-specific regions: Sequence locations=1-55,84-139,170-782
gcggcacagccggcggccgcggaccgaccgatgcatccgtcgatgatggggnccgaaccaacagcagcagcagcagagggaacgtgcccatcgccctcccccacaccatccaggcgcatccatgcgaatgccggacatgcacaaccaacagcagcaacaacaacagggcgggttttggagtggaaaaagcggtggttcgatggcatggatgttgcccttctacaccgttggcgttgtgtgctttttgctctacacattgttcaagatcatgtttaagtcgaagaccaaacggcaaaaacgacgtcgcgaccgaccgcttgaccttttgtatggcgacgacgacgacgatgaaggaacggaggacggcttggaatatggtgttcgtggtgcgaaactccgctcggtgcagcacagactgcgcaaaacggagcaggcgatggcggacattctcagccaattggagcaaatttcggcccattcaaaggacattaatgatgacgacacaaaagcagcggaaaagaatgttaatgacccaaacattgccaatgctcaaaacgaagaagaaaatgccgaaacgttgcaagaaaaggatggcacattaagggaagcgcaaagtgcaaaggttgagcaatcattgcgcgagttgaaaatgttgtccgatctgtgcaaaagtgaccggcgattgagacgganattgcgtgccgncgcacaacgacagcagaaccttcattcatcctnctnctcgtccgccaacagtgacaacgaatttctgggatgaggaa

SEQ ID NO: 48220 - DNA, 586 bp, Heterodera glycines
  misc_feature (574)..(575): n is a, c, g, or t
  SCN-specific regions: Sequence locations=1-90,112-191,216-238,261 -407,429-561
atcgttgttggacgtaaactcccaactgcaaatgacccaaatccgacactgcatgaaatggttatttttgccagcaaccacgtcgttgctaagtctcgcttctggtacttcactagcatgttgcgtcgtgttaaaaaaacacacggagaaattatttcatgtcaagaggtcttcgagaaaaagcctggctccgtgaagaactttggcatttggctccgctacgattctcgtactggacaccacaacatgtaccgcgagtatcgcgatgtttgtgaagcgggtgctgttacgcagtgctatcgcgacatgggcgctcgtcaccgcgctcaagcggatcgcattcagatcatcaaagtgcaaaccatcagtgtggcggactgcaagcgagccggggtgaagcaatttcagaactccaagatcaaatttccgcttcctcaccgtgtgaattccaagcgacgcaatatgactcctttcacgacacagcgtccgagaactcattttgtgtagagaaagaaatgagacgacttgtatttccgatttgttgattaaagttgttgtgctaaaaaaaaaaaannaaaaaaaaaaa

SEQ ID NO: 48221 - DNA, 502 bp, Heterodera glycines
  SCN-specific regions: Sequence locations=1-31,54-82,123-251,273 -396,418-427
gaattattgacgtgttttgaattcgttcgccatttagcccccctccccatctctgttccgtaacaaattaattgaaatgcgttgctgctgctgctgctgttgttgatgttgctgctgttgcttgttggccccggtgttcggatgttccgtctccaaatgccgttccaacttttggtaggaggtgcaacggcgtactgcttgctgcacagcttacaccgtcccgagtccgccttgcgctgcgcttttgccaacaaatcggcagtgacgagcccatggaccatgaccaaatgccgttccaaacctaataatgtgtagatgatgtacaattgtaatcaagggagtaggacatgatggacaattatagatttaaatcgcggagcaagtcgtttaccgccctattttttttaatttttaaaacagaaaattgaaagaaaaggaaaaaaaaaaaaaaaaaaaaaaaaaaaaaaaaaaaaaaaaaggccaaaaaaaaaaaaaaaaaaaa

SEQ ID NO: 48222 - DNA, 710 bp, Heterodera glycines
  SCN-specific regions: Sequence locations=1-90,113-710
cagctgaacacctccaattcttcggaatcgccttccattgaaaatccgcctttgattccttccgccgtttatccgtccactccgagtgcgccgccccctccccaagttcagctgagtgcgcttgtccttcccccttcgtcacgatcctttaacgtcgaaagtcccatctccgatttaaactctccacaaatttcgaaccgtcaaacaaataaaacttcggcactatcaatgccccggggcacgaccaaaacggtggcacagcgaaggggcgggcggagaccgcgagaagcggaagatcaccagctaacggatgaggacaaagaccgacgggcgaagcgacgcgagcgcaacaaacaagcagcggcacggtgccgacggaggcgggaggagaaaatgcaaagtttgcaggaacaggtggacgaattgcggaagcaaaatgaacgccgggagaatgaaatccgaaaaatgcgagaaaaagagcagcgacttttggaaatgttgcgactgagaaacggcggaattgtgcagcagcagttgcaccaccatttgcaagcagttcacgtccaacaacagcaccaatccgtcgctgatcatccgactgtcagtcggcccacttctcttcttcagccttttctggtcggactgaataacaaaaagagattctgcgaagccccggcagtgccatcctcgtcctcttcagcagcatcacg

SEQ ID NO: 48223 - DNA, 602 bp, Heterodera glycines
  misc_feature (577)..(577): n is a, c, g, or t
  misc_feature (590)..(590): n is a, c, g, or t
  SCN-specific regions: Sequence locations=1-82,106-162,195-228,251 -505,529-577
ttctgttgacagtttcctgctgtgtgccatgatatcgaatgaaagggaacatttgtcgtctgaggctctcgaagctgctcgaatttgtgcgaacaaatacatggtgaagaattgcgggaaggacggctttacatgcgcgtccgaatccacccgttccatgtgattcgcatcaacaaaatgttgtcctgcgctggtgctgaccgtcttcagacgggaatgcgcggcgcctttgggaaaccccaagagttggtggcgcgtgtcggcatcggtgatatgctgatgtcggttcgtgtccgtgaccagcatcaagcccacgctcttgaagcattccgtcgagcaaagttcaaattccccggccgtcaatacatcgtcatttcgcgcaaatggggcttcaccccttttgaccgcgaagtttacgagaagcaccgcaaggaagggcgagtcattccggacggagtcaactgccgattcctcaagcaacacggaccattgacggaatggctcaaaaatccaatctgatcaattgtacgacggatatattcccttttatatgctttgttgattaaattgttggatnaaaaaaaaaaaanaaaaaaaaaaaa

SEQ ID NO: 48224 - DNA, 711 bp, Heterodera glycines
  misc_feature (700)..(701): n is a, c, g, or t
  misc_feature (711)..(711): n is a, c, g, or t
  SCN-specific regions: Sequence locations=1-711
accgtagttgtcacatagatggcatcaaaaattgttccattgccgtttcgccctctttaactttttgcgtcgtccattgccttcgttggtctttcgtcgttctcttttcaaatcgccattggacgcgccgttctgtggcatttacaggacaaatggcgggatttgccggacggatgacattttggtgtgccaacgcaagatggactatcaccttggagcaaatgtccgtcatcaacggggtcggaaccagcacttgttgaaagctaattgtgacgggacggttgtgatcacacgcggcaaaacgttcgaagagttcaagcaggagtatgagcgtgagtcggtttcgaggcgtgcggcatttactcgcggcaccattttcactgttcttttttatccgggcatttttgttggcattttggcggtcatcagtgtcatgtctcatcgctggcacacttatcatggcactggccgtgaacttcgccccgtgtcgaacgccttcgtccgctttgtcgccgctttcttcggttgttacagctattttccctacaacactgaccccgaccctgaaccaatcgctgtcgttgaaaaggaatgagtggtgaagaggaaatacgatttaggcaagcaaccacaacactttggtctttttattgttatttccctggcacataaacacagaccaaatgccaaaaaaaaaaannaaaaaaaaan

SEQ ID NO: 48225 - DNA, 522 bp, Heterodera glycines
  SCN-specific regions: Sequence locations=1-522
aagaggacgaaggggaagaggaatcgaccacttatacgaacattttgggcgaagaaaaggacgtgacgaagggcgtgggagcgatgttgaaattggccggccaaaagggctatttggagtcgggcgagcggaggctggaggaaggcaaactgaagcacctggagagcaaacgcttctccaaagttgagcagggacgatatgacattgaggacaaaacgatgcgaaagttggaacgtatgggcacagcggggacagggccaactcgtccattccccgagaaagcggagtacgaaccgaagattgaaataaattatgcggatcaaaagggccgcattttggacccaaaggaagcatttcgcgtcctttcgtggaaattccatggcaaagggccgggcaaaaagcaggcggaaaagcacgcagcacaagtggtgaagcgggaaaagctgaagaaaatgaactccatggacacgccgttgggaactttgaacaaacaatcgaagaagcaggagcaactgcaagcgc

SEQ ID NO: 48226 - DNA, 679 bp, Heterodera glycines
  SCN-specific regions: Sequence locations=1-112,134-679
tccttctgcaacacattaaacaacgacgcatgccggaggaactggtggcgctcagtcccggaacgcgtgtctccggccgctggaccatcatcaagaagcttggggcgggtgcgtttggagccgtctacttgtgtcaagaccgagatggaaggacaatggcagcactgaaaaccgatttttctacgctcagagaccactgctgtatatggaggcccacgtgttgctcaccctgaacgaacttcgatcaaacagtggacgccatttttgccgttgtctggaccttggacgcgatgaacaaccggatgccgattctggacagacgatggagttcaactacgttgtcatgtcgttggttggccgtccagtggacaaactccttcacgaatccggtgaccgcttcagccccggaactgcgatcggcacttcaattcaacttctcaaagcgcttaaggcgttgcacagcgttggatacctccatcgtgacattaaaccagcaaactcggccatcggcacgcctgagacgaacgaacagcgccttctctacctcctcgactttggaatggcgcgcaaatatgtcagagaggacggcacacaccggcgccaaagggacaccgaccgctttagatggacgccaatctacgcaccaatctctgcgcacatcaaacgcgactacagccgc

SEQ ID NO: 48227 - DNA, 722 bp, Heterodera glycines
  SCN-specific regions: Sequence locations=1-80,102-433,456-570,592 -620,642-722
tctgtcaattttccgctgacggccaatggttggccagcgcatgtgcggacaaaaccgtgaagatttggagcaccgttgacgggaaattggagaatactatccaaggtcataaattgggaatcagcgacgtttgttggtcgtacgacaaccgaatgattgtcagttgttccgatgacaaaacattgaagttgttcgatgtgcaacagggaaaaacattgaaaactttccgtggtcatcataattatgtattctgttgcaatttcaacccttaatcgactcttttggtctctggctcattcgatgaaacggtgcgcatttgggacattcggaatggcaattgcgtgcgcactttgcccgcccgttcggaccccgtcagcgccgttgcgttcaaccgggacggctctttgatcgccaccagcagctacgacgggctggtcaggatttgggagaccagcagtggccaatgcatgaccaccctcttcgacaatgagaatccgccagtttcatttgtcaaattttcgccaaatggtaaatacattttggccgctacaatggacagccagctgaaactttgggacttcaataagggaaagccgctaaaatcctaccaaggacacgtcaacaaaaaatattgcatttttgctaatttctctgttaccggaggcaaatgtatcgtcagtggctcagaggacaatcgcatttacatttggaatttgcagaca

SEQ ID NO: 48228 - DNA, 612 bp, Heterodera glycines
  SCN-specific regions: Sequence locations=1-220,242-395,419-469,507-612
tgggtgcttgtggaacgcgagagtttgaggctggaatttctaaaaacggccaaacgcgtgagcacgctttgcttgcgcagactttgggggtcaagcagctcatcgtcgcttgcaacaagatggacaccactgaaccgccattcgccgaggcccgttacacggaagtgatgactgaagtgtctaacttgatgcaattatttatcggttacaacccagccaccgttccattcgtcccaatctctggcttcaatggcgacaacatgttggaaccgtctgacaggatgccgtggtttaaggggtgggccatcgagcgcaaacatggcattgcatctggcaaaactctgctcgaggctcttgactccattcttccaccgcaaagaccaactgacaagccattgcgtttgcctctccaggatgtgtataagattggaggtattgggacagtgccggttggccgtgtcgagactgatgttctcaagcctggaatggtggtcacttttgctccgcaaggcatttccactgaagtcaaatcggaggaaatgcaccacgagtccttgccatgagcgctttcaggacacaatgtgggcttcaacgtgaaaaacatctctgtga

SEQ ID NO: 48229 - DNA, 524 bp, Heterodera glycines
  SCN-specific regions: Sequence locations=1-77,102-185,207-524
gtacggaaaagaaggtcaaaaaggtgaagaagaagtccaggaccggctccgaggcgagctccttcgaccagaagaccatccaggagttcaaagaagcatttggcattatggaccaggacaaagacggagtgatcagcaagcaggacctgaaggacttgtacgccactttttgagttgtggcgagcgactcgcatatggacaacatgctcaaggaggcaccggggccaatcaatttcaccgttttcctgacactgttcggagaacgactgactggcactgaccccgaggcgacaattatcggcgcctttcaaatgttcgacaaaactgactgtggcgaaatcacagaagagacattgatgaaaattctgaagaacaaacggggggagccattgacggaggacgaagtgcaagggatgtacaaagggaaccctccaattagtggaggcaaagtggactacaaggcattcgcgcatctgatcacgacaggcgcagcggaggagttggccaaagtgggctaagcgggg

SEQ ID NO: 48230 - DNA, 393 bp, Heterodera glycines
  misc_feature (2)..(2): n is a, c, g, or t
  SCN-specific regions: Sequence locations=1-47,88-216,238-361,390-393
gncccccctccccatctctgttccgtaacaaattaattgaaatgcgttgctgctgctgctgctgttgttgatgttgctgctgttgcttgttggccccggtgttcggatgttccgtctccaaatgccgttccaacttttggtaggaggtgcaacggcgtactgcttgctgcacagcttacaccgtcccgagtccgccttgcgctgcgcttttgccaacaaatcggcagtgacgagcccatggaccatgaccaaatgccgttccaaacctaataatgtgtagatgatgtacaattgtcatcaagggagtacgacatgatggacaattatagatttaaatcgcggagcaagtcgtttaccgccctatttttcttaatttttaaaacacaaaattga

SEQ ID NO: 48231 - DNA, 758 bp, Heterodera glycines
  SCN-specific regions: Sequence locations=1-308,331-758
tcccctatttgaaagcgaaaagtgctaagaatgtgcgctttttcttggccagttacaatttctcgcttcgatgagttcctacaattacatgcgttcggtgtggaagaaaaatgcgatggatttgctgtgggacaattcattcttcaaaatggacatccgcgcgttgcgccaatggttgtatttaatcgacaatttgatgaccaacgacaaaacatcgttcaaggaattgcttacgcggatcaccacctccacgtcgaccactctgtcaacactgatcaccagcaaggagcaggagtacgagatgcgtgcccagtacctgaagcggctggcgttcgtcattctcagctcggagctggaccaatatgcgggccaattaaacgaaatccaagaacggctgacagaaaatttacgtctttgccaagtgccggtgatccacacgcaggtgttcacgtgctaccgcgtgctgttggtccgcatgagtcccagttcatttgtgtccatttggccgtcgatggtcaccgaattggtccatgtgctggcacaaattgaccaccaactcacttcaacaacaccaacaagcagttccggaggcagcttcttcgcccgttgatgaacagaaatcggcgcgtgacgagcagtgcatgcagctgttcttggccgcttgcaaattgcttgagacgctgtgcgcacttccctccggttacatgtcgcagtttcaaatgtgtcgctggacattcatttccccgatgaatgccgtg

SEQ ID NO: 48232 - DNA, 676 bp, Heterodera glycines
  SCN-specific regions: Sequence locations=1-124,148-617,641-676
gtgggctcttctgcgtccttaagtattttttcgttgctctgagcaagttaactgtcttctactgctgtacaacaaaatgccccgtcatcgtgcaaagcctcgttcttttcatgccggattgaaattccccgtcggtcgtgtccatcgcaagatgaagaagggtccgtatgccaaacgtctcgcgaacggagtgccggtctacatgacatgctcgtgctggaacacatcacgggcgagctgctcaagaaaattggcgagatcacgcaggccgaaggcatgaagcgtctcagtgcatttcacatccgaactgcagcgcgcgatgacgacgagttgaggaagctgttctctggcgtctctcttgccgaggtgtgcgtgctgccggagctcgaatcggatgtggagcaatcatcggaaggaagtggcgagtccgactccgatgaagaaagtacggaagggagcgcgagcggaagtcatgagggtggcggtgctgctgctgcgcagcaatgagaggaggattgaattctcgagaccgccgtgataacattgactgccaatttaaaagaggatagattgtgtctctgtctgtgatatatacatttattgtgaatatgtccatgtctctttctgtgacattgtcttcttgctgctgaataataaatttcgaaaaaaaaaaaaa

SEQ ID NO: 48233 - DNA, 566 bp, Heterodera glycines
  SCN-specific regions: Sequence locations=1-566
caaaaactgataaaaaaaatggcgttcctctcccgtctctccatccttccaaattcgccaatttcgctgcttgcagtttctttggccgttttggctttcgtcgctttggcatcggccaatccgccgacggcacgcgaaacggcgccaaatgcacagcaaaacaatgccaatacagtggcaactagggaaattgcgaaaaacattgcggaaaagatggagcggacgaacgagttcattaattattttagggcgaagaagttcatcgatgcacataatttggcatttgagaagggcgaagtgtcgctcaaagttgcgccaaaccatctgatgcattttacacctgcccaatataatcgaattcgcggcttgcaaatgcgcagcaaccgacaacggcacaacatggcaactctggcgggaaacagcagtacttcgccggaaaagccggactggcgcgagaaaggggcggtgaccgaggccaaagatcagggggactgcggctcgcgttgggcattcagtgccaccggtgccatcgagggagcattggcacagaaaaaagcgccgaaaaa

SEQ ID NO: 48234 - DNA, 746 bp, Heterodera glycines
  SCN-specific regions: Sequence locations=1-256,278-746
cacgtcggaatcccgacccatcgaagtgcacagttgaaggagcaggcgaaggaggagcgcgctcagcggcaattgaaaatatccatgaaggaagagatagaaagtgcgcagcgtgagttggaagtagcacaagggcgaattcggcgcctggaagatcaaatttacgagctgattgatgcatagcgattgctggaagaaaaggagcacgagctacaaacattgaacactgaattggcatcagagagagctatgagcaaggaggaacgggcaagactgctcactgaaattgcactgcaagaatcgcgcgtttccgaaaagcgattcgaagttaagaacaaaacggaggagatgaacaaactgaaggcggaggttgaaagtgggaatggccatttgccgaccgaattcaatgacccggacgatctgacagcccacattgaattgagtacattccacgagggcgacgtcaacaatgtgatgccacagcgtgaattggaccgaaccaacttcactgatcaggacttgtcgttgaagcgcaaactcgagttgcttacaaaggagttggacaatgcgcgagatgagcgggcgatcactgactttgatgtgctgcacatggagaataaaaggcatgctcgtgacaaatacaacacattgcgccaaattcgcagtggaaatacaaagcgacggattgatcaatttgaaaatttgtgaggagcgggcatttttgccttgagagaacaattcattgc

SEQ ID NO: 48235 - DNA, 712 bp, Heterodera glycines
  SCN-specific regions: Sequence locations=1-281,305-335,362-712
tcgcttttcgaagaatacccaaaatgtcttttggtcggtgtcgacaatgttgggtcgaaacaaatgcaggaaattcgcggggcaatgcgagggcatggtgaaatattgatgggaaagaacacaatgattcgcaaagccatccgtggaaatcttcaaaaattcccgttgcttgataatttgttgccttacattgtcggcaacgtcggattcgttttcaccaacgaggatttgggtgatgtgcgcaaaaaactgttggagacaaacgaggcgcgcctgcaaaggctggtgccattgcgccatgtgacgtgcgattgccgcctcaaaacagtggaatgggtccagagaagacgtccttcttccaagccttgcaaattccgaccaaaatttcgcgtggtaccatcgaaattctcaacgaggtccatctgatcaagactggggagaaagtcggcgcttccgagtcagccttgcttaacatgttgggcattcaaccgttttcctacggactggtcgttgagcaggtttttgacaatggggctgtttactcgcccgatgtgcttgatgtgacgacggctgatctgcttgcacgtttccaacaaggtgtgctcaatgtggccgcactttcacttggcatcggctacccgaccaaggcatcggcgcctcatctgattgccaatgctttcaagaacttgttggccgttgctgccgaaacgga

SEQ ID NO: 48236 - DNA, 681 bp, Heterodera glycines
  misc_feature (662)..(662): n is a, c, g, or t
  SCN-specific regions: Sequence locations=1-681
accttctctcttaattctcttctaaaaatggtcctgctttttctccattggcactgattttgctctgttcggtgtttgcttttattgtaatgatgcgcaaacatcgcaagtactggtccaaccgtggcattccgtccccaaccccgcagctgatcagtggcaatttcggctcgctgtacggcgattatccgagcatgttccagctgcgggattggaccagacagtacggcaagcagtacggtatccaatacggttggcgcaacgcgttggtgatttctgacccggcaatggtccacgagttgcttgtcaccaaatttgaatatttccacgcaagaaatctttcgcccatctttggcaatttggacacaaacaaatggatcagcatgttcttggccaggggaggccggtggaaaaggctccgaacgattgcgaacccggcattttcggtagcgaatctgaaaaagtgcatgtggctcattgacgattcagttaaaaatgccatcaattttctggaaaaagcgcgcaacgaaggcaaatcttttaacattcaaaggcatttcgtagaaatgagtttcgatgtgatcgcccgtgtggcgttggggcagcgcgagtcgcgacagtttgagactgaaatggcacacctggcgattgagtcgatgcanaaatacaaatattcaattg

SEQ ID NO: 48237 - DNA, 813 bp, Heterodera glycines
  SCN-specific regions: Sequence locations=1-660,682-813
accttctctcttaattctcttctaaaaatggtcctgctttttctccattggcactgattttgctctgttcggtgtttgcttttattgtaatgatgcgcaaacatcgcaagtactggtccaaccgtggcattccgtccccaaccccgcagctgatcagtggcaatttcggctcgctgtacggcgattatccgagcatgttccagctgcgggattggaccagacagtacggcaagcagtacggtatccaatacggttggcgcaacgcgttggtgatttctgacccggcaatggtccacgagttgcttgtcaccaaatttgaatatttccacgcaagaaatctttcgcccatctttggcaatttggacacaaacaaatggatcagcatgttcttggccaggggaggccggtggaaaaggctccgaacgattgcgaacccggcattttcggtagcgaatctgaaaaagtgcatgtggctcattgacgattcagttaaaaatgccatcaattttctggaaaaagcgcgcaacgaaggcaaatcttttaacattcaaaggcatttcgtagaaatgagtttcgatgtgatcgcccgtgtggcgttggggcagcgcgagtcgcgacagtttgagactgaaatggcacacctggcgattgagtcgatgcaaaaatacaaatattcaattgcccagactgcggacactgagaaagaagtggcattctccggacaatcggtgataacgccaaaatcggtcactgttgggcttaaactgagggacgaagacggcacggcacatttgaataacctctgctgattaa

SEQ ID NO: 48238 - DNA, 619 bp, Heterodera glycines
  SCN-specific regions: Sequence locations=1-619
tatatttgaaaatcacttctctcttaattctcttctaaaaatggtcctgctttttctccattggcactgattttgctctgttcggtgtttgcttttattgtaatgatgcgcaaacatcgcaagtactggtccaaccgtggcattccgtccccaaccccgcagctgatcagtggcaatttcggctcgctgtactgttattatccgagcatgttccagctgcgggattggaccagacagtacggcaagcagtacggtatccaatacggttggcgcaacgcgttggtgatttctgacccggcaatggtccacgagttgcttgtcaccaaatttgaatatttccacgcaagaaatctttcgcccatctttggcaatttggacacaaacaaatggatcagcatgttcttggccaggggaggccggtggaaaaggctccgaacgattgcgaacccggcattttcggtagcgaatctgaaaaagtgcatgtggctcattgacgatccacttaaaaatgccatcaattttttggaaaaagcgcgcaacgaaggcaaatcttttaacattcaaaggcattccgtacaaatgagtttcgatgtgatccccccgtgtggcgttggggcaa

SEQ ID NO: 48239 - DNA, 735 bp, Heterodera glycines
  misc_feature (563)..(563): n is a, c, g, or t
  misc_feature (694)..(694): n is a, c, g, or t
  SCN-specific regions: Sequence locations=1-57,89-735
gcaatgtctgtgcctggctctaacctccgcaacagggcgaggacgccgaggagcggctgatcaacgaggagtacaaaatctggaagaaaaactgcccgttcctttacgacatggtgatgactcatgcgttggaatggcccagtttgaccgtccaatggctgcccgacgtgcaacgacaggagggcgccgactacacaatccatcgcctcattttgggcacgcacacgtcggacgagcagaatcatttggtcatcgccaaactgttactgcccaacgacgacgcacagtttgacgcgtctcgctacgacactgaccgaggcgaatttggtggctttggcacagtgaccggcaaaattgaggtggaaatcaaaatgaaccacgagggcgaggtgaaccgggcccgatacatgccacagaatccggttctgattggcaccaaatcaccctcctcggaggtgtacgtctttgactacacgaagcatccgtccacgccggctgacgtggagtgcaagccgcagttgcgactgcgtggccacaccaaggagggatacggcttatcctgnaacaacaatttgcctggtcatttgttgagtgcctccgacgacatgaccgtgtgcctgtgggacattcaagcggcgactgcgaatgccaacttttttggacgcaaaatccatttgcacagcacacactgcgngtgttgaggacgtggcatggcacgttttacatgacacagtc

SEQ ID NO: 48240 - DNA, 552 bp, Heterodera glycines
  SCN-specific regions: Sequence locations=1-552
taccttgtcgaagtgagcgagaaggcgcgacgttacgacgacatggtggaggccatgaaaaagctgatcaagttggacccaaatctgaccctggaggagcgcatttcgttgtcaacggcttacaaaggtgcgatggcttctcgtcgtacgtcctggcgtgctttggtctccatcgaggaacggaccggcgcgagtttgagcgatgcacaacaacaggtgttggagaactatcgtgagaaggtgcagaatgaactggtgaacacttgccaagaacttttgacatgcatcaacgaagtgctgtttccgaaggcgtccgacgtggagcagaaggtgttctatctgaagatgaaagccgactactaccgttacatttccgaagtcgcgacggacgaagaccgatccggtgttgtcgaactcgccaaagttgcctaccaggaagcgattgacatggccggcgacaaaatcccagcgaccaatccgactcggcttggccttgcgctcaacttcgccgtgttcaactacgagatcttaaattcggtgaccgaggcacgc

SEQ ID NO: 48241 - DNA, 594 bp, Heterodera glycines
  SCN-specific regions: Sequence locations=1-594
cactgaatttgtgggagaccacttccattgagaagctcttctacccagaagaggatgaacggttcggcgaaattattgtgcgaactcccatcttctactgcgagtactcgcagaaaaggggacccaaaatggctcttgcactgcgagaatttgaccgggtccggaacgagtcgcgttacccatacgtggactacaaggagatttaccttctggaccggggctaccgatacttcttcaaggaacgcaaatttggcaagtactgtactccacaagcgtacgtgcaaatgtgggattcggcgtacacagaacagcgcaagcgatttgattcgcatcgtcgtggaaagaaaaggcggaggaacaattaattaggtggagagggcactacgaaaatttatgaattgctttgtttgtttgttagtgctttttttgtatattttgtcttggtttaatcatcggaattgtctctattcatttactatttttctgtccatcctcatttccctcattatctatcgctttggtctgtttctctcgcattccttttccactcactttcgatatttttcccctattgtgcgaataaagaagactgga

SEQ ID NO: 48242 - DNA, 409 bp, Heterodera glycines
  SCN-specific regions: Sequence locations=1-55,78-175,205-262,291-409
acaaatcttctctcttctttcattcaaataaaatgccaccaaagccatcgggaaaaggggcgaaaaaggcagtgaagtccacaagacggtgcgcacggctgacaagaagcgtaagaagtctcgcaaggagtcgtactcagtctacatttaccgtgtgctgaagcaggttttctctgacaccggcatctcgtccaaggccatgtctattatgaactcgtttcgcaatgatgtgttcgaacgcattgctgccgaagcatcgcgtctggcccattacaacaagcgctcgacaatctcttctcgtgaaattcagacggcggcgcgtctcatccttccgggcgagttggcaaagcatgccgcttctgaggggaccaaagccgcgaccaaatacacctcgtctaaatgagaccat

SEQ ID NO: 48243 - DNA, 749 bp, Heterodera glycines
  SCN-specific regions: Sequence locations=1-124,153-306,333-345,372 -474,504-504,546-546,594-636,687-749
gctccttaagcttaaaaaacagacctgcattcagtattatttataagaacaccaaaaatgcgtgaagtgatctctattcatgtgggacaagcgggcgtgcaaattggaaatgcttgttgggaattgtactgcttggaacatggcattcagcccgatggaaaaatgccatccgaccaaaacaaccaagacgattcgttcagcaccttcttctcggaaacaggcaatgggcgtcatgttccgcgtgcggttatggtcgacttggagccaacagtgatcgacgagatccgcactgggacttacaagcatctcttccaccctgaacagctcatcactggaaaaggagacgcggccaacaactacgctagaggacattacacagtcggcaaagaaatcatcgaccccgtcttggatcggattcgtcgcatcgcggataactgcaccggacttcaaggctttctcatcttccattcgttcggtggtggcactggctctgggttcacatcgctgcttatggaacgtctctctgttgactatgggaagaagtctaagctcgagttctccatctaccctgctcctcaagtgtccaccgctgtcgttgagccgtacaattcggtgcttactacgcacacgactctcgaacactctgactgtgcatttatggttgacaatgaggccatctacgatatttgtcgtcgaaatttggacgtggaacgaccttcttacaccaatttgaaccgtttgatttctca

SEQ ID NO: 48244 - DNA, 392 bp, Heterodera glycines
  SCN-specific regions: Sequence locations=1-6,28-75,97-392
ccggtgttgctcatgagcaagatggaccgtgcgctgctcgaacttcatcttggccaggaggaattgttccagacattccagcgcattgtggagaacatcaacgtgatcattgccacttacggagatgatgatggaccgatgggtccgatccatgtggacccgtccgttggctatgtcggctatggctctggacttcatgggtgggctttcgcatcgaagcagcgatgcggagatgtccgctgacaagtttggagtccagcaggccacattgatgaggactctgtggggcgatcggttcttgacgggaagacctcggaaatggaccaacaaccagggaccccgggaccatgcgagggttctcccaatctgtgctggacccgatcttcagcggg

SEQ ID NO: 48245 - DNA, 706 bp, Heterodera glycines
  SCN-specific regions: Sequence locations=1-706
tttgcagaactgtggaccgaattcgtttccaaatgctattctttaaaacggtccggtcgagcagtgtccgcaccaacagcagcagaatgccgcgccgctgtcccaccgccccacggcattttccctccccgcaacttcgcctttctcaacaatttcatcggtgggctcactgccgtcggagccaacaacgcccacagaaagaatgagcacaggaaatgtgatgatgatgatgagcccgaaaagaatggacaaaggaaacggaggagagaaaggacaaagacagaaagccccgggcaaagagcggccaaaggacggcaaagagcgcgtgcacaagtgcgaccagtgccaaaaggcgttccgcttcaagtccaacctgttcgagcacaaatcgctgcatttgggcagcagcagtcggaaccctttcgtgtgccctttctgctccaaaacgtgccgtctgaagggcaatctgaagaagcatttgcaagtgcacgtcaccagcgcggaggacttggaatgcttgtgggaacgctctttctcacgcagttccggtcgtccgagtaaaaatgcaccgcccgctccgttgccaaagcccggcgacgacctcggcatggtgccggtgctcgtctctcagcaggatgcttcttcctcctctccatttggctccccccccaccatcaaatggactttgccccaaaatcgaagtgcc

SEQ ID NO: 48246 - DNA, 508 bp, Heterodera glycines
  SCN-specific regions: Sequence locations=1-207,229-508
atgcggttaattcgaccaacgcggtgcgcacggaaaacaaaaagcggaaaaaggccctcaaggaatcttactccgtgtacatctaccgtgtgctcaaacaagtccacccggacaccggcatttcttccaaagcgatgttcatcatgacactcggttgtcaatgacgtgttccagcgcattgctgcggaagcctcgcaattggcccactacaacaagcggtccaccatctaatcccccgaaattcagacggctgtccgactgattctgccctgcgagttggccgaccatgccgtgtacgaggggacctaggccgtgacgaagtacacctcgttaaaatgagcaagacatgatgaaatcagtggtgatcagacaggaaaaactatcccaaactgtgcctctttaaggccacaatcactctaatggacgcgaatgacactttttttgctgtcttgcatgtgaacgcaaataaatcggctttacgcttaaaaaaactgttgaaaacggcggc

SEQ ID NO: 48247 - DNA, 795 bp, Heterodera glycines
  misc_feature (627)..(627): n is a, c, g, or t
  SCN-specific regions: Sequence locations=1-48,70-117,139-243,281 -505,527-708,730-730,756-795
ccctgagacggtgttgcgtcaagcattgccgagcgtatcaaaccggtgttgctcatgagcaagatggaccgtgcgctgctcgaacttcagcttggccaggaggaattgttccagacattccagcgcattgtggagaacatcaacgtgatcattgccacttacggagatgatgatggaccgatgggtccgatccaagtggacccgtccattggcaatgtcggctttggctctggacttcatggttgggctttcacattgaagcagtttgcggagatgtacgctgacaagtttggagtccagattgacaaattgatgaaaaatctgtggggcgatcgcttcttcaacatgaagaccaagaaatggaccaacaaccaagagcccgagaccaagcgaggcttctgccaatttgtgttggacccgatcttcaaagtgttcgacgctgtgatgaacatcaaaaaggacgaagtggcgaagttggtggagaagctgaacatcaaactgaccttggaggagaaggaacaggagggcaagccattgctgaaaacgatgatgcgcaaatggttgccagccggtgacactatgcttcagatgattgtcatgcatttgccatcgccagtcacggcgcanagataccgcatggaaatgctgtacgaagggccgcatgacgacgaggcgggcggttgcaatgaaaaactgcgaccccaacggaccactgatgatgtacatctcgaagatggtgccaacctctgacaagggcgcttctacgctttcggtcgtgtgtttgctggcagagtc

SEQ ID NO: 48248 - DNA, 683 bp, Heterodera glycines
  SCN-specific regions: Sequence locations=1-41,87-110,135-146,170 -266,303-515,537-548,571-683
tgtagatcgggggtattgggacagtgccggttggccgtgtcgagactggtgttctcaagcctggaatggtggtcacttttgctccgcaaggcatttccactgaagtcaaatcagtggaaatgcaccacgagtccttgccagaagcgcttccaggagacaatgtgggcttcaacgtgaaaaacatctctgtgaaggacattcgccgtggttcggtcgcgtccgactcgaagaacgacccggcaaaggagaccaagagcttcacagctcaagtcatcatcatgaaccacccgggtcagatcgctgctggttatactcccgtgttggactgtcacaccgcgcacatcgcgtgcaaattcgccgaactcaaggagaaggttgaccgtcggtctggaaagaaagtggaggacaacccgaaggcgctgaaaaccggcgatgctgggatcgtcgatttgattccaaccaagccgatgtgtgtggaggcattcacggactacgctccgcttggtcgtttcgccgttcgtgacatgaggcaaaccgtcgctgtcggtgtgatcaaggcggtggagaagactgaaggcggtggaaaggttaccaagtcggcgcagaaagctgctgcccctggtgggaagaagaaatgagacacgctgataattggaatggattcgatttttggatctgttgtt

SEQ ID NO: 48249 - DNA, 679 bp, Heterodera glycines
  SCN-specific regions: Sequence locations=1-20,66-89,114-125,149 -245,282-494,516-527,550-580,603-679
cagtgccggttggccgtgtcgagactggtgttctcaagcctggaatggtggtcacttttgctccgcaaggcatttccactgaagtcaaatcagtggaaatgcaccacgagtccttgccagaagcgcttccaggagacaatgtgggcttcaacgtgaaaaacatctctgtgaaggacattcgccgtggttcggtcgcgtccgactcgaagaacgacccggcaaaggagaccaagagcttcacagctcaagtcatcatcatgaaccacccgggtcagatcgctgctggttatactcccgtgttggactgtcacaccgcgcacatcgcgtgcaaattcgccgaactcaaggagaaggttgaccgtcggtctggaaagaaagtggaggacaacccgaaggcgctgaaaaccggcgatgctgggatcgtcgatttgattccaaccaagccgatgtgtgtggaggcattcacggactacgctccgcttggtcgtttcgccgttcgtgacatgaggcaaaccgtcgctgtcggtgtgatcaaggcggtggagaagactgaaggcggtggaaaggttaccaagtcggcgcagaaggctgctgcccctggtgggaagaagaaatgagaaacgctgataattggaatggattcgatttttggatttgttgttttttttggccgtgaaat

SEQ ID NO: 48250 - DNA, 412 bp, Heterodera glycines
  misc_feature (383)..(385): n is a, c, g, or t
  SCN-specific regions: Sequence locations=1-385
tttttctccttgggggagtcggtcattgaacaagcgcggaagcccattttgtattgttgacaaaacacaagcgtcgccgaaattgaggacgcattccgcactttctgtacccgcgatgacattgcgattattctgataaaccaacacgtggcggagatgatccgataccaggtggaccaacacgtggccggcatcccggccgtgctcgaaatcccctccaaagaaatgccttatgacgcgtccaaagatagcattttgaaccgagcacgtggcctggtgaacactgacgacctcaagtcatagaagaagacattacaaaaaacaaattctcctttattagtcaatgaatgtgtttaattaattatgggaatgacgagaacctnnnaaaaaaaaaaaaaaaaaaaaaaaaaaa

SEQ ID NO: 48251 - DNA, 507 bp, Heterodera glycines
  SCN-specific regions: Sequence locations=1-336,359-507
cgccaccaattgcgcgcacgcgtgaatgtctagacaaaaccgacagttgctcacgttcaacacagcgccattctcaacatcattgcaccaaaatggcacgccgtactaagaaagaaggagccgtgaaaggtgtcgtccaacttgaaccttcgacgggcgctgaaggaaatttatccgggcaaagaaatctcattgcgtgcgttgaacattatgaactccttcgtcatggatgccttggatcgcattgcaaccgaggcgacgcgcatggcccactacgaccggtgcaagaccgtcacgcttcgcgacatggagttttcgtgccgactgtgcctgcccgacaccatggccaaacatgcgaaccaaaaggctcagaagacggtgaccaagttctacgctgcataagtgcgggaccggatgagaaggacggatatgccacgtggcgaatttgcgatgatgcatatgggagcgctgcgagcacactcaacttttggacgaccgccggatgat

SEQ ID NO: 48252 - DNA, 695 bp, Heterodera glycines
  SCN-specific regions: Sequence locations=1-137,159-159,182-190,217 -273,299-425,478-483,505-506,541-695
tgactttctgcggtactcacttcggcctccggcgaggaacctgcagcttcaggactatgtttcgcgcatgaaagagaaccaaacatgtatctattacatcaccggcgagtccaaggacgttgtccaaaactcctccttcgtggagcgtgtgaagaagcgcggcttcgaggtcatctacatggtcgacccgattgacgagtactgcgtccagcagctcaaagaatacgacgggaagaagttggtcagtgtgaccaaggaaggccttgagctgccagagagtgaggaggagaagaagaaatttgaagaggacaaggtcaagttcgagaagctgtgcaaagtcattaaggacatcttggacaagaaagtccaaaaggtttctgtctcaaaccgtttggtctcttctccgtgttgcattgtgaccggagagtacggatggtctgccaacatggaacggatcatgaaggcccaggcattgcgtgactcctccacaatgggatacatggcgtccaaaaagaacctggagatcaaccctgaccattcaatcatcaagtctttgcgcgaccgtgttgagaaggagcaggacgacaaaactgcaaaggacctcgttgtgctgctgtacgaaacttctctgctcacctccggcttttcattggaggacccgcaacagcatgcgtcgcgaatttaccgaatggtga

SEQ ID NO: 48253 - DNA, 718 bp, Heterodera glycines
  misc_feature (681)..(681): n is a, c, g, or t
  SCN-specific regions: Sequence locations=1-627,649-718
aacgaatcgttaagtacatgcgaggacaagccggacccagctcgaaagaactcaaaagcatcagtgactttgacaaatttgtggatggcgatgacgttagcgttattgggctgtttgaaggagaaagcaagctgaaggactcctttcataaagtggccgacaccgagcgtgaccgttttttttttgcgcattcctctaacccggatttgctgaagaaaaccggatacaccgacgacattgtggtgtttgtctcgaagaagttgcacaacaaattcgaaccgaacgaatttcattacgatggcaattatgacacggacaaaatcaaaaacttcctcctctacgaaaccaatgggttggctggaattcggacccaaggaaatctcttccaatttacgcatcgtccattggttgttgtttactacaccgtggactacttgaaggacccgaagggttctaactactggcgaaaccgtgtgctcaaagttgcgcaggattacaagcgcaaagtgcactttgccgtcagcgacaaggaggaattcgctcaggaagttgaacaaaatggccttgcggaccgtaaggaaagcgacaaaccgttggtggcggcaatcactgtcgatggaaagtacccaatgaacaaggaattcagcattgagaatctcaaacaattcgtcgaggatctgncagcgggcaaattggagccatacttcaagagcgagcc

SEQ ID NO: 48254 - DNA, 506 bp, Heterodera glycines
  SCN-specific regions: Sequence locations=1-506
tacggaagccaagcggagaagacttcgccgcctgtctcgtcgaggcaatccgagccatcaatcgagggactaaccccgaacgaattcctcagggctcttcgggctcatattttgtcaaaaacttacaaggggaagtgatcggtgtgttcaagccaaaaaatgaggagccttacgggtcattaaatccaaaatgggttaaatgggcgcacaaattgctctgtccttgctgttttggtcgttcgtgccttgtcccgaatcagggttatctctcagaggcgggtgcttcgctggtggaccaaaaattgggcctggacattgtgccaaggactgcgattgtggcattggcagcacccaccttttactatggacgaattgataggacggtgacgaacacaaaagaacaaattgccaggaattatcccgacttgggccggcacttcaagcgcatcggattgccaccaaagcggggcagtttccagctgtttgtccgtggcttcaaagatgcc

SEQ ID NO: 48255 - DNA, 687 bp, Heterodera glycines
  SCN-specific regions: Sequence locations=1-687
agtttcgctctttttgtctacggacccgaacccgagcacggggaccaatactcggacaaaacgccaattgccgccgctttttgccgcgtgcgcgacgcactttttttcgtggagaacgtttatgcgagagcccatccgtgagaaattgttgcccgacccggtgaagccgccatggcaccagccgaagatcacggtggtgatggaaatgcgcaatgtgttggtgtgtccaaagtgggagtacaaaaagggccattactttgtgaagcgacccgcgctcgactactttctcgacatggtcggctatcccaacttcgagttggtcatacacacatcggaaacgatgatgcaggcggcgccggttgtgcaacagttggacccgaagggctcacgcatcagcaacgcgctgttcagagagtgcaccaaaacgcggttcatcgacgggacggcgatgaaagatctttcccggctcaaccgcgacctgtccaaagtgatttacatcgactgggacccgcaggcattccagctgaacccggagaatgtgctgcgagtgcccaaatgggagggcaacatggacgacacgacattgattgacttggcggagctgctcaaaaccattcatctctccgacattgacgacgttcggcccacgctgcagttctattcacagtttgacaacccaatgcagga

SEQ ID NO: 48256 - DNA, 492 bp, Heterodera glycines
  SCN-specific regions: Sequence locations=1-492
taagacaacattattaatgatgttgcccaactcgtcccaattgtgctgttgctcaaccttggaaaacagtcggtgaacgcgcttccgcttggtcgtcaatcagacgcacaacgatgtccaattgcccaactttgacgcgtaccgcaacgaattgaccaaagacccacctcaaccgtcccatgtgactgaggacaggcgcaaaggcgtgtcaagcttcatcttttatggagtgggcggcgccattacgttgatgacagcaaagttggtcgtccgaaaagcggtcacttacaaatggatgccacgggaccaagccgcaatggcatcgaccgaaatcgacctcagcttggtgccattgggcaagacaaagacatttgattggagtggcaagcccgtgtttgtcaagcatcggacggacaaggaaattgagcgcgaacgtgcggtggaagtgggcaaactgcttcacccggaacgggacgaggaccgtgtgctgaa

SEQ ID NO: 48257 - DNA, 566 bp, Heterodera glycines
  misc_feature (452)..(452): n is a, c, g, or t
  misc_feature (465)..(465): n is a, c, g, or t
  SCN-specific regions: Sequence locations=1-147,189-258,280-301,390 -390,438-465,555-566
catttttgcttgtcgacgacagcacaccacagccgaaaagcgcttcttctcatcgccttcgccttcaaaacttagaagcaccaatcccaaccagaaaaaatgtgcgacgaagaagttgctgctctcgtggtggacaatgggtccggaatgtgcaaggccggtttcgcgggcgatgacgcgccccgcgcggtgtttccgtccattgtgggccgcccccgtcatcaaggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacaagctgcgtgtcgcccccgaggagcacccggtgctgctcacagaggccccgctgaacccgaaggccaacagagnaaagatgacccanatcatgttcgagacgttcaacacgccggccatgtacgtggccatccaggccgtgctgtccctgtacgcctccggccgtaccaccggtctcgtgttggactc

SEQ ID NO: 48258 - DNA, 644 bp, Heterodera glycines
  SCN-specific regions: Sequence locations=1-503,525-644
tcacgtttgtggcattgtgtgcggcaatttgatgcagggcttttcgctcggcggatggaaagaacagcacaatgtgcaccacgcggcgcccaacgtggacggaagggacggcgacttggacttgttgccgctgtgggcgaccatcggcacacaactcaaacgcattgacggtgcttctccgctcgcccatctgttgcccttccagcatttgtattggtccttcgcgttgccgttgctccgtttctcgtggctgctccaatccgtccaatttgtgtgccaaatgcggcacagtttttacgatatccatcgccagagggcacttgttgagcagtgttcgttggcattgcattggtcgttggtgctcgttcagctgtactttttgccggacaatttggcccgtctccaatatttcctcgtctccaatctgttcgccggtttcctcatcgcacacgtggtcacctacaaccactactccaccgacaaattcgcatatgacgacccaatcctggagaactttgcctgtctgcagctgtacaccacgcgtaacatgcggcccggcccgttcatcgattggctttggggtggtctgaactgtcaaattgagcaccatttgttcccgacaatgccgcggcacaacctgaaga

SEQ ID NO: 48259 - DNA, 459 bp, Heterodera glycines
  SCN-specific regions: Sequence locations=1-459
ttggatgtgtgcggacgactctgccacatccgccgaagaactcgtaaccgacggggaaattggcgaaccgacgggccgtttgtcgcccgaaatgctatcgttggaagacgcagttgaagttttgcaaaaagagcaaaatgcggagagattccgattggcttttgagtcggtcaggcgcgttttgagtcgcagcaaatgccctccaattgacaaagtgatcactcttggctttccttgtgctctcgtccaggcgctccattatgacgatgacaaagtgaagtttgaggcagcttggtgcatcaccaacatcgtttctgggacttcggaacagaccatgaccatggtcaacgcgggtgcggttggtccgctgcttacactgtgctcctcttcttcgcttaaattgagtgaacaggctcgttggtgcattgcccatatggccggagatggcgttcaacttcg

SEQ ID NO: 48260 - DNA, 752 bp, Heterodera glycines
  SCN-specific regions: Sequence locations=1-752
ccaactgtaaatggaaatggctttggcttgaccaatgggacacatttcgctgatgacttttctgagtccattaaagacgttggtattattggtatcgaactttactttccaaaatcctacgcgaaccaagaagaccttgaaaaatttgacaatgttacatcaaataaatatgtgctgggacttggccaacaagaaatgtgcttttgccatgagaatgaagatgtttgttcactttcgctgactgttacagctgcactgatggacaattacaaggtcaatccaaaggacattggctttctcgcggttggcaccgaaacattggtcgacaaaagcaaaagtgtgaagtcagtgttaatggatttgtttgccgattcgggcaacatggacttggagggcgccgacgagaaaaacgcgtgtttcggtgggactcaggcgttgttccatgccgtcgattggatgtacgctaattacgcaacagaaaaacgccttgccatcgttgtctgtgctgatgtggcagtttattcggctgggcccgcccgatgtacgggcggtgccggtgcagtggcctttctgattggaccaaatgcaccgattgcacttgaacgtggccttagggcatgccattctcaaaatgtttacgacttttacaagccaattgtaggcgttagcacgcaattcccacgagtggacgggccaaacagtgtggagacctatttgaacgccgttgacatgtgttacgggcgattttgtga

SEQ ID NO: 48261 - DNA, 771 bp, Heterodera glycines
  misc_feature (678)..(678): n is a, c, g, or t
  SCN-specific regions: Sequence locations=1-22,45-302,324-748,770-771
ataattgtcctaaaaaatggtccaatacaaattatattattttgatgggcgcggtttgggtgaatccatccgtctgttgcttcactatgttggccaaccatttgaggacatccgaattaaagacatggaagaatgggagaaaacgtacaagccgaaatttttttacggaaaggtcccagttttggaggttgacgggaagccattgggacaaagtgctacgattttgcgctaccttgccgaaaaatttggcttggctggcaaagatgaatgcgaaaaggcgaaggctaacgaaatcatcgactttcaaaaggatgctaacactgatttggccccctatttatacgtcaaaatgggatcccgccaaggcgatttggacaaattgcgtgccgaagtgttcgagccgggagtcaagcacattttgccactgtttgagaaacttttgaaggagtccgggtcagggtacatgctcaagtccggactctcaatggtggactttcaagtggccaactttctgtacacgtttaccaagttggagccggagactatcaatgcgttcccggagctgatcaaatacgttgaccgtgtccatgcgctgccccaactgcagcagtatttgaagcagcgtccgcaggaccgctaatcactgatcagaaaagtcgagattgaatgagaaaaganaatcaatcattgagattaattcgataagttatgataagacaaagctttttttctttaaacagaatattgaaaaatatttgatcttttttatca

SEQ ID NO: 48262 - DNA, 514 bp, Heterodera glycines
  SCN-specific regions: Sequence locations=1-205,229-424
ttccgtgcgtcgtggctactggggcaacaaaatcggaaaaccgcatacggttccatgcaaggtcactggcaaatgtgcatctgttctcgttcgactcattcccgctcctcgtggtaccggcattgttggtgcgcctgtgcccaaaaaattgctccaaatggctggcattgacgattgctacacttccgccgttggccagacggcaactctgggcaactttgccaaggcgacttactacgccatccaacggacatattcctacttgacgcccgatctttggaaagagaacgaattgccgagaaatcctctggatcacattggcggtggcggggcgcaataagcgcagcgaggagagacagtggtgaaaaaagcacggaatgttatgtttttctctgatttgttggactgataaaattttttgttgaaaaaaaaaaaaaaaaaaaaaaaaaaaaaaaaaaaaaaaaaacaaaaaaataaaacaaacgcgccaaaaaaaaaaaaaaacaaaaaaaaa

SEQ ID NO: 48263 - DNA, 724 bp, Heterodera glycines
  misc_feature (580)..(580): n is a, c, g, or t
  SCN-specific regions: Sequence locations=1-724
aaaaaaaatctgaatggtgagcgctcagagtgattctcctgttcctaattggctgcttaacatcggaccaatttcttgccatgcgtggaacaaggacaaaactcaattggctgtttcgccttccaacaacgaaattacatattcgctcgttcggagaccgtttggaacccgttgcacgtgctaagagaacacgacttgctgatcaccggattggattgggctccgaatactaatcggattgtttcatgttcgcacgacaaaaatgcatttgtgtggacatgggaggctgaaaagaacagttggaaaccggagatggtggtcgttcggataaacagagctgccacctgtgtcaaatggtcgcccaacgaaaacaaattcgccgttgggacgggtgcgcgtttagtcgctatttgttattacgaacgtgaaaatgactggtgggtagcgaagcaaatcaaaaagctgattcgttccactgtcacctcattgaattggcatcccaacaacattttgttggctgttggcgcctgcgacttcaaaacgcgtgttttttctgcttatgtgaaagagattgacgaanaaccaacgccaaacccttgggggaccaaaatgccattggggagaattgctcaaggagtaccagtcgaccggatgggtccatgacttggccttttctccctccggttgtaaacttgcctgggtctctcatgattcgtccattgct

SEQ ID NO: 48264 - DNA, 841 bp, Heterodera glycines
  misc_feature (781)..(781): n is a, c, g, or t
  misc_feature (800)..(800): n is a, c, g, or t
  SCN-specific regions: Sequence locations=1-445,467-614,637-841
ctgagagaaggcgacgagggcactccggcgaaggaagtcgaaactcggcacccgcaaaagggcatcgacgaattggtggcacagctgggccattacaacgaaaacatttgccgagatgcgatccatggtgttcgccttctgttaaaaactcgcctgatcagttgaggaggcatttgcgcagaataatcccggccatcggttctgtaattattcgcgagctaaaatcgaccgcaactcgcaatcagttgaagctgctgatcgaaatggtctgtgaagtgcccgaggaagtgatcagttcccatttcgtcctttttgtggcttcgttctcaccgggatttccgatgttcgttcatctgttcgatcactgtgcttcgacattttatcacttttattgcgcaaatatgtacagttgtgtcggaaaaatcgcgaaatattcgatgcgtttttgcaactgatggaaggtcaacggaagccagaaaatcgtaccaaattgcttgattccttgtcccaatttgtcactgtcttcggcgatgaagcgaacagcaacaacaaattgtggcccgagcgcactttggacatttcatttgaaaacggagaggcaacgattcgttcgccctctctctctttgctcccttcgccagcctatttccattttcccgtcctttgtccgtccaacgatggcacaacttcggacggcacttcgccgcttatgacgcgggacggactgctcaattgttgcaaggttctctgcccattattagaggcagtgattcgggccgangaagacgctgacggcacanaattcagctcaacatgggcagaactcacaatgtcgtctctc

SEQ ID NO: 48265 - DNA, 574 bp, Heterodera glycines
  SCN-specific regions: Sequence locations=1-574
gctgactgctccgtgctggtggttgcttgacgtacgggagaccatgaggctgaaagcctttaaaccggccacaatcatcaccgccctttgctcggcatactatggggcgaacatagctcttttccatcttgcagcacaatggacacgactgaacccgcgttcttcgaggacctttacaccgacagagatgagctgaattgtgacaacttcttctaggaacatgggctacaatcccgcccaccgtatcattcttcccagtctctgggttcaatggccactacatgttgctccctgctgacaggatgccagggctatccgggtgggctatccatcaccaacatcgtactgcttatgctacaactttggttcagtgctctagccttccttgatcccacaaatgcaccaactgcacaatccgctgcgacagcctgttcaagatgcgtatgaaatcgggggtactgtgacagcgcctatctggccgttcccaacactggtgtatctcgatatctatcaatggcccgccactagtcgctcctcacacgtatttgcacgaccccatacactgcgtcattga

SEQ ID NO: 48266 - DNA, 294 bp, Heterodera glycines
  SCN-specific regions: Sequence locations=1-87,110-160,182-261
aattatttgggctgtatatcggagagatatgaacaccgatgacagaaggctgaatgcttgggctccaattaaaaagctgaatcaataccaatcagaggaggaggaacacaaacaattgatgttcttccaacgaaagtcgcaacacattgaaaaaaagcggaaacttttggaagaaattgatttcgcattgccgaaaaaggcgcaaaagtcaaaagcaaaaacagaggaacaaaaagcaaagagagaagaagcaactgaatcaaaagataaaaaaaaaaaaaaaaaaaaagaaaa

SEQ ID NO: 48267 - DNA, 651 bp, Heterodera glycines
  SCN-specific regions: Sequence locations=1-33,56-444,467-581,603-651
cagggattgcctctgtaaattttccgctgacggccaatggttggccagcgcaagtgcggacaaaaccgtgaagatttggagcaccgttgacgggaaattggagaagactatccaaggtcataaattgggaatcagcgacgtttgttggtcgtacgacaaccgaatgattgtcagttgttctgatgacaaaacattgaagttgttcgatgtgcaacagggaaaaacattgaaaactttccgtggtcatcagaattatgtattctgttgcaatttcaaccctcaatcgactcttttggtctctggctcattcgatgaaacggtgcgcatttgggacattcggaatggcaattgcgtgcgcactttgcccgcccattcggaccccgtcagcgccgttgcgttcaaccgggacggctctttgatcgccaccagcagctacgacggcctggtcaggatttgggagaccagcagtggccaatgcatgaccaccctcgtcgacaatgagaatccgccagtttcatttgtcaaattttcgccaaatggcaaatacattttggccgctacaatggacagccagctcaaactttgggacttcaataagggaaagccgctaaaatcctaccaaggacacgtcaacaaaaaatattgcatttt

SEQ ID NO: 48268 - DNA, 680 bp, Heterodera glycines
  misc_feature (625)..(625): n is a, c, g, or t
  SCN-specific regions: Sequence locations=1-404,426-680
tctgagcgaagtgttttcacgtttggcgaaatcatcagtgcaaaggtgatggaggatgacagcggaagtccaggggttcggcttcgtcgcctacaaggaccatgaaagtgctgcgagggcggtggagaagatgaacgaggtttcggtgcccggcagtgagaaggtcgagcaaaagtttacggtgtgccgtgcgcagaagaagagcgagcgccaggctgagctgaagcgtcgttacgagcagtacaaagctgagcgcatccagcgttatcagggagtcaatctgtacgtcaagaacctgcacgataccatcaatgatgagacacttcgaagcaattttgaatcctacggaaacatcacaagtgcaaaggttatgtgtgatgagcatggtcgctccaaaggatttggttttgtgtgctttgaaaaggcggatgaagcaaccaaggctgttgtggaaatgaacaacaaaatcatcgaaaacaagccgctttacgtcgcgcttgcgcaacgtaaggaagaccgcaaagctcaactggcctcgcagtacatgcagcgcttggccgcgatgcgcatgcagaaccctgctggcctcatggggacaatgtatgcgcctgccagcggtggattnttcctgccacaggccatccaaaaccaacgtgctgcgccgttcatgcaaacaccga

SEQ ID NO: 48269 - DNA, 795 bp, Heterodera glycines
  misc_feature (761)..(761): n is a, c, g, or t
  SCN-specific regions: Sequence locations=1-701,730-795
tgtttgccggaggaggaggattactttgtgtggtctgcaattgacccgggcattggcagcatcgctcattcactgaaacatttggacgacgaacgcaagctgttggaccgtttcgagcgttttgtgtgcaaaatgattgaacccgtcgctgccaaattgggctgggaacccaaagagggagaaactatacacgttggacgtcttcgtgccctgctcctcagccgtttgtcacattttcgccatcaaccgactattcaaatggcactttccaaattcaatgccctcatcgagaaaggcgtcgatgttgtcccggacttgcgaaagctcattttccgtgccgtaggctctacaaatgatgaaaaaaatcattgctgcattgaaaaatttgatggagacatcgggctacgcacaagtggagttgtcatgtgtattaggacttggccagtgttcggacttgaaaatgctcgaggacattttcaattatggtgttattcaaggcaaaatccgcgaccaggacctttatcttttgttcgcggcaacggaaatggcaccgatggcgtgctgtggacatttcgcatgggactttttcaaaaacaatttcgcacttttgatcgagaagtacggcagcgtcaacagcaacgtgttcttgcattgctttgactgcgtgacttcgggtttctgttcgaatgccatggccgaggacatttatggagttttttaaaaagaattggacgaacattctctgaaaacattggagcggnctcttcgtcaagccgtcgaatccattaaagtcaa

SEQ ID NO: 48270 - DNA, 294 bp, Heterodera glycines
  SCN-specific regions: Sequence locations=1-87,110-160,182-261
gaattatttgggctgtaacggaagagatatgaacaccgatgacagaaggctgaatgcttgggctccaattaaaaagctgaatcaataccaatcagaggaggaggaacacaaacaattgatgttcttccaacgaaagtcgcaacacattgaaaaaaagcggaaacttttggaagaaattgatttcgcattgccgaaaaaggcgcaaaagtcaaaagcaaaaacagaggaacaaaaagcaaagagagaagaagcaactgaatcaaaagataaaaaaaaaaaaaaaaaaaaagaaaa

SEQ ID NO: 48271 - DNA, 833 bp, Heterodera glycines
  misc_feature (726)..(726): n is a, c, g, or t
  SCN-specific regions: Sequence locations=1-628,650-833
ccttttgcgttatgttgtgttgagcatgccccatcttttgccggaacagaccatttcgacgcgttcagaagtgcccaccaaaagggtgcctttgcttcttcgccccgtcgtcctctgctcatttccatcgacgaatgctccgtcgctttggaggaggccagcatttcgcacaatttcagtcgcctttccaagtcactcgacattctcttgggccgtgcaactgtggagcagcaattctgctactacgagctgatcctcaaggcgatgagtctctctttggacggaaaatggccacgggcactcgtcgacaaattgcaattggcctgggaacgttttgacagcgttattccccgtcgtcttcacgaggattctgtccgtctttggttgtcctccgctaatgccgccaaaatcagtgggctcgaccagcgcgacaactcctttctcattgcccacacgccgttggttctgttccgcgttgactcacgcattttccgcagtcccccgcacttgcgttgcctttgtcgttcgctgtctttttatttggccgcttcacgcgacatgaacacgctgcagttggtccgttcttctctgaacagctccaaaagcgaaattgaggagaaagaagctctgctccgttcttttggtggcactcaacgattggccgttgttcaaacatacattgaactttgtgacgacgaggacggcaccgaaattgatgacattgangagattcggcagaatttatgctcacaaatccaccaattgtttattgcggacacccatcttccaagctcgtccatttcaatatgtatcccctcaggcttgtccctgtc

SEQ ID NO: 48272 - DNA, 726 bp, Heterodera glycines
  SCN-specific regions: Sequence locations=1-36,58-124,159-234,256 -259,282-293,315-336,406-408,432-483,550-726
tttcggccggacaatttcctttttggacagagtggcgcgggaaacaattgggcaaaaggccattacacggagggtgctgagttggtggacaatgtgctggatgttgtgcggaaagaagcggaaggctgtgactgtctgcagggctttcaactcactcattcactcggaggaggcaccggctcaggaatgggcactctactgatttcgaagatccgcgaggaatatccggaccgaattatgtcctctttctcagtggttccatctcctaaggtctctgacaccgttgttgagccatacaatgccactctttccgtccaccaacttgtagaaaacaccgatgagaccttttgcattgacaatgaggccctctacgacatttgcttccgcacattgaaacttcagaatccgacttatggcgatctcaaccatctcgtgtctgtgacaatgtctggcgttacaacttgcctccgtttcccggggcaactcaatgccgacctccgaaagttggccgtcaacatggttccgttcccgcggctccactttttcatgccaggatttgcgccgctttctgccaagggggcagctgcgtaccaagccttgtctgtgtcagaacttaccaagcaaatgttcgatgctaaaaatatgatggcggcgtgtgacccgcgtcatggccgttatttaacagtcgcggcgatgttccgcgggcgaatgtcaatgcgcgaagtg

SEQ ID NO: 48273 - DNA, 360 bp, Heterodera glycines
  SCN-specific regions: Sequence locations=1-271,293-360
atcacacatcaagcacccacaaagccagcccgacaacagcgacaacaacagcaatggcgcaacttccaccagaggacgtcgcaacaatgcccacgcataatgtcgtcttcaacgccccgttctacaacaaggccacctactacatgcgggtgatcaaccctgggacgaagcgcatcggctacgccttcaagaccaccaaaccgaagcgcatcaacatgaacccgccgaacggagtgctcggcccaaaggagtccgttaacgtggccgtctcctgcgacgccttcgaccccggcagcgatgacaccaatggcgaccgcgtgaccgtggagtggaccaacacgccggacccattcgccaccg

SEQ ID NO: 48274 - DNA, 592 bp, Heterodera glycines
  SCN-specific regions: Sequence locations=1-68,92-149,171-492,516-567
catgctgtgtgcacatgatatcgaatgaaagggaacatttgtcgtctgaggctctcgaagctgctcgaatttgtgcgaacaaatacatggtgaagaattgcgggaaggacggctttacatgcgcgtccgaatccacccgttccatgtggttcgcatcaacaaaatgttgttttgcgctggtgctgaccgtcttcagacgggaatgcgcggcgcctttgggaaaccccaagggttggtggcgcgtgtcggcatcggtgatatgctgatgtcggttcgtgtccgtgaccagcatcaagcccacgctcttgaagcattccgtcgagcaaagttcaaattccccggccgtcaatacatcgtcatttcgcgcaaatggggcttcacccctttttgaccgcgaagtttacgagaagcaccgcaaggaggggcgagtcattccggacggagtcaactgccgattcctcaagcaacacggaccattgacggaatggctcaaaaatccaatctgatcaattgtacgacggatatattcccttttatatgctttgttgattaaattgttggatctataaaaaaaaaaaaaaaaaaaaaaaaa

SEQ ID NO: 48275 - DNA, 776 bp, Heterodera glycines
  SCN-specific regions: Sequence locations=1-776
gttgctgcgctttggaggccgtcctcggtggtgccttacggggacgcccattccaacaaactttgggaccttttctcactcatacgctttttgcgaatttctcccttttccgaagagaaaatgtggaaggaattcattatgacttcgtcaggaacaagtgctcaaaggttgaatgttattgtgaagagtattctgctccgtcgtaccaaaaatcaaatttgtacggaaacgaaccgaccgattgttgacctgcaaccaaagaagtacgagctggtcaccctggaactccaaaaacttgaacagcattgttattcaattttgtttgaggcatccaagcagaaggtgcgcgagttgcttcgagacggtgcatttggtggctgtggcactcttcggcggtttaagcccggggcgaaaatcaaaaacccattcattgggggcggtgctcggatggccgtcgatgccaatttcaaagcttactcctgcattctttcactgctgctccgacttcgtcaggcgtgtgttcacctgtctctgaccaggaatgcaattgacattgacgcatttaaacaagacgagggtgagacggacagcgatgcggagaatttagttgcgaaagccctcgaaatgtcaatggctcaaatgggtctcgaagaagaagccctcgagagaaataaggagcgggaaaagggacgaaggcagcaaatcgaacgcctttttgagaaggaacaccaaagcaccaaagtgaacgctttgatgaaccgtttggatggagtcgt

SEQ ID NO: 48276 - DNA, 702 bp, Heterodera glycines
  SCN-specific regions: Sequence locations=1-355,380-680
tattgcggaaaagcggagcggatgaatgagttattaaggcgaagaagttcatcgatgcacataatttggcatttgagaagggcgaagtgtcgttcaaagttgcgccaaaccatctgatgcattttacacctgcccaatataatcgaattcgcggcttgcaaatgcgcagcaaccgacaacggcacaacatggcaactctggcgggaaacagcagtactttgccggaaaagttggactggcgcgagaaaggggcggtgaccgagggggactgcggctcgtgttgggcattcagtgccaccggtgccattgagggagcattggcacagaaaaaagcgtcgaaaattatttcattgtccgaacaaaacctggtcgactgttcgtccaagtacggtaacgagggctgtgacggtggactgatggacagcgcatttgaatatgtgcgagacaacaacgggttggacacggaggagtcgtacccgtacgaggccgtaacgggcaaatgccaattcaaaaatgagaccgtgggcggcactgtcgttagcttcaaagacttgaaggaaggcgacgaagagcagctgaagattgccgtcgccacaattgggcccatttccgttgcgctcgatgccagcaatttgtccttccaattttacaaaaccggcgtttattacgagcggtggtgcagcaaccgatacttggaccacg

SEQ ID NO: 48277 - DNA, 711 bp, Heterodera glycines
  SCN-specific regions: Sequence locations=1-711
tcttctccgctctccgttttccgctcattgtcttctccccccattttcggcaggcaaatgggaaatgtttttggctcttctgtcgctgctgctgatgaggaagacaattttgaggagcgcactcgtcaattcttcgccttcgtcaaccagggaaacattggacaattgcgtgcgctggtcgactcgctggacgcggatgagctgagcatttggctgcagatgaaccaaccggatgtccaacatgctcggcccgcactcgtgaacgcaattttgaatcggcgcacagaaacggctgttttcttgttggagaagggtgctgatccgcatcagaccatgattggccaactgaacggcttgaacatgaatgtgacaccgctttgggccgctgtcgtttttgtcaatttggagctgtgccgtgcgctgatcgcccatggtgccaacattgaaatgggcacggactctggtgaatcgccactgctgtgcgcatgtttcaatggcaatttggagatcgccacttttctcgtcgagaatggcgccaacgttaatctcgcggacactgacggaatgacgccattaattgccactacctttttgctgcgtctcacttcgccaacaattctctccgatctcaacatcaattcaagcaattccggcacactgtgtctcgatgtgtttgctgaagaaatgattttgatgggccaaatgcgacga

SEQ ID NO: 48278 - DNA, 655 bp, Heterodera glycines
  SCN-specific regions: Sequence locations=1-181,203-365,388-389,412-655
attaaactgaaagtatgattattcttgagcaaacaatagggtaattgcggaacttttggaaatgaaatttaccaatgcccgaacaaacagtaaatttgataccgtcgatgttgtgttcgccgattttgatggcattttataccatgcatcaaatccggatggaggcgacaaatcaaagcttatgctgagcatttcattgaaattttacaaagagcttcaagaacatggtgcagatgaactcattcgctcgatttatggcaaatttttgtcggaaagtccagaggctggctacagcgtgtctttggtctacgatgtggctgacattcctgaaaatttcactgcgctcgttgagcaggcgtcctatctgaaacgaaactgttttgcctcggtgtttgaaaaatattttcaattccaagaaagcggccaggagggcgagaagagagcggtcattcattaccgggaagacgaaacattatttatcgaggcaaaatcggaccgggtgactgtcattttcagcacgttgttcaaagacccggacgatgtggtaatcggcaaagtgttccttcaggagttccgtgaggggagaagggcaagtcaaactgcgccacaagtgctctattcggtgggcgaacctccgttagaactgaggaataac

SEQ ID NO: 48279 - DNA, 742 bp, Heterodera glycines
  SCN-specific regions: Sequence locations=1-70,94-118,146-220,268 -285,308-742
ttgtgactttgccaactggcgtagtgtgctgaacatcggtgcccacaaaccgtcccatttggcattgatggagaatgccaatgtgctcgcccgatatgcgagcatttgtcagcagaacggacttgtgcccatcgtggagccggaggtgctttgtgacggcgaccacagtttggaacgatgccagaaggtgactgagttgactttggcctacacctacaaagcattggccaaccaccacatttacctggagggcactctgctcaagccgaacatggtcacccccggccaatcccactcgcccaaggccacgcccgaccaaattggtctcgccaccgtgactgccctccgccgttctgttccgattgccgtccccggcattgttttcctctccggcggccaatccgagatcgaggctacacacaattttaacgccattaacagtgtgcccgggccgaagccgtggacgctgtccttttcctacggaagagcgctgccgtcgtcagtgatcaaaaaatggaacggcaaagacgacaatctgggcgatgcgcacaaagtgttgcttgaccgtgccaatgccaacggcgacgcttagaatgggaaatccaccggcgaggaggcagccgcgtctgccgctgaaatcactttttgtggcaaatcacgccctattgaaacagaactgtggaatatgccatgaataggccccgaatccgatattccctcatcatatatttttacctgggag

SEQ ID NO: 48280 - DNA, 284 bp, Heterodera glycines
  SCN-specific regions: Sequence locations=1-26,59-60,137-208,232-284
gtgaagcggtggtacaaccagagtacttttttttttttttttttttttttttttttttcgcttcttctcttcctcctcgaacttcttgcgctcctcctcgtcatgcgcttccttctgctttttctccgcctccttcagctggtcgaaagtgtccgccgcgtgttttttcgcgtcctccacagagtccgctaccaaaatgttgtcgaaaatggtgcccgacttgacctgccaaatgtctattccgatggcgccccaatcttttcgcaagtaaaggtcgtcgtccg

SEQ ID NO: 48281 - DNA, 718 bp, Heterodera glycines
  misc_feature (555)..(555): n is a, c, g, or t
  SCN-specific regions: Sequence locations=1-531,553-718
cagagaaagcgattatggcgaacccttttgatgacgacagtgacgaattcattcgcaaaatccgggccggccgtggaattgaaccgacaaaagtttacaacgcccgcagcttcgcaaaacattgaggaccaaattgccgctgatgagaaggccattgagcgttacttgcaggcgtcgttggacagcacacagcgctcccgacaacagctgagctcatccgaggggttggccgagtccaccgcacgggaattgttggagcaacgggaaaagttggaacgggccgaacagaatttggacaccattcaccacaccactcagcacacacagcgcagcctgaacagcttgaagtcgtggtttggtgggctggtcagaaacaaactttcacgagcgccaaaagggttgggcacggcaaatgccaatgccaacaatcagcagcaacaactggaacagaccgtgcagcaacaacatcagcagcgtccgctgcatgcccatttggtgcagtcgtctgctgacgaatttgccggggccatcggtggcggaggcggcggcgttcancccccgcaacagcactcgctgaactcctcgtcacgcgcgtacattcagggcactcgttgggaggcgatggacgacaaaattgacaacaatttggatctgatgagtgcccatttgggccgactgagaacgtttggcgtcgcgctgggcgacgaggtgcaggacc

SEQ ID NO: 48282 - DNA, 479 bp, Heterodera glycines
  SCN-specific regions: Sequence locations=1-179,201-479
gttgcccgactgggtggactaggtgaactggggcaaaaacaaagagttgacaccaatcaatcccgaccggtactgcgtagctcgtggcactccctccgctcgacgatatgtacatctccttcaccggcaagtgtcggcccgttccccaacgtgtctggcggaaaaaatcgacatggtgttacacccattcacttcaccatggcttccggagcagtgattcttaaggctttgcaatcgatcgatgaaatcaaatgggtggagaaagactgatgcactggtggactgcaaactgaccgaacagggccagaaggatctggaccgcattgcgtcacacctgcctgacagagccgaacaatgaagatttcaacagatagatggggagaacaagttcacttttctgttgttgacgcttgtgctttcgacactcatagaaacatgaaaggagttgactgttcagcggatgcggcgactattgcaaa

SEQ ID NO: 48283 - DNA, 640 bp, Heterodera glycines
  SCN-specific regions: Sequence locations=1-244,266-305,328-509,531-640
tggaaagagcgggagaaaaaacgggcgaaagcgaggaaacaagtgcggttgttggcaatgaattggatgttcacgcggacattttggaggaaatgcgtggcaaggccattttcaagaagtctttcatcgcttcgggaattccttcggagtttggcaaatatcgtcctttgccatccgacagaaaatgttcccgcaaaggctgcgccagcgacccgcccccggccactcattgtcagcccggacattcttctgaaaatgggactgtccaaccgacgaaaacgagcagtttgatcagctcaaagaatggatgcgctgaggcggaggaggagcaatgcctttttgtggaacattttggcccaattccccaatacagcgaaacggacgaaaaagagaatttgcggctgcggaaattgcacgaagtcgcattagaaatttatcagaaacaacgcgcttatgttatgaaattgcaactgattgggctcaattatccgaggcatttgaatgactgtgaaaaaagaatgaacaaaaaattgctccattccaaacacgtcatcagacgaatcgcggatcactttcagactattttaaatgttcatcttacgtttttgcataatttttatgacaaaattcttaaatggga

SEQ ID NO: 48284 - DNA, 157 bp, Heterodera glycines
  SCN-specific regions: Sequence locations=1-6,28-157
gtgatgactgaagtgtctaacttcatcaacaagatagggtacacacccagccaccgttccattcgttccaatctctggcttcaatggcgacaacatgttggagccgtctgacaggatgccgtggtttaaggggtgggccatcgagcgcaaagatggc

SEQ ID NO: 48285 - DNA, 674 bp, Heterodera glycines
  misc_feature (660)..(671): n is a, c, g, or t
  SCN-specific regions: Sequence locations=1-353,376-549,572-674
gtgattttctttttcttacctctttgacgacaacagaagcgcaatgagtggttgggatgcgtacattcagtcattgacttccagttgtgcggagattactcgcgtggccataattggcaattcggacgcgagtgtttgggccaggactgaaggggagaacgaattcaaggcgagtgaacctgagctcaagaaacttgtcggccaattcgatgatctttcgcaagttccgtccgtcggtgccgacctcgagggaattcattacattgtgccgcgaacggatgaaaatcttatctttgggaagagggacaaaacgggctttttcgctgtgaagaccaagtccgccattctgatcgccatttacaaggacgaggaaagtgtcgtcggcgccgacgtgcgaggggcggtggagaaaatggccaaataccttgaggacgccggttaccgagccgttgctcggtttcctaaacgacttttgtgttgccaaacgaaaagtgctgagaatggctttgacttattcttccaaatgcattccttttccatcccaaatgatcacttattattttattattacacattctgtgaagtgcgcgtgccgatttcttttttattatttgacctttggatgtgaataataaaaaggtgtaacgccgaaaaaaagannnnnnnnnnnnaaa

SEQ ID NO: 48286 - DNA, 476 bp, Heterodera glycines
  SCN-specific regions: Sequence locations=1-89,115-178,202-217,274 -367,427-476
aacctgttgtcggttgcctcaaaaagtggtcggtgcgcgtcgttcctcgtggcgcgttatctcatccattgaacagaagactgagggctcggagaagaagcagcagatggccaaggagtatcgggagaaggtggagcaggagttgccagagatctgtcacgacgtgctggatttgctcgacaaatatctgatcccgaaggctggcaaccctgaatcaaaggtgttctacctgaagatgaagggtgactactaccgctacctggctgaggttgccaccggtgacgaccgaaacgctgttgtcgagaagtcgcagcagtcgtaccaggaaacgtttgacattgccaaagacaaaatgcagcccacccatcccattcgtcttggtctggcgctgaacttctctgtgttctactatgaaattctgaactcaccggacaaggcgtgccaactcgccaaacaggcgttcgatgatgcgattg

SEQ ID NO: 48287 - DNA, 677 bp, Heterodera glycines
  SCN-specific regions: Sequence locations=1-411,433-468,491-677
tggaatttctgcgcacagtcgaaggacgtcgtgttggacaacatttggtgccgagccaattgtgcgagttcgaggcgtacaattgcttactaaaacagaaactgctgcctgccctgaaccatttattttgggtcgacaaatgcaattacggcacaattgtgcaccctctctatgcccaacaggtcaccttcccatacaacatttattacatggaaaggagacggagacgaatggacacaacagtcagagcgatcaggaagaaccaacaacagctaactttggatgcaattcaggcactgaatttactttcggcaaagttgtcagacaacaaatatttctgtggcgacaagccatgctctatcgatgcgctcgtcttcggctgtttggctccgctgctgcgcacccctttgcccaatgatcggcttcagcttcacctttcggccactccaaacctcgtccgattcgtcgattccattttgagtatttatttgccactgcccgaaaaagtgatcaaggaacaggcgatggcgagaaaaaagtggcaaaaactgaaaatggacgcccaacagacaatggaagagggccgaattgagagggaactgcgcaaagcggagaagaaggagcgcaactccatgcaccacattctgttcttcgccatcagttcaattaccatctca

SEQ ID NO: 48288 - DNA, 782 bp, Heterodera glycines
  misc_feature (780)..(780): n is a, c, g, or t
  SCN-specific regions: Sequence locations=1-782
gtggtggtctgctgggacaatttgcggtttaagcagtcagaagtgtgtcaagtcgggcattctccacccctttggccacattctgcaggacggggacaaaatcggctgtcattttcagccgcagaatgacccaattactcttgcaaaaatggccgtggttggtacgcctggtgtgattttctcgatgtctcatctgaaggacgcctttttggtctccagccgtggcacttccgcacttccaatggaccgtttccaatttccgacattgcgctacgacttcaccatgcgtcaattctattccagtgcacaaatgggatcggagtttttgttcgcttgcaataacattgtgcagcgtgcccgttacgacgagaaggaagggatgttgttcactttaaacatcaacggcttttgattcgacagcgtttaaacggcgatgtggaaatcttctgccggcctcgccaaatcatttgttcgcctgaactcagcaccgtccacctgcgcaccgccaacgttgagatggaagttcagaccgacaaaaaggcctatgtgaagtacgggtcgaagcgtgtgcacgtgtcgcggagtgggatggtcgtgtcgaatgagaactgttccgcatcgatggaccacattggccgcattgtgtccgcctcttaacttaatgggccgtggtgccaaagtgtaattatgccataatgtgtctagtttctgctattcttttccttcccacaccgatgttaaagtgtactcatgtcctgaatttctgcgatctcattattntg

SEQ ID NO: 48289 - DNA, 601 bp, Heterodera glycines
  SCN-specific regions: Sequence locations=1-538,567-601
acagcggactgggcgcaaccgaatttgtaacgtccaaaaatgcgcttcaattgcttagccgggcctcggaattggtgctcgactcagaaagagtgctgaacagtgaacacacgacgaatgaaatcaaagaatgtttgaaagacattaaagtttgtggacctgccgaactgagaagcattttaaaatggcgtaagaaattggttgacgaacagaaaaaggaggaaaaagcgtctaaagaaagtgtaaaatcggctgaagaaatggtggagggtgatactggcgaggagttggaggaaaatactgaattcaaagagttggaagagatcgacgatctgatcagaacagcaaaagccgaagaaaaggcaacgctgaaaaaacgaaagagaaaactgttgaaggcaaagcgcaacttggaagaacggaagaaactgaagatggtccacgagggggacgagccgacgataggcgaggatttggagctgttttctttaaaaacggtgaaaaggttatcggaacgtgcggcaaaagcggtgaagggaattaaagaagaggaggaggaaaaagagagcaatgacgaggatgacaaataaaaaaaaaaaat

SEQ ID NO: 48290 - DNA, 764 bp, Heterodera glycines
  misc_feature (682)..(682): n is a, c, g, or t
  SCN-specific regions: Sequence locations=1-683,705-720,743-764
ttaattgcgtgtccctatgataaggagcagaaattctcacaataaggcacttcttggtgacgaaaaagcgaggttgggcctttctttatgtacgatgcgcccgctggcattaacaaaaagaaggaggaagggccggaaccgaaattcgaatggcaaaggaaatacaatgcaccgcgtgaagaatgggcgaaaggaaatgaactcatccaggaccaacctttcggaattcaggtgcgaaacgttcgctgtgtcaaatgtcgcgcgtggggtcatttgaacacggaccgcgaatgcccactgtatggtatgagtggaaatgctgaagaccatggctatgcaaataatccctccgatatcattcgtgatttaaatgtcgaaaagaaaacaaagactgtctctgatgtcacgaccaatgagcagattgatataaaaccgaaaattgaggtgcgcaaaagccacgaagagaagaaaaagaagcgacgccattactcatcggaagaagaggaagaggggacggaagaagaagaaaagaagccggaaccgatcgatcaggaacaattgctggtgaacatgcgtgaggagcacaatttgaagttcaagaccggcattctgattggtcttcgagcggacgaacacataaaaaaaatgtcagcgatggttggaggaggaagaggaaaaactnttgaggcttttctgaaagactggatgagaaaaacgaagaaattaatgaaaaaatcatgaagactgaagtgagcgatggctcc

SEQ ID NO: 48291 - DNA, 713 bp, Heterodera glycines
  SCN-specific regions: Sequence locations=1-5,89-451,473-713
taagtttcttttcctcctcctccatacattttcgcctcctcatgtcccctccctgctccttttccccttcctccgcctcctcttcctctgacagtccctcagcagaaggccaagcccagcaaaatggccaagttttggccccccgtccattgcccacgtgggaggaaatccgtgccgcggtgcccaaagagtgttttgaaaagtctctccttcgttctctgtactatttggccatcgatttgctcgtcattggcttcctttacgccgttgtgccttttgtagagacaaatttcggactgatcggactgtttttctggtactgcttgctcggcatgtttttgtcctctctgttttgcgttggccatgactgcggccacggcactttttccgattggacatgggtcaacgacattttcggccatatttcacacgctttgctaatggtgcccttttggccatggcaaaaaagccaccgtcaacatcaccaattcacttctcatgtggacaaggacaaaggtcatccctgggtgttggaagatgactacgaaggtggcggatggctgcgaaaacattttgctaagattcccttgtccggactgatcagcctcgcgccaaagaaactcgcacaaataggagtcaagcatttgccggtgagagggacagaggctggccatataaggtggaatcccatttacactgtcgccggtctcccc

SEQ ID NO: 48292 - DNA, 709 bp, Heterodera glycines
  SCN-specific regions: Sequence locations=1-709
cagctggtggcggtcagttcggcggcgctaaccaaattgctcgtggaggacctcgctccggtggtggcggaggaatgcgtcagtacgggggacaaccgcgccagcaacagaaccgcatgcctggtatgggcggaggccatcagcagcaaggaatgcgttaccagggacagccgagaggaatgcaacaacaacagcaggctcaacaaccacaaattgcctattcgtcgtatccgcagcagcagagccgtggcggcatagcaccgcagatgggtggcggagcgagtggcggtggagccaacgctggccatgtgatcacttcttcaacacaccaggagccgttgaacacacagctgcttaccgaggctaacataaccgcacaaaagcaaatgcttggtgagcgtctgtacgcgatggttgcgcgttgcttccgggatggtgatgtcgagaaaatcggcaaaatcacgggaatgcttctcgagatggaaaatgccgagattgtgttgttgcttggagacgaggaaatgttgcgtttgcgcgtggacgaagcagcaacagtgctttaccaggccacgggtcagaaggaggcgcagtaggataaatgaagtggatggattggatgaataaattgatgagtaaggaaaaatcaaaaaaattgatatgttatttggcttctttgtctgagtaaatgcttatctgttagaaaaaaaaa

SEQ ID NO: 48293 - DNA, 329 bp, Heterodera glycines
  SCN-specific regions: Sequence locations=1-153,182-329
ggacctcccatccggcggatctgctgctgcactctcaaaatccgctgttgcacccatcgagcgcgtctagcatgttgttgcaggtgcaagatgcttccattcacatcaccgcggacaaacgctacataggcattatcgacgtcctcgtccgtgttcccaaggagcagggctttctgtcgttgtggctgtggctacctgaccaacgttatacgttactttccgactcaagcgctgtactttgccttcaacgacacttataagcgattcttcacgctaggagtggacaacgtgaatcagttcttgatgttcttcctcatgaatttggcttc

SEQ ID NO: 48294 - DNA, 522 bp, Heterodera glycines
  SCN-specific regions: Sequence locations=1-209,233-301,370-464
tggaaaagttgggaggaaaactacgtgcggaggacaaaacgaccatcgaaggggctgtggatgaggccatttcgtggttggactccacaaggacgcgccacctgaggagcttaaggagcggaagaaggacctcgaggccaaagtgcagccgatcatcagcaaactctacgcagggcagtcgcctccgcccggcagcgaaccgccgccgactgaggagaaggacgagctgtgaacggtggaatcaccaagtgctaactgtgacgactttccttggtctatcccccttccttcccccactatctctttggtttttcatttatttatgttattggtatttttcagatcttgattctgtttttgtttttttttggatttatcctatctcatttcttgatcgagttgttgtgtggatatgtacggttttgttgactattttgtgcagcgttatatataaattctgcgataaaaaaaaaaaaaaaaaaaaaaaaaaaaaaagggaaaaaaaaaaaaaaaaaaaaaaaa

SEQ ID NO: 48295 - DNA, 758 bp, Heterodera glycines
  SCN-specific regions: Sequence locations=1-388,410-653,696-758
caggaaaactctttaatgagccgggtggcaaagatgtttatgaaggcgtaaaaatcgactcagcggaaccgaggttaaccctgaaaatttcgaagcggtccttttgggcgatgagcagcgatcggagggaaagccggtgctgaaaagcactgaaaaggacaaagtgttcgtgtacttctcggaccatggcgcggtcggagttatcggattcccagcagccgacttaacggttaaacaattgactcaaacactgaaggaaatgcatgccaaaaaaatgtacggcgaattgacattttatctcgaagcatgcgaatcgggctcaatgtttgaccacactttggcgcagagtttgaaaatttacgcagtcaccgcggccaatggcgacgaatcgagctggggctgtttttgcgacaccaaatttttgcccggaaattgtttgggcgatcttttttcagtgaattggatgcaagactcggaccaggaaaatttacgcaccgaaactctgcggaaacaatttggcattgtgcgcgaagaaacgaacaaaagccacgtgatgcactacggcgacttgcaaattcaggacgaacacgtttctgagtttatgggcaaagagcaggcgcaaaagcgcaacgaacgcccaccatcaccgcacaaatttccaatgtttccttctcgagacattcccatgttcatgatggcacgccgtcagaatgagtctaagcagattcagcacaatctccgcgtggcgtgggaaaaaa

SEQ ID NO: 48296 - DNA, 596 bp, Heterodera glycines
  misc_feature (567)..(571): n is a, c, g, or t
  misc_feature (578)..(579): n is a, c, g, or t
  SCN-specific regions: Sequence locations=1-86,108-571
tggatgaaattgagaaaatgattgatgttgtggacattttgcaccgagaagaagccaccattccaattgagccccttttcatttcggtggaccctgagagggacaccgccgaacggattcgcgtttattgtgcagaattttcgccaaaacttcgcgggtttaccggcagcaaagaacagatagcaaaagttgcgaaagcttttcgggtttaccattctgaggggccacggacgaaacggacggacgattacattgtggaccataccgtaatcatgtacctgatcgacccggaggggaacttccatgattattacggccagaacagacgggctcgtgaaattacaaatgtgataaaactaaaagctgctgaatgggacgcgaaaaagcgtaaggaacagttttggctgaacaaaattttacgcggttcgaacggagagggaaaagcgaatgccacggcaaaagcaatttcatgagaaaggcattttttatccgggaaaagttcaaatggacgcaatttgtcttcattttctatatattattttgcttgttttttttaattatttgccnnnnnaaaaaannaaaaaaaaaaaaaaaaa

SEQ ID NO: 48297 - DNA, 529 bp, Heterodera glycines
  misc_feature (7)..(7): n is a, c, g, or t
  misc_feature (17)..(17): n is a, c, g, or t
  misc_feature (53)..(53): n is a, c, g, or t
  misc_feature (57)..(57): n is a, c, g, or t
  misc_feature (59)..(59): n is a, c, g, or t
  misc_feature (78)..(78): n is a, c, g, or t
  SCN-specific regions: Sequence locations=1-529
ttttttntttttttccncccgcagatgcggtcaaaaaaacccacactgcttcntccnanaccaaccgcggccacagcnccccaccgccgactttatttatacgacgacacatgcgaaggacaaaggctgcggagagagaggcgcttcgctctttctctacgcggaatcattcgacattctctataaacttgagtacccaacacagggatgcatccgtgccttttggcatcccgaaaataaaccaaattttggtcggtctgagcgatgggacgagcaaaatttactacgacccgtccatacagtctgagcggggccctccaatgcgtcagcaaaccgatgaaacggtcgctagagtccgagatggtccgctaggaattggtcctctccccattgactctcgaaatgttccaaccgcgctgcgaatacggtcaggaaaaggaagtgacggagtggcgcattccgacattcttgccgatgctaaccaaacagaagcggccccaatttcggcagcccgccgtaatgccaatgt

SEQ ID NO: 48298 - DNA, 713 bp, Heterodera glycines
  SCN-specific regions: Sequence locations=1-206,229-415,445-713
agcgctcgaatgtacttgtacttggtgcacaaatcgtcccaattccattgacccggctcttcgtcgctttgggcgtttcgatcgcgagattgacattggtattcctgacgcaattgggcgtttggaaattctgcgcattcacactaagaacatgaaattggcggacgacgtcgacttggaaaagattgctaatgagtgtcatggctatgttggtgccgatttggctgcactgtgctctgaggcggcaatgcagcaaattcgtcaaaagatggagctgatcgacttggaatcggaaaatattgatgcggaagtcttggcgcaattggctgttactatggacgactttcagtttgcactcggtaaaaacagtccgtccgcgttgcgtgaaaccgtcgtcgagactccgaatgtcacttgggaagacattggaggccttgaaaatgtgaagagggaattacaggaattggtccagtacccggttgaacacccagagatgttcctcaaattcggaatgcaaccatcccgcggtgtcctcttctacggtccgcctggttgtggaaaaactttgcttgcgaaagcaattgcacgcgagtgccaagcaaacttcataagcatcaagggccccgaactgttgaccatgtggttcggcgagtccgaggccaacgtgagagatgtgttcgacaaagcacgtgcagctgctccatgcgtgctgt

SEQ ID NO: 48299 - DNA, 486 bp, Heterodera glycines
  misc_feature (461)..(462): n is a, c, g, or t
  misc_feature (464)..(464): n is a, c, g, or t
  SCN-specific regions: Sequence locations=1-458
caagggcaacggcgccttccagaaggcatgccgttcaaggcgtaccacggcaagaccgggcgcgtgttcaatgtgaccaaacatgcgctgggcgtcgtcgtcaacaagcgtgttcgccatcgcatcatcccgaaacgcatcaatgtccgtgttgagcatgtgaaaccgtccggtttcttgctcgagtttctgcagcgatgcaaagcgaatgacttgcagaagaagcagcacaaggagggcaacgcaccgtttgtggcgctgaagcggaagccgaaggagccccggggggcgcacttggtcaaagtgaagagcaccaaagttgagcggctggctcccgtcaaattcgaaattgtcgcttgaggcattatgggggcaaacgaatgcacgagcacagaaaaccaaccgacaattgttatttttaatttgttgatccgtttcgtgttaaagaaaaagtttcgaannanaaaaaaaaaaaaaaaaaaaaaa

SEQ ID NO: 48300 - DNA, 856 bp, Heterodera glycines
  misc_feature (738)..(738): n is a, c, g, or t
  misc_feature (780)..(780): n is a, c, g, or t
  misc_feature (787)..(787): n is a, c, g, or t
  SCN-specific regions: Sequence locations=1-44,66-117,161-162,184 -232,266-473,505-856
taaacgaagaaacgttcagaaatttagttacctttggcctttgctcagctctttcaagtgttttaaaaccaaaatgcaaaatgctttacgtgccaaattggccgagttacagaacagcagacgaacaaaagaagaagaaaaggagcagcagaaagaggaaccaccacaaaaattagatttttccctcttcgacgactccgaattcgcgaatcgttcgtgggtcgaactcattgaagaggaggaggcggcggcgcggaagacgcaaaaaacaaaagcggcgaccgctgaaacgaccgccgcgtccgctgcccctccaattgcttctgttgctgcggtcgcttcgtcttccgcttcccccagcaataagcgacgcaacagcgaaagagcggagaaggaagagaatgtgccgaaggcgcaaaagttcgacttttccctcttcgacgactccgactttgccaaccgttcgtgggtcgacatcattgacgaggaggagagggagcggagcaagagcacggcactgtccaccactccgtccgttgtctcatcgtccgcgcccaacaaacgccgtcatattttgccaactccacaaaaaggatgggcggagccgaacacaggttggtgcacggacgaagcgacgttggaacggcgggacaaggaactgcagaagatgaaggagaagccgtcataaaggagcgcttatggcaagagccgaaccatgaaattgtggccaagttgctntcgatgggtttcactgaaaacgcagctaaaaaagcggcgctnttcacanagaacgaatcagcggaatcggccattaattggattcttcagcattctgacacactgatgtaaacgatcc

SEQ ID NO: 48301 - DNA, 722 bp, Heterodera glycines
  SCN-specific regions: Sequence locations=1-640,662-722
catgaatctgagattgaccccgtccgtatcaatcaattgtatgaacaggccaaatggtccgtccttttggaggaggtcgaacacacggaggaggagtcatcattatttgcagcgctgcagttgcaagccgcgcttcagcgaaactctccggaccgcgaatctccggaacgtgacgaggtcgatgtactgcttgatgagttggaacagactttggacaccactgcctcactaagtcgccgtgatttaacatacgtgcctgagttgacagaatatctcaaatatttgaaacctaaaaaattgggttttaacaacttcaagagagcttactttacatttcgagacctttacttgagttattacaacacagctcaagatgcaaatgggcctccacttggtcactattatctcaaaggttgcgaggtcagccaggatttgagcgtctcgcaaggaaagttcaacataaaattgcaagtgccgagcagtgaagggatgtcggaactaatattgaagtgtgacacggagcaacagtttgccaaatggatggccgcttgtcgtttggcatctcgtggagagacaatggccgattcttcgtacaattcggaggttgaatccattaagaaagtgctgcagatgcaagcagggagggcagcggcagcgcaaaacggtgcacaaaacaagaagaaatcgcaaccggtgcagctgcccacggatttcaattcgga

SEQ ID NO: 48302 - DNA, 741 bp, Heterodera glycines
  SCN-specific regions: Sequence locations=1-546,571-741
gcgttcctctcccgtctctcctccttccaattcgccgatttcgctgcttgcagtttctttggccgttttggctttcgtcgctttggcatcggccaatccgccgacggcacgcgaaacggcgccaaatgcacagcaaaacaatgccaattcagtggcaactggggaaattgcgaaaaatattgcggaaaagatggagcgggtgaatgagttcattaaggcgaagaagttcatcgatgcacataatttggcatttgagaagggcgaagtgtcgttcaaagttgcgccaaaccatctgatgcattttacacctgcccaatataatcgaattcgcggcttgcaaatgcgcagcaaccgacaacggcacaacatggcaactctggcgggaaacagcagtactttgccggaaaagttggactggcgcgagaaaggggcggtgaccgaggtcaaagatcagggggactgcggctcgtgttgggcattcagtgccaccggtgccattgagggagcattggcacagaaaaaagcgtcgaaaattatttcattgtccgaacaaaacctggtcgactgttcgtccaagtacggtaacgagggctgtgacggtggactgatggacagcgcatttgaatatgtgcgagacaacaacgggttggacacggaggagtcgtacccgtacgaggccgtaacgggcaaatgccaattcaaaatgagaccgtgggcggcactgtcgttagcttcaaagac

SEQ ID NO: 48303 - DNA, 659 bp, Heterodera glycines
  SCN-specific regions: Sequence locations=1-181,210-265,296-659
accgcgaagaggtgttgcccaatggaagttgtgcctggtcggtgctgccatttttctctgttttgccttgctttacccgagcgtcttctcaccgatgctttccaatttgttcggcggcggtacccagcggcaacagccggcggccgcggaccgaccgatgcatccgtcgatgatggggccgaaccaacagcagcagcagcagagggaacgtgcccatcgccctcccccacaccatccaggcgcatccatgcgaatgccggacatgcacaaccaacagcagcaacaacaacagggcgggttttggagtggaaaaagcggtggttcgatggcatggatgttgcccttctacaccgttggcgttgtgtgctttttgctctacacattgttcaagtcgaagaccaaacggcaaaaacgacgtcgcgaccgaccgcttgaccttttgtatggcgacgacgacgacgatggaggaacggaggacggcttggaatatggtgttcgtggtgcgaaactccgctcggtgcagcacagactgcgcaaaacggagcaggcgatggcggacattctcagccaattggagcaaatttcggcccattcaaaggacattaatgatgacgacacaaaagcagcggaaaagaatgttaatgacccaaacattgcca

SEQ ID NO: 48304 - DNA, 493 bp, Heterodera glycines
  SCN-specific regions: Sequence locations=1-493
tgtggtgggctttctccttgggggagtcggccaattgaacaaagcgcgggagcccaattttgttattgatgaccaagacacaagcgtcgtccaaatcgaggacgcgttccacactttctgtacccgcgatgacattgcgattattgtgataaaccaacacctggcggagatgatccgataccatgtggaccaacacgtggacagcatcccggacgtgctcgaaatcccctgcaaagaaatgccttatgacgcgtccaaagatagcatattgaaccgagcacgttgcctggcgaacactgacgacctcaagtcatataagaagacattacatgaaacaaattatcctttattagtcaatgaatgtgtataattaattatgggaatgacgagaacctacatacacatttcgacttttggacttttcttggtactccaaaacccagacattatgcacaacaaaatttggttttcgtcggaaacgatcgctgtctgg

SEQ ID NO: 48305 - DNA, 658 bp, Heterodera glycines
  misc_feature (546)..(546): n is a, c, g, or t
  SCN-specific regions: Sequence locations=1-67,89-110,132-658
ccgtgaagaacttcggcgacttattggacactgaaaaaataaggaagtgttcggtaagttcggggagatcaccagtgccaaagtgatggaagacgctgacggcaaaccccgagggtttggctttgttaactacttggagcacgagaatgccgcgaaagcggttgagcaaatgcatggcagtttggtgcctaatgggaagcctgaccagaagttcaccgtgtgtcgagcacagaagaaaagtgagcgacaagctgagctgagacgccgttacgagcaatacaaatgcgagcgcattcagcgttacaatggaacgaatctgtacgtcaagaatcttgtggacacaatcaatgacgaaacactcagaggttacttcgactcttacgggaaaatcaccagcgtgaagattatgtgcgatgagagtggccgttcgaagggtttcggttttgtgtgttttgagcacatggaagcagcttcgaaggctgtcgtggagatgaacaacaaaatcatcgccggcaaaccgctgtatgtcgcacctgcgcaacgcanagaggaccgcaaggcgttgcttgcttctcagtacattcagcgcttggcctcaatgcgtttgcaaaacccaaccgggattttggggacgatgtacgcgcctgctaacggcggc

SEQ ID NO: 48306 - DNA, 422 bp, Heterodera glycines
  SCN-specific regions: Sequence locations=1-70,92-422
tcaaaagttgggacaatgccggcgatggaaacatttgggcggtgctggtggccgggtcgagcggatggttcaattacagacaccaggccgacatttgccacgcttatcacacgctgttagcccatggagtggccaaagagcgcattatcacgatgatgttcgacgacattgccaacaacaaacacaacccatacccaggaaaactctttaatgagccgggtggcaaagatgtttatgaaggcgtaaaaatcgactacagcggaaccgaggttaaccctgaaaatttcgaagcggtccttttgggcgatgagcagcgatcggagggaaagccggtgctgaaaagcactgaaaaggacaaagtgttcgtgtacttctcggaccatggcgcggtcggagttatcggattcccagcagccgactta

SEQ ID NO: 48307 - DNA, 683 bp, Heterodera glycines
  SCN-specific regions: Sequence locations=1-154,177-322,344-378,404 -415,437-683
tgaagttgttgtggaattcgacttcctcggcaaagactccatccgctattacaaccgtgtgccggtggaaaagcaagtgttcaaaaatctgaagctttttatggaggagaaagacccgggggacgatttgttcgaccgattggatacgagttcgttgaaccaatacctgaaggaactgatggacggactgaccgcgaaagtgtttcgtacgtataacgcgtcgatcactctccaagaacagctggacaaactgacaaatccttccgattccgtccacgagaaaatgctttcctacaatcgtgcaaatcgtcaggtggccatcctttgtaaccatcaaagggcagtgccaaaaacgcacgaaaagtcgatggaaaatttggagaataaaataaaagagaagaagcaggagtacaaggagttgaaggatcagctgaagaagagcaaatcggtggacgagaaaatggcaaaaaaatacgaaagattgaaggaacagatcgccaaactgaacacacagcgcacggacaaggatgaaaacaagcaaattgcactgggaacctcaaaactgaactacttggatccgaggatttcggttgcatggtgcaaaaagaatgacgtgcccgttgagaaaatattcagcaaaacgcaacgcgacaaattccgctgggctctcgacatggcgaagg

SEQ ID NO: 48308 - DNA, 495 bp, Heterodera glycines
  SCN-specific regions: Sequence locations=1-495
accgccttggagcactttttgatggcggaacgcgacagatcggtgttgcgcatcatgaaacgcaatcgggagctggagaacgaggtgatgaaggatgtgccgggatggaagaccggcacttggtacggcgagccggtctatttacgttgggcgacaaatggattgaaccgaatgcaatggaggtcagtcctcatttgtccttccgagactcggacttcaaccactattatcgactcaatacgctgcggcctcagcgcaaatgttaacgtggagaaaggaaggaaggcttttgactctgagtccatttgaacaaattaaggacgttgtttgcggtgtgtgcgccacaaattaattgtgctggcattgtttcgcataaatgttttgtttgtatgcgaggatcgaaaagttagcggatgagaaaaagaaggaattggccaatgagtaccggccggtgtgcgtgagggtatttggggtgaaaggacattcgggcggaag

SEQ ID NO: 48309 - DNA, 519 bp, Heterodera glycines
  misc_feature (382)..(382): n is a, c, g, or t
  SCN-specific regions: Sequence locations=1-157,179-435,457-519
cttgctggagagaaagttgtgctgagtgacggtccgaaggcacaatcggaaccgttccttaaggacaaagtggcctgtgccacttgcttctgcgggcgagacccggaatgtacgcgctctccctaccaaacttaaaagatcgtacgaggaaccttagagagggaagctaaaacttcaaagataagggagcataatgcgaccatgctgataaacacctcaagccatattaccgaaaccaccacagaacttgggcctacctctagttcagaaacccgattactctcgaacttctcgagaagtacgaagtgaaaaccctttccacttgcacaactattaaaccccacggaactatcgttgccaatgacgcacgaacctaaggtcnagaaaacggcgtggagaatgcacttggtctttgtgatgaatggctgccattctatgaagcttgaaaaatcccattggctagcgaaccgacgaacgaaggataatttgataaactctcctcaatgcttatctatatag

SEQ ID NO: 48310 - DNA, 600 bp, Heterodera glycines
  misc_feature (596)..(597): n is a, c, g, or t
  SCN-specific regions: Sequence locations=1-20,42-192,214-600
taaactgttctaaggaaatggctcaacttcttgctggagagaaagttgtgctgagtgacggttcgaaggtagaagcggaagtgttccttaaggacaaagtggtcgctgtttacttctccgccgggtggtgcccgccgtgtcgcgcgttcactcccaaacttaagaaattctacgaggagctgaaaaaggcaggcaaaaacttcgaggttttgttcgtctcgcgcgaccgtgctgctaaagacctcgtcgaatattaccgtgaccaccacggcgcttgggcctacctcgagttcggaaacccgaaaattcaggaacttctcgagaagtacgaagtgaaaaccattccgacttgcaaagtgataaaacccgacggaacgatcgttgtcaatgacgcacgaaccgaagttcaggaaaagggcgtggagaatgcacttggtctttgggaggaatggctgggattctatgaagcttgaaaaagcccattggcaagcgaaccgacgaacgaaggataatttgataaactttcctcaatgcttatttatatagccttaggcatttcaacattccccgataaagtaatcgcgagaaaaaaaaannaaa

SEQ ID NO: 48311 - DNA, 708 bp, Heterodera glycines
  SCN-specific regions: Sequence locations=1-147,189-258,280-301
catttttgcttgtcgacgacagcaccacacagccgaaaagcgcttcttctcatcgccttcgccttcaaaacttagaagcaccaatcccaaccagaaaaaatgtgcgacgaagaagttgctgctctcgtggtggacaatgggtccggaatgtgcaaggccggtttcgcgggcgatgacgcgccccgcgcggtgtttccgtccattgtgggccgcccccgtcatcaaggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgcgtgtcgcccccgaggagcacccggtgctgctcacagaggccccgctgaacccgaaggccaacagagaaaagatgacccaaaccatgttcgagacgttcaacacgccggccatgtacgtggccatccaggccgtgctgtccctgtacgcctccggccgtaccaccggtctcgtgttggactccggcgatggtgtcacccacaccgtgcccatctacgagggttacgccctgccccacgccatcctccgtttggacttggccggccgtgacctcactgactacctgatgaagatcctcactgagcgtggttactccttcgtgacc

SEQ ID NO: 48312 - DNA, 495 bp, Heterodera glycines
  SCN-specific regions: Sequence locations=1-495
tcacgttttgacattagattttgccgaaagtagaatacactggtacaactttggtgggcatggaatgctttggcggaattgtcgttgctactgattctcgttcttccagtggaacttatatatcgaatcgcacaaccgacaaaattaccatgcttaacgaccgtattgtgatcctgcgagcgggcactcaagcagacacacaggctttggccgatatcgtcatgtattatgcggaagcgcatgcgatcatggacgaagaggatgagattaccgtgcgcaacgttgccaattacgcccgcaaaatgcactacaattatcgcggacaactcaacagcacttttcttgtggctggttacgactccctcaacatgggtcaactgtatgtcatcccaggcggaggatacaccacgcggcacccttattatacgtctggcagtgggtcgtcatacatcccagaatatctccaaaaccaatggaaggaagatttggacggag

SEQ ID NO: 48313 - DNA, 614 bp, Heterodera glycines
  SCN-specific regions: Sequence locations=1-158,181-406,428-614
ccgactccattggcggagaaagaggcaacggagagtggcgcgtgttcagcggaaatgagatgggcattctgctgacgtggtgggcgtggaccaattggcgtgccgccaacccaacggcggactcttcgcgggtgttcgtcctccattccgccgtctcttcccaaatgggcgccacaatggccaaaaaggagggcttcaaagcggcgcattcgttgacgggcttcaaatacatacgcaatttggcacacaaattgcggtcggaaggcaacaccgttattgccgcctggggggagtccattgggtttactcccggcacaacgctggacaaagacggcgtttcttccgccgcggtctttgctgaaatggccaattggctgcgcacccaaaaaggcgtttcgctgcgtgaacagctcttccgcctcttctccatctacggctttcacctccaacgcaattcgtattggggggtcaaatcgacggaagtgacgaagaaattatttgcggaccttcgctccgattatcccgaaacgattgggcagaatttcgatgtgaaatttgtgcgcgacttgacgacaggttatgacaacgctcaaccggatgacagggccattctg

SEQ ID NO: 48314 - DNA, 762 bp, Heterodera glycines
  misc_feature (584)..(584): n is a, c, g, or t
  SCN-specific regions: Sequence locations=1-762
gggcacaaacatccgcccgtctgtttttcgactttgcacatctcaagcagatcactggcggcgaatacaccaccaaaccgttacaaatcaatcggttgggcggacggtgtccaattacgaggaaaaagctgtgcatacacatcggtggcggtgtcaagtttgactatttcatgctcaacttgcacccgcgcggtccaaccgttgccgaccaaacgtacgacgagcgcgtgatcgaagtgcgccgtgacccaaaccgaacgccgtacattgcgctagtggcgggtgtcaagggaaagcgttggatatacgccacgcaaaacatgcaggccggtcaaatcatccaaacaacgtgccacatcccggaacggccggtcatcggctgtgagggcaacgcctacccattgggcgctttggtcgaagggacaatggtgaattcgattgagcttcatcggaacaacccgaattcacacgtggtcatcaccgaagcgggcggttgcgccgaaattatccgacacatggacgaattcactgttgtccggatgccgaacaaatatgagtacgcggtgcgtaaggaatgcatggcnggttgttggaaaactgtcacacgtggactgggaaaaaaagcagtggggctctgcccaaatgcatcgtcggtttggctttcgcatggccagcgggcccagcaaacggcgccgtgaccaataccagggcaagaaacatccgcgtaatccgcccctgtgcaccattgacggagtgcgaccg

SEQ ID NO: 48315 - DNA, 748 bp, Heterodera glycines
  misc_feature (35)..(35): n is a, c, g, or t
  misc_feature (617)..(617): n is a, c, g, or t
  misc_feature (623)..(623): n is a, c, g, or t
  misc_feature (626)..(627): n is a, c, g, or t
  misc_feature (630)..(630): n is a, c, g, or t
  misc_feature (632)..(633): n is a, c, g, or t
  misc_feature (639)..(639): n is a, c, g, or t
  misc_feature (641)..(641): n is a, c, g, or t
  SCN-specific regions: Sequence locations=1-153,178-253,275-712,735-748
cattctcttctcgccaagccttctccgcatttgtntaagccgccggttctcctcaacaaataacacacaaccatcatgtcggaaaagaaggtcaaaaaggtgaagaagaagtccaggaccggctccgaggcgagctccttcgaccagaagaccatccaggagttcaaagaagcatttggcattatggaccaggacaaagacggagtgatcagcaagcaggacctgaaggacttgtacgccacactcggagttgtggcgagcgactcgcagatggacaacatgctcaaggaggcaccggggccaatcaatttcaccgttttcctgacactgttcggagaacgactgactggcactgaccccgaggcgacaattatcggcgcctttcaaatgttcgacaaaactgactgtggcgaaatcacagaagagacattgatgaaaattctgaagaacaaacggggggagccattgacggaggacgaagtgcaagggatgtacaaagggaaccctccaattagtggaggcaaagtggactacaaggcattcgcgcatttgatcacgacaggcgcagcggagggagttggccaaagtgggctaagcggggccatggacggacgggnagaaanganntgncnngggccnangccaaccagtgacctgccgattcgggggaaaaccgatcatccatcccgtcgttctttccatccttacgatcgatcacccttttccccctcgcccattgtatctcctt

SEQ ID NO: 48316 - DNA, 782 bp, Heterodera glycines
  misc_feature (743)..(743): n is a, c, g, or t
  SCN-specific regions: Sequence locations=1-129,158-311,338-350,377 -479,509-509,551-551,599-641,692-782
ttctgtagtccttaagcttaaaaaacagacatcattcagtattatttataagaacaccaaaaatgcgtgaagtgatctctattcatgtgggacaagcgggcgtgcaaattggaaatgcttgttgggaattgtactgcttggaacatggcattcagcccgatggaaaaatgccatccgaccaaaacaaccaagacgattcgttcagcaccttcttctcggaaacaggcaatgggcgtcatgttccgcgtgcggttatggtcgacttggagccaacagtgatcgacgagatccgcactgggacttacaagcatctcttccaccctgaacagctcatcactggaaaagaagacgcggccaacaactacgctagaggacattacacagtcggcaaagaaatcatcgaccccgtcttggatcggattcgtcgcatcgcggataactgcaccggacttcaaggctttctcatcttccattcgttcggtggtggcactggctctgggttcacatcgctgcttatggaacgtctctctgttgactatgggaagaagtctaagctcgagttctccatctaccctgctcctcaagtgtccaccgctgtcgttgagccgtacaattcggtgcttactacgcacacgactctcgaacactctgactgtgcatttatggttgacaatgaggccatctacgatatttgtcgtcgaaatttggacgtggaacgaccttcttcaccaatttgaaccgtntgatttctcaagttgtctcttcgataaccgcttcacttc

SEQ ID NO: 48317 - DNA, 441 bp, Heterodera glycines
  misc_feature (237)..(238): n is a, c, g, or t
  misc_feature (244)..(245): n is a, c, g, or t
  misc_feature (251)..(252): n is a, c, g, or t
  misc_feature (369)..(369): n is a, c, g, or t
  misc_feature (377)..(377): n is a, c, g, or t
  SCN-specific regions: Sequence locations=1-441
ttacttggttgagtaccgccagaagcagcgccaattggtcgcgttgaaacgggaagcgaagaaagtgggcaattactacgtgccggatgagcccaaactcgcatttgttgtccggatcaagggaatcaacaagatccatccacgccctcgtaaagtgttgcagctgcttcgtctgcgtcagatcaacaacggcgtattcgtcaagttgaacaaagcgacaatccagatgttgcgcannttgctnngacccnngtacattgcgtggggctacccgagtcagaagatcattcgccagttggtgtacaagcgtggttatgccaaggagagtgggcagcgcattccgatcacggacaatggccattgttgagncgaaacantggggcaaatcggaccgtgaatcctgtgttgggagggaccatggattcaccagattttgacagt

SEQ ID NO: 48318 - DNA, 691 bp, Heterodera glycines
  SCN-specific regions: Sequence locations=1-16,38-42,65-417,442-691
tggagaggaaggggacaaaagaaaaagaagaccagaagatcaggagaaatcacggaggatgaagagctgaacaagaccaaaccgatttggactcgcaatcccgatgacatttcaaatgaggagtatgcggagttctacaagagcttgtcaaatgactgggaggaccatcttgctgtcaagcatttcagcgttgaaggccaactcgaattccgtgctctcctcttcgtcccccaacgcgctccgttcgatctctttgagaacaaaaagagcaagaatgccatcaagctttatgtccgtcgggttttcatcatggagaactgcgaggagctgatgccggagtacctgaacttcatcaaaggagttgtcgactctgaggaccttccgctgaacatttctcgtgaaactttgcgacaatcgaagatcttgaaagtcatccgcaaaaaccttgtgaagaagtgcatggaccttttcgaggagatttctgaagacaaggacaacttcaaaaagttctacgagcaattcgcgaagaacattaagcttggtattcatgaggactcggtgaatcgtaaaaagctctcagactttctgcggtactacacttcggcctccggcgaggaaccatgcagcttcaaggactatgtttcgcgcatgaaagagaaccaaacatgtatctattacatcaccggcgagt

SEQ ID NO: 48319 - DNA, 673 bp, Heterodera glycines
  SCN-specific regions: Sequence locations=1-459,481-546,568-673
tggggcggaacattcttggttgagtaccgccagaagcagcgccaattggtcgcgttgaaacgggaagcgaagaaagtgggcaattactacgtgccggatgagcccaaactcgcatttgttgtccggatcaagggaatcaacaagatccatccacgccctcgtaaagtgttgcagctgcttcgtctgcgtcagatcaacaacggcgtattcgtcaagttgaacaaagcgacaatccagatgttgcgcattgctgacccgtacattgcgtggggctacccgagtcagaagatcattcgccagttggtgtacaagcgtggttatgccaaggagagtgggcagcgcattccgatcacggacaatgccattgttgagcgaaacatgggcaaatcggacgtgatctgtgtggaggacatgattcaccagatttggacagtcgggccccacttcaagcaagtgaccaactttttgtggcccttcaaactcagcaaccccgtgggcgggttcaagaagaagtccaaccattttgtggagggaggcgactacggaaaccgcgaggaccaaatcaacaaattgcttgaaaaaatgatctaatttcggaaacaattgcgatgagttgatgtgcagcggacggcacgcttttgttgttgttattttacagataaactttttttgg

SEQ ID NO: 48320 - DNA, 613 bp, Heterodera glycines
  SCN-specific regions: Sequence locations=1-141,163-613
cacttactttattattctattgcgctattcttcttctgcacacattaaacaacgacgcatgccggaggaactggtggcgctcagtcccggaacgcgtgtctccggccgctggaccatcatcaagaagcttggggcgggtgcgtttggagccgtctacttgtgtcaagaccgagatggaaggacaatggcagcactgaaaaccgaaccgatcgacgctcagcgaccactgctgtatatggaggcccacgtgttgctcagcctgaacgaacttcgatcaaacagtggacgccatttttgccgttgtctggaccttggacgcgatgaacaaccggatgccgattctggacagacgatggagttcaactacgttgtcatgtcgttggttggccgtccaatggacaaactccttcacgaatccggtgaccgcttcagccccggaactgcgatcggcacttcaattcaacttctcaaagcgcttaaggcgttgcacagcgttggatacctccatcgtgacattaaaccagcaaactcggccatcggcacgcctgagacgaacgaacagcgccttctctacctcctcgactttggaatggcgcgcaaatatgtcagagag

SEQ ID NO: 48321 - DNA, 421 bp, Heterodera glycines
  SCN-specific regions: Sequence locations=1-421
acctgttcgggccccctgtggttgggtgtacgccattctgaaggtgctcgccgaaatacacagcgaaccggacctgaagctgaacttgcgttttgaaattgaagtgctctgcaaggagctgaacgttaacctgagaagcattgaggttggcagctacctgaaggagcagcgacgtttgcccagattggtgccgccctccaaacttggcacagccgcagcatcttcaacattggcacaatgtcagttgccgccaatccaaccaccgcacattggcgctgggatttcgtcacacagcacggcagattatacgccaactgacatagcgaacatcctcgctgaaatgagcatctcccggaaatattcaccggccagttatacgcccggcggatcgcaacaacaagtttcatcaataacagcccat

SEQ ID NO: 48322 - DNA, 746 bp, Heterodera glycines
  misc_feature (738)..(738): n is a, c, g, or t
  SCN-specific regions: Sequence locations=1-62,84-199,221-746
tctgcagcctcctgtggtcctttgcggcgacatccatggccaatttcgggacttgctgagaatcttcaagacgatgggctttccgccggacaagaagtacctcttcctcggggattacgtcgaccgcggcacgcaaagcctggaaacaatggtcctgctcttctgctacaaagtgaaatatccggacagtgtcatccttctgcgcgggaaccacgagtgcagcaacatgaaccgagcctatggcttcttcgaagaggttgaacgtcgctatgggcagatggatgcttacgctctttggaaccacttcaaccaaacattcgcatggctcccttacgtcggattgatcgggaacaaaattttatgcatgcacgggggcatctcggacaaattcaccagcctggaacaactaaacgatctgcgcccgacgaccgaaccgccaaacccgtcacttgagattgacctgctctgggccgatcccgtgcctggcatccaaggagttcgtccgaacaacagaggggcgagcgtgcaattcggcgaagacatggtccacaaaatctgcaatttgcttggcgtcgacttaatcatccgggctcatcaggttgtccaaggtggcgtcgaattttttgctgatcgccgactcatcacactgttctccgctccacattacgagaatatgcacaacacgggagcaatcatcgcaattgcgggaggatctcagctacaccgttcatacctttncgccattg

SEQ ID NO: 48323 - DNA, 806 bp, Heterodera glycines
  misc_feature (20)..(20): n is a, c, g, or t
  SCN-specific regions: Sequence locations=1-365,387-502,524-806
tctttctgccttttgctcgnccacaacacatacatttccctaacgaccttcgaccgactacgacacgacgcgtacgatgaacgaggaatactgcttctctacttcgactgttgttgcacagagctgggcccaaacaaacttccgaccagtggacgagcaaccgaacagccttgtggacacgctcatcgccaaattttcgtgcacgactttcgagcagttcacttccgaagtcagtgctcaggacattcacaagctttgcgatgtcaccgtcggtgttctccagcaacagtcaatgctcatccatctgcagcctcctgtggtcctttgcggcgacgtccatggccaatttcgggacttgctgagaatcttcaagacgatgggctttccgccggacaagaagtacctcttcctcggggattacgtcgaccgcggcacgcaaagcctggaaacaatggtcctgctcttctgctacaaagtgaaatatccggacagtgtcatccttctgcgcgggaaccacgagtgcagcaacatgaaccgagcctatggcttcttcgaagaggttgaacgtcgctatgggcagatggatgcttacgctctttggaaccacttcaaccaaacattcgcatggctcccttacgtcggattgatcgggaacaaaattttatgcatgcacgggggcatctcggacaaattcaccagcctggaacaactaaacgatctgcgcccgacgaccgaaccgccaaacccgtcacttgagattgacctgctctgggccgatcccgtgcctggcatccaaggagttcgtc

SEQ ID NO: 48324 - DNA, 757 bp, Heterodera glycines
  misc_feature (731)..(731): n is a, c, g, or t
  SCN-specific regions: Sequence locations=1-132,155-216,238-621,643-757
caattccttcggtcggctcctccacattctaaattcaactccactgcttgggattggctgacggaatatcaaagggacgcagcacctattccgatgaatattttatgcagagcatgtcaagtcggtcgttcctatggactcgtttcccactgtcgaacttcgtccaaatggcaattgagcagcttgggtccacatatgccaatgacaaaatgcaaaattattttacttttttggtgtctttgttcggcattttgattgaaaactcgacagctgacggaactgttgatgaccaactccttgccagattgatgccgtttttaagcgttgcattgaagtccaaattggaagccttcaaatgtgccggcattatgttgctgatttgtttggcggtgaacgttgcgacgcttgacaatgagacggttcaaaatgcactgaaattgttactgtacaaactccgtcccaacacttttccgttggtgcttcgggcggtgtgtgtgctctgtcagcgattgtcgttggacactctgccgaggaatgcaacattgcgaatcgtctacaatgatgacgaattgaaagcgacgacggagatccaaaaattgatggaactcttcgacttgagtcattttctggtgcctttttggcggattctcgttgacgcatacagaaccggagaaaacgaaacatggcgtgacgcctatctgacgatgctcctcaaaacgatggacttggangggaatggacagattccaagcagaaa

SEQ ID NO: 48325 - DNA, 264 bp, Heterodera glycines
  SCN-specific regions: Sequence locations=1-264
tcaggaagtgctttttgacgaggctgggaaaacggtgtgcggagttgcgacgggcgatgttggaattacaaggacggaagcccaaaggagagctttgaacgcggcatggaactcaaagcaaaatgcacaatttttgctgagggctgtcgtggccatctgacaaagtcagtcattgaaaaattcggcctcagtgagggcagagacccgatgacttttggaattgggctgaaagagctgtgggaaattgacccgtcaaagcatcgg

SEQ ID NO: 48326 - DNA, 523 bp, Heterodera glycines
  SCN-specific regions: Sequence locations=1-115,137-523
ttcttcttctgcaacacattaaacaacgacgcatgccggaggaactggtggcgctcagtcccggaacgcgtgtctccggccgctggaccatcatcaagaagcttggggcgggtgcgtttggagccgtctacttgtgtcaagaccgagatggaaggacaatggcagcactgaaaaccgaaccgatcgacgctcagcgaccactgctgtatatggaggcccacgtgttgctcagcctgaacgaacttcgatcaaacagtggacgccatttttgccgttgtctggaccttggacgcgatgaacaaccggatgccgattctggacagacgatggagttcaactacgttgtcatgtcgttggttggccgtccaatggacaaactccttcacgaatccggtgaccgcttcagccccggaactgcgatcggcacttcaattcaacttctcaaagcgcttaaggcgttgcacagcgttggatacctccatcgtgacattaaaccagcaaactcggccatcggcacgcctga

SEQ ID NO: 48327 - DNA, 803 bp, Heterodera glycines
  SCN-specific regions: Sequence locations=1-803
gttaacgacgagcgacgcctgaaattgcgcgcggaatggaacgcccagaattgccaagacatgcacaaaaaggccatctacggactgtttctcggctttgactgtcctgaaataaatggcaccatcgaggattggctttgggccaaattgttccattgtaaatttgccgttgacccggcacgggcacttcgccaactccaaacgacactttgcactcagcatggcgaacgctattttgttggcgaaggtggcagccatttgatttatttttccgtccttttgttcaccggtcaaatcgaaagggccgtgcatgtgctgttcaggtccgaatacattgttcatgccgtacatttggctattctggcccatcaattacgtttgctgatgaccgtaccaaaagtgtccgatgagttgttgaccaccgatgtgcatgagccgagtgtttgtcgactgaatttggcccgtcttttgcttctctttgtcaaggactttgaattgagcaatatcgaatacgcaataaattactgttttttgcgcgcgactttaagttggacacaccttccgcggacaatgccacaattagacaagaaggtcggagtgtttttgtggctgctgtcagccgaatagtgttcatgtccggccatcgggaagcgattttgggccgattggactctcaggggaacagggtccccggtctcattgacaaaattaaagacgccatggacatttgcgaattgattgacagcattgccttcgacactcatgtccagggacactctcttgctgcgtgtcacctttacgca

SEQ ID NO: 48328 - DNA, 627 bp, Heterodera glycines
  misc_feature (451)..(451): n is a, c, g, or t
  SCN-specific regions: Sequence locations=1-97,121-627
atatttcgtgccctgaacacttcactgtctgctactgctgtacaacaaaatgccccgtcatcgtgcaaagcctcgttcttttcatgccggactgaaattccccgtcggtcgtgtccatcgcaagatgaagaagggtccgtatgccaaacgtcttgcgaacggagtgccggtctacatgactgctgtgctggaacacatcacgggcgagctgctcaagattatcggcgatatcacgcagtccgaaggcatgaagcgtctcagtgcatttcacattcgatctgcagcgcgcgaaaacgacgagttgaggaagctgttctctggcgtctctcttgccgaggtgtgcgtgctgccggagctcgaatcggatgtggagcaatcatcggaaggaagtggcgagtccgactccgatgaaagtactgaagggagcgcgagcggaagtcaggagggtggncggtgctgctggtgcgcagcaatgagaggaggattcattctcgagaccgccgtgataacattgacttccaatttaaaagaggatagatatctctgtctgtgatatatatgtttattgtaaatatgtccatgtctctgtgacattgccttcttgctgttgaataaatatattagcac

SEQ ID NO: 48329 - DNA, 254 bp, Heterodera glycines
  misc_feature (251)..(251): n is a, c, g, or t
  SCN-specific regions: Sequence locations=1-204,228-254
ggacaagaaattgtccttaagcctattattaacattttctaaaatttccaatgggctggtggcaaaggaaaagcgggcaaggacagcggaaaagcaaagtctaagaaaatcatctcgcgcagtgccagggctggcctccaattcccggtgggacgcatccatcgcttcttgaagaagcgcacaacaagcaccggacgagtcggcgccaccgccgccgtgtacagcgcagcaattctggagtatctgacggncga

SEQ ID NO: 48330 - DNA, 724 bp, Heterodera glycines
  misc_feature (13)..(13): n is a, c, g, or t
  misc_feature (683)..(683): n is a, c, g, or t
  SCN-specific regions: Sequence locations=1-265,288-448,471-512,535-724
cctagtttttttntctgaagaaatgaagcagccagaaccaataattaacaaagaaaatcttcgcccagccaatcagccaagcaataaaatgcatgaaggaataaattattcggagttcggaaaggaatggaacgaaaaacaatggaccctttctgactttgacattggacgtccgctcggcaaaggaaaattcggaaatgtttatttggcgcgcgaccgaaagtatcgcattccggtggcgcttaagatcctcttcaaatctcagctggtcacagggaatgtggagcaccaattggtccgtgagatagaaattcatgcccacctcagacacccgaacattttgcggatgttcaactattttcacgacgataagaaagtgtacctcatattggagtacgctcttcatggcgaattgctcaaagttttgcaaaaaagtcgtcggttctctgagtcaacttctgcccagtacatctttcaagtgtccgatgcgctcaattattgtcactcaaaaaaggtcatccatcgtgacatcaaacccgagaatattttgctttgtgccgatggtaaaattcggattgccgactttggttgggctgtccacgccaaaaataggcgtcagacaatgtgcggcacacttgattacttgccacctgaaatggtcttgaaacgacaacacgatgaanaggtcgattattggtcagtgggcgttttatgctacgaattt

SEQ ID NO: 48331 - DNA, 637 bp, Heterodera glycines
  SCN-specific regions: Sequence locations=1-146,168-637
catcttctgtagtcctaaagctatacaaattccctttgcctaacttgcctcttcattggacttctgtggacactcgcaacgcacttttgtgcgccgccgttccttccattggcgccttcgtgggctcgacgatggccatcaaagatcaggaattggttcaatttctcaagaatcaaaactttccttctttcgcccgttgttgcaaatacaattatttgctggccaacactgccgtcaccattccgttcggttacgcttcttatttggtctacaaaattggaggaggttttgattacacggacacgactgttgcattgggactgtacggggcgacggtgctcagcggctgttttttggtgcccgtgctcaagaagcaggatactaaggcgctgactgccaacgctgttgtccttgccggactttccgtcgccacttctgtggctttctacaacatcgacaagatttccgcttattggaccatgcccttcactctttgggccattttctgcgctggacttacggtgaaggcttgaaatgtttgaagtcggctgcctttttctggattgtcattttatgttaactcatcttttgttgagttaggaatattttacttccaagtaaattgtctcgaccaaaa

SEQ ID NO: 48332 - DNA, 695 bp, Heterodera glycines
  SCN-specific regions: Sequence locations=1-695
agatgccgaattgtggacggagttgtgcaaaatttgcggcaacaattgcagtatttctggccaatgaagaggacgaggaccaacagcttgacgaggaggacgaagccgcacttttgtccgccttcagaaaaatggttgcgttcgccagcacaatcgacgtgcctgtaaatgtcgaattttgggacatgtgcatggctttgtttcaaaattcgcatcgatttcggtcggctgatttggttgaaaaggcgatgcttttgtgctttcttcttctcagctgggaaatgaaacgatttgtggcggcacaagaacatggagaggagactatcgaaacattgaagaaaaaacgcgaccaatttttgaggacgacaaagtccattctgcgcgacttcgctattggcgttcatgtgcatttgtgacattttgattttatttaattggaaacttgctgctgacaatggccctgaccatcccatccattctttggcaattaaattggacagggaaatggcctttcggctcggtgactttgtcatggacaatgtcttcgtgttggaagagaacgattctgttcgtgatctgaatgagcctgagcgaattcaattaatggccaaacgacgcaacattctcgcgcagtacagcaaactgttcatttgtggcttattgccgattatcgaaagcgttggcattcttaggca

SEQ ID NO: 48333 - DNA, 429 bp, Heterodera glycines
  misc_feature (36)..(37): n is a, c, g, or t
  SCN-specific regions: Sequence locations=1-370,393-403
gtgtgaaagccgcggaacaaatggcaacctcaatgnngttggtcgtcaattataaaggttatgtatcaacctatgcgatgttcgagaagtacaacgtttccatgatcaatgaagagggcgttggtggttcaggaggtgaatatgaggttcagaagggatttggttggacaaatggtgttattttggatttgttggacaagtacgggtccaaaatctccgtctccggtgcggctgtccccaacggcgttcgttttcttcctctcgctttgattgtgcttttgttcatgaccgtagttgaaattgctattgcacaatgtttttggtgtatttctgggtaattctctgatactgacgtaattcatcttttttgtatcatcatgcattatcataaactatcaataacaaaaaaaaaaaaaaaaaaaaaaaaaa

SEQ ID NO: 48334 - DNA, 703 bp, Heterodera glycines
  SCN-specific regions: Sequence locations=1-140,182-251,273-294
gcttttcgacgacagcacacacacgccgaaaagcgcttcttctcatcgccttcgccttcaaaacttagaagcaccaatcccaaccagaaaaaatgtgcgacgaagaagttgctgctctcgtggtggacaatgggtccggaatgtgcaaggccggtttcgcgggcgatgacgcgccccgcgcgatgtttccgtccattgtgggccgcccccgtcatcagggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgcgtgtcgcccccgaggagcacccggtgctgctcacagaggccccgctgaacccgaaggccaacagagaaaagatgacccaaatcatgttcgagacgttcaacacgccggccatgtacgtggccatccaggccgtgctgtccctgtacgcctccggccgtaccaccggtctcgtgttggactccggcgatggtgtcacccacaccgtgcccatctacgagggttacgccctgccccacgccatcctccgtttggacttggccggccgtgacctcactgactacctgatgaagatcctcactgagcgtggttactccttcgtgaccac

SEQ ID NO: 48335 - DNA, 705 bp, Heterodera glycines
  SCN-specific regions: Sequence locations=1-705
gaagcatgccgcggaacatttggcatcgacgtggacacgcttcgggagcaaaacatgtattcggagggggacattacacattacgggatgcatttgcaccaatgcaacattcgccgatgttggacagaatgccaaaaattggcaaattacgaccagcgaaaattgaagctccaagagtgcaattccaggaataaatttttgaaacgaggcatttacatggttccgacaaagtttggcatagcttttggtttcaagcgacttaaccaggctggagctcttgtcaatgtgtacactgatggttccgtgctaatttctcatggcggaatggaaatgggccaaggattgcacacaaaaattctccaaattgcttcaaggtgtcttggaattgacgtttcaacgattcaaatcattgacacggccaccgacaaagtgccaaatgcgagcgcaaccgctgccagcgttggaagtgacgtcaatgggttggctgtgaaaaacgcatgcgaaattttattaaaacgattggagccgttgagaagcgaactgccaaaagaagccagttggaaagatttggtgatgcacgcctattccaacagagtgcaattgtctgcgactggatttgctatcattcattctgagcctcctgatttcgtagaaagtcgtggctccgaatcgtacagttattgtgtttatggggtcggatgtgcg

SEQ ID NO: 48336 - DNA, 621 bp, Heterodera glycines
  SCN-specific regions: Sequence locations=1-621
tagggaagattcacgacggcgattttctaaagtgactcgaggcgctttgcaatggccttgtcggaatttatgctgaaccgcgctatggaacttctggacgattttttcgcatcagtgacattacaaaaccaaacactggaaatggtcttaacgcggagaacacattcatcacacaccaagtcttttggaagatcagcgtcaaacaatatttcgaggatacctatcggaaaacgcttcagtaccctaaagcaccactcctcgtcaattatcgcagaattggggacccggcgtattatcccatggaggtttgctttgttttggatggtcaacgcgtcaaaagttctcaacaaaatcctgagcaaattcgtgaaatgatcaaagagactgccattccgcccaccgtttgcgagtgcacaacgaacgggtgaaggagtcgcttcagttggtcaacaacgaatacttgacaaaagcgtccgttcattttgacacaacgccactccatgtcgattaccgtgttcttggtccgccagcaactctctatcggaacaaccatcgtgtcactcctgccacgtcaaactgtgaatggcgtccgggtgacgctttggtgaatgcccaaattgg

SEQ ID NO: 48337 - DNA, 380 bp, Heterodera glycines
  SCN-specific regions: Sequence locations=1-78,102-316,338-380
catcgtctgcaactttaatcccacgcagcgacgtgcccggcgcaacaatggcaagagaggactacggcttcgatgcaacggcggcggcagcggcggagcagtctcggccttcggcaaccacttcaacgccatattggcagcacgactccttggacatcgccctttttccatcatccggaaggtcaggcaatcgcctgtccaccgcttcacggatgagatcaccgacgaggaactccaacaactctgcatggcggcaacggacgtcttcagaatgcagccgacgctcgtcaggattcagccgccggtcgtcgtcgtgggcgacatccatggacaattcacggacctgcagaggatcttcgacacgcatggctaccctccag

SEQ ID NO: 48338 - DNA, 726 bp, Heterodera glycines
  misc_feature (660)..(660): n is a, c, g, or t
  SCN-specific regions: Sequence locations=1-349,371-486,508-726
gctggccacaacacaacatttccctaacgaccttcgaccgactacgacacgacgcgtacgatgaacgaggaatactgcttctctacttcgactgttgttgcacagagctgggcccaaacaaacttccgaccagtggacgagcaaccgaacagccttgtggacacgctcatcgccaaactttcgtgcacgactttcgagcagttcacttccgaagtcagtgctcaggacattcacaagctttgcgatgtcaccgtcggtgttctccagcaacagtcaatgctcatccatctgcagcctcctgtggtcctttgcggcgacatccatggccaatttcgggacttgctgagaatcttcaagacgatgggctttccgccggacaagaagtacctcttcctcggggattacgtcgaccgcggcacgcaaagcctggaaacaatggtcctgctcttctgctacaaagtgaaatatccggacagtgtcatccttctgcgcgggaaccacgagtgcagcaacatgaaccgagcctatggcttcttcgaagaggttgaacgtcgctatgggcagatggatgcttacgctctttggaaccacttcaaccaaacattcgcatggctcccttacgtcggattgatcgggaacaaaattttatgcatgcacggnggcatctcggacaaattcaccagcctggaacactaaacgatctgcgcccgacgaccgaaccgccaa

SEQ ID NO: 48339 - DNA, 674 bp, Heterodera glycines
  SCN-specific regions: Sequence locations=1-49,71-674
ggaagaagaaattgaaaatgtgcacggaacggaagaaaacgaaaatgcgatggcggaaaatgaaaatggcgggaattctgttgaaatggcggacgaatccgaattggaccctttggatgcttatatggcagaaatttcccagaaaaacaaaggcggcgatgagaagaaggcgcgagttctggtcataggcgccgtatcaaaaagtgcaccaaacaaaggcgacatcgtcgaacctgaggatgagacggttccgataaccgacgaattggacattgagcaaacggcctccagtttattggccaaagggcgaatgctcgcacaaactgaccatacaaaagtctattatcgaccattccgcaaaaatttctacgtggaagtcccagagattactgcgatgtcgaaaaaggaagtggacgaatatcgcaaagaattggaagagatcactgttcgtggcaaaaatgtgccaaagccgatcaaaagttggtcacagtgcggagtcgaccttaaaatgctcaacatacttaaaatccataattatgtgaagccgaccccaattcaagcacaagcgattcctgccattatgagtggacgagatttgattggaattgcgaagaccggcagtgggaagactctcgcctttctcattcctatgttccgccatgtgatggatcagc

SEQ ID NO: 48340 - DNA, 269 bp, Heterodera glycines
  misc_feature (182)..(182): n is a, c, g, or t
  misc_feature (199)..(199): n is a, c, g, or t
  misc_feature (217)..(218): n is a, c, g, or t
  SCN-specific regions: Sequence locations=1-126,148-241
tcatttcgacctgaatgtacgctgcggtttcttcttcgcgtccgatggaagattggaaatctgagttagctatgccagacaaggaccttcgatacaaaacatctgatgtgactgcgactaagggcgttgaatttgaggaatttgggctcactcgcgaccctcttaaaggcatttttgagaangggtgggagcatccaantcccggtcaggaaccgtnntttggaattgcccttcccggcacaaaaattttcccttccccccaaaagggc

SEQ ID NO: 48341 - DNA, 624 bp, Heterodera glycines
  misc_feature (623)..(623): n is a, c, g, or t
  SCN-specific regions: Sequence locations=1-200,223-284,307-514,543-624
tttgggacactgcacgccaggaatcctttcgctcctcacccgttcctattaccggggcgcggctggcgctttgctcgtttacgacatcactcgacgcgacacgttcaaccatttgacctcgtggctggaagacgctcgtcaacactccaattccaacatggtgataatgctgattggcaacaaaagtgatctcgaagcgaggcgtgaggtcaaaaaggaggagggggagcagttcgctcgcgagaatggacttgtctttatggaaacgtcggcgaaaacggctgccaatgtggaggaggcattcattgatacggccaaggaaatttacaggaagatccaggagggcgtgtttgacattaacaatgaggccaacggcatcaaactcggtcctcaacacccgcccagttcgccaagctctcccggtggtgcgccgttaggacgtgcgagcaactgttgctgaatttgaccaacggaatgcgaaagtgaaaaaagaccgcaccgtcagaaactcacgccctcccccccccccttcccctccctctgtggataaatcaaagatttctcacaaatctgtatctttgacaaatttgtcgatcaagtcagcatcataaatacctattaant

SEQ ID NO: 48342 - DNA, 251 bp, Heterodera glycines
  SCN-specific regions: Sequence locations=1-251
gatcaacggttggcacgcatcgaacggaccggccctatcacttttaggctatcgcaaggcggtgaatagggacgttttcgggggacaaatgttcgcgcaggcaattgccgcggcagaagcaacggtggacggcgacgaatttgcaccgaacgcggcccattcgatgttcattagaaaagcattcattgaccatcccatcgaatatattgtcaccagaacgcgcgacgggcgttcattttgcactcggacag

SEQ ID NO: 48343 - DNA, 650 bp, Heterodera glycines
  SCN-specific regions: Sequence locations=1-111,133-348,370-650
ataaaactgggactgagaacccatgggacgaagaaaagcgcaatcagattctccaaccgcacatgtgatggtcgaaagtcacgcatttatgacggaaaagtgtcctcgtttcgagttgaaccgaacaatccatttgggaggtgaatcattctcgattgaagacctgttgggccaaggcggatttgcgcgtgtttacagggccaattcacgtgaagatggttgcacttatgccatcaagtacgaatccccggcttgcccatgggaagtgtacatttgtagcgcactcaaaagacgcattccatcccaattcgctgcttatctaatggaagtgagagacgcgtacattttcaaaaatgccagtgccattgtttacgaatatttcccaaaagggacacttttggatcttaccaatgtctacaaaaagaacggaacggtggtgggcggtcttcttgccacttttttcggcattcatttggcacgtgcgctgcgccaagtccacgagacggccaacataattcacgcggatgtcaagccggacaacgtcatgctgttgacggctgccttgaatgcacatgattcgctggacaatttgctcaaacccccgtgctgaagctaatcgactgggggcgatccatcgacatgaaccattt

SEQ ID NO: 48344 - DNA, 751 bp, Heterodera glycines
  misc_feature (36)..(36): n is a, c, g, or t
  SCN-specific regions: Sequence locations=1-319,341-751
atcaaaagtgttttgttgaaaatggcaccacagtcngcagataatacaagaaactcactttgcaatcgaagacatcatgatgaaattaggcgactatgtcagccaatggacgcgttaccaggcactttgggactttaacaggaaatgctttttgagcgacttggaacggacttgtgcaattggatgaaggtgcttttggacaccaaaaaagctcgaacaatggtcgactctccggaaacgcgccacaatatttttccgtttgtggtcgacttcactcgggtccaatcaaaagtgtccataaaatacgacttctggcaacgtgaagttctcaataaatttggaagcgcattgggctcatcaatgcagcagtttttttccgacatctcaaaagacagacatgagttggagtcgcaaagcattgattcgaccaacaccagttccaccgtggctttgattatgcacgtgcaatcattgaaaaagcgaataaaagcctctcaagaacaggttgacactttcttgtccggacaaaagcttctgactgtgcatcgttatccgtttcctcaatcatggctatatgctgaaaatgtcgagggtgaatggtctgcacttttggacgtcttaaatcgaaaggatgtcgcgattcaatctcaagttgccaatcttcaaacgcgcattttggaggaagaacagttgctggagaagcacatcaacgatttatttgctgaatggaacaaatcaaaaccggttcatg

SEQ ID NO: 48345 - DNA, 577 bp, Heterodera glycines
  SCN-specific regions: Sequence locations=1-116,140-577
ttctgctggattgttatactggttgctacttttgagaaactcgtaaagactgatggcaaagcgcccgatgaccttgaaaaacagttgcatcggctttgtctgaattggcacacaattcagagatcaaggctgagctctgcgaactttattttgttggagcacaggaatacaacatttggaaacaaaaagtgtattctggtatggattcctgtggcctacttttagactgccaaatgattgacccaaaattagactcgtgagctggagaagaaaatgagcgggtgtcatgtcatcttcattgccaagcgtaggattttgccaaaacctcagcgaggtaaaaaccgtatgccattgggacagaagcgttctcgttcgcgaacactcactgctgtgcatgactcaattctggcagacgctgtattgccaactgaagtgggtggcaagcgaactcgagtcaagcttgacgggaaacaaattatgaaagttcacttggacaaggcacaacactacgaccgtcgaacacaacgtggacaccttttggcatctgtacaagcgactgactgggaaggatgtgggt

SEQ ID NO: 48346 - DNA, 739 bp, Heterodera glycines
  misc_feature (717)..(717): n is a, c, g, or t
  SCN-specific regions: Sequence locations=1-400,424-670,692-739
gaaaaaagcccggccacgtggcggcggcggaggttttccggggataggcaatctcttcggtgttgggcagtcgactgcacgggtcatcaacagagaggacgtgaaaacggcgtttgcggatgtggcggggtgtgaagaggcgaaaatcgaaatcatggaatttgtcaactttctgaagaaccccgcacaatacaaagcactgggcgcaaaaattcccaagggtgctcttctgactggccctccgggcactggtaaaactcttctcgccaaagcaactgctggcgaagcaaatgtgccatttatcactgtgtccggttccgagtttttggagatgttcgtcggtgttgggcctagccgagttcgggacatgtttgaaatggcgcggaaaaaggcaccatgcattctgttcattgacgaaattgacgctgttggacggaaacggggcggaaggggcgccatgggaggccactccgagcaggagaacacactgaatcaattgctggtcgaaatggacgggttttcaactgatgaatcgaacgttgtggtcatcgctgccacaaaccgcgtggacattctcgaccccgcgttgatgcgtccgggccgatttgatcgacaaatattcatccccgttcccgacatcaaaggccgtgcttccatcttccgcgttcatttgacaccaatcaaaacaaccttggacaaaatcgagctttcccgcanacttgctgcgcacacgcccgga

SEQ ID NO: 48347 - DNA, 202 bp, Heterodera glycines
  SCN-specific regions: Sequence locations=1-60,186-202
agttgtcacataagcgatcgaattcacaccctttaatttggctatatgcaaatcttcgtcaaaactctcaccgggaagaccatcacccttgaggtcgaggcgagcgacaccatcgagaacgtgaaagcgaagatccaggacaaggagggcatcccgccggaccagcagcgccttatcttcgctgggaaacagctcgaggacg

SEQ ID NO: 48348 - DNA, 325 bp, Heterodera glycines
  SCN-specific regions: Sequence locations=1-325
ctcgatgttctgtgaagcgggtgcgggtacacagtgctatcgcgacatgggtcgctcgtcaacgcgctcaagcggatcgcattcagatcatcaaagtgcagaccagtgactgtggcggactgcaagcgagccggggtgaagcaatttcacaactccaagatcaaatttccgcttcctcaccgtgtgaattccaagcgacgcaatatgactcctttcacgacacaccgtccgagaactcattttgtgtacagaaagaaatgagacgacttgcatttccgattggcgataaagttgctgaggtcaaacttctatctttttggacgcc

SEQ ID NO: 48349 - DNA, 709 bp, Heterodera glycines
  SCN-specific regions: Sequence locations=1-53,88-709
tggggccgtccggcgcaagaaaagtgcatttgatgatcatcatacattcggaagggtctgatgaggaagaagaagttgaggaagaacgaaagtcggaaaaatgggccaaatgcgatgccaacagaagcgcttttgccgctgtcaaatgttgctttgaaaaattggacaatcatttgccttggaagttcaaaaggaatctaaacggagaaacattcggcagacatttctcccaatggtttcactttttggagagcggccaattcagtattttactccatgggcttggttcaaaacgtcgaattttggaggattttcgcgactttctgtccctccgaaaccgtcggtcgttcgtcggtgatggtctcaacccttccgacacaatgccaaaaatgattgaccgaatgacggaagagctaaaactgaagggaatggccaaaacgaaggaaaaatctgtcgaagcggcggcaaaagctttacgaaatgctgtcgatgctcagctgcgttttccgattgttttcattttgctgaatatcgactcgccccaactgagatctcgggaacatcagaaggccctttccgtgttggccaagtcgagcaaagtccaactgatcgcttcggttgaccacgtcaacgctgcgctcatttgggaccaatcccttcgcgatgcgttcgcttggcttcacttcccaatttcgactttccattgcta

SEQ ID NO: 48350 - DNA, 213 bp, Heterodera glycines
  misc_feature (18)..(18): n is a, c, g, or t
  SCN-specific regions: Sequence locations=1-31,57-57,99-213
gaagcgatgagacagggncagtgcagcagtagcaattcgtagcaaagattatgctgttgtggtcgcacttatgcgtgcacaaaacgagctttcttcatatcagcagaaagttttcaaattggacgatcatctcggcttgtctatgtctgggcttatttcagatggacgcattttggcacgctttatgcaaagtgaatgcgccgagtttcgctg

SEQ ID NO: 48351 - DNA, 204 bp, Heterodera glycines
  misc_feature (202)..(202): n is a, c, g, or t
  SCN-specific regions: Sequence locations=1-37,59-204
agggaaatcgacacgataggcctctacgacactttttcctgtttggaagcattctgagctgcaagattgccactgacattgagggaggaagcaaagggtatgggttcatccattttgagactgaggaagcggcgaacagtgcaattgcgaaagtgaacgggatgcttttggatgggaagaaagtgtttgttggaaaatttgngc

SEQ ID NO: 48352 - DNA, 452 bp, Heterodera glycines
  SCN-specific regions: Sequence locations=1-90,113-241,264-452
attccgccgtcaaaacggacgttttgccggcgccgtttatgaaaaatgtgatcggagcatttgcggaactgccggattggcatttcatcgtcaaaatcgagccggacgacgaacaaagccggaggatggctgagaacgtgcccaacattcgccttacttcgtgggcgcctcagcccgccattctctcccatccccgcctccgtctgttcattacccacggcggttacaactctttgctggagggtgcacaaagcggcactcccgtgctcagcatcggattcttcgcggatcagcgaaggaatgcattggttgcgcagagaaacggatggggaagggcatttgaaaattggaaactgttggaaggaatgaacgaattcagagagacggtcaaggagatgtgggaagaggacaacgaccatttgagcagggccgccaatcgagtgaagacaatt

SEQ ID NO: 48353 - DNA, 227 bp, Heterodera glycines
  SCN-specific regions: Sequence locations=1-78,102-129,156-227
catctgctatcttaaagcggcgccaagaaggtggtcatctccgctccgtctgcggatgcgccgatgtacgtgatgggcgtcaacgaggacaagtacgacccggctaaggacgacgtgatcagcaatgcgttgtgcaccaccaactgcttagctccgttggccaaagggatcaactactagtttggcatcatcgaaagactgatgaccactgtgcatgcggtgaccgc

SEQ ID NO: 48354 - DNA, 582 bp, Heterodera glycines
  SCN-specific regions: Sequence locations=1-134,157-343,373-582
ggcgtttcgatcgcgagattgacattggtattcctgacgcattgggcgtttggaaattctgcgcattcacactaagaacatgaaattggcggacgacgtcgacttggaaaagattgctaatgagtgtcatggctatgttggtgccgatttggctgcactgtgctctgaggcggcaatgcagcaaattcgtcaaaagatggagctgatcgacttggaatcggaaaatattgatgcggaagtcttggcgcaattggctgttactatggacgactttcagtttgcactcggtaaaaacagtccgtccgcgttgcgtgaaaccgtcgtcgagactccgaatgtcacttgggaagacattggaggccttgaaaatgtgaagagggaattacaggaattggtccagtacccggttgaacacccagagatgttcctcaaattcggaatgcaaccatcccgcggtgtcctcttctacggtccgcctggttgtggaaaaactttgcttgcgaaagcaattgcacgcgagtgccaagcaaacttcataagcatcaagggccccgaactgttgaccatgtggttcggcgagtc

SEQ ID NO: 48355 - DNA, 305 bp, Heterodera glycines
  SCN-specific regions: Sequence locations=1-48,70-126,162-305
tggtttttctctattaacagagataaagaaatagtacgccaaaaagcgaaccttccgccacttctctttccccgtgcatttgacggatccgaataaaatccgatgtcgccttcgtccatttctattcttttgggggcccagtggggcgacgaaggcaaaggcaaagtgttggattttctcatcggacatcacaggattgacattgtcgcgcgatgccaaggcggtaacaatgcgggccataccgttctggcaaatggccgcgagtatcatttccaccttttgccttccggattggcctcagataa

SEQ ID NO: 48356 - DNA, 721 bp, Heterodera glycines
  SCN-specific regions: Sequence locations=1-225,247-721
acggtgtgccgtgcgcagaagaagagcgagcgccaggctgagctgaagcgtcgttacgagcagacaaagctgagcgcatccagcgttatcagggagtcaatctgtacgtcaagaacctgcacgataccatcaatgatgagacacttcgaagcaattttgaatcctacggaaacatcacaagtgcaaaggttatgtgtgatgagcatggtcgctccaaaggatttggttttgtgtgctttgaaaaggcggatgaagcaaccaaggctgttgtggaaatgaacaacaaaatcatcgaaaacaagccgctttacgtcgcgcttgcgcaacgtaaggaagaccgcaaagctcaactggcctcgcagtacatgcagcgcttggccgcggtgcgcatgcagaaccctgctggcctcatggggacaatgtatgcgcctgccagcggtggatttttcctgccacaggccatccagaaccaacgtgctgcgccgttcatgcaaacaccgaatctgtccggggcacaaatgcgtggcgctgtccctcgctggaacaatatgggcggtttcaatcatccaatgcaaggctacatgatgggtccagctggtggcggtcagttcggcggcgctaaccaaattgctcgtggaggacctcgctcccgtggtggcggaggaatgccttattaccggggacaaccgtgccaccaacagaaccgcctgcctggtatggg

SEQ ID NO: 48357 - DNA, 778 bp, Heterodera glycines
  misc_feature (652)..(652): n is a, c, g, or t
  SCN-specific regions: Sequence locations=1-778
cattaaaataacattaattcaccataaattaaaaaagatgcgagatctgttcatcgaagacaacagcccgatcactccggcccggcttgccgaactgatcagacatttctacgcgttgggatggatgcgcgataacggcggaggaatggcggtcctttgcaacggcgccgtgttcggttcgcccacttcggtgcagaaggagaaagtgtccgaaaatgatctgtttgtaattgatgctacgaccggcacagtactgaaacggccgcaaaacgcggcgagtgttccgagtgccacctgcggactgttaatgaacacaggggtcgagaatcgtagcagcggactccgtctcgacaacgtcgaccgcctcgttgtgcctaccgttgattctgagttaaacgaacaaatgctcagtcctgttttgctccgaactttggacaaatacacagaagcatcggccattttggtgcgtggccacggcttttttgtgttcggctctcactgctggcagtctaccaaaatgatgttggagtgttacgagtacctctttgagttagcctgcgaaatgatcaaatacaaattgccattggtgccaaaatcgccgaaaattaaaataatgcgccaattcacacgtaacacgacgacggcatagganaggaatgtgccgacggagggcgacaaaagcgatggaaggaaagggcggaagattccttagtggcacaaagggtctttagaatgaaaaggctatcgatgacgctttcccattgacacattttgcgag

SEQ ID NO: 48358 - DNA, 517 bp, Heterodera glycines
  SCN-specific regions: Sequence locations=1-56,78-517
ttattatttgcggacttgactccattgaagctcgccgttggcttaatgcgactgtgtgttctttggttgaatgtgatgactgaaataacccaaaatccacaccatagtgccgttgatcgatggtggaaccgagggattcaaaggaaattcacgtgcgattattcctttcatgacgccgtgtattcaatgcacgatagatctttacacttcccaggtcaactttccgttgtgtacaattgctcacacacctcggcttgctgagcattgtgtggaatatgtaaaagttctgctttgggaaaaggagaagccttttgggcaagacgttaaattggatgctgatgaccctgctcatgtccaatgggctttccgtgctgctcaacaacgcgcgaatgagtatgaaataaaggatgtcgatttgcgactcagccaaggcgtgctcaaacgtataatcccggcagtgggttcaaccaatgccgtcatagcgggaagctgcgctcttgaggcattgaaactggca

SEQ ID NO: 48359 - DNA, 509 bp, Heterodera glycines
  SCN-specific regions: Sequence locations=1-357,379-463,501-509
aaagtgctcccctatgttgactttttgtttggcaagtaaacagagatgcattggtttacgcaaaaactccataaatcggaaaaacggacgttggggacatcccattgtatttgactgaaaagtgagaaagtgaacggtgagatgaaacggatagtcatgataacacagggccctttgccggttttggtggcccatgaccgcgaactcactcagtttccagtggagccaatttcggaggacaaaattgtggacaccaatggggcgggcgatgcattttgtggaggctttttggctgcattttccaccggccgctctttggatctttgcgtccgtgctggtaattttgctgctcgtacaattatttaacacattggctgcacttttccaaatgaatgtgcttatttagaatgagttaaaaatgtgcgcacaatccttctcaaattgttaaatttacagttctatgttttattaaatttattcgtaattttttaataaatattcgtaccctc

SEQ ID NO: 48360 - DNA, 524 bp, Heterodera glycines
  SCN-specific regions: Sequence locations=1-524
cggtcaatcgaaagggccgtgcattgtgctgttcagggtccgaatacattgttcatgccgtacatttggctattctggcccatcaattacgtttgctgatgaccgtaccaaaagtgtccgatgagttgttgaccaccgatgtgcatgagccgagtgtttgtcgactgaatttggcccgtcttttgcttctctttgtcaaggactttgaattgagcaatatcgaatacgcaataaattactgtttttttgcgcgcgactttaagttggacacaccttccgcggacaatgccacaattagacaagaaggtcggagtgtttttgtggctgctgtcagccgaatagtgttcatgtccggccatcgggaagcgattttgggccgattggactctcaggggaacagagtccccggtctcattgacaaatttaaagacgccatggacatttgcgaattgattgccagcattgccttcgacactcatgtccagggacactcttttgctgcgtgtcacctttacgcattggca

SEQ ID NO: 48361 - DNA, 703 bp, Heterodera glycines
  misc_feature (553)..(553): n is a, c, g, or t
  SCN-specific regions: Sequence locations=1-154,180-194,218-282,308 -326,356-703
cattttcttccctttcctttgtcttccattattccgcttttccctccccatttctcatttgttcttctccgcttcttctctccccgatgaatcactttgggctgacttttctgttcgtcgccgtttctctgctggtaattgcgcccggctgcgatggcatgcaaattttcgtgaagacattgacgggcaaaacgatcactttggaggtggagagctcggacactgtggacaatgtgaagacgaagatccaagagaaggagggcgttccgccggatcagcaacggctgatcttcgccggcaaacagctcgaggacggacgaacgttggccgactacaacatacagaaggagtccacgctccacttggtcctccgtctccggggcggaaatgggaagagaaacacgagtaagaacaagaaaagcaacaaaaagcttgatcagaattgatcagcagcgaacgcaccatcacatgattgattggcacagtgattttccaccaccaaattcacaacacttttcccttttccgggttatctttgatttccattttcggntattgttttctgtttttctcctctatcttttgtaaaattctgttactttgatccttagttttatcatttatcatcgcatatttagaagttatcatagtccatatttctgtccctttttatttatttttttgactataaaacttttggaca

SEQ ID NO: 48362 - DNA, 474 bp, Heterodera glycines
  misc_feature (449)..(449): n is a, c, g, or t
  SCN-specific regions: Sequence locations=1-221,243-254,277-307,330-474
cagatcgctgctggttatactcccgtgttggactgtcacaccgcgcacatcgcgtgcaaattcgccgaactcaaggagaaggttgcccgtcggtctggaaagaaagtggaggacaacccgaaggcgctgaaaaccggcgatgctgggatcgtcgatttgattccaccaagccgatgtgtgtggaggcattcacggactacgctccgcttggtcgtttcgccgttcgtgacatgaggcaaaccgtcgctgtcggtgtgatcaaggcggtggagaagactgaaggcggtggaaaggttaccaagtcggcgcagaaggctgctgcccctggtgggaagaagaaatgagaaacgctgataattggaatggattcgatttttggatttgttgttttttttggccgtgaaataggcccgttaactttgggttttgttggataaaatttgttcgantaatacatacaacctccaatggcat

SEQ ID NO: 48363 - DNA, 636 bp, Heterodera glycines
  SCN-specific regions: Sequence locations=1-4,28-173,195-232,268 -333,358-462,489-561,585-597,621-636
tcgaacactctgactgtgcattatggttgacatgaggccatctacgatatttgtcgtcgaaatttggacgtggaacgcccttcttacaccaatttgaaccgtttgatttcgcaagttgtctcttcgataaccgcttcacttcgatttgatggtgctttgaatgtcgatctcactgaattccagaccaatcttgttccttatcctcgaattcactttcctcttgcgacttattctccagttatctcagctgagaaggcctaccacgaatcattgtcggtttccgaaatcaccaacatgtgctttgagccgtccaaccaaatggtcaaatgcgatccacgtcacggcaaatacatggccgtgtgccttctctaccgaggtgacgtcgtcccgaaggatgtaaatgcggccattgcttcgatcaaaacgaaccgttcaattcaattcgtggactggtgcccgaccggcttcaaggttggtatcaattatcaacctccgactgttgttcccggcggtgacgttgccaaagtcccacgtgccgtgtgcatgttgtccaatactaccgcaattgctgaggcttgggctcgtttggatcataaatttgatttgatgtacgccaaaagggcatttgtgcattgg

SEQ ID NO: 48364 - DNA, 596 bp, Heterodera glycines
  SCN-specific regions: Sequence locations=1-44,66-596
gttcacgcgtttttccacagtttttgtgcaagcgcctcgtctacgacacgtcggccagcgaggagcaggagcggtgcatgatcgcaaagctgaagcacatgtgcgggttcgagtacacctcaaagttggagcgtgtgctgactgatgtcgcgctgagcagggaccgttccgagcagtacaagcatgcagccgagaacatgcaacgttgacttctccgtcattgtcgtcatgtcgaacgtgtggccactggggcaggcggtccaattcgacatcccgcgtcctctcctcgactgcattgactcatacacccagtactacaccaaccgcttcaatgggcgtaagctgacttgggcgttgcaaatgtgccgcggtgaattggtctcgacgagcaacactttcaaggacaaatactcatttttgtgcaacacgcaacaaattgccattctcatgcagtacaacgaacgcaacacgtacacacttgacgagctgcacgtcgctcttggcaccgactttcccgctgatcagctgtgcgccgttgttcaatccttggtcaagacgaatctgctgaagctcaccagcgcccatgggacagcttt

SEQ ID NO: 48365 - DNA, 718 bp, Heterodera glycines
  misc_feature (706)..(706): n is a, c, g, or t
  SCN-specific regions: Sequence locations=1-46,68-574,626-718
cgaaagcctgaaaaaattaaagagcaacttctgggcgagaatgcttcaggcccggtgttggtggagcccgacaaccccaaaaatgtgcttgtaagacgcattacgctggtttcggacgaccaagttaagcacagcatggacctccccgcaaagggtgacttcgtcttctgcgtgaaagaaagctgcacctatcggatacgcttcgaattcgttgttcagcgtgaaattatatgcggactcaaatacgcacacaaagtgagtcggcttggcgtcggagtgaccaaagagttgtacatgctcggctcctacggtccccggcacgaaccgtacacttacgaaacatcaccggaggaggcgccttcgggaatattaagccggggaaaatatcgagtacattccctcatcaccgacgacgacaaaaacatttggttggattggtcgtggcacatcgaaatcgcaaagagttggtaaattgttaagcgtcgatagattttgtggctcctttttgaatactcaattcgttatcaaaatttcaaaaatcaaaaaaagggccataatttgttaaatttgttccacccttgcccttcacttattccttttattcatgtgacattcttttgtacttcatccgttaattgcccaaaccaaaagttgttagagcacgaaattttgcaagtgacccctttacctactatatgttgacctnccgcattatgtc

SEQ ID NO: 48366 - DNA, 242 bp, Heterodera glycines
  misc_feature (214)..(214): n is a, c, g, or t
  SCN-specific regions: Sequence locations=1-1,35-36,107-170,200 -217,241-242
cggccgtgctgtccctgtacgcctccggccgtacaccggtctcgtgttggactccggcgatggtgtcacccacaccgtgcccatctacgagggttacgcactgccctcacgccatactactttttggacttaggccggcccggtaaccctatccttatcttccctcgaagaaaatatccccccttgggggcgggggggtccccccccttttttnggaccccccccgggggggggggggggaa

SEQ ID NO: 48367 - DNA, 111 bp, Heterodera glycines
  SCN-specific regions: Sequence locations=1-21
tcaagcgtggtattctgacgctgaagtacccgattgagcacggcatcgtcaccaactgggacgacatggagaagatctggcaccacaccttctacaacgagctgcgtgtcg

SEQ ID NO: 48368 - DNA, 128 bp, Heterodera glycines
  SCN-specific regions: Sequence locations=1-128
gtgattgggcgtccgactcgcggaatttagtttcggcttctcaggacggcaaattaattgtgtgggactcgtacaccacgaacaaagtacatgccattccgctgctgtcttcctgggtgatgacttgc

SEQ ID NO: 48369 - DNA, 214 bp, Heterodera glycines
  SCN-specific regions: Sequence locations=1-9,31-35,180-180
ggtttttgagaaaagcttttatcaaacttttttgtaatttattggcttatcaaatgcttccgtctaatcctgacgacaaaatagatgaggtcgacaagattctttcaaaacttgatggaaaaattgaacgtaaaatggaccctttgatgtgtcgccataaccaaagacagaaatgcacaaattgtctcccattggacccctacgatgaaaaatt

SEQ ID NO: 48370 - DNA, 273 bp, Heterodera glycines
  misc_feature (2)..(2): n is a, c, g, or t
  SCN-specific regions: Sequence locations=1-65,90-273
cntttttgaagagatttcttcccgattcaactcgaaagaattgaccgatgtgacgagggtggactgtgggggagggagtgttctgccgggcatggcggacgcccattcccaccccgtgttctctggcgatcgggtgcatgaatttgcgatgaaactcgctggtgccacttatatggaagtgcaagcagccgggggcggaattcacttttcaaccgaaaagacacgtgaagcaaccgaagagcaattgctggaggactttttggagattgctct

SEQ ID NO: 48371 - DNA, 430 bp, Heterodera glycines
  SCN-specific regions: Sequence locations=1-33,55-159,199-406,427-430
cattaccctaacatacagaatgtgaaatcgctcgaaaaagtctgtgagcagcttattcgcggcgcaaaggacgagaatttggtggtcaaaggcccagtgagaatgcccacaaaaattctgcgcattaccacacgcaaaacgccgtgcggagaggggtcgaagacttgggaccgtttccagatgcgcatccacaaacgcatcatcaatctgaacagctccagcgacgtgctgaagaaaatcacgggcatttccattgagccgggcgtggacgtggaggtgacaattgcggagtcgcccagcaattaaacagcgcgtgccgaggggcggacggagagatttcccttttttgttgttgcgttcgctctattgttgctttatgccacaaaattgaaaaaaaaattgttgcaaaaaaaaaaaaaaaaaaaactac

SEQ ID NO: 48372 - DNA, 438 bp, Heterodera glycines
  SCN-specific regions: Sequence locations=1-438
gttgtccgaattcgctggtggcatttcgcctgtcgacgccgtgccaatgccaaccgcggccaatgactgcaacaataattccatcgaagacattcaatcggaccgccgaaggggcccaattgatccgacaaacttcgaccatttggtccgtctgagtgagctcatccgttccatggccgaccttggcactttgcagcccgagttcggcacaatctgtggctccggattgggcgcaattgccgaccaaatggagggggcgcggattttgcctttctccgaggtgcccggctttccacagccgagtgttattgggcacaaagggaatttggtgttcggtcggattggtggtcacttttgcatgtgtcttcagggccgtttccacccctacgaacacaaaatggacatggcattgtgtacgatgcccgtccgtctgatggg

SEQ ID NO: 48373 - DNA, 246 bp, Heterodera glycines
  SCN-specific regions: Sequence locations=1-246
ggccgcaaaggcggagttctcaagagcttgtcaaatgactgggaggaccatcttgctgtcaagcatttcagcgttgaaggccaactcgaattccgtgctctcctcttcgtcccccaacgcgctccgttcgatctctttgagaacaaaaagagcaagaatgcctcaagctttatgtccgtcgggttttcatcatggagaactgcgaggagctgatgccggagtacctgaacttcatcaaaggagttg

SEQ ID NO: 48374 - DNA, 203 bp, Heterodera glycines
  misc_feature (180)..(180): n is a, c, g, or t
  SCN-specific regions: Sequence locations=1-45,180-203
ggccgccaaggagcgatcgaattcacaccctttcaatttggctatcatgcaaatcttcgtcaaaactctcaccgggaagaccatcacccttgaggtcgaggcaagcgacaccatcgagaacgtgaaagcgaagatccaggacaaggagggcatcccgccggaccagcagcgccttatctntcgctgggggaaacagctcgagg

SEQ ID NO: 48375 - DNA, 325 bp, Heterodera glycines
  SCN-specific regions: Sequence locations=1-12,34-325
ggccgccagggcggaattcagaaaagggatttatttcaccccaggcattggccaggcgagttcaatgggcagtcttttgttgacggccggtgccaagggaatgcgcacttcgctgcccaatgctcgcattatggtccatcagccgagcggtggcgcttacggacggcggcggacattgtgatcagagcggaggagatcaaccgaatgcgaaaacggctcaacgaaatctatgccatgcacacgggccaaacggtggaaactattgaccaggcattggacagggatcgtttcatgagcgcactggaggcccaagagttcgggctgg

SEQ ID NO: 48376 - DNA, 627 bp, Heterodera glycines
  misc_feature (578)..(578): n is a, c, g, or t
  SCN-specific regions: Sequence locations=1-17,39-145,177-203,238 -245,292-343,366-368,396-413,436-581,606-627
ccctctagagcggccgccaagcaacagcagcagaagcaaaaatggctgacttcgacaaacacgctgcccagcgcgaggcggagtctctccgcactttggccttcttcggcgtttgcctgtccaccgtggccacggttatcgctgtgctttccgtgccgttcgcctaccagcacttctagcagatcggcgcccaaatgcagaacgaagtggacttctgcaaaatgcgctccggcaacatgtggcgtgaggtcacccgcacccaggcctactccaaggtgtcgcacgacagccgtcacaagcgtcaggcaggcggttgctgtggctgcggagtgtcgcccccgggcccgcccggaccccctggcccatcgggacaacccggcggagacggacaacccggaggctcaggacagcccggagcaccaggccaggcagctcctcgcccgtacccgccaagcggcggatgcgtgccgcaatgtgaggccgcccagcccggactccccggcccgcccggaccccccggacccgagggacagaacggccaacccggacagtcggcaccgcccgcgtctcctggccgncccgggccccagggacctcctggacccgatggacagcccggcaaccccg

SEQ ID NO: 48377 - DNA, 496 bp, Heterodera glycines
  SCN-specific regions: Sequence locations=1-83,106-496
ggccgcaacttcaacaacaccaaacatcgtctccatccctcgtttctttgtcatttctccgtttgctcactttttgcccgcttgaaccttcactttcttaacaccacgaactttcttctggcggttctttcgctccttgcgttgctttcgtcctcccttctttttttctgaccaacgccttgcctcaacaagcgatatttggcctcaaagcgcttggcgtagtcgagtgagtcgtacacatttgcaaaccctgtgctgcgacctcctccaaattgacaccggaaaccgtacgcaaccacaacatcttgggtcgtcttgtacaacttggccagcctctcacgcacctcggatttgggcacagaagcgcgattcggatggagaatgtcaacaaccatctgtttacggaaaagaagtcgattgttgagcactttgcgcgtgtgcaatgtgataacaccaccttcgaccattttcactttttttattagctcaaacttgg

SEQ ID NO: 48378 - DNA, 262 bp, Heterodera glycines
  SCN-specific regions: Sequence locations=1-133,162-262
ggccgccaagcaagtttgagcttaaaaaacagacatcattcagtattatttataagaacaccaaaaatgcgtgaagtgatctctattcatgtgggacaagcgggcgtgcaaattggaaatgcttgttgggaattgtactgcttggaacatggcattcagcccgatggaaaaatgccatccgaccaaaacaaccaagacgattcgttcagcaccttcttctcggaaacaggcaatgggcgtcatgttccgcgtgcggttatgg

SEQ ID NO: 48379 - DNA, 426 bp, Heterodera glycines
  SCN-specific regions: Sequence locations=1-88,112-426
ggccgccaagccttcgactacacatttaatctcacgaacggacgtgccctggtgcaacaatggcaaaggaggaatactgtttcgatgcaaaggcggcggcagcggcggggcaatctcgtcgtccttcgacaacggcatcagtacttgtgcaaggagatggccagtcaagcagatttgtggatgcgatcatcagaaaagtcacgcagccgcctcttcaacgcttcacggatgagatcaccgacgaggaactcaaacaactctgcaaggcggccacggacgtcttccggatgcagccgacgctcgtcaggatccgcccgccggtcgtcgtcgtcggagacatccacggacaattctcggatctgcagaggatcttcacaacgcatggccccccgccggagcagcagtacatgttcttgggcgactacg

SEQ ID NO: 48380 - DNA, 233 bp, Heterodera glycines
  SCN-specific regions: Sequence locations=1-233
ggccgccaaggccatcagcagagaaaatgaccgagtcggacagtcgcattcgggcgtacaaattcgttgcctattcggccgtcactttctccatcgtggccgttctctctgttgtggtcactctgcccatggtgtacaattacgtagcccacgttcggcgacagatgcagcacgagctcggcttttgcaagggctcagccaaggacatttacgtggaggtgaaccatatgaag

SEQ ID NO: 48381 - DNA, 572 bp, Heterodera glycines
  SCN-specific regions: Sequence locations=1-42,77-84,131-182,205 -207,235-252,275-420,445-572
ggccgccagagccttccgcagatcggcgcccaaatgcagaacgaagtggacttctgcaaaatgcgctccggcaacatgtggcgtgaggtcacccgcacccaggcctactccaaggtgtcgcacgacagccgtcacaagcgtcaggcaggcggttgctgtggttgttgagtgtcgcccccgggcccgcccggaccccctggcccatcgggacaacccggcggagacggacaacccggaggctcatgacagcccggagcaccaggccaggcagctcctcgcccgtacccgccaagcggcggatgcgtgccgcaatgtgaggccgcccagcccggactccccggcccgcccggaccccccggacccgagggacagaacggccaacccggacagtcggcaccgcccgcgtctcctggccgccccgggccccagggacctcctggacccgatggacagcccggcaaccccggagagtctggccaacccggccagcccggcaaactcacccaggccccgccctccctcggaccgcctggcccagcatgaccccctggccagcccggacagcccggcga

SEQ ID NO: 48382 - DNA, 242 bp, Heterodera glycines
  SCN-specific regions: Sequence locations=1-49,191-194
ggccgccaaggtttgagcgatcgaattcacaccctttcaatttggctatcatgcaaatcttcgtcaaaactctcaccgggaagaccatcacccttgaggtcgaggcaagcgacaccatcgagaacgtgaaagcgaagatccaggacaaggagggcatcccgccggaccagcagcgccttatcttcgctgggaaacagctcgaggacggacgcaccctggccgactacaacatccagaaggag

SEQ ID NO: 48383 - DNA, 433 bp, Heterodera glycines
  SCN-specific regions: Sequence locations=1-433
ggccgccaaggattagctgaatttgacttctctttgtgcgaacgtaatcatgcactgaagcgacaaatggacggcgaaggttttggtaaacagttcgaaaacatgacgaagatgacgagctcgggaacaacggttgttggggctattttccaggatggcgtcgttttgggtggtgattcgcgatccactcaaggcaatataattgctaacaaaaacagtatgaaggtacattacctaaccgacagaatttatgcttccggggccggaggagctgctgacttggaaaaagtttcccaaataatcagtgcggagttgcggttgttcgaattgaatagtggacttcaggcccgcgttgtcatggcggttcgtcggttgcgccaatacctttttaaatatatgggtcacgttagctgctattatttggtcggtggtg

SEQ ID NO: 48384 - DNA, 264 bp, Heterodera glycines
  SCN-specific regions: Sequence locations=1-264
ggccgccaaggcgacagcgaaaatgaccacggggaaagcggagcgaaaccgaagggcatttcggcttccggcggttggttttcggcattcaaatcgctggtgggcaccaaacagcttgcccgaggcgacattgagccggcgatggagaaaatgaaggaaatgctgatcacaaaaaatgtcgcgtcggaacctgctgaacgcatttgtgagtcggttgctgccaaattggagggcaaagtgatcggaacgttcaaccgagttgcg

SEQ ID NO: 48385 - DNA, 463 bp, Heterodera glycines
  SCN-specific regions: Sequence locations=1-463
ggccgcctagcgcccgaattgttaaacaaatcagtcggaggattagctgaatttgacttctctttgtgcgaacgtaatcatgcactgaagcgacaaatggacggcgaaggttttggtaaacagttcgaaaacatgacgaagatgacgagctcgggaacaacggttgttggggctattttccaggatggcgtcgttttgggtggtgattcgcgatccactcaaggcaatataattgctaacaaaaacagtatgaaggtacattacctaaccgacagaatttatgcttccggggccggaggagctgctgacttggaaaaagtttcccaaataatcagtgcggagttgcggttgttcgaattgaatagtggacttcaggcccgcgttgtcatggcggttcgtcggttgcgccaatacctttttaaatatatgggtcacgttagctgctattatttggtcggtggtg

SEQ ID NO: 48386 - DNA, 413 bp, Heterodera glycines
  SCN-specific regions: Sequence locations=1-33,55-413
ggccgccaagttcttcctcgaggaggagggacgcgagggccgtccgttcaaccagaatttaacgccaggctccgtaatccaagagaaggtgacgcgcgcggacatcacggaattctttcttcagccccacgcaccgattcagggaacgggcaaacccgtagaatacgccatgttggaggatgagattggcatcagcatggacgaattgcaaggagtgattatggcgttgtcttactcgcatcagattgtcaatgttgcggtgagcatgcccgagcctgtataccaagcccacgaattggccaagcgagggaaaaacaatttcgtgactttgaagcgtttcaagccggagcgtgtgccaaagattgacaagcaaattgtggcaaagggtggcaagcgtcagatcatttcaattg

SEQ ID NO: 48387 - DNA, 545 bp, Heterodera glycines
  SCN-specific regions: Sequence locations=1-144,171-195,230-230,284 -335,358-360,388-405,428-545
ggccgccaagaaccaacagcagcagaagcaaaaatggctgactttgacaaacacgctgcccagcgcgaggcggagtcgctccgcactttggccttcttcggcgtgtgcctgtccaccgtggccacggttatcgctgtgctttcagtgccgttcgcctaccagcacttccagcagatcggcgcccaaatgcagaacgaagtggacttctgcaaaatgcgctccggcaacatgtggcgcgaggtcacccgcacccaggcctactccaaggtgtcgcacgacagccgtcacaagcgtcaggcaggcggttgctgtggctgcggagtgtcgcccccgggcccgcccggaccccctggcccatcgggacaacccggcggagacggacaacccggaggctcaggacagcccggagcaccaggccaggcagctcctcgcccgtacccgccaagcggcggatgcgtgccgcaatgtgaggccgcccagcccggactccccggcccgcccggaccccccggacccgagggacagaacggccaacccggacagtc

SEQ ID NO: 48388 - DNA, 547 bp, Heterodera glycines
  SCN-specific regions: Sequence locations=1-17,40-134,194-206,278 -476,500-547
ggccgccaagctcctctgacgctcttgacaagatccgttaccaggcgctgaccgacccgtctcagatggagagtgggaaagagctcttcatcaaaatcgtgccgaacaaagccgataagacattgaccatcatcgacactggcattggcatgaccaaagctgacctcgtcaacaaccttggcaccattgccaaatccgggacaaaagcgttcatggaggctcttcaggctggtgcagatatttcgatgattggccagttcggtgttggattttattcggctttccttgtggccgaccgtgtcacggtcacatcaaagcacaatgacgacgattgctaccaatgggagagctcagctggtggctcgttcatcattcgcaattgtgtcgatcctgaagtcacccgcgggacaaagatcgtcctccacctgaaggaagaccaaacggattatttggaggaacgtcgtgtgcgcgaagttgtgaagaaacactcgcagttcatcggttacccgatcaaattgttggtggaaaaggagcgtgacaaggaaat

SEQ ID NO: 48389 - DNA, 242 bp, Heterodera glycines
  SCN-specific regions: Sequence locations=1-49,191-194
ggccgccaaggtttgagcgatcgaattaacaccctttcaatttggctatcatgcaaatcttcgtcaaaactctcaccgggaagaccatcacccttgaggtcgaggcaagcgacaccatcgagaacgtgaaagcgaagatccaggacaaggagggcatcccgccggaccagcagcgccttatcttcgctgggaaacagctcgaggacggacgcaccctggccgactacaacatccagaaggag

SEQ ID NO: 48390 - DNA, 451 bp, Heterodera glycines
  SCN-specific regions: Sequence locations=1-119,143-357,379-451
ccctctagagcggccgccaagattgttattatatattgctcatcgtctgcacactttaatcccacgaagcgacgtgcccggcgcaacaatggcaagagaggactactgcttcgatgcaacggcggcggcagcggcggagcagtctcggccttcggcaacgacttcaacacttgttcttgttatggcctgtcaagcagcttcgtggacgcgatcatcaggaaggtcaggcattcgcctgtccaacgcttcacggatgagatcaccgacgaggagctcaaacaactctgcatggcggccacggacatcttcagaatgcagccgacgctcgtcaggattcagccgccggtcgtcgtcgtgggcgacatccatggacaattcacggacctgcagaggatcttccacacgcacggcaaccctccagagcagcagtacgtcttcctgggcgactacg

SEQ ID NO: 48391 - DNA, 664 bp, Heterodera glycines
  SCN-specific regions: Sequence locations=1-81,108-125,158-164,187 -281,341-353,425-623,647-664
ggccgccagacctattgcttctttaatcaatctctcacaatgtctgaacaatccggggaaacctttgcgtttcaagcggagattgcgcagttgatgtccctgatcataacaccttctactcgaacaaggaaatcttcctccgtgagctgatctccaacttctttgacgctcttgacaagatccgttaccaggcgctgaccgacccgtctcagatggagagtgggaaagagctcttcatcaaaatcgtgccgaacaaagccgataagacattgaccatcatcgacactggcattggcatgaccaaagctgacctcgtcaacaaccttggcaccattgccaaatccgggacaaaagcgttcatggaggctcttcaggctggtgcagatatttcgatgattggccagttcggtgttggattttattcggctttccttgtggccgaccgtgtcacggtcacatcaaagcacaatgacgacgattgctaccaatgggagagctcagctggtggctcgttcatcattcgcaattgtgccgatcctgaagtcacccgcgggacaaagatcgtcctccacctgaaggaagaccaaacggattatttggaggaacgtcgtgtgcgcgaagttgtgaagaaacactcgcagttcatcggttacccgatcaaatt

SEQ ID NO: 48392 - DNA, 467 bp, Heterodera glycines
  SCN-specific regions: Sequence locations=1-64,91-183,209-467
ggccgccgagcaagtttgagatacacaaatcaaaaattagcatttgccatttataccgagcgaaatgggtgcctacaaatacatgcaggaattgtggcgcaagaagcagtcggaggtgatgcgctatttgctgcgcatccgctgctggcaatatcgccaaatggaggccatccaccgctgcacgcggcccacgcgtccggagaaggcgcgccgcttgggctacaaggcgaagcaaggctttctcatttaccgcgtgcgcattcgccgcgggggtcgaaagcgtcaagtgaccaaagggcaaacgtacggaaagccgaaaacgcatggcgtcaaccagctgaagaacacgcgcagtttgcaggccgttgcggaggcccgtgccggccgccgtttgggcgaacttcgtgtgctcaattcgtactgggtgggccaggactcgacctacaaattcttcgaagtcattctcg

SEQ ID NO: 48393 - DNA, 510 bp, Heterodera glycines
  SCN-specific regions: Sequence locations=1-52,74-217,239-407,442-510
gcgtcgtagcttggatccttaacggcgcagcttttgtccttaaatcgcttgactttcgaagaatgacaaagccgaacaagctgcggaaaaaaaggaaagaagttgggaaaccccatgagagattaaagattcaaaactctgtctcaacatttgcgtcggtgagtctggtgaccgtctcactcgtgctgcaaaggtcttagaacaattgactggtcaaactccggttctttcaaaggctcgttacactgtgcgctcgttcggaattcgtcgtaatgaaaaaatcgctgtccattgcacagttcgtggaccaaaagctgaggaaatcattgatcgtgggctcaaagtcaaggaatatgagctttaccgcgagaatttttcggacactggcaattttgggttcggcattcaggagcacatcgatttgggcataaagtacgacccgtcgattggtatctacggaatggacttttatgtggtgctcggtcgtgctggtttgcgggtggcaaaacg

SEQ ID NO: 48394 - DNA, 690 bp, Heterodera glycines
  misc_feature (683)..(683): n is a, c, g, or t
  SCN-specific regions: Sequence locations=1-542,564-690
ggccgccaagaaaacattgaaaactttctccgtgcttatgccggtgtccacttcagcttctgccagcttcttttgctggtcgctgctctgatgttgcccttcactatgctcaaatcgccaaaagatttttggtgggcagtgatcggagcgatggtaaccacgacggtggcagtgagcatcattctcttcgccactgcttccgatttctccgtctgtgcttccgctgctcgttaccctcccgtcactgcttccaagttcttcatgagttttggcactgtgatgttcgcttacggcggccacggcgcctttccgaccattcagcacgacatgcgcaagccgtaccgcttccggcgttccgtgttctgcgcttacctcatcatcttttgtatgtatttgccggtctctttactcggctatctcgcctacggggacagtctgattgactcgatcatcccctccctgcaagacttaatcctgcaacaagccgtcaacattctgatcaccctccacgtggtcttggcacttaccattgtgttcaacccgctcaaccaggagctggaagaactgctaaatgtgccgcaagagttcggatttcggcgaatattatgccgtagtgggatgatgctggcggtggttgcagtggccgaaacaatgcctaatttcggtgtactgctcgacctcgntcggagg

SEQ ID NO: 48395 - DNA, 713 bp, Heterodera glycines
  SCN-specific regions: Sequence locations=1-167,189-392,414-595,617 -629,651-713
ggccgccaagctaattcccaaataatcggagaaaagtcggaaagcggaaaaatggcggacattgaagcggcaccggcaccaaaatcggatgaggaagccaaacggcaggcattggccgccaaaaaggcggaagtgcgcaaacggttggaagaagcagggaaatttggcaagaagaagaagggtttcctgacgccggagcgcaagaagaagctgaggaaactgttgatgatcaaagcagcggagaacctgaagaaccagcagaaacagcttgactcggaacgccaaaatgtgctgagcaagcgaattccgcaatgtccgaatatcgacgcaattgaggacaaaggacagctggagaagatgtacaacgacctgttccagcaaatgctcaagttggaggaggagaagtacgacatcaacttcgtggtctcgcaaaaggacgcggagatcagcgaaataaccatttctgtgaatgatttgcgtggaaaatttgtgaaaccaacgctgaagaaagtgtccaaatatgacaacaaattccgcaaagcggcattaacggagggcgaaagtaccgcgccgaaggaggacttccgatcgaaactgaagacggtggagaagaagaacgtgatggaagagttggagagcaagcagaagaacaggcggagaagccggaatggacgaagaatgtggaaaatgacgccacgggacgccgggcgagc

SEQ ID NO: 48396 - DNA, 624 bp, Heterodera glycines
  SCN-specific regions: Sequence locations=1-36,58-247,269-542,564-624
gccagacattgttaaaaaccgtgccgtacaacatccttcactgggtcggcatactgattatactccaaatgtccaagtttctcgatgtccgacaaatgcatttgaacattcactgctgtacgcaatgggtttaactccatctccacacatttgtaaagtgcgtaggcggcgggcgaggccaactcggggatgtgcagtcggacaatttctttgaggattccgcttcggcttggcgtaattggcaaacgtaaaagagacgaaagaatgcgaatattggccgagtgttgctcctcaatgtgcaagtgtgtcgtcaacatcgacgcactctccgccccctccggaatgctcaaagttgccaacaacacgcgggttgcttgatccatcgcctcttcaccgccaaattggcggcgcatgtgtttgaaaatgcaaaaccgttgaagcagcgaagcggcgtggaaaagaatgttgccgcccttccaaaaaaccaaagaaatcttctcgtaataattggcatagctagtcggtcggatgatttttttgtgcttctctttaccaagttgcataaaactgtgcaaatcttccgcacttttgaacgcttcctgccacaagtccatgttaatcgcg

SEQ ID NO: 48397 - DNA, 223 bp, Heterodera glycines
  SCN-specific regions: Sequence locations=1-49,86-87,137-137,172-197
ggccgccaagaccctttcaatttggctgtcatgcggggggtgggggaggactctcaccgggaagaccatcacccttgagggggaggggagcgacaccatcgagaacgtgaaagcgaagatccaggacaaggagggggtcccgccggaccagcagcgccttatcttcgctgggaaacagctcgaggacggaggcgcgtggggcgactacaacatccagaaggag

SEQ ID NO: 48398 - DNA, 195 bp, Heterodera glycines
  misc_feature (53)..(53): n is a, c, g, or t
  misc_feature (185)..(185): n is a, c, g, or t
  SCN-specific regions: Sequence locations=1-195
ggccgccaagaaaagggagttgacctttcgtcgttttctgggtctgggcctantgggcggattttggctgccgatttatcaaaggctgaaggggaatttacgagccgtgggactcaaagctccgcgtcttcgttcatcgatattccgctttcgaacatgcgcaaaacaattgcgaagcgtcttantgaggcgaag

SEQ ID NO: 48399 - DNA, 528 bp, Heterodera glycines
  SCN-specific regions: Sequence locations=1-66,129-150,173-267,303 -378,405-528
ggccgccagatcaatctctaacaatgtctgaagcgtgcgggggagacctttgcgtttcaagcggagattgcgcagttgatgtccctgatcatcaacaccttctactcgaacaaggagatcttcctccgtgagctgagctccaactcctctgacgctcttgacaagatccgttaccaggcgctgaccgacccgtgtgagatggagagtgggaaagagctcttcatcaaaatcgtgccgaacaaagccgataagacattgaccatcatcgacactgggattgggatgaccaaagctgacctcgtgaacaaccttggggccattgccaaatccgggacaaaagcgtgcatggaggcgcttcaggcgggggcagatatttcgatgattgggcagttcggtgtgggattttattcggctttccttgtgggcgaccgtgtgacggtgacatcaaagcacaatgacgacgattgcgaccaatgggagagctcaggtggtggctcgttcatcattcgcaattgtgccgatcctgaa

SEQ ID NO: 48400 - DNA, 531 bp, Heterodera glycines
  misc_feature (31)..(31): n is a, c, g, or t
  misc_feature (474)..(474): n is a, c, g, or t
  SCN-specific regions: Sequence locations=1-123,158-221,243-531
ggccgcgaattgctttcttctctccctttantgagggtgtgaatggtgagcattaaggtgttaaaatttttcgcagtcaattttccaacgtctcttctgtgaaaatgtcatctgacaagaacaaggaacgcactttcatcgccatcaaacccgacggtgtccagcgcggattgggtgccaaaatcattaaacaattcgagcagcgtggttacaaattggttgccatgaaacttgccaaggcgactgtgccccatttggaggtgcactaccaagacctcaaggacaaacctttctttgccgggctcgtcaaatacatggcatcaggcccgattgtggctatggtttgggaaggtttggatgtggttaaacagggtcgcgttttgctcggcgctacgaatccgttggccagtgccccagggactattcgtggcaatttttgcattgagatgggacgtaacatttgccacggctccnattcggtgccttctgccgaccgtgaaattgcccattggttcaagccggaagaactcg

SEQ ID NO: 48401 - DNA, 288 bp, Heterodera glycines
  SCN-specific regions: Sequence locations=1-9,38-107,135-200,224 -227,270-288
atagcaatgcgtcgtgcaccaccaactgcttagctccgttgggcgaggtgatcaacgacgagtttggcatcatcgaaggactgatgaccactgtgcatgcggtgaccgccactcagaagacggtggacgggcccagcggcaaacaatggcgagacggacgtggcgcggcgcaaaacatcatcccggccagcgccggggcagccaaggcggtgggcaaagtcatcccggagctgaacggcaaactgaccggcatggcgttccgtgtgcccactccgaacgtgtccgtcg

SEQ ID NO: 48402 - DNA, 167 bp, Heterodera glycines
  misc_feature (164)..(164): n is a, c, g, or t
  SCN-specific regions: Sequence locations=1-167
ggccgccaagtaaccatatcaaatggctacttacaatcccaactatgaatccattgggcaggcctttgtccaacacttttacaccaaatttgatgtgcccgatggtgcgactcgcaccgtcggccttcatgatttgtatgatgctgaacactcttttatgactnttg

SEQ ID NO: 48403 - DNA, 568 bp, Heterodera glycines
  misc_feature (537)..(537): n is a, c, g, or t
  SCN-specific regions: Sequence locations=1-50,73-568
ggccgcacaagtgagaaatggcattgtcaacgaaggtggtgccgcgggctttttcttcgctcttctgcattttgtgcaccaattgcttgcagtcggatggcaaagtcggacgtgccggcgctgagcacgacgaatcagccctacccgtacaaggaacagactccgaagggggttttcgagaagatgggcttgcggaaaacgccggacggcgcttcaatcggcgaatttgcagtgatgcgtatggacgacatgatgaacttgatcgggcgtggctctctttggccattgaccttcggtttggcgtgctgtgctgttgaaatgatgcattttgccgctcctcgttatgacatgatgcggtttggcgttgtttttcgtgcaactcctcgtcagtgcgacttgagcatcggctctggcacagtcacaaacaaaatggcaccggcactgagacggagctacgaccaaatgccgcatccaaaatgggtgatcagcatgggctcctgtgccaacggtggcggggattaccattattcctattcngtgttgcgcgggtgtgaccgggtcatccctg

SEQ ID NO: 48404 - DNA, 299 bp, Heterodera glycines
  misc_feature (30)..(30): n is a, c, g, or t
  misc_feature (135)..(135): n is a, c, g, or t
  SCN-specific regions: Sequence locations=1-299
ggccgccaagaccaaaccgatttggactcncaatcccgatgacgtgtgaaatgaggagtatgcggagttctacaagagcttgtcaaatgactgggaggaccatcttgctgtcaagcatttcagcgttgaaggccnactcgaattccgtgctctcctcttcgtcccccaacgcgctccgttcgatctctttgagagcagaaagagcaagaatgccatcaagctttatgtgcgtcgggttttcatcatggagaactgcgaggagctgatgccggagtacctgaacttcatcaaaggagttg

SEQ ID NO: 48405 - DNA, 640 bp, Heterodera glycines
  SCN-specific regions: Sequence locations=1-478,501-640
ggccgccaaggggcactaaagttttcatttttactgctattcattcaaaatgactcaaaatgggatgacaacagccagcaatgagttcaacgagctcaatgatttcctgtcaacgcgcgcttatcttcacggttttctgccgtcccacgaagaccaatatgtgttcaaatgcattgcggctgctccctccgccagcgaatatccgcacattgcgcgttggtacaagcacatcaaaagctacgaggatgctgaacgtgccacttggccaaagaaggctggacagccgccgcagaaagtcgtttcgaaagacagtgcaccaccggcaaagaaagccgacgccgaggaggacttcgacctgttcggcgacgaggacagcgatgatgaggagaagaagcgaatcaccgaggagcgcctgaaagcgtacgcggagaaaaaggcgaagaagccgggcccggtggccaagtcgaacgtcatctatgacgtgaagccgtgggacgacaccattgacatcaaggacattgaggccaatgtgcgctccatcgaatgtgacgggctcgtgtggggcacgtcccgaattttgccggtcgcattcggcgtgcagaagttgcagattggatgctgtgtcgtggacgagaaggtg

SEQ ID NO: 48406 - DNA, 355 bp, Heterodera glycines
  misc_feature (96)..(96): n is a, c, g, or t
  misc_feature (331)..(331): n is a, c, g, or t
  SCN-specific regions: Sequence locations=1-355
ggccgagcgcacagtccggattcgggtacagagaagcgaagagatggagagcagcactttcgaaatggtcaacgccggagcccacatctgcttcanaatgtccaaacaaatgtcgcccctttctccaacgttcggatggtgaatgtcgttgatgaatttgacaatcggcggagtgcatgggtagtcgcggcgcaaaacgatgtccaaatgaaaggtgcctcacttcgtacggcgactcgggcggtcctttgatggaggccctccaatggtgcaagtctttgccgtcatccatcggtgtcgcggtgcaacccgtgatcggttcctgcttcanctccgccagttcctgtgtgatgcg

SEQ ID NO: 48407 - DNA, 409 bp, Heterodera glycines
  SCN-specific regions: Sequence locations=1-409
ggccgcaagggctgagtcgtgcgactttttgtcctcaccaattacgccaaaaagctgtcaaaacgccgttacagaaagcggtcacttcggcggcagagcgtgcgcttgacattgtcggcaatgcgtcgcgagtgcggcttcaggacttgagggacaacccgggcgcgaggacggtgggcaggcaagtgcgcgcgaagggccacaaccaagcgggtcacaccattggcgagttgcaacacgcgtcgaagccgccgctcggctgggtttggggcgactattacaaaccttggcagcggtcctttgacggcgacagacgcttcaacggggacataaatctccgccgtgaatacattcccatttctttggtggagcttcagcgcctcatcgacttgggctggttggacacgag

SEQ ID NO: 48408 - DNA, 343 bp, Heterodera glycines
  SCN-specific regions: Sequence locations=1-343
ggccgccaagtgagactgaaatataaaccacaaataagccgacgagagcgaaatggctccacgaggaaacaacatgcttcccaatgcccacttcccaagcattggcagcgtcgtatcaaaacttgggtcaaccaaccggcacgcaaggaacgtcgccgcgctgcacgttccgccaaggcggcccgattggcaccgcgtgcggccggcggtctgctgcgccctgttgtgcgttgcccaagcgttcgctacaacaagaaatgccgggtgggccgcggcttcacactggaggagttgaagcggtccggcatgggcaaatacgaggccagatcgttgggcattgcgg

SEQ ID NO: 48409 - DNA, 654 bp, Heterodera glycines
  SCN-specific regions: Sequence locations=1-209,233-288,311-410,437 -506,530-555,584-654
ggccgccaaggtttgagattgttttctcagccaacttccgcttaatcttcagaccttcactattttcttgtttaaaaaagttgcaacgatggtgaaaccaaaggttggcatcaacggttttggacgtattggacgcttggcattgcgtgcagcgattgaaaaggacactgtccaagtggtggcggtcaacgacccgtgtcatcaaactcgactacatggtgtacatgttcaactacgactccacccatggccgtttcaagggcaaaatttccacaaacgccggcaatttggtggtggagaaggaggggaagagcgcgcacaccatcaaagtgttcaacctcaaagacccggccgaaatcaaatggggcgaagcgggcgcggaatatgtgattgaatccaccggagtgtttaccaccattgagaaggcatctgctcatcttaaaggcggcgccaagaaggtggtcatctccgctccgtctgcggatgcgccgatgtacgtgatgggcgtcaacgaggacaagtacgacccggctaaggacgacgtgatcagcaatgcgtcgtgcaccaccaactgcttagctccgttggccaaagtgatcaacgacgagtttggcatcatcgaaggactgatgaccactgtgcatgcggtgaccg

SEQ ID NO: 48410 - DNA, 236 bp, Heterodera glycines
  SCN-specific regions: Sequence locations=1-49,99-99,185-203
ggccgccaaggcgatcgaattcacaccctttcaagggggcgatgaggcggatcttcgtcaaaactctcaccgggaagaccatcacccttgagggggaggcaagcgacaccatcgagaacgtgaaagcgaagatccaggacaaggagagcatcccgccggaccagcagcgccttatcttcgctgggaaacaggtcgaggacggacgcaccctggccgactacaacatccagaaggag

SEQ ID NO: 48411 - DNA, 391 bp, Heterodera glycines
  SCN-specific regions: Sequence locations=1-140,165-198,233-246,275 -363,385-391
ggccgccaaggttgaaccaacagcagcagaagcaaaagtgggggggttcgacaacacgctgcccagcgcgaggcggagtcgctccgcactttggccttcttcggcgtgtgcctgtccaccgtggccacggttatcgctgtgctttccgtgccgttcgcctaccatcacttccagcagatcggcgcccaaatgcggagcgaagtggacttctgcaaaatgcgctccggcaacatgtggcgcgaggtgacccgcacccaggcctactccaaggtgtggcacgacagccgtcacaatcgtcatgcaggcggttgctgtggctgcggagtgtgacccccgggcccgcccggaccccctgggccatcgggacaacccggcggagacggagtacccg

SEQ ID NO: 48412 - DNA, 300 bp, Heterodera glycines
  SCN-specific regions: Sequence locations=1-300
agaaaacgaaatgggtcccgaggaaacaacatgcttccaatgcccacttccacaagcattgggagcgtcgtatcaaaacttgggtcaaccaaccgggacgcaaggaacgtcgccgcgctgcacgttccgccaaggggggccgattgggaccgcgtccggccgggggtctgctgcgccctgttgtgcgttgcccaagcgttcgctacaacaagaaatgccgggtgggccgcggcttcacactggaggagttgaagcggtccggcatgggcaaatacgaggccagatcgttgggcattgcgg

SEQ ID NO: 48413 - DNA, 239 bp, Heterodera glycines
  misc_feature (11)..(11): n is a, c, g, or t
  SCN-specific regions: Sequence locations=1-239
ggccgccaagngttgagccatcagcagagaaaatgaccgagtggggcagtcgcattcgggcgtacaaattcgttgcctattcgggcgtgactttctccatcgtgggcgttctctctgttgtgggcactctgcccatggggtacaattacgtagcccacgttcggggacagatgcagcacgagctcgggttttgcgagggctcagccaaggacatttacgtggaggtgaaccatatgaag

SEQ ID NO: 48414 - DNA, 535 bp, Heterodera glycines
  SCN-specific regions: Sequence locations=1-535
ggccgccaaggttattattcatacaatgtctaccttttattggggaatgtttcttcgaattgggtgaaatatttatctcttgggacggctttggtcgttggctatgcagtttacattgaccgtaaacgtcgccttgacccggaatacaaacaaaaaattcgtcaaaacaggaaacagaaacaagccaactttttgtacgcaaaaatgagcggaggagttgattttcccgacccaagtgatccacaggcgaatgagatcttcttcttcagtcagatcactcttggagaggagaaaatgcagactgggcacattgaggaggggattacgcatctgtcgaatgcaattgtgacttgctcgaagcctgacgaattgctcagaattttccaacagaccatcccaccggagtgtgtcagtttgcttgtgcaggcgattcctggcgccaaaatgcgtcggaatgcctcttcatcgtatcgccatgggcgagagccgattgatttagactgtgcaaagattgacgatattggtgacaatgcgg

SEQ ID NO: 48415 - DNA, 213 bp, Heterodera glycines
  SCN-specific regions: Sequence locations=1-213
ggccgccaagccgagtcggacggtcgcattcgggcgtacaaattcgttgcctattcggccgtcactttctccatggtgggcgttctctctgttgtgggcactctgcccatggggtacaattacgtagcccacgttcggcgacagatgcagcacgagctcggcttttgcaagggctcagccaaggacatttacgtggaggtgaaccatatgaag

SEQ ID NO: 48416 - DNA, 567 bp, Heterodera glycines
  misc_feature (310)..(310): n is a, c, g, or t
  SCN-specific regions: Sequence locations=1-326,348-427,449-567
ggccgccaagttcgaatttaaaaattccttcgcttttcccaatgtgcccacttttccttctgctcagtgcttttgctttgactgcgttttgcctttttcctccttcgttcgctgccaaagatgcgcaacaattggtcgaggatggcaaaattgggcaaatgccaccgaaatgtttgatgagcctcggggagcaaaagtcgaaatggcacgacgagggggaaaagattgaggctggttccattgtttacgagtgccgtggggcgaaaatggtgccaatcggatgtttggacgaatttggccaacaaattcnacttaatgagacgaccgtggcgaagggccttctgatgcgatgctcactttcgcgttgggcgaccgatttgcaattgaaaatcattggctgtgtgccgaagggaaaagcgaacgaaaccattttggtaggagagaaatggacagagaaagagagtcagacgtggtgggaatgcgcggcggagggaacgaccgtcagagcacggcttggcggatgtgtggacgagccgagtcggagccgacttcgcatcggcgaaagcg

SEQ ID NO: 48417 - DNA, 311 bp, Heterodera glycines
  SCN-specific regions: Sequence locations=1-179,202-311
ggccgccaagctccgatctcattgcaaaaaatggttgtatgttggcgggcaggacgaccatgaatacggcccttacacttccactgagatgttgcattggctgaacaactcttatttcgatggctcccttcggttgcgcactacgaatgacaaccgtttttacacactttccgagtggattcaagcttgtgggaatgagattccctttgcgttggatgtgcattctatggagtctttacgtgccaccgccaacagtcgaaattaccggggcatccaaccgaccattgacagtgtgcacaaccaccagcagg

SEQ ID NO: 48418 - DNA, 354 bp, Heterodera glycines
  SCN-specific regions: Sequence locations=1-331
caaggtgtgtgaatttcgaaaaaatgggcggaattcacggcgtggggcgtccggacaacagcacaaagtcgtgcaaagctcgtgggtcagatcttcgtgtgcatttcaagaacacacatgagacggcgcgtgccatcaaacatatgccgtggaagcgtgccatccgctttctggagaatgtacgggagaagaaggagattgtgccgttccgccacttcaacggcggcgtgggacgcaaagcgcaggcgcaagcgtggggcacaacacagggacgttggccgaaaaagtccgccgagttccttctccaacttctcagaaatgcggagagtaatgccgaggtgaagggcctggacg

SEQ ID NO: 48419 - DNA, 448 bp, Heterodera glycines
  misc_feature (210)..(210): n is a, c, g, or t
  SCN-specific regions: Sequence locations=1-332,354-381,403-448
ggccgccaaggttggaggaaagaaaatgcacgaagcgaagagatggtgggaattgcttccctttgttcgctggccgcgattttggccactctcgtggggatcccgcaactatacactcaaatcaacgaaatgaacaaccgcgtgatggacggtgtgcaggctttccgcgtgaacacggattccgcgtggactgagctgatggaggtgcanatcagtgtgactccaccgacccgtccgcgagagaatcccttcaactccattttcctacgccaaaagcgccagggattgcctccccaatgcgtttgccaactgcagcagccaagctgtgctcctggggctcctgggccgcctgggccccccggaacacccggcgagcccggcggcgccgggcatccgggaagcccaggacagcgccggacaacaagcaccgccatgccctccgcccgtg

SEQ ID NO: 48420 - DNA, 124 bp, Heterodera glycines
  SCN-specific regions: Sequence locations=1-124
ggccgccaaggccaacggtcagtaagcgcgatgaagcttgtgcgctttttgatgaaattgtcccatgagtcggtgaccatcgagctgaagaacggcacacaagtgagcggtgctattcagggcg

SEQ ID NO: 48421 - DNA, 369 bp, Heterodera glycines
  SCN-specific regions: Sequence locations=1-369
ggccgccaagaagatttcttaacccgactatttgttgctgagtcggtcgtttagctcatcataatcacctcataatattatattgaatgcttatattgcaagaattggatccgccgacagaggcggtgatcgaaacggagggtcaagtggtcgctcattgggaaaatcattgccttggccagggaactttatattggatagagagcgctttggtttggataagccacggcactaaaaatgggtttcgtttgcctattccgtcaattgtcgtccatgcagcatccggagccaatgaggacttttccgagccatgcctttttctgatggttgactattcaaagactgacattgaatacgttcccgcggagg

SEQ ID NO: 48422 - DNA, 297 bp, Heterodera glycines
  SCN-specific regions: Sequence locations=1-297
ggccgccaagggaaatggtggcgaggattttgcccgaatgtgtggaggaatttcagcggacgtggggcaatcgaagcgaagtgaaaattgacaatgagtactttttgtccccggaaagtgcgggcggcgtctaattgttggccaaagacggcaaaatccgcgtctcgtccactttggaagcgcgtctcgacctcattgccgacaaaatcactccccaagttcgcactgctctgttcggtcccaatcagaaccgccgcttcttcgactgatcggtgccttcgcttcgaccattccatt

SEQ ID NO: 48423 - DNA, 275 bp, Heterodera glycines
  SCN-specific regions: Sequence locations=1-275
ggccgccaagccttaagatggcccgtcgctatgatactcgtgcgacaatcttctctccgaaggccgtctctaccaagttgaatatgcaatggaagcaattggtcaggctgggacttgtcttggaattcgagctcccgatggcattttcattgctgcacaaaaactaacggcaaacaaattgcttgatgatcgaatcatgagcgagaaaatctacaaggtgtcggcgaacatcttctgcacggtggcggggatcaccagcgacgcgaatgtgctgg

SEQ ID NO: 48424 - DNA, 285 bp, Heterodera glycines
  SCN-specific regions: Sequence locations=1-17,40-285
ggccgccaagcaagtttgagaccaaatgggtcagaaattagctggtggtcttgacgattattttcatcctgagacggcacctcgaattgacagaccaccgacgtttgatcctttgtatggttttccaaagggtcgcaagccaagagaaatgcaggcttcgtgggaagaattggagaaaatgaaaatgccgattagtgagcgagattattgtgcccataaaatggttgctttgcgcaaatgcgtttgggatagggcgccatttgcctcgcattattgccatggacg

SEQ ID NO: 48425 - DNA, 275 bp, Heterodera glycines
  SCN-specific regions: Sequence locations=1-275
ggccgccaagccttaagatggcccgtcgctatgatactcgtacgacagtcttctctccgaaggccgtctctaccaagttgaatatgcaatggaagcaattggtcaggctgggacttgtcttggaattcgagctcccgatggcattttcattgctgcacaaaaactaacggcaaacaaattgcttgatgatcgaatcatgagcgagaaaatctacaaggtgtcggcgaacatcttctgcacggtggcggggatcaccagcgacgcgaatgtgctgg

SEQ ID NO: 48426 - DNA, 499 bp, Heterodera glycines
  SCN-specific regions: Sequence locations=1-308,337-499
ggccgccaaggtttgagaacttaatttgaggattacattggaaataaattaattagacttcaaaatgggcatttcccaagacagatggcacaagcggcgaaagactggggggaagcgaaaccccattcacaaaaaacgaaagttcgaaatgggacggccggcagcaaatactaagattggtcctaaacgaattcatttggtgcgttgtcgtggcgggaacattaaacatcgcggacttcgtcttgataccggaaactttgcttgggcttctgaagggtgcactcgcaaaacgcgtatcatcgacactatgtacaacgcttccaacaacgaattggtgcgcaccaaaacattggtcaagggaatgatcgtctcaatcgatgccattccgttccgccaatggtatgaagcgcattacgcactgccattggcgcgcaaaaagggacaaaagttgaccgaagatgaggaggcgcggattggaggagcacaaaaacgctcaaag

SEQ ID NO: 48427 - DNA, 337 bp, Heterodera glycines
  SCN-specific regions: Sequence locations=1-249,277-337
ggccgccaaggctaagcgaaacggaggtggaggagaagaaaaagcgtgtggcccagtcgccaggagggcttgacccgcaagaagtgttcgactcactgcctgcggaaatgcaagaagcgttcgaaacacagagcatggcaaagatatttgaagtggcgaagagcatggactccgaggtgttcaagtaccatttggatcgctgcactgcctccggactttggattccaaacgcaaaggaagccgagggacatggacaagaggaggaggagaaggaaacggaggagaaatgaccgatactcaactcaaagatatggtaaaccatgagaatacgtttaag

SEQ ID NO: 48428 - DNA, 236 bp, Heterodera glycines
  SCN-specific regions: Sequence locations=1-236
ggccgccaaggccggatgtgccgcagatcgctccatttttctgttcgacacccgccagaaagtgccgctgagccgcgtagtgctcaaactgaggacgaacagcattgcctggcatccgcttgagccgttcacttttgttgctgcaaatgaagactacaatttgtacaccttcgacatgcgcaggttggactccgctcgccacgtccaccaagggcacacctccgctgtgatggacg

SEQ ID NO: 48429 - DNA, 509 bp, Heterodera glycines
  SCN-specific regions: Sequence locations=1-509
ggccgccaatattgcacactaaaacaaattactgtgaaacatgggaaccgaacttgatgaaaatgcagtgcttgctgatccttggagcactgttgaacatgtgagcggtggacgagtcaatgcaccaattggtcaccctgaacctttccgaaattaaactgttcagggagtggtatcttaatgacgtggacttttccgtcctttcactttttgattatgtcgcggtgaatagaaaatgcggataaatatttgccgcccaaatgcggttgttatctgcataaccgcttccgtcaggttacctgttcagtggtggaacggttggactcgtcactgatgatgtactggcggaacaaccgtgatagactgatggtggtgcgcattgtgaaacatgtctctgaaatcattgatcttatcaccgcatagaacctcgttcaattgttacataatgctgtgataggcgacggacttagtgcggattacgctccttttttccttgcgggtgcttgtaa

SEQ ID NO: 48430 - DNA, 337 bp, Heterodera glycines
  SCN-specific regions: Sequence locations=1-4,26-337
ggccgccaagaagccaccaaaaatgcgtttgtcatttctccgtgccagcgagaaacattttggcaatttgtcgaaggcttacggttggtattacgttcgcattgctccggttgaacagaaagtatggaagggctttttctttgatgcgtttgttaagccggtcaaagagcagttgccccactggtggatgttcttcttccccgtagtcacttactttttggtcaccgactgggccaagaaagagtaccgtcgtctgggacggatcaaagaattcactgacgaagaatgaatgtcgaattggccattcggactgttatttgtaggaaagaccaccgag

SEQ ID NO: 48431 - DNA, 345 bp, Heterodera glycines
  SCN-specific regions: Sequence locations=1-345
ggccgccaaggttttcgacatgaatagcctgtatttcgaggatttgttcaccgtcaaaaacattgaccccgatgggaaaaagttcgacagagtcagtcgtctcttttgtgacagcgaatcattcaaaatggacctcattttggatgtgaacacccaactctacgccatgggaatcaacgacaaattccggttgatgctttgcacttcgattcgggacgacggactcaccgaagagggcgaatacgacaaatcaatagaaaacattccccgggttcgaatgttcgaatatgtgatgtacggcaaaatttaccggattgagaacgacgagggcaccgcagaaacgag

SEQ ID NO: 48432 - DNA, 259 bp, Heterodera glycines
  SCN-specific regions: Sequence locations=1-259
ggccgccaagattagctgttagtcttgacgattattttcatcctgagacggcacctcgaattgacagaccaccgacgtttgatcctttgtatggttttccaaagggtcgcaagccaagagaaatgcaggcttcgtgggaagaattggagaaaatgaaaatgccgattagtgagcgagattattgtgcccataaaatggttgctttgcgcaaatgcgtttgggatagggcgccatttgcctcgcattattgccatggacg

SEQ ID NO: 48433 - DNA, 214 bp, Heterodera glycines
  SCN-specific regions: Sequence locations=1-214
ggccgccacgacaacgcaccaaatgaattcgtttaggaccaatcttagtatttgctgccggccgtcccatttcgaactttcgttttttttgtgaatggggtttcgcttccccccagtctttcgccgcttgtgccatctgtcttgggaaatgcccattttgaagtctaattaatttatttccaatgtaatcctcaaattaagttctcaaacttgg

SEQ ID NO: 48434 - DNA, 520 bp, Heterodera glycines
  SCN-specific regions: Sequence locations=1-235,257-344,367-520
ggccgcggcgatgatcggcgacagcaggaggccgaacaccgggtacagcacgccggcggcgatcggaatgccggcggcgttgtagatgaaggcgaagaacaggttctgccggatgttggccatggtcgcctgcgacagccgccgcgcgcgcacgatgccggtgaggtctcccttgagcagcgtgacgccggcgctctccatggcgacgtcggtcccggtgcccatggcgatcccgacctcggccgccgccagcgccggcgcatcgttgacgccgtcgccggccatcgccaccaccttgccctgcgccttcagcttcgcgaccacggcgctcttctgctcgggcagcacttcggcctcgacctcggcgatgccgagccggcgtgccacggccgcggccgtggtgcggttgtcgccggtcagcatgatgacgtggacgccttcggcttcgagcgcgcgcaacgccgccggcgtggtcggcttgaccggatcggcgatcgcgatcagcccggcgagctggccg

SEQ ID NO: 48435 - DNA, 215 bp, Heterodera glycines
  SCN-specific regions: Sequence locations=1-112,149-193
ggccgccaaggtttgaggagagttgaaattttatcttttgaaaatcgtctagacctatttaatttttcgaaaaatgtctgacaacaaagaagaactcgttcagcgggctaagttggctgagcaagctgagcgctacgatgacatggctcagtcgatgaaaaaggtgacggaattgggtgcggagttgagtaatgaggagcgcaacctgttgtcgg

SEQ ID NO: 48436 - DNA, 450 bp, Heterodera glycines
  SCN-specific regions: Sequence locations=1-328,351-450
ggccgccaagcaagtttgaggaaagaaaatgcacgaagcgaaaatatagtcggaattgcttccctttgttcgctggccgcgattttggccactctcgtggtgatcccgcaactatacactcaaatcaacgaaatgaacaaccgcgtgatggacggtgttcaggctttccgcgtgaacacggattccgcgtggactgagctgatggaggtgcagatcagtgtcactccaccgacccgtccgcgagagaatcccttcaactccattttcctacgccaaaagcgccagggattgcctccccaatgcgtttgccaactgcagcagccaagctgtcctcctggtcctcctggcccgcctgggccccccggaacacccggcgagcccggcggcgccgggcagccgggaagcccaggacagcccggacaacaagcaccgccatgccctccgcccgtg

SEQ ID NO: 48437 - DNA, 283 bp, Heterodera glycines
  SCN-specific regions: Sequence locations=1-283
ggccgccaaggtccaattaagaaaaaattaagcccagtccttccttaatattcatcgtaacccatccatctaaatggcagaacagcgcgaggaccacatccaacgggccaagctggcggaacaatgcgaacgctacgacgaaatggccaaggagatgaagcaggtggccgaaatgagcgtcgaactcaccgaagaagagcgcactttgctgtccgctgcgtaccgaagggcgatcagcactcgtcgttccgcgtggcgtgtcatcgaatcccatgtgaaaaag

SEQ ID NO: 48438 - DNA, 286 bp, Heterodera glycines
  SCN-specific regions: Sequence locations=1-286
ggccgccaagaaacaaattcgaacttgttgggtgtggcgtaagaacaaccgttggtggcgttatttgccgcgacgtaacgactcccacaacctaatcgacatggacgagctgggcgaacaatgcgccactttttccgacccaatgcccgccgatccacccaaactttgggtggcgtggctgtacacagattcttacgggtcgggacgaaagatcagggaccaggtgacaaagctctttggcaaagacgcgaaaacgggcgaaatgcaagtgttcaaaaacacactg

SEQ ID NO: 48439 - DNA, 215 bp, Heterodera glycines
  SCN-specific regions: Sequence locations=1-215
ggccgccaagcgcaattcgtattggggggtcaaatcgacggaagtgacgaagaaattatttgcggaccttcgctccgattatcccgaaacgattgggcagaatttcgatgtgaaatttgtgcgcgacttgacgacgggttatgacaacgctcaaccggatgacagggccattctgccgctgagcacctcctccgaaatggtgacgttcactttgg

SEQ ID NO: 48440 - DNA, 233 bp, Heterodera glycines
  SCN-specific regions: Sequence locations=1-40,182-185
ggccgccaagatcgaattcacaccctttcaatttggctatcatgcaaatcttcgtcaaaactctcaccgggaagaccatcacccttgaggtcgaggcaagcgacaccatcgagaacgtgaaagcgaagatccaggacaaggagggcatcccgccggaccagcagcgccttatcttcgctgggaaacagctcgaggacggacgcaccctggccgactacaacatccagaaggag

SEQ ID NO: 48441 - DNA, 235 bp, Heterodera glycines
  SCN-specific regions: Sequence locations=1-42,184-187
ggccgccaagcgatcgaattcacaccctttcaatttggctatcatgcaaatcttcgtcaaaactctcaccgggaagaccatcacccttgaggtcgaggcaagcgacaccatcgagaacgtgaaagcgaagatccaggacaaggagggcatcccgccggaccagcagcgccttatcttcgctgggaaacagctcgaggacggacgcaccctggccgactacaacatccagaaggag

SEQ ID NO: 48442 - DNA, 422 bp, Heterodera glycines
  SCN-specific regions: Sequence locations=1-300,323-422
ggccgccaagcgaaaatatagtcggaattgcttccctttgttcgctggccgcgattttggccactctcgtggtgatcccgcaactatacactcaaatcaacgaaatgaacaaccgcgtgatggacggtgttcaggctttccgcgtgaacacggattccgcgtggactgagctgatggaggtgcagatcagtgtcactccaccgacccgtccgcgagagaatcccttcaactccattttcctacgccaaaagcgccagggattgcctccccaatgcgtttgccaactgcagcagccaagctgtcctcctggtcctcctggcccgcctgggccccccggaacacccggcgagcccggcggcgccgggcagccgggaagcccaggacagcccggacaacaagcaccgccatgccctccgcccgtg

SEQ ID NO: 48443 - DNA, 245 bp, Heterodera glycines
  SCN-specific regions: Sequence locations=1-52,194-197
ggccgccaagcaagtttgagcgatcgaattaacaccctttcaatttggctatcatgcaaatcttcgtcaaaactctcaccgggaagaccatcacccttgaggtcgaggcaagcgacaccatcgagaacgtgaaagcgaagatccaggacaaggagggcatcccgccggaccagcagcgccttatcttcgctgggaaacagctcgaggacggacgcaccctggccgactacaacatccagaaggag

SEQ ID NO: 48444 - DNA, 233 bp, Heterodera glycines; identical to SEQ ID NO: 48440
  SCN-specific regions: Sequence locations=1-40,182-185

SEQ ID NO: 48445 - DNA, 397 bp, Heterodera glycines
  SCN-specific regions: Sequence locations=1-43,66-101,123-397
ggccgccatcgcctgttccttgatcactttttcgggcagtggcaaataaatactcaaaatggaatcgacgaatcggacgaggtttggggtggccgaaaggtgaagctgaagccgatcattgggcaaaggggtgcgcagcagcggagccaaacagccgaagacgagcgcatcgatagagcatggcttgtcgccacagaaatatttgttgtctgacaactttgccgaaagtaaattcagtgcctgaattgcatccaaagttagctgttgttggttcttcctgatcgctctgactgttgtgtccattcgtctccgtctcctttccatgtaataaatgttgtatgggaaggtgacctgttgggcatagagagggtgcacaattgtgccgtaattgcatttg

SEQ ID NO: 48446 - DNA, 237 bp, Heterodera glycines
  SCN-specific regions: Sequence locations=1-44,186-189
ggccgccaggagcgatcgaattcacaccctttcaatttggctatcatgcaaatcttcgtcaaaactctcaccgggaagaccatcacccttgaggtcgaggcaagcgacaccatcgagaacgtgaaagcgaagatccaggacaaggagggcatcccgccggaccagcagcgccttatcttcgctgggaaacagctcgaggacggacgcaccctggccgactacaacatccagaaggag

SEQ ID NO: 48447 - DNA, 571 bp, Heterodera glycines
  SCN-specific regions: Sequence locations=1-507,529-571
ggccgccacatttgaagaggaaatcatcgacgattatttctcacctgttttgaaaatgaaaggccgagcgaaacaacaacaacggatgggcagtttccccgactttttgcttttgcaacttggcagattcgcatttgattggattctcggtacgcagcataaattggacgtggacgtgcatgtttcggacgaattggacattaacgcgttcttttcaacgggagaattacagccgaacgaaaagagtttgcctgttgacgacacttcagccgtcataaaggagcgcttatggcaagagccgaaccatgaaattgtggccaagttgctttcgatgggtttcactgaaaacgcagctaaaaaagcggcgcttttcacaaagaacgaatcagcggaatcggccattaattggattcttcagcattctgacgacactgatgtaaacgatccgcatccgatgttaacgaaacaaagcactccgccactgacatccaaccaaggccagaacgcgtctcagaaagttcgtcacggcaaaggtcattaccgactgcgcgccttcatttcgcacattggg

SEQ ID NO: 48448 - DNA, 363 bp, Heterodera glycines
  SCN-specific regions: Sequence locations=1-363
ggccgccaagttttccctttgttccctctcccaaaatgtcttctcgcgcgacccccggtggcattggcttccaagtggtggcaaagcaagccagcaaattcaatgaccaagagggcaagctgatcctggactgggtcaaaaagctaagtggtgaaaacttcagcacggatgggagccgtgagaatttctataaattgttgaaggatggcactttgttgtgcaaattggccaacggcattcagcccggatcggtcaagaaaattcaacaaccgaccggcaatttcgcctgtatggaaaacatcaacgcttttgtgtcatttgccaaggcccaaggagtgccaacggaagaaacttttcagagtg

SEQ ID NO: 48449 - DNA, 201 bp, Heterodera glycines
  SCN-specific regions: Sequence locations=1-24,150-153
ggccgccaagtgcaaatcttcgtcaaaactctcaccgggaagaccatcacccttgaggtcgaggcaagcgacaccatcgagaacgtgaaagcgaagatccaggacaaggagggcatcccgccggaccagcagcgccttatcttcgctgggaaacagctcgaggacggacgcaccctggccgactacaacatccagaaggag

SEQ ID NO: 48450 - DNA, 433 bp, Heterodera glycines
  SCN-specific regions: Sequence locations=1-311,334-433
ggccgccaagaatgcacgaagcgaaaatatagtcggaattgcttccctttgttcgctggccgcgattttggccactctcgtggtgatcccgcaactatacactcaaatcaacgaaatgaacaaccgcgtgatggacggtgttcaggctttccgcgtgaacacggattccgcgtggactgagctgatggaggtgcagatcagtgtcactccaccgacccgtccgcgagagaatcccttcaactccattttcctacgccaaaagcgccagggattgcctccccaatgcgtttgccaactgcagcagccaagctgtcctcctggtcctcctggcccgcctgggccccccggaacacccggcgagcccggcggcgccgggcagccgggaagcccaggacagcccggacaacaagcaccgccatgccctccgcccgtg

SEQ ID NO: 48451 - DNA, 2247 bp, Heterodera glycines
  SCN-specific regions: Sequence locations=1-42,84-87,120-126,149 -243,303-315,387-659,826-1176,1201-1477,1499-1499,1522-1530,1557 -1613,1639-1765,1802-1823,1845-1846,1881-2055,2077-2247
atgtctgaacaatccggggaaacctttgcgtttcaagcggagattgcgcagttgatgtccctgatcatcaacaccttctactcgaacaaggaaatcttcctccgtgagctgatctccaactcctctgacgctcttgacaagatccgttaccaggcgctgaccgacccgtctcagatggagagtgggaaagagctcttcatcaaaatcgtgccgaacaaagccgataagacattgaccatcatcgacactggcattggcatgaccaaagctgacctcgtcaacaaccttggcaccattgccaaatccgggacaaaagcgttcatggaggctcttcaggctggtgcagatatttcgatgattggccagttcggtgttggattttattcggctttccttgtggccgaccgtgtcacggtcacatcaaagcacaatgacgacgattgctaccaatgggagagctcagctggtggctcgttcatcattcgcaattgtgccgatcctgaagtcacccgcgggacaaagatcgtcctccacctgaaggaagaccaaacggattatttggaggaacgtcgtgtgcgcgaagttgtgaagaaacacccgcagttcatcggttacccgatcaaattgttggtggaaaaggagcgtgacaaggaaatttcggatgatgaggcagaggaggagaagaaggaagatgaagcaaaggaggaggagaagaagccagaagatgacgtgtcagatgacgaagccgagaagaaaaaagaggaaggggacaaaaagaaaaagaagaccaagaagatcaaggagaaatacacggaggatgaagagctgaacaagaccaagccgatttggacccgcaatcccgatgacatttcaaatgaggagtatgcggagttctacaagagcttgtcaaatgactgggaggaccatcttgctgtcaagcatttcagcgttgaaggccaactcgaattccgtgctctcctcttcgtcccccaacgcgctccgttcgatctctttgagaacaaaaagagcaagaatgccatcaagctttatgtccgtcgggttttcatcatggagaactgcgaggagctgatgccggagtacctgaacttcatcaaaggagttgtcgactctgaggaccttccgctgaacatttctcgtgaaactttgcaacaatcgaagatcttgaaagtcatccgcaaaaaccttgtgaagaagtgcatggaccttttcgaggagatttctgaagacaaggacaacttcaaaaagttctacgagcaattcgcgaagaacattaagcttggtattcatgaggactcggtgaatcgtaagaagctctcagactttctgcggtactacacttcggcctccggcgaggaaccatgcagcttcaaggactatgtttcgcgcatgaaagagaaccaaacatgtatctattacatcaccggcgagtccaaggacgttgtccaaaactcctccttcgtggagcgtgtgaagaagcgcggcttcgaggtcatctacatggtcgacccgattgacgagtactgcgtccagcagctcaaagaatacgacgggaagaagttggtcagtgtgaccaaggaaggccttgagctgccagagagtgaggaggagaagaagaaatttgaagaggacaaggtcaagttcgagaagctgtgcaaagtcattaaggacatcttggacaagaaagtccaaaaggtttctgtctcaaaccgtttggtctcttctccgtgttgcattgtgaccggagagtacggatggtctgccaacatggaacggatcatgagggcccaggcattgcgtgactcctccacaatgggatacatggcgtccaaaaagaacctggagatcaaccctgaccattcaatcatcaagtctttgcgcgaccgtgttgagaaggagcaggacgacaaaactgcaaaggacctcgttgtgctgctgtacgaaacttctctgctcacctccggcttttcattggaggacccgcaacagcatgcgtcgcgaatttaccgaatggtgaaacttggacttgacatccccgacgaggaggagccggccgagcaacagccgagcacttcgggcgagccgacaattgcggagaaaattgctggtgccgaagaggaggcctcgagaatggaggaagttgactgaatggtgacatcgctatccattcttggatctcggctattcattgtttttttgttttcttgtttgacataaatttgaattaaa

SEQ ID NO: 48452 - DNA, 1356 bp, Heterodera glycines
  SCN-specific regions: Sequence locations=1-59,81-253,275-435,457 -920,944-1061,1103-1317
caagtttgagcttagacagacaaatatttcaattctcccaattttataaagcaagtaaaatgtttcttcttttcttattatcaatgcttctacttcagacaaatggttggcgtgcccgcgagcgtgcaattgaattggccgactcggacgaatcgatcgaattgcagaacattggccaacggaaaacggacattcgaacaccgacagaacgaatgtctgctcttcgtcaaatgatcgaacgcggcttttccgattggaatgcttacaaacagaagcatgggaaagcatacgcggaccaagaagtggagaacgaacggatgctgacttatttgagcgccaaacagttcattgacaagcacaacgaggcgtacaaagagggcaaagtgtccttccgagtgggagagactcatattgccgacctgcccttttccgaataccaaaagctgaacggattccgtcgtttgatgggcgatagtttgcgccgcaatgcatccacttttctggcgccaatgaatgtgggcgatttgccggaatcggtggactggcgggacaaaggatgggtgaccgaagtgaaaaaccagggaatgtgcggctcgtgctgggcattcagtgccaccggcgcattggagggacaacacgtgcgcgacaagggacatcttgtttcgctgtcggaacaaaatctgatcgactgctcgaagaagtacggaaacatgggctgcaacggaggcatcatggacaacgccttccaatacattaaggacaacaaaggcatcgacaaagagacggcctacccctacaaggccaagaccggcaaaaagtgtttgttcaagcgcaacgacgtgggggcaaccgactcgggttataacgacatagccgaaggggacgaggaggacctgaggatggctgttgcaacgcaagggcccgtctcagttgccattgatgctggtcaccgttcctttcaattgtacaccaacggcgtttactttgagaaggaatgcgacccgcaaaatttggaccatggtgtgctcgtggagggctacggcaccgacccaacccaaggcgactattggattgtgaagaacagctggggcacccgctggggcgagcagggatacattcgcatggcacgcaatcgcaacaacaattgcggcatcgcttcccacgcctctttcccattggtctgatcggagtgaatttgttgcccttgcgctgattcagagacatttcatttgattaatcgtgctaaatgataagataattgataatccatcagtctatcggtcgatttccattttttatgttcgcaattttattcacatataaataaatgacttatttaaaaaaaaaaaaaaaaaa

SEQ ID NO: 48453 - DNA, 1822 bp, Heterodera glycines
  SCN-specific regions: Sequence locations=1-803,825-1137,1159-1822
atttgcttagatggatttgttaaaatcttacgacggctcttcatcatcggacaatgaacaagaattggcagatataccttcttcgtccaatcacaacaaattgctcgctttgaaaatcccatccatcaacttaacacccaacgtgattgaacaacgcgccattcaacaggttgcggttgtggatccaaaaaccaaagagttgtatcacaatccgcgcttcgacgaattgtttagaccagagagcggcccacaaaatccgtttaaaagtgaacatcaacgagcagaaaagaacacactgaccggctatgtggagccagcgcatttcaacgccttccattttgagcgttcacttcgctcctacgatacgcttggctatgcggataatccaacggcagacacaaccagcgcaaagttcgttggtgacgttggacaagcgcaagaaaaggccggcgagtcgctttttgaatcagtaaaaactggcggacagaagcgaaagagagtgataaattacgacgcatcaaacgttgacggatatacgggaccgtgggcaaggtttgaggacgagaagacatttgctcgaccggacccagaattgcagaaggaaatggacgaaattgtgcggaaacggaaactgaaaagtcgtgctggccgaagagcggccatcgcggaattgcatttggcagaagagagcaccaaattgcacataaaagatgacactgactatttgggccgttcctttatggaaccgccgaaatacacgggcaccaatctgcgcgaggactttgtgcccgaccgctgtttcccgcccacaaaacaagcacacacctacagcagtcacaccaaaccggtgaccgccatccgatggtttcctcgtagtgcgcacatgtttatctcttgttccatggacggaaaagtcaaattgtgggaagtgtacggcaaccgtaagttgatccgcacatacactggacacaaagtgcccgtgaaggacatttattttaacaacaccggcactgaatttctaagtgccgcttatgacaattacatcaaattgtgggacactgaaaccggtcaggtgaaaaaccgctacacaattggaggccatcgggcgtatgtggtcaaattcaacccggacgatgataaacaaaacattttcatggccggaatgtccaacaaaaagatcatccaatgggacacgcgaactggcgaaatcgaacaagaatacgaccgtcatttgggtccagtgaactcgatcacctttttcgacaaaaaccgtcgtttcgtttctacttcggacgataaatctcttcgcatttgggaatttggcattcccgtggatacaaaactgattcaacatgctggactacattccattccttcaatgactagggcaccaaatgaaaaatggatcgttgggcagtccatggacaatcgaattgtccttttccaaatcgtcgatgacaagttgcgattcgctcgtaaaaaggccttccgtggtcacaatacagcagggtacgcctgctcaactgatttttcgccagagatgagttttctcgcttccggtgatgcggacggtaaaatcacaatgtgggactggcgcacacacaaaattgtctccacatggaaggcacatgataatgtgtgcatttcaacactgtggcatccgcacgagaaatcgcggatgatttcttgcggatgggacaatgtaatcaaaatgtgggtctgacaatgaagtaaagctgacgacgattcaatgatttaaagtgaatttatttgtaatgtctcaaccgataaaaggaaaaacgtccaaaaaaaaaaaaaaaaa

SEQ ID NO: 48454 - DNA, 370 bp, Heterodera glycines
  SCN-specific regions: Sequence locations=1-113,136-311,339-370
aggaaatggccgagaacatcgaagaaatccttgccgaaatcgacggctcccaaattgaggagtaccaacgctttttcgatatgttcgaccgcggaaagaacggttacataatggccactcaaattgggcaaattatgaacgcgatggagcaggactttgacgagaagaccctcagaaaattgatccgaaaattcgacgcggacggctcgggcaaattggaattcgacgaattctgcgcgttggtgtacactgtggccaacactgtggacaaagacacgttgcgaaaagagctgagagaggcattccgactgtttgacaaggagggcaatggttacatttcgcgccccacgctgaaagaactcaatgctgc

SEQ ID NO: 48455 - DNA, 507 bp, Heterodera glycines
  SCN-specific regions: Sequence locations=1-44,76-76,111-141,165 -195,231-314,336-355,378-398,425-507
gctcatccatctcttctcatcttcatcctctacttttgtccttctccccatcgccatgtctgaagaggaatcgcaatattccgacgaagaggttgaggaggaaagcattgccgcggatgaagtgagcgtgcaggaaccggcaccgcccaaagaagaggagccggcgccggaagccgaagcggaggcaccgccggcggaagaaaaggaagaggaggaggaagaagagccggggtcacccggaggggcaggcgatgcgccgaaagaagaatttcgtcgcaccagtgttacggagtccgtcgcgccgatggcgcaacttcgccgcgcgccgccccctcagccgaagccggcagaagaatcgatgacggaggcggaagcggcgatgctggcggtgaagaagcgccacgaggaggaggaggaagccaaaatgcgcgacaatgacgagcgacgccgccaggaactcgctgcagttgaggacgaactgcgcgttttgaaagaactcaatgctgc

SEQ ID NO: 48456 - DNA, 559 bp, Heterodera glycines
  SCN-specific regions: Sequence locations=1-118,188-228,289-384,413-536
gtccaattaagaagaatatttttgttttgctttgcttcctgaagagaatacgcaactgaagatgcaaattttcgtcaaaaccttgaccggaaagaccattactttggaagtcgaggcgagtgacacaattgaaaatgtcaaagccaaaatccaggacaaggaaggaattcctccggaccagcaacgtttgattttcgctgggaaacaattggaggatggacgcactttggccgattacaacattcagaaagagtcgacgctccatttggtgctccgtctgcgcggagggatcattgagccgtcgttgcgcatgttggcacaaaagtacaactgcgacaagcagatctgtcgcaaatgttacgctcgtctgccgccccgtgccaccaattgccgcaagaagaagtgcggacactccaacgacttgcgcatcaagaagaagctgaagtagaggaccaaatgtttgctggacgaatgggattattgttgatcgaattatttgattttgtttgatgtcgtgagaagacaattttatgttgaaaaaaaaaaaaaaaaaaaaaaa

SEQ ID NO: 48457 - DNA, 630 bp, Heterodera glycines
  SCN-specific regions: Sequence locations=1-12,34-630
gacatggaccaatttgacttttcttatttgaataaggcattcaagcgagcattggagcccaaattgccaagcaccgacatccggccaatcccggatgaacgctgcgttaacacagctcatctcggcgaggcagagaaagagcgcttggaacaaatcggcttgaaagccattgcggaaggtcgcgtggcggccgttgtgttggccggcgggcaggccagccgtctgggctctgcccaaccgaagggcgttcttcgcctgggcaccggacttggccaggacgacgtcgactcacttttgttcattcaggctgcacaaattgtacgccttcaacgcatggcggccgagcagttcccggccgaggctgcgaagagcggtgggcgcatcacttggctggtgatgaccagcaacaccaccaatgccgcggtgcatgaccatctgaatgccgtactcgccgagactggcctcagttcggaccaggtgctgatcttcacccaaaaagaaattccggcatttgactttgatgggaacgcactcatgaaaagcagcactgaattggtcactgctcctgacggaaatggcggcttttatgacgtggtccgcccgcttcttgccgaactggagaaacgcggt

SEQ ID NO: 48458 - DNA, 1169 bp, Heterodera glycines
  SCN-specific regions: Sequence locations=1-327,350-546,568-617,639 -1035,1057-1169
agtcaacgtccaccgatattgagtttcaacatcatcgccatgtggcagtgcccgcctccgaattgacgccgtccccgtcgaccaccaccgcaacggccactgacgatggttcaacaacaacaaacgctgctgcggatatggaacaacacgaaaatgctgggcgtaaacggcacacaaaggaccggttccgctacggtaactacaaccgctactacggtgtgcgcaaccaaggctttgaccacgacccccgtgtcgacttgtttcccgtccaatggttccatgggcgtcgcgtgttggacattggctgcaatgttggccatttgacgcttgaaattgccaagaagttgggcccagcgcatattgtgggcattgacattgacgaccatttggtcggtgtggcgcgcaaaaacattcggcattattgtggcagcgcgcaaaagctgatcggcaaattccccgcctcactgttaccaccggcggaggaggcggaagcgtcgtcaacaaatgctgtcaatgacgacggcaaaagtgccacaaaaatggagtcggaaaatgggaaaggaggaggggccatcttcgaccaccgcaaagcccgccgttctcccatatgggcaattcccaaaaaatgtgtggtttttgcgcgaaaattacgtgctcgactgtgacgagttccttgaaatggttcgcgaggagtacgacgtgattttggcgctgagcatcaccaaatgggtacatttgaactggggcgacgatgggctgaaacggttcttgcgtcgcacctttttgaaccttcggccgggcggacgactgctgttggaagcgcagccattccccagctattacaaaaaggcaaaaatgacgtctgatatgttcgagacgtacaaggccatccagttcaagccgtaccagttcaaggacttcctgctgtccgacacggttggcttcagcgagtgcgaagagttgggcacaccgacggcaattagcaaaggttttgaacggccaattttggtgttcaagaaggcgtcatcgtcgactacaccaacaacaacaaagcggaaaagggagagatgtcttcgtccgtaaagggcggcgccgagtagttcatcttctgcagacgatcagacacgggaattgtgacgaatttatttcacgaattggacatggatttt

SEQ ID NO: 48459 - DNA, 1034 bp, Heterodera glycines
  SCN-specific regions: Sequence locations=1-269,291-500,521-666,689 -1034
agggtatacacgcttcatcaatctttcgaaggtcaaatatgccagaggcaattccggaaggcgattacgagagaggaaagaagattttcaagcaacggtgcttgcaatgccatgtgattgattcgactgctacgaagactgggccaactctcaacggcctttggaataggaagagtggctctgtaccaactttcgattattctgctgcgaacaaaagcaagggcgtcatttggaacaaggaaacgctgttcgaatacttgctcaaccccaagaaatatattccggggaccaagatggtctttgctggactgaaaaaggctgaggagcgcgccgatttgatcaaattcatcgaagtggagagtcagaagccgccttcgtaaagtgattgaatcgaacctccgattattagggcaatggttgtttgacggtctataataatagagtctgttattgtcgtaacatttctgtccggttagtctcaaataaaatgttggatgtctaaaaaaaaaaaaaaaaaaaatatcaaaaacataataatcaacttaagcttcagtctcatttcttttttgccatcttacttatgtttgaatgttttatatactcgagcaattattagctctaaaattatttcttatttgatatgagtgcctaagcagtttgttctttccatttttggccctcttgttaacacatgagatttgactgccttagtgccgtgtaatactgcggggaggggtgaatacggcacacaaagcaaacacttgatgaaagagggagaagcggggggggcatcgcccgaaggattgcttatgccgtgcccagcccaatgcccccggcaattcccgtcgcttaattgcatttccattcccttctcatgtctctctctctctctctgtccttttcctccgtcaattcaatggcaaattctgatcaaacacaaataaactttccttaattgggcgtgtcttttcattgccttgtccttttgcaatttcggtctctcattaattaattccattgatttgcctttccct

SEQ ID NO: 48460 - DNA, 690 bp, Heterodera glycines
  misc_feature (689)..(690): n is a, c, g, or t
  SCN-specific regions: Sequence locations=1-31,53-412,434-620,642-690
ggaggttcggcacgcagtgaccggcaaacacaactcaaagggttggcaagtgatcccatgccaaggatggaatttgttggacggatgcgacggagtcggctcatggtaggagagaaggagcaaaacacgaaataaccttgcaaaatagccgatattgcgacgtgttggacaaatgcaaagagacggtcaaaggggcgcataaatatgtgaacgatcgcaaggcagaagagtttttgcggcagaataaattgtgccctccgcccaaagcccataggacgatgacttgcagcaaaatcttcaccattgaggatttgccgaaaagtttcttcggccccctccaatcgaatgaatattggctgactttctctttcactgacgggaaagacaaaaaattgggctgcgcgaggctttgggtggacgtgtgcaaataccatctgcaggacaaacagcaaaagtgcctgagggacccaaacgcatttaagaatttcatcaacgaaatcagcagtcaggcggagcaaatccgacagaggacaaacagcggatgaaagaagcggaaaaagcacgcagaaacgggtcactcccccccctccccccacaaatcagcccaatttgaggagaacaataaattaaacaccatttataatgtgactgactcattttcaatttgcccaatgaactttcgaaatccnn

SEQ ID NO: 48461 - DNA, 566 bp, Heterodera glycines
  SCN-specific regions: Sequence locations=1-96,121-339,363-431,456 -522,544-566
caagtttgagtcaggctttttgattatttttgtgactttattcccgtcctaatgccaccaacgagtaaaaaaacaggaaaggctgtcgcaaaggctgtggaggccaagaagaagctggccaaaggccagcacattgtgcgcaaaaaaaagatgcgcacgtcggtgcacttttaccggcctcggacgctgaagctggcgcgttcgccgaagtttccgcgcaaagcggtgccgaaacggaacaaactcgactccttctccatcataaaacacccattgaccaccgaatcggcgatgaagaaaattgaggacacaaacacattggtgttcatcgtggacgtgaaggccaacaaacatcagatcaaaagtgcggtcaacaagctctacaacatcgaagcacagaaggtcaacactttggtcacgcccgatcatacaaagaaggcgtatgttcgcttagccgccgattatgatgctttggacgtggccaacaagattggtattatttgagtatattctgcgctttgttttgttgatttttgcgaataaattgttgctatgttaaaaaaaaa

SEQ ID NO: 48462 - DNA, 605 bp, Heterodera glycines
  SCN-specific regions: Sequence locations=1-196,220-226,248-271,293-605
gtccaattaagcctaattaactcaacattttctaaaatttccaatggctggtggcaaaagaaaagcgggcaaggacagcggaaaagcaaagtctaagaaaatcatctcgcgcagtgccagggctggcctccaattcccggtgggacgcatccatcgcttcttgaagaagcgcacaacaagcaccggacgagtcggcgccaccgccgccgtgtacagcgcagcaattctggagtatctgacggccgaggtgttggagctggccggcaacgcgtccaaggacctcaaagtgaagcgggtgacaccgcgtcacttgcacttggcaattcgtggagatgaggagttggattcgatggtcactgcgacaattgcgggcggcggagtcattccgcacattcaccgttcattgatgagaaagcctccgagtcaactcaatcacagtcaccagcagaatcattcgcagcagcagatgaccaacgttggcaatggcgacaactgattttggccaaatgaatatcgttctttcaataaaaaaaatattgtgacgatttgtgcaattttaccaaaaccgataaatcttttgctcttcaaaaaaaaaaaaaaaaaaa

SEQ ID NO: 48463 - DNA, 385 bp, Heterodera glycines
  SCN-specific regions: Sequence locations=1-123,162-346
gagaatccctgagtcgtttaataattgtagtcagtaaagacaagatttatttaacgaaggacaatgccgcgccaaataactgatattaagcaatttctgctgactgctcgacgcaaagacgcgaagtcagtcaagatcaagaagaacaaagagaacaccaaatttaaggttcgctgtacgcgctttctttacactctcgtggtggatgacaaagagaaagctgagaaattgaagcagtctttgcccccagggcttcaggtcaaagaattgaagtgattgacgcacgaaaattgcatatggttttttgttttgtttttccattttattctcgataaactgttgtgttaaaaaaaaaaaaaaaaaaaaaaaaaaaaaaaaaaaaaaa

SEQ ID NO: 48464 - DNA, 795 bp, Heterodera glycines
  SCN-specific regions: Sequence locations=1-536,579-795
caagtttgagatttgctaatttgtccgtcctgacgaagaggcatgaaatggctctttgcatgtggcaacatggagaagaggcactggccaaggcgttggtggcatgtcgcatttacaaaagtttggccaatgaggcagcggaggattacttggaagtggaagtatgtgaggaacttaagacgtatgccgaagagtttcggcaactttcactggaattgctcgaccattgctataaagaagatgacgcacaaacgcttcagttgctgacatacgaacttagctattggggccaccagacatgcttgtcactggccgtcattgtgaacaacaagcaattcctggcacacccttgctgccaaattttgttggccgacctttggcacggcggtctccgtattcgaagcaactccaacatcaaagtgctcatgggcattctgttccctccctcaatctttctgctcgaattcaaatcccgcgaagaattgctgcttcagcctcagaccgcagctgaacatcagaaggacatcaacgaatcgtcgtcgtcctcctcagattcctcctcttcgacctcgtcttctgacagtgaaagcgacggcgacgagtcggacgcgggcgaaagaggcggtgccacagccgaagagcgccgacgcacgtcgcattcgcacggaagcatgcagtcgttgaacttcacctccatttttaaaagtaagcgcaaacgccgtcgtccttcccactcgcgttcttccaccacggccaaagaggacattgagatgggcaaacagaggaaccgagtga

SEQ ID NO: 48465 - DNA, 443 bp, Heterodera glycines
  misc_feature (419)..(419): n is a, c, g, or t
  SCN-specific regions: Sequence locations=1-41,97-97,183-186,247 -342,365-419
agtttgagcgattgaattcaataccccttcaatttggctatcatgcaaatcttcgtcaaaactctcaccgggaagaccatcactcttgaagtcgaggcgagtgacaccatcgagaacgtgaaagcgaagatccaggacaaggagggcatcccgccggaccagcagcgcctcatcttcgctgggaaacagctcgaggacggacgcactctggccgactacaacatccagaaggaatcaactcttcatctcgtcttgcgccttcgtggtggaaagaactagaacgacgaacggaagaaatgagtgatctgtatcgatccatatccgtatcttgagactgtcctgtattattgtgttccgttttattcatcatcatgaaatgtatttcaatgaccacggaacgataaatccatcaaaactcnaaaaaaaaaaaaaaaaaaaaaaaa

SEQ ID NO: 48466 - DNA, 714 bp, Heterodera glycines
  SCN-specific regions: Sequence locations=1-383,405-714
gtccatttaagtatcgaaatgaaaaggcctataatgcaaaaagattgtacttcaaaaggtgaaaatgtttctcaactcgataaaagcactagcaaaatggagggaagcaaacctctgcagattgaggaatatgataccagcgacgaagaggatttacgcaacacaattggcaatattccggttcaatggtacaacgactacgaccatgttggatacacattaagtggcgataaaatcaaaaaagatgccattaaaactgacgaaattgacgcgtttttacaaaaagaggaagactcggactattggcgtaaggttttcgaccgtcagtcgggtcagcaaatggcactcactgaccaacaggtggagaaactgaatgccattgcggacaaccggttcccggaaataggttacaatccctaccctcctttcttggacattttctcctccgttcgcgagattcacccaatttccaatcgaccccccgacaaacgctctttcgttccgagtgccgatgaacgtcgaattgtcggccgaatggtccacgccattaaaatgggatggctaaaaaggaaagagccccccaaaggctcagaagaagaggaggagccgaggctttacgacctttgggacgacgagggggacgagcagcggaagagcaaatcgcaaatggcacgcgtccgaatgcatttgccggcaccgaaggtgaaaccaccg

SEQ ID NO: 48467 - DNA, 792 bp, Heterodera glycines
  SCN-specific regions: Sequence locations=1-769
gaagaaagtgaggacgacgaaagcgaagcgatcacttacggcgtcctttccattgtgccattgaacggaactcagaattttcaatcgcaagttgccgcattggttctccaacgttcaaaaaaacacgcgaccgacgaaattttcaaaaaattcgaaaatgttttgggcgttggccgagtgtcgtcaaaagtcggttttctcataaatgaacggatgctcaattttcctgctcaaattgcgggcccggcttttcattcccttgcggaggattacaatggccttgcggaggagcgacgctttgagcacattttggccattttgaaagtgcgaatttgcaccgaacagtgcgcttcctcttccacgagtccgaacattggaaaaaaaagaaaattgggaaaggctgcgcggaagcgattggcagttgaacgaacgatcgaatcggacataatattcgacaatttggaagaacaaatgctctttcagcattcttccgactttcctttcttccaataccccgtcgaatcagaaatcgaaaaatcttcgaaattccattctttgcgccgcgacggtcgaatatttcgccctttccgtcgcgtttgccttctctccgtcgaccaattcctccaattcgcttcgtccgtcgttcgttcgttctccgtttgaccgccattcattgcgtaattacacaaaaggtggaaagagaaaaacaaacgtcaattgttatttgcatttctattataatttttttttggttaaaatttaacagtccaaaaaaaaaaaaaaaaaaaaaaa

SEQ ID NO: 48468 - DNA, 732 bp, Heterodera glycines
  misc_feature (709)..(709): n is a, c, g, or t
  SCN-specific regions: Sequence locations=1-50,88-709
gtccaattaagaattccgttgtctttctattgtaaaaatgccgaacattatgggattgcatggtggctccatgattgccatgagaagcaaagatagtgtggtgattgcatgtgatctgcgcttgggagagcaagccatgaaaaacattgctactaatgcgacgaagatccatcccatttctgacaacgtttttatcggattgaccgggtttaacgcggacgccaccactgtgcttaacaagttgcgcacacatcaggccatttatgagatgcgcgagcagcgtccaatgtctcccaaggcgttgacttcctatctcgcttggatgctctataagcgcaggttcggcccgttcctgatcgaacccatcattgtggggctgaatcaacaaaatgagccgttcatttcccacatggacgtggtcggtagcgtaagtgagcccgaagactacacggtcggtggcactggtggcgacttggcgatgtctctgtgtgaagctctctggcgacccgatatgacctccgaagaaatgacggtggcggtcggtcaggcgatgcttgcggtggtcgaacgcgacgcatccactggatggggcgttgtcatccacacgatcactgcggaaggagtgaccacaaaaatgattaaatcgcgcatggattgatttgatcagctcctgtcgcttttgttgtattcgaaataagcgataaattcntaaaaaaaaaaaaaaaatttata

SEQ ID NO: 48469 - DNA, 629 bp, Heterodera glycines
  SCN-specific regions: Sequence locations=1-217,240-469,492-629
ccaagtttgagtgctctttgccttccttttggcatggcttcctcctcctctgatcattcggcttattccaagcaggtcctggaggagttttggcccggccagaatgtgaagatcggccatatgacaatgaattcttttcgagaagtgaacagacattcagaattgccaattgcacgcataaagaaaataatgaaaatcgaggaaggcgtgaaaacccagatgatcagtgccgaagcgcctgtactgctcgcaaaggctgccgaactttttatcgaagaattgaccctccgcgcttggctgaacaccaacgacaaccgccgtaaaaccatccaaaagtcggacatcgccgccggggcggccaaaagcgaaatgttcgactttctcattgacatcctcccgcgcgacgagctgcaaaaagaacaatcggttgactacgatggcacagaaattcaagtggtggacgacggggcggaagaagggccgacaatggcggacggtcagcagaatgtccaatacattctgcagtacgcggacagtggtgagatggaaaattcgatggtccagttggaggacggccgaataatccacgccacccaaattgggcagccaattccgttgtcctccgccac

SEQ ID NO: 48470 - DNA, 1128 bp, Heterodera glycines
  misc_feature (1066)..(1066): n is a, c, g, or t
  misc_feature (1070)..(1071): n is a, c, g, or t
  misc_feature (1076)..(1079): n is a, c, g, or t
  misc_feature (1081)..(1082): n is a, c, g, or t
  misc_feature (1084)..(1088): n is a, c, g, or t
  misc_feature (1095)..(1095): n is a, c, g, or t
  misc_feature (1104)..(1104): n is a, c, g, or t
  misc_feature (1107)..(1107): n is a, c, g, or t
  misc_feature (1120)..(1120): n is a, c, g, or t
  misc_feature (1122)..(1122): n is a, c, g, or t
  SCN-specific regions: Sequence locations=1-267,296-310,332-344,367 -616,663-779,815-1066,1127-1128
ccaagtttgaggtagtgtaataaattcttattgtagtaaaaatgtccgaaaataagtccgaaggtggcgctgaaaagaagaagagcggtggattcaacacgaagaagtttttgttggacctcgcatccggcggaactgctgctgcagtctcaaaaaccgctgttgcacccatcgagcgtgtcaagctgttgttgcaggtgcaagatgcttccattcacatcaccgcggacaagcgctacaaaggcatcatcgacgtcctcgtccgtgttcccaaggagcagggctttctgtcgttgtggcgtggtaacctggccaacgtcatccgttactttccgactcaggcgctgaacttcgccttcaaggacacttataagcgagtcttcacgcaaggagtggacaaggagaagcagttcttgaagttcttcgccatgaatttggcttcgggcggtgccgctggcgccacttcgctgtgttttgtgtaccctttggactttgcgcgaacgcgtttggcagcggatgttggaaaggccgatgcccgtgagttcaaaggtttggcggactgcatcatgaagatcctcaagtcggacggtcccatcggtctctaccgcggcttcttcgtctccgtccagggcatcatcatttaccgcgccgcttacttcggctgcttcgacaccgccaaaatgctcttctccccggagggcaagcagatgaacttcttcgtcaactgggccattgcgcaggtcgtcaccgtgtcgtccggcgttctctcctacccgtgggacaccgtccgtcgtcgtatgatgatgcagtcgggccgcaaggacatcatgtacaagaacactttggactgtgccatcaaaatcatcaaaaacgagggactgctcaagggcatgttcaagggtgctttatccaatgtgttccgtggtactggcggtgcccttgttcttgcgttctacgacgaaatccagaaatatatccactgattgtgtgtgatcttcttagtatatttgtttgtgttgcgtcatattcggtcatttgggtaatgataaagaagataggtgtgttnaaannaaaannnnannannnnnaaaaaanaagaaaaanaanaaaaaaataaaancnaaaaaa

SEQ ID NO: 48471 - DNA, 417 bp, Heterodera glycines
  misc_feature (398)..(399): n is a, c, g, or t
  SCN-specific regions: Sequence locations=1-417
gtttgagctttaatccatttattcaaccaagcgtgcaaataaataatggcttcttcaattcgactcgctggcggtgctttgcgagaactccgaattcatctttgccagacaaccgcagcaagcaatggagttcgggaattcatccagaaagattatgtggacctgaagcagaacaatcgggatttccccattcttgtaagagaatgctccggaattacgccacgaatttgggcaagatatgagcatggagttgagacaagcgtttcggttgagaatcagccgcgtcagaagataatggaagtgatcaaagaaatggcaacgaaaaaaattgattgatttgaatttgtttttggctgccgtttgtaaattctttgataggataaataattgtctcccannaaaaaaaaaaaaaaaaaa

SEQ ID NO: 48472 - DNA, 627 bp, Heterodera glycines
  SCN-specific regions: Sequence locations=1-627
gtccaattaagttgtacatccacattcattaatcattcattactctcttcctctttgttttcaatgcacgacatcgatgaaccgagggaaatttttctaagtgctgatgatgcgtttgtttcggacgcattggaaacgattggattaacatttgttggcactgaggatgaacttgaaacggcccctgtttttgcgcccgaatttgcgcatcaacacttcgagagtgaaaaaattgtcggatataaaaacctgaaagtgtccgtgctttattcggatccaaccctttttctgacttccttttatcaatgcgaacagaaagaggatgactctacgaagtgcgacgatattgaatacagaatcaaagacgcgctcccacaaactcaactcaacgcctatttgacaattgagaaattcaggcagaaactcagcgagcaaaagaactttgttcctttcggagaactcatcacaaagttttgccttaaagattcagagattgaacataactttatactttataaattcgagaaaaaacagcaaaacgatgctcaatttgaccagggctgtaaatttctggagcgagtgcaagcgttggcccattggtacatcgatgcggtctcttacactgac

SEQ ID NO: 48473 - DNA, 1372 bp, Heterodera glycines
  SCN-specific regions: Sequence locations=1-1085,1107-1335
agtgattctcctgttcctaattggctgcttaacatcggaccaatttcttgccatgcgtggaacaaggacaaaactcaattggctgtttcgccttccaacaacgaaattcacatattcgctcgttcggagaccgtttggaacccgttgcacgtgctaagagaacacgacttgctgatcaccggattggattgggctccgaatactaatcggattgtttcatgttcgcacgacaaaaatgcgtttgtgtggacatgggaggctgaaaagaacagttggaaaccggagatggtggtcgttcggataaacagagctgccacctgtgtcaaatggtcgcccaacgaaaacaaattcgccgttgggacgggtgcgcgtttagtcgctatttgttattacgaacgtgaaaatgactggtgggtagcgaagcaaatcaaaaagctgattcgttccacggtcacctcattgaattggcatcccaacaacattttgttggctgttggcgcctgcgacttcaaaacgcgtgttttttctgcttatgtgaaagagattgacgaaaaaccaacgccaaacccttgggggaccaaaatgccattgggagaattgctcaaggagtaccagtcgaccggatgggtccatgacttggccttttctccctccggttgtaaacttgcctgggtctctcatgattcgtccattgctgtgattgacaagtccaattctcaacctcaggaaaggccaattcagcacaaaactgcctttttgccgttcacttctgtccgatgggtcaatgagacgcatattgtgacggctggtcacgactgttccccaatgcttttcactttcgacgggacggcgttgaattttaaatgcaaattggatgtgccgccagaaaataaaaacggttccaacgtgagctccgctttcgccatgtttcgcagcatcgacaaaaaggcgttgtccgccgactctccgttgggttccaccgcactgaaaacgttgcatcaaaattcgattatgcaaattcaaccgcacactgtctccagccaatcggggacaatcagcaaattcacaacttgtggcctcgacggggtcgtggctctttgggatgttcagaagcctctcggcatgcctttggctaatggcgccgcgcaaatgagttaatttggccaaaagtgattacctgatcaacaaatgctacaaattattgtgcaaagtcgcaaactgtggtgtgtcgcggactccgtcgcttttcgctcgctattttatttttaatcccttccgtaatttgtaatttgcgctatctcttctcataatattatcgatgatttcaaccacatgtttttattatatttcgtttattataatttaaaaaaat

SEQ ID NO: 48474 - DNA, 632 bp, Heterodera glycines
  SCN-specific regions: Sequence locations=1-632
gtttgagaatttataatccagcaaattgaaatgccggaacagagcagcggtgccgatgagtacgaatcgttggctcccacttattcgctttgggttcatttggcggcgggcgcagcggcgggaatggctgagcattgtgtgatgttcccattggacagtgtcaaaacgcgtctccagtcgctgtgcccttgtcccgagtccacgtgtccgactcctatccatggcgttgcttcaatggtccgcagggagggattttggcggacgtttcgcggagtcaatgcggtcgctgtcggctcagtgccagcccacgccctttacttcacggtctacgaaaagttcaagtcttcactgactggcaacactcatggccattcgaattcgttttcgtacgcattggccggcatggcggcaacagtggtccacgatttggtgatgaacccggccgaggtggtcaaacagcgcatgcaaatgctgtacagtccgtacggcggttcgttggaatgtgtgcgttgcatctttcggaacgagggaatggccgctttctatcgctcttactccacccaattgtttatgaacgttccgttccaagccgtccatttcgtatgctatgaattctggcaagagcaatttaa

SEQ ID NO: 48475 - DNA, 673 bp, Heterodera glycines
  SCN-specific regions: Sequence locations=1-11,44-269,291-647
attttaggtaatttcaagcacattatttttggaaagcttatttgatttatccatcaacagctgcaaaatgacgattagcaagaacaacaagatgatggcgcacctcaactacaaaatgaaggtgatcgtccaggattcacgcgtttttatcggatacttcaaagcattcgataaacacatgaacataattctggccgactgtgaagagatgcgccgcattaagcccaaacaaggagctaagaagtcaaacgtcgaggaggaaaagcgcattcttggcctggtgttgctgcgaggggacaaaatcatctccatttcggtggaaggaccgcctcaaaaggaggattctggtgtgcagttgccaaaggctggcggactcggtgggcctggacaaggacgaggtgccggtcgaggaatgccgatgggtgtggtgccgccaatgggagctgttcctccgggtttgcagggcgccgttcgtggaattggtggtcctgggatgggtgggcccatgcagcccggatacatgcaagggatgccgcagggaatgccgccacgtccattttgatgctcgattttgttttctttgttcgaccattatttgttttcttacttttacacaatgatctgtttgtttgataaataagttatcgaaaaaaagaaaaaaaaaaaaaaaaaa

SEQ ID NO: 48476 - DNA, 802 bp, Heterodera glycines
  SCN-specific regions: Sequence locations=1-57,123-136,171-177,291 -313,343-407,432-438,462-486,509-540,611-666,688-779
agacaaggaagtctcaactctcagacgagcctgtcccgcacactttgccttccgcccttcaccatgcaaatcttcgtcaagaccctcacgggcaagaccatcacccttgaggtcgagtcctcggacacgatcgatgccgtcaaggccaagatccaagacaaggagggcatcccccccgatcagcagcgcctcatcttcgcgggcaagcagctcgaggacggccgcacccttgccgactacaacatccaaaaggagtcgaccttgcacttggtgctccgtctccgtggtggtggcaagaagaagaagaagaagacctacaccacccccaagaagatcaagcacgtccacaagaaggtcaagcttgccatcctcaagttctacaaggtcgacgacaacggcaagattacccgtctgcgtcgtgagtgccccgccaagacctgcggcgccggtgtcttcatggcctggcacgtcgaccgccagtactgtggcaagtgcggcttgacctacaagctcgaccccgccaccatcaagaagaacatggccgctgccgccaaggcctccaagcccgccgctgctgccaagcccgctgccgaggctgccgctgccgctggcaagggcaagggcaagaagaagtaaacctttgcttcccactcccttggttctctctggtgtgtgcccttggcacctccacgattgttgctcggttgggtcggtgttgtttcttggatgtcaactttgtgtgttcaaggaatgtatatatcgcccatcttggtttcttgaaaaaaaaaaaaaaaaaaaaaaa

SEQ ID NO: 48477 - DNA, 992 bp, Heterodera glycines
  SCN-specific regions: Sequence locations=1-683,705-969
cttcggcggtttaagcccggggcaaaaatcaaaaacccattcattgggggcggtgctcggatggccgtcgatgccaatttcaaagcttactcctgcattctttcactgctgctccgacttcgtcaggcgtgtgttcacctgtctctgaccaggaatgcaattgacattgacgcatttaaacaagacgagggtgagacggacagcgatgcggagaatttagttgcgaaagctctcgaaatgtcaatggctcaaatgagtctcgaagaagaagccctcgagagaaatgaggagcgggaaaaggacgaagggcagcaaatcgaacgcctttttgagaaggaacaccaaagcaccaaagtgaacgctttgatgaaccgtttggatggagtcgttcagaacggtgataaatgcgttatcgtaagccaatggacttcgatgttggctctcattgaatttcacttgcgacaaaaggccatctcttttactagcataacgggagaagtgcgcacggaagaacgtcagtcaagggtggatgctttcaacagaaccaacacgggacccaaagtgatgcttttatcattgaccgccggcggcgttggattgaatctgattgggggaaatcatttgtttatgattgatttgcattggaaccccgcgttggagttgcaggcgtccgacagaatccaccgtttgggccagaagaagaatgtgttcatccacaaatttgtgtgtgcctcgaccattgaacagcgcgtactccaattgcaggagaagaaaaatgccatggccacctcagttttagaaggtgccgctaaaaagttgggcaatttgagcaaggatgacgtgatgtatttgtttgagttggagaaacgtcccaacaatcagcagaaagctggccaatcccagaaaccgacaacgagttcccaaatgtgagacgacaaatggggatttttattgtacgtgcattactcatttgacatttatttatttatttg

SEQ ID NO: 48478 - DNA, 665 bp, Heterodera glycines
  SCN-specific regions: Sequence locations=1-306,329-381,403-542,574 -586,608-665
agatttaattgaaaacaatgactcgtgggtcaagcgccggatacgaccgtcacatcacaattttctcaccagaaggaaggatttaccaagttgaatacgcgttcaaagctgctaacactgcgacactctccgctgttggcattgctcttgatgaaactgccgtaattgccgtacaacgtcgcgttcccgacaaattggtggacccatcttcagttaaaagcatttataaattgtcctcaaccgtcagttgcggtgttatcggcattgtcccggatgcgatgttccaagtgcgccgtgcacaatcggaagcagccagatggaagtatgagaatggctatgaaatgccaatttcggaactcgcgcgtaaaatggccgagatcaaccagtactatacacaggttgctgaacttcgttcattgggcacactgatgcttatgatctcgtacgacgacgaaaaaggcgcttctgttttttccatcgatccagcaggacattacatttctgttcgtggttacggcattggagtcaagcagcagcagatcaacggttttctggagaaaaaactcaaatcaaaagaccgaaaattcggtgacacggaagtgattcaactggcgcttgaggcactgcaaaccgggctgggaattgacttaaatgctgaccaggtg

SEQ ID NO: 48479 - DNA, 603 bp, Heterodera glycines
  misc_feature (584)..(584): n is a, c, g, or t
  SCN-specific regions: Sequence locations=1-572
gtgttattgaaaaattattattacaaaggaaaaatggctgacgcagctgctcaagaacaaaaaaagaaacgcacttttcgtaaatttgtctatcgcggagttgacttagaacagcttctggaaatgaatgagaagcaattcaaccaaatgattcccgcccgtcaacgtcggaagatgaaccgcggattgaaccgaaagcacaaatctttgctcgttcgtctgcgtaaggcaaaactcaattgtcccgagctgatgaaaccggagtgcgtgaagactcatttgcgtgatatgatcgtgctgccggagatggtcggctgtgtggttggcattcacagtgggaaggcatacaatcaggttgaaattcgagctgagatgattggatattacttgggcgaattttctattacgtacaagcctgtcaaacacggtcgtcccggaatcggcgcaacgcacagttcgcgtttcatcccactcaaatgattctttttgcgatcatcggaaattgttgtttaccgatcttttgttattgaattgtttggattttgttggaagttagcggactcaataaagtgaaaatttgttanaaaaaaaaaaaaaaaaaaa

SEQ ID NO: 48480 - DNA, 1423 bp, Heterodera glycines
  SCN-specific regions: Sequence locations=1-760,785-1383,1410-1423
agaaaatataatgactgccaaattatatggaaatcaagacaactttcgtgtgaaaaaagttctaattgcggccaaattgtccgggaaggatattaaggcgattcctcagcttcctccaacaaatctcttcccattgggacaagcacccgctttcgatgatggaaaagtgtgtcttttcggtgccgaggcaatttccaaatatcttttgggcactggttcaatttatttgccacagaacccggaattggaccaatggattggttggactgcttcttctttgcaaccaaatgtcctttcctatgttttgccttgcgtttccgctgccaaaattgaccaaaatgctttagagacggcaaagaatgaattgcttgcccaactttctctcttcgaccaaattctccttcccaaaacttttctcgttggcgagcgtttgtcccttgcggacatttccgttgcgattgatcttctgccggcttatcaatacgttttgggagaagaagctcgcaaaggccttgtgaatgttaaccgatggtttcaaacggtggtcagtcaaccaggaatcagagaagtgctcggggagttcagcttcatcaaggatcccttgaccttcgatgaaaaagagtacaacaaactcttgaatgctgctggtcaacctgcgaagaaggaacaaaagccggaaaagcagaaaggtgccaaagaggaaaagccaaaaagcgctaaagaggaaaagccgaagaaaaaagccaaggaagaagccgacgaggaaatggacgctgctgacgaggctattgccgctcagccaaaattcagcgacccattggctgcgttgcccccgggctcatttgtgatggacagcttcaagcgcgtttattcgaatgaagacaccgcaaccaaagcaattccttatttttgggaaaatttcgaccccacaaattacagcatttggttttctgaatacaaataccccgaggaacttaaattagtctacatgtcttgcaatttgattggcggaatgtttcaacgactcgagaaaatgaagaagcatgcgttcgcctctgtttgtttgttcggaactgacaacaactcgacaatctcgggaatttggatctggcgtggccagcagttggcgttcgagttgtgccaagattggcaagtcgactacgaaagctatgagtggaagaagctcgaaccggaaaacgaagctgacaagaagatggttaacgagtattttatgtgggagggtgactttggtggtaagaagttcaaccagggaaaaatcttcaagtgattctgatcagtaatcacagttttgttgcctacaactgttattttttgttgacgaatttttatactttattcaagtgattaaaggtgggtcctttcaaaaaaaaaaaaaaaaaaaaaaaaaacctcaagaggctag

SEQ ID NO: 48481 - DNA, 797 bp, Heterodera glycines
  SCN-specific regions: Sequence locations=1-24,46-402,425-658,680-765
caattaaggcgacgcctataaattaaataattctttgttttgtttcgttcttcagtttctatgtccaaacaaattcgaacttgttgggtgtggcgtaagaacaaccgttggtggcgttatttgccgcgacgtaacgactcccacaacataatcgacatggacgagctgggcgaacaatgcgccaccttttccgacccaatgcccgccgatccacccaaactttgggtggcgtggctgtacacagattcttacgggtcgggacgaaagatcagggaccaggtgacaaagcttttcggcaaagacgcgaaaccgggcgaaatgcaagtgttcaaaaacacactgtcgaccaacaaacagttatggaagataaagcatctgctcgaaatacggccggtaacatttccaaacggagagccggggcaggaagatgcgacacatttggagataatggcagatggacgctgtgtaatcaaccggcaaagtttgcctaatgtcgacgactttcaactgattgaccacagcaagcagttcagcccgcgttatttggcttctcgactgatgtcaaaggacgtgaccaagcaggacgtgtacgaggacaccgtctacaacccagaaaatatcagcattggatgaaagaagggcggcacaattattgcaaatttaagatgttctttttgatgtcatttgctctactccgtccatcctatatacttcattttgtttttgtctaaaaattacattttgttgcaaataaacttctcatataaaaaaaacaaaaaaaaaaaaaaaaaaaaaaa

SEQ ID NO: 48482 - DNA, 1686 bp, Heterodera glycines
  SCN-specific regions: Sequence locations=1-469,491-557,580-1083,1105 -1621,1643-1686
gtttgaggcacattaaatgaaatttatggcctcgatggtgacgtcatttcctgtgtcattttttctgtttttttctacggctctaatccacggcacaatgggaggccttttctggtcgaaaaagccggcggattcagcggacgattcgctgtggagccgataccatgatcaaaatgcaatggaagagttgttggagaaggtgcacagcaaatgccccaatgtcactcgtctgtacagcgtcggccgatcagtccaaggccgcgatttggcggtcattgaattttccctccatcccggacggcatcaaattttgaagcccgaaatgaaatacatcggaaatatgcacggcaacgaggcgatcggcagggaattgctgctgcgattggctcaattcctctgcgacggatggcggcaaggccaacggtcggtggtggagatgctcaattcgaccaacattcacattatgcccagcatgaacccggacggctttgagttgacgctgaagacaaagccggaacagcgcggatgggtcacgggtcgcacaaacgcgcacggggtcgacctgaacaggaacttccccgacttggacgcgatcttttacaaggccaacgcacaacggctgccgttctttgaccatttgctggaagtgttccacgactccgacaacggccaacagtttgagcccgaagtcactgcagtggccaattgggtgctttcgtggccttttgtcatttccgcaaatctccacgagggcgatttggtggccaattatccattcgacgaaagtctgaacccgaacgaacttcgcgcctattcaaagtcgcccgatgacgtcacttttcgatacatcgccgagacttacgcccgtgcacacgcgcacatggcgaagaatgaccacgcgccatgcgatgggacggcgggggacaatttcgcgagacagggcggcataaccaacggtgccaaatggtactcagtggcgggcggaatgcaggacttcaattatttgtccaccaatgccttcgaaatcactttggaattgagctgtgagaaaatgccggcgccggaacgactcccccaattttgggttgacaataaattggcattgttggaattcatccgtttggcacacattggcatcaaaggaatggtcagcgatgcacgtaacggtgaaccaattgcaaatgccgtggtgtgggtgagaaatgtgaccgacggagacggacaaacggccatcaaacacccggtgaccacgtggatcactggcgattatttccgtccgttggtctccggctgttaccaaatcgcggtggaagcggacggttatgaaattggcatcaaaacgctgaacatcagtcagaaggacgtgaaggaacgacgtccacacattgtgaacttccaattgcgtccgatcgaagttgaagtgccggaggcgcgaattggaagagaaatgggcgaggaagaacggggggaggaggagaacggaccactgacaccagaacaagcagccgaatttttgcaactcatccgaatgcaacagccggtgggcgtacggactgccaatgcgccgtccttctcacaatgaaacggaacaaaagagaaaagggatgatctcgacagaacaatggacagacaaaaagcagcagaaacgaagtgttggttgatatgatttgtgttgtgtgtacattt

SEQ ID NO: 48483 - DNA, 557 bp, Heterodera glycines
  SCN-specific regions: Sequence locations=1-249,285-327,349-399,421 -482,504-535
ttattattattcgcctgattctttataatgggaaagccgaagggaattagaaccgcaagaaaactgaaaaaacatcgtcaggagcagcgctggaatgacaagcgttacaaaaaaaccaatcttggaactcgttggaaagccgatcctttcggcggagcctgtatggccaaaggaattgttctcgagaaaattggcgtcgaagcgaaacagccaaattctgcgattcgaaaatgtgtccgtgtgcaacttatcaaaaatagcaaaaagatcactgcttttgttccaaacgacggttgcttgaattttatcgaggaaaacgacgaagtgcttgtgtctgggttcggacgaagtggacatgccgttggagacattcctggagttcgtttcaaagtagtcaaagttgccaacacgtcattgctcgcacttttccgtggaaagaaagagagacctcgttcatagaaactgacttcgcatgataaaggatttttcctttcattgtttttgttgattgcgattccgaaataaattgttgttgaaaaaaaaaaaaaaaaaaaaaa

SEQ ID NO: 48484 - DNA, 541 bp, Heterodera glycines
  misc_feature (525)..(525): n is a, c, g, or t
  SCN-specific regions: Sequence locations=1-298,320-511
gcagacaattcctttgtccgccttttcccaaccgccacaaatagctctgataatggacaaaggacggagcaaaagcccaaatcataacaatgaggcggaggaaactcaaagcgccaaagaggacaagactgatcataaaacaaatgagcaaatgttgctggtgaggaccggactgaaactgaagcgtggcactctcttcaagaagaagcgaaatgttgacccgaaaacaatagatctgaccataaagaaggaacaagagggcccgcggaagacgaaggccgaattggcatttctcaaacggcaggaggagacggcgttcgaccgtttgtcaaagagggcccaaatcagtcaccgggagaaagtggagaagttcaacaagcaaatggaggaactgacggaattcaacgacatcccaaaggtgtcttggaccaaatgagaaggaaggaaaaatactactgtatcatatattacatttgcgatcacaatcagaaaaactaaagcaaatgcattcatttttagtaaaanaaaaaaaaaaaaaaaa

SEQ ID NO: 48485 - DNA, 788 bp, Heterodera glycines
  SCN-specific regions: Sequence locations=1-147,171-788
gacacttaaagcgaaaaatgtttgaagctaaatttacaaatgccgcccttctgaagaaaattgtggaagcgatcaaagagttggtcagcgaagcgccatttgactgtacagaaaattcaatgtgtctacaggcaatggatgggtctcacgtggcactgatttccctcaaattggacattggccttttcgaagtgttccgatgcgaccgcaccattgcacttggactgagtatgggcgagctcagcaaagtgctcaaatgttccaaatcggaggacactttgatgattcgctttgaggacagtgagcaggacatggtcacgttcacttttgaggacaccaaaggacggaagcaggacatcacactgaaactgatggacattgacaacgaacacttgggcatcccggaccaaaaatacgctgccgtggtcgaaatgccgtccaccgagttccaaaaagtgtgccgtgacattgcctccttctccgactcgatgaacatcaccgccacaaagagcggcgttgtgttcagcggcagcggagattcggtcacaaacacaattcgctactccaaggacaaaacggcggatgacgacgatgacaaagatcgcgtggacataactgtgaaggagaaggtgaacctcaacttctccatcaagtacctgaccaacttcaccaaggccacttcacttgcggaccgcgtgcgtttgtcgatgggcgacaaggttccgttggtgggcgaatatgacgtcgaaggcaatggatttttgcgtttctgtttggccccaaagttg

SEQ ID NO: 48486 - DNA, 635 bp, Heterodera glycines
  SCN-specific regions: Sequence locations=1-364,386-436,458-607
aaaagttgaaggtgtaatttttgacgggatgggtgtgcctcatttttgtcttgaaggctattggaatgaacacgtaaatattgcaagtgtcgttggcagaagaaaggatgaaaagggcaatttggtgattcaaatgggcgaaaaacgacgaatttggacagcaaacgctcctttcggtgactcttcacaatacaacttcactaaactcgccatcgaaatgaatcagccggacgattccgtcgctccaacggattcacgacgaaggcccgaccaacgactgatggaggacggggattgggacgaagcgaacaagcggaagaaccaactcgaagaaaggcagcgcaaggcacgtagacaggccgaggcggaagccgagagggcgatggacaacaaccaaatgaccgctgaataccaagcacgctggtttaagaaggtgcaagactcccacacgggctctgtgatccatgttgttcgggacgaagaatattggcgatgcaaaataaaccgggactggtctcgatgtcctgaaattttctaattaaatcggatgggtgcacggggtaacacacggattgtgataatttgccataaattatttcaacatttcaaaaaaaaaaaaaaaaaaaaaaaaaaaa

SEQ ID NO: 48487 - DNA, 311 bp, Heterodera glycines
  SCN-specific regions: Sequence locations=1-232,260-291
agacgcttcaattgccgattccgtttgaaaatggttcacgaaaacatccactggtcccggccgcgcaaatttgggcccggctcgcgttcgtgtcgcgtctgcttcaaccaccatggactgattcgtaaatattcactgaacgtttgtcgtcgctgcttccgtgaatatgcctccgacattggattcaaaaaactcgactgaatggcgaagaggaatttatgagcagtcattggagggttgttttttgtttgttctgttcgttattttatgttgataaaaaattgcgttaataaaaaaaaaaaaaaaaaaaa

SEQ ID NO: 48488 - DNA, 790 bp, Heterodera glycines
  SCN-specific regions: Sequence locations=1-31,70-790
cacaaattttctttatttgtacaaacatatgaataaattaatattttatacatttttgtattattaaatgtcatcacttatccgtggtgaaattcagcagtttgcatcttttgcaaatgttttccactggtttgatgagcttcatggatgcttccgacctcttcactcttttaaccaattgagaattccttggctctccgcccatttggccactatgtcggatgtggtgcaggcattttatcgacttctctttgtcgacgaggcgctttagtcactggcttagatgcggataaatctgtgctagaaattgctaatggttataaggaaacaatggcgccgacctcttcgcaaaaaaatagaatttattcctggcacgattgagagacttgcgcaagaaaaggatcgaatcggaacattcgatgcggtcgtttcttcggaagtggttgagcacgtttccgacttgcccttgttcattcggagttgttgcaaattggctcgtccgaattctccaatttttttcacaacaatcaaccgtacaatttggagccaactcttggctaaaacaatagctgaggatttgctccggatactgcctcaagggttgcatcaattcgaacaatttgttgctccgcgcgacttgcgcaaattgctactggacgagcagtgcagcgttgggccggtgcttggaatggcctacaacccattttttaacatttggaattggactcggtttactggcgttaattacgcacttgttgctcacactaaaaattaacataatttattgtgc

SEQ ID NO: 48489 - DNA, 849 bp, Heterodera glycines
  SCN-specific regions: Sequence locations=1-146,168-180,202-820
gtccatttaaggcttgcgcaatggagcagctttttcagcaggcgaatatggaccttcatcagatccatctcgaaatgagacatttggagctttgtaaaaatgagagtgaagcgcagcctctttttcagaagctccaccaacaaataaggcaatctgccgctcagctcgacggcctcgaacgtttggtgaataaagagccttctgggaagcgtcacacttcgaaatatcggtttgaacagctgcgacatgattataatgcccttgaaatggcaattaattcactgcaaaatcgactcacaacgaaatggagaacggctgcggaaagggaggagttgctgaccatgagatttaaaccaaacgaaacgcatttggactttgaggggacggaattgctcgtcaacgaccgactgaaacagtcgcacaacgccgtggacgatctgattgcgcatgggaattcagtgctcacttcgcttcgtcatcaacatttggggctaaaggacgttaaacggaaaatgctcgatattggtcaagtgcttgggttgtcaacgacaacactgcaaatgattgaaaagcgattggaggacgattggctgcttttcctcgtcctttgtgttttgtgcgttgtgttcatgtactgcttctacagattttggaaaggctaagctctttgtcctctctgctcacaatcagaataactcttgaaaaacgttatgatacttcctgaaaaggcattcccttttttcgggtcttttgctgattgtttttttctttcactgaattcttatattattttttcttgtgataataaattagttcgtttaaaaaaaaaaaaaaaaaaaaaaaaaaaaa

SEQ ID NO: 48490 - DNA, 1398 bp, Heterodera glycines
  misc_feature (1370)..(1371): n is a, c, g, or t
  misc_feature (1373)..(1374): n is a, c, g, or t
  SCN-specific regions: Sequence locations=1-561,642-758,780-935,957 -1047,1069-1371
cataaatgttttatcatctttcacttgagcatgaaatccaactacatcctaaatattttggccaaaatttaatggagacagtaaaacagaaactttttagtgaagtggaaggcacttgtacgggaaaatatggctttgttattgcggtgacgacaattgatactattgggcatggaatgatacaaccgggacgtggctttgttacttatcctgtgaaatataaagcaattgtgtttcggccattcaaaggacaagtgattgacgcggtagtcagtcaagttaacaaagttggcattttttgtgagatcgggccgctttcatgcttcatttcaaggcattgtattccaccagacatggaatttgagccgaacaacatcccaccttgctacaaaactgcggacgaaagcatagtgataaaacaggatgacgagattcgtttaaaattaattggaattcgagtggacgcgaatgacatttttgcaattggaactttgatggatgattatttgggtctttgttcgactgaatgaatgaatttttccacgaattcttttagttgcctaatttattaaaaaaattaacttattttaacattagttgttttttcattatatctaaacaatttttacttttttattaatcttataaccaagaatcacagaaatgggccttttcgatttgtcaatttttgacgagttccgtcgcatggatggtcgtcagattctgtatcaatttttaaatttcgccatgattgtcagttcggctctgatgatatggaaaggtcttatggttgtgacgggctctgagagtccaattgttgttgttctgtccggttccatggagcctgcgttttaccggggtgaccttttgatgctcaccaatgacttggacgacccaatcagagccggcgacataactgtgttcaaaattgaaggtcgtgacatcccaattgtgcacagagtaatcaaagtgcacgagaagaacgacgaagagaccaagtttctgaccaagggtgacaataacatggttgatgacagaggtctttatgcccccggccaatactggctgcaacgcaaagatgtggtcggtcgtgccaaaggatttgtcccatacgttggcatggtgactataatcatgaacgactatccgaaactcaagtacaccgttcttgcactacttggtctcttcgtgcttttgcatagagaatgaatggagaaattgattgcgaagaagtgttgtttttttaccgaggcttgatttgtttctcatctgtccattttcttttcggttcggttctatcatcttttttattgctttccttatttatgtataacttttcgctttaactaaatgattaaaacgttgttgcnnannaaaaaaaaaaaaaaaaaaaaaaaa

SEQ ID NO: 48491 - DNA, 813 bp, Heterodera glycines
  SCN-specific regions: Sequence locations=1-38,60-134,156-566,589 -668,690-776
gtttgaggatgtttttttctaattttgtggcgctcactttctgcattttctccatcttcattctgatcccaaatgtgtcagctgctgcctgcgagtcgcccaaatactccgccaacggttactccacgcaagacggatttttccactacaaaacttcttacattgttgaatttgcgatccaatgctctaacaattacaaggacgcgccattctacgcactggtcggtgaaaaaacgctccaattggctgtgtctgaggagaccaacaagtaccaggtgtcctggcaattggaacatgccgattctggtgcacaaacattcgatattcgcgtttatgacgaagacaaattcgcggagcacaaaaaggccgatgagtccggctcaagttctgtccaaccattgttcactgtccagcattaccacggcggcacctctcacaaaacgtggatttcctcagagtccgtcttccttttgttgggcgtcgtggcgctgtactttacgatgaatttacgccaattgttggccaaaagagactgactgaccaattggttgttgcccattctcccgaatttcacccttttaatccttcaatctgtgaaatgaccattttaagttattcctgacactttgggcttactcaatttatttgtaaccttttttggtggggtattttcgttttaacaacattttcaaccgtctcttcgagccttgttttgtcatccaattgatgactgttgcctaacttcattctttcattgttgataaaaaaagtcgttgaaaaaaaaaaaaaaaaaaaaaaaaaaaaaaaaaaaaa

SEQ ID NO: 48492 - DNA, 627 bp, Heterodera glycines
  SCN-specific regions: Sequence locations=1-567,589-593,615-627
gtttgagcattccttgatggttcgtcatgtgactgcctcctgctttcgtgcgccatggccttttgaaaaaaagggctcaactggatggcggaagaatgggccggttgttattgaatcgcacaaatggcccggtcaacaaaaggaattccccgagctctcgccaaaatttctaggagcaaactttaaacagctatggagatacaccggagtggcgcccacaggatttaatgaccccaaaactgacgattttgttcatgttcccgaaatggtgcccgaattggtcgtgccggacctagccaatttcgagctgaagccatacgtctcttacaaaacagatgcaaaaattgaagaaaggctacgcaattttgacaaaaaattgacaaaattcggtgggaatgagaaagcagcgattgccaattccaaagagacggaactatggccccctccgccaatcgacgcgaaaattctcttcgactttttctacgctgaaaaaattcgtcaggcatttgaaaaagggaagaagtaaaaaaagattagcagacgatggaccaaagcagacgattgacgccttatttttctctgttttattctccctttgataaacaatgattagctaaaaaaaaaaaa

SEQ ID NO: 48493 - DNA, 1074 bp, Heterodera glycines
  SCN-specific regions: Sequence locations=1-884,906-1001,1025-1074
ctgaagtatttttttgttataatgatcaacaaccacgtcaatggggcgaatgacgtcgacatggaaaggaccgaaaacgaaagttttggtgaacttaaccagcgactgattgcgcttaaagcggagaagaacaacaaagagagtgccactttggcggtcaaagtgttggccttttttgtcaactgcgacaacctcagtgctgcccaggattttgtggaggcgttgaagaatttgcccgagtcggcctccaacagcgattgggcccggtggttttattatttgggacgcatcgaagcgttgaagggcaccgacgccgagacgtacaaagcggcagagaaacattttgaggtcgcacttcgaaaggccccacaaaacggcgccgtcggcttcaaacaggaagtgaacaaatgggtcgtgctggtcaaattgctcatcggcgaaatccccgagcgcagtctcttccgcacggccgaacttcgccacgtgttggcgccgtatttgctgctgacccaaactgtacgccttggcgacgtggccggctttgaccagacgaagcgcgagcacgggcccatctttgtgaaggaccgcaccgctgcgcttgtcgagcgcatccatcagagcgtcattcggaccgcaattcgcaaaatttcgacgacatattcgcgcatttacgtgtccgacgtggccaccaaattgaattcgaccgagcaggaggcgcatcgcgagttggtcaaggcgatcaaagagggcattgttcgtgctcagttggtcgccggcgacccgttggcgggcgggcggcactacgtcaaatttgggaccaccgatgaccaataccgcgggattgagccccgcagggaattcgacgcgcgggtcaacgaactgttggagctgtaccaccaggcggtgaaggcactgcggtacccggacatgcgcaacccggaggtggagaccattgacgagcagcgcaggcgtgaacagttggctctcgaaatggcagcagcggaagaggaggatgatgacgatttttgaccaaaatgatgtttttgtttcacaaaaattttttatatgctgcga

SEQ ID NO: 48494 - DNA, 659 bp, Heterodera glycines
  SCN-specific regions: Sequence locations=1-15,50-659
gtccaattaagaaaattttctctttgcttctctctcctctgtttttcatttccttaaaagcggcaatgaccagtcgaattttgagctgcaatttgcgaaggtacttctccaagatgaaccaacacatcgagttcggcacaacgaagagcgcttcgtccgacaaacaatcgccgccttcccctacaaacaatcaaacgcaacacgagggaatgagtcaggaatgtcgggagcaaatcgagcagatggaaaagctgaagagcgacaacgaaatgctgaccgacaaatacaaaagaacacttgcggacatggaaaacttgcggaagagaacgcagcggcaaattgaggaggcaaaactttttgcaattcagccattttgcaaggatttgctggaggtggctgatgtgcttgacttggcgttgaattcgttggaaaaaatgaaaacggaggacggtgccgcctccttggacagtggagtgaacaaagggatcaaaatgacgaaggaagtgttgctgaagacgttcaaaaagcatgggcttgtaccggttcaacccgaaggacagaagttcgacccgaatttgcacgaagcggtgtatgaaataccgaaggaccagtcagataggcctgccggtcacattgcgcatgtgttgaacattgggtac

SEQ ID NO: 48495 - DNA, 767 bp, Heterodera glycines
  SCN-specific regions: Sequence locations=1-121,144-363,385-526,551 -593,615-639,661-767
caaaggtttcaattttcaacacccgtggcgacaccgtttgggagctcagcgaagggcaccgcaacgaagtgtacttcaacccacagagcacaattctggtcacttgtggcttcggaaacattgcttctggcaagatggagttttggaatttggaaacccgaagcgaaatctgtgcattttgtgctcctcacacgactcactttgaatgggcaccggacggacagcacatttgcacgtcgaccacagcgccaagactcaggacagacaacggatttaaactttggacatatcggggcgattttgtttatgaacaaaaatacgatcgagaggaactttgggagatcaaatggcgaccgtgcgcagcgtataacaaattcaaaattgaggagcccaacagagagcaaagtacatcaaattccagccgaataaacgacggaaatgccaaaacgcccttcgacaatttgccgaagggatcgctgacgcaaacggcgcgttacgtcccaccgcatctgagaggaaaaccgcagaaaaaggaagaaaaagggaagaacgagacaaattcggaagagacggacgtggggaagaaaattcggacattgcagaagaaattggacgatatttcgaagctgaagacgaaaagggccgcgggccatcagttggagttgaaccaaatggacaaaatacgcaacgaagatcgattgctggaggaaatggaacgactgacggccacggccaactgctgaaagaattagcatttaatgtcattg

SEQ ID NO: 48496 - DNA, 478 bp, Heterodera glycines
  misc_feature (456)..(456): n is a, c, g, or t
  SCN-specific regions: Sequence locations=1-422,444-451
gttttattgcctcagatgcccaaaaaacatacgcaatcgaataaaacgaggaaaaggtcgggaagagaccttgacgagatccatgctgatctgatcaggcccgacaaaatgcaaagaattcaggaacggccttttgacgacgaccttcccggcggaggatggcactattgcgtcgcttgtgaccggcactttgtggacgaacagacaaaagcggggcacgaaaagaccaaaggtcacaagcgtcgcctgcgcgcactgcgagaaaagccgtacacgcaaagagaggcggaattggccggcggattgggcgtggaagagcaaatcaaattggaaagcctggcggatttgacattttagcacccatttcttatagggtgaatttatgtttttttttgttgttgtttttgagttctttatcatacaaacagaaaataataaataacattttcgcaaaanaaaaaaaaaaaaaaaaaaaaaa

SEQ ID NO: 48497 - DNA, 1028 bp, Heterodera glycines
  SCN-specific regions: Sequence locations=1-445,467-1028
ccaataaagattcctattcttattgctagtctgtttattcatcataaaaagcaatcctggactccattcaattctttgtacctgacgacatgaaaagacaatttgaaccaatggaacaacaccaaggccgaatgtcttcagggaccaagcgataccgagccgatggttacaacgatgcattggctgaagggaaatttgaacttcgtcttttgataccgacgaagtctgctggcgcagtcattggcaaaggtggcgagtcgatcaaatcgctccgcgccaagtacgatgccattgtaaccgtccccgatcgaagcactcccgaacgtgttctgaccatcgtgtgcgcccaggagaagttggctgattgtttcgcggaaattctggagaaactaactgaggaccaaggcagagatgatgtcgatgtgcgtgtgattgtccatcagtctcatgccggagcaattattggcaagcagggcagcaaaatcaaggagcttcgtgaactgatgcaagcacatatcaaagttttccaagaatgcgcaccccaatccacggatcgcgttgttctcataaccactcaacaatccaaaatgccggatgcaattaagcacctgatggagtttatgcgcgaggtgccaattaaagggccaaccaaaccatacgatccgagtagccacgaccctcgcattgtgcagtgttatgggggcttcagcggaccaatgccaccacctccaatgggtggtccaccgatgggaatgcatggaggcggaggaggttatgcaggttttggaccacgtggcggaccgcctatgcctggtggaatgggaatgcccggtggttttatgcaagaacaagtgaccacgactcaagtgaccattcccaacgagttgggcggcaccatcatcggcaaaggcggagatcgcattaatcggtagtcacccaaaataaattcaaattttgttattatgctgacacagaattcgggcggaatcgggtgctcgtattgagatcggaaatgcttatgggaacga

SEQ ID NO: 48498 - DNA, 546 bp, Heterodera glycines
  SCN-specific regions: Sequence locations=1-546
ggtatttcggtctgcagaaatggcttttgtaaattctttatcgtccaacactaaaacaattcactttttgaagaagtatttacttcttgcacacaattattgcactttttcgcgcgaatggtctgagatggaatatgaaaggcgcgctgaggacactttggtggcactcactgagtatttggacacattgccggaccgtgtcgattgtgaatctgccttcgatgtttcatattcaatgggcgttttgaccgcgcacataagcccacgaataggcacttatgtgatcaataaacaaactccgaacaaacaaatttggctttcatcgccagtttctggtccaaaaaggtacgacctcagcgacaaaggccggtgggtgtataagcatgatggagttacgctacacgaattgctcgagaaagaatttagacacattttcaaaaacgatcaaatttcgttacatcagagttaaagatttatcgttttttataccgatataaattttatttggtgaaacccgccgaacgaacaccgctacaaaagagcccg

SEQ ID NO: 48499 - DNA, 1014 bp, Heterodera glycines
  SCN-specific regions: Sequence locations=1-71,165-194,247-1014
aaaaacttaaaaaaaaaaatgaaaaaagtcactttatatatatatttctggcgcagcgtttttatgtacacaaaaaaaaaataaaaaaaaaaataaaattcaactgtaatattaaaaatttattcattaaataaaaaaaaatatataaggagaaaaaaaaaaaatattttttttttacacctaaaaattatattaaaaaatagaaaaataagaaaaacttaaaaaaaaaaatgaaaaaaaaaaaaaacccatctctccgcatcacctttggtaaaggttctaagctcaggtgagaacatccctgcctgaacatgagaaaaaacagggtactcatactcacttctaagtgacggctgcatacttttgagtttaaagctcaaactttccttattcgtgatgaaaaagagtgctaagcccgaaattcaaacagcacagacgcgaatcgcaattgtaaacccggacagatgcaaaccgaaaaattgtgggcagccgtgcaaaaagaattgtcccgtcgtccgcactggcaaacaatgcattgtggttgagccaacatcgaaaattgctgaaatttccgagatattgtgcatcggatgcggcatttgtgttaagaaatgcccttacggggccatccaaatcatcaatttgcccagcaatttggagcgcgagaccacccaccggtacagtgccaattcattcaaattgcaccgcctgcccacgccgcggctcggctcggtgctcggcctggtgggcaccaacggaattggcaaatcgaccgcgctcaacattttgtccaaccgactgaagccgaacttgggcagcttcaagagtccgcccgattggccctcaattttgcaatattttcgcggctctgagctccaaaattacttcaccaaactgctggagaacaaattcaaggcgatcacgaagccgcaatacgtcgaccaaatcccgaaattcctcgaaaaacaaccgctgaaaaaggttggcgaattgttggagaaacgggcgcagaaa

SEQ ID NO: 48500 - DNA, 601 bp, Heterodera glycines
  SCN-specific regions: Sequence locations=1-59,82-418,441-601
agcttttcattttccttgttaacaaagcaatggcacacatccagtttggaccgcaacaacccgaggtggaggaggacctggtcaactgggacgaggtgccagatgatgagttggaggagactgcgttcgaacgttttgaggggctcaaggaaatgtttccgacaccggtgcgctctgcgttgtccaccactgtgcaattgacatgggtggtagcgcagaattcgttctcttttgcacgcagtgctgcttgggtgttgtcgaccagcgcgctgctcatggtgatgccgtacattgtggacaaggagttgcaagatgtggagaaggcacagttgaaacaacagcaacagttgctgctcggtggacggcccagctgaaatgattgattttgatcaaattggtcgatcagagagcgcaattttcttgatcagcactgattgatttcgatcactttttgttgcttttttccattttttgattgtttcgtttgttgtgttcacaacaattagagcgcctttgccccgtttaccctcaaatcgtcgccattatccgccgtttttctttgtttgaccaatttcttcaagctattgatacataaaatttt

SEQ ID NO: 48501 - DNA, 551 bp, Heterodera glycines
  SCN-specific regions: Sequence locations=1-162,184-323,346-432,455-528
caagtttgaggtaacttatggcgcaaaatactgcacaaattgaagagttcgttcgtttggtgctcagttcatggccttcatatcaatttgcgattaaaaatcagttggcgggatcattaacaagtgccaaggatgcatggtttgtcgaagagctcagtgcgcatttgctgaagcacaaggacatttgtccgtttgcgctgtccgattggatggaggacattttggacacggagttcagcctgatttcggacgatggcactttggagcccaccgccaaattgttggttgagttggccgatttgactgtcggaaggggcgcacacaaaggggcggaggcggcagcaaaactcgaggagcatttgcaaagactgcgaacactttccgctaaatcttgcacaaattcaacaacgccccgtttggacagttcttcaagtgaaagtgaagaaaacaatggaagcgatgaagagaacgattggcagtagattgttgatgagacgactgctttttaatcattgttgttttttttgtaattaaatttgttaattcaaaaa

SEQ ID NO: 48502 - DNA, 955 bp, Heterodera glycines
  SCN-specific regions: Sequence locations=1-3,25-251,281-350,376 -582,604-955
gtttgagcaattttaaaaagtgattgtgccaatgttgccaatccggctgctttttctgttggccgtgccgtcgtcggcaatgggccaatttgacttgggtggactgctcggcaacgtcaaccaatttacgagccaagcgggcgtcaatttgggcggcattttcggccagatgggtcaacagcagccgaacacggcgcaaagcaatgatcaaccgccacggcattttcatcggggcggaccacccccacaccatcatcgagacggcggcggtggtggcggactcggcaacatcggcggtgccgtggaaggcatactgagccgtgtgggtgtcaacccgcagttggccaaccaatttggcaaaatccaaattccgcccattccgtcgttggcggtgcacaatgtgctggacggagtgccgggcattttgcgccaatttttgcctgcccaaactgtgggccaaatcaccgcaattgcacgccaagcgattgagtccatttgctcttcggataattgtcttcagcagaggccggaatggcttcatcagcgggcgacagttgcgcagtttgaaactttgatcagaaaaacattttcaccaggccaatcggacagtcaaattggtcgtgacgtggagatcagactttcgcgaacattccaagtgaagaaggcgttgattcgcaaagctggcctggagggacgcgttgagccggcgaacaatggcgttttccagcaagatttgctgctaacggaacagcaggcgaatgtgctaattacggagatcaatcagaatgaggttggcgttggtgccgtgccgccttctgacaaccgccgtttcagtcgtcggcacaatttcaatcgccgtcgtttcactcgcgccggcaattcgctgttctttgaagcttctcccacccaaaaatggccagtcggacaaccaattctgtacatgttcgatcagtcc

SEQ ID NO: 48503 - DNA, 1309 bp, Heterodera glycines
  SCN-specific regions: Sequence locations=1-190,212-587,611-994,1021 -1309
gtccaattaagatttgacaaataaaatgtccccttctctttccgttgccaactcaaatgtctctcgaccgcttggccaaccaaaagtagcgggcttcaaagataaggataagccggaaagtgttcgtactagcaacattgtggcagcaaaggctgttgcggatgcggtgcggacgagtcttgggcctcggggaatggacaaaatgatccaatcgggcaacggagaagtgacaattaccaacgatggggcgactattctcaaccaaatgtcggttgtgcatcccaccgcaaaaatgttggtcgagctgtccaaggcgcaggacattgaggcgggcgatggtaccaccactgttgtggtgttggccgggtctttgttggacgctgcagaaaaacttcttgccaaaggaattcatccgaccaccatttccgactcattccaacgggcggccacattttctgaaaaagttctcgaggaaatggccacacccattgacattaacgatgacgacgagttggtgaagctcgccatgacgagtttgaactcgaaggtcgtttcgcaatattcccatcttttggcaccaatggcggtgcaggcagtgaagaaactgatgagttcaccggaggactcaagtgtcaatctgaagttgattaaagtcgttaaaaagttgggcgaaacggtggaggagtcgcagctcattgagggagcgctgatcgatcagaaatcgatgggccacggaggccccgcgcgggtggagaaggcgaagattggcctcatccaattccaaatctcaccaccaaagcccaacatggaaaatcaagtggtcatctctgactatgctcaaatggaccgtgcgctgaaggaagaacgaaattacattttggaactgtgcaagcaaatcaaaaaggccgggtgcaatgtgctgctaatccaaaagtccattttacgcgatgccatcaacgaaatggcgctgcattttttcgcaaaaatgaaaattatggtgatcaaagacatcgagcgggatgacatcgaattctatgccaaaatcctcgggtgtcgcccggtggcatccgttgaccattttgtcccggaatcgctcggaacggccgatttggtggaggaaattgagacggctgatgggaaagtcctcaaagtgaccggccttaaacacactgggtgcgctgtgtccattttggttcccggctccagcaaattggtgttggacgaagccgagcgctctctgcacgacacattgtgcgttattcgctgtttggtgaaaaacacgcccttctgaccgggagaggtgcccccg

SEQ ID NO: 48504 - DNA, 963 bp, Heterodera glycines
  SCN-specific regions: Sequence locations=1-67,89-110,132-935,957-963
ggaaacattatgactttgcttatcaccggaatccttcgcaaatttgcacttacaaaattcccatttactgcatcaaattcttctttgtcgtcatggtgtaaagctcgagagtccccatttcccatctcaatggcgaacaattggaaagcctttttgttgatgaacgcgtccaacgcttgctgctttcgctgaccggccatgacaccgacaaaattttgcgccatcgtcgcatcaaccaaacggagcgcaagcattacgcgttgatgacggacggcatggtgaaggagttcatgtcacgactggaccaacgggcgggcaaatttctgcgaattgtgccgttcaaagagccgcgctcaaaccgaaccgaagtgttggcacgggacgcggaaattgacggatttgacaccgccaaattcgttttcaccgacatttcattcgacgccacagatatggatcgcactgtcgttgtccgggagcaggacggaacgctacgaacggcgttgccggaagaacacgatcggatgaatcggctgttttttgtgcaacccaatcggcctgtcaacgaaccgccgctgtttgcaatgaccgacgaatggttacagaagacgctggaccgtgatgagcatgagtttgtgctggactgggcctgtcatttttacgagccggacgctcccaaatttgttgagctttgtaagtacatttttgaccacacattggaaaatgacaagttggacgtgctgtactccaccagacatttcggcacattggccttctatttggtgatcaacggcaaaatggacaaactgttggaattctatgagcagaagaacagaaatgacggcgtagatcaaacgcgacaactttggcagatactttcttgttattgaagttttaattggatttctttctaaatgtgccgacaattttttgaataaattttgttcattttcaaaaaaccggaaa

SEQ ID NO: 48505 - DNA, 667 bp, Heterodera glycines
  SCN-specific regions: Sequence locations=1-71,96-104,127-667
ctgaaatataaaccacaaataaaccgacaaaaacgaaatggctccacgaggaaacaacatgcttcccaatgcccacttccacaagcattggcagcgtcgtatcaaaacttggttcaaccaaccggcacgcaaggaacgtcgccgcgctgcacgttccgccaaggcggcccgattggcaccgcgtccggccggcggtctgctgcgccctgttgtgcgttgcccaagcgttcgctacaacaagaaatgccgggtgggccgcggcttcacactggaggagttgaagcggtccggcatgggcaaatacgaggccagatcgttgggcattgcggtcgacacacgccgtgttaaccgatccgttgaatccaccgagcgaaacgttgcgcgtctcaaggaatatcggtctcgtttgatcattttcccgaagaagatgaacaagccgaagaagggcgacagcagtcccgaggagttgaagctggccgcacaaatgcccggctctgtggtgatgccgccggtggtcaaacagcgccggttgaaggctgagccgatcaccgaggcgatgaacaaattctccgcctattgtcaccagcgtcgcgtgcgggcggacaaacggttgaagggcaagcgagaaaagaaagcaagaaacggcggacgaagggctgggcaaaag

SEQ ID NO: 48506 - DNA, 362 bp, Heterodera glycines
  SCN-specific regions: Sequence locations=1-340
gttctctttccgatgacttcgtggcgattgtgtttaggaaagatcagacgaaaagagatggtcagattgtacaaagtgaaaattatgcgttctgatggttccgtcattttcggacgttgcgacgaaccgagggaaatcattcaacttccggtggaccttcggacactcagtgacgacgagcgaaggatgcgaatagccgagcgaaagccaattgccaagaaagtggttgaggatacattggacgactccttcgactttcacaaatatgtgtctcaatggaagcgatgataaaaccctttctttgttcgttagatttttgaataataaaaatggtcaaattaaaaaaaaaaaaaaaaaaaaaa

SEQ ID NO: 48507 - DNA, 669 bp, Heterodera glycines
  SCN-specific regions: Sequence locations=1-669
ttgaggtattactataactcatttattgttaattgttcggtcggaatatctgctcgtccttttggctgtcattcgctttaaatgatttccggtcaccgttcggttggcagatgtttgctgtctctgccacaatttgcaagtcggttgattcccatttacggccatgtccaggcacaatgtttccacttcatgaaaaaacaagtcaccgtcgacccagaaattgcaaaactgagagagggcagaaaacggcgtaaattgacaaaagcaatcaaaaagctggcggagtacagcaaaaagccggtaccggttgaggagattgaggtcgacctacgccaccaggcaacgaagggacagagggaacggacggacaacggagtacaaggacgagacgagaagaaagaggcatatggcagaaagaagttgctcaagcagtacgcccagtcgagagccaggctggccagaacggacatcatgtggattaaacgttcaattgatgcccaagagaatgcgttggaagtgttgaagcaactctctcccacactttacgaagcggcggtacaactcgacgagcgcttattctacacacaaattcaaggtccaccaatcagtccgccgattgacaattacaattgcccagacggggagtaccaagacgtaaccaagaaatgg

SEQ ID NO: 48508 - DNA, 995 bp, Heterodera glycines
  SCN-specific regions: Sequence locations=25-844,867-940,962-965,988 -995
cctcgtgccgaattcggcacgaggcattttttgccattttttcattttcgttactgttcattttgtgccatcattgttcatttgccgcttttttgatcaccaattatccaaatccgttaaacaacgcttcgctgtggaaatgcggcatttcctcgccgggccctttgtgcgacccggactcgctgctcaacgaaacggcacggcacgaggcattggagcttttgaagcagtttcaggaccaaacggacattgatgacaatggcgatggcagctgcaaaggcaaaggagtgattgttgggttggcgctaacgaaacagccaatcattgcgaggaatgcgcggatcaatgtgacggacgatctgatgaagaacatttggcagttggacaatcggtgcaacaaggcgctgatgctgacgctgtccgtacagccaacccccgtggtgcgcttcactcggtacatgaccacgccggtgtttgacgacgagttgcaccacctgatctggactgagatgcattggcttcgtgatcgcaattacatcatgtgggtccgcttggtgctggacggacttagggcactgatcgtggaccggcacaacactttgggcattggcccggcccagcagctggcggcagccaacaaaaagtgtgccagccatggcttcgtcattttcagtgcgttcattgccgtcctctgctccatcgttggcactatgtgcgcaccgctgctttggcataaatgctgtgaacgttttgggcccattgttggaaagccttcactgccattcccgatggtccgctttaacaatgaacgtgacatcggcccttacacaacgacaaacaatggccaccaacagcaacaacaacaatgaagcaattacaaatggactttttaagaatttaatgcacagcgaatgctcgatattaataaaataaagttacaaagagatattttaataaatattaacccattttaaacaaatacatattaatgtggt

SEQ ID NO: 48509 - DNA, 1156 bp, Heterodera glycines
  SCN-specific regions: Sequence locations=1-707,731-893,923-1102,1124 -1128,1150-1156
gtttgaggtttaaggccttaagcctgctaattgacatcttgaacctcaaaccttctcctgtttaaaaaacgacaaattttttgatggctgctgtagtcacaaacaatagcaaggaattcatcgttggtgtgaaatacaagctcaagcgcaaaatcggtagcggatcttttggcgacatttacctcgccatcaatattcagaatggtgaagaagtggcggttaaacttgagtcagtcaaggctcgccacccgcagcttctctacgagagcaaggtgtacaaaattctgcaaggaggggttggcattccgcacattcgttactacggcatcgagcgcgactaccactgcctggtgatggatttgctgggtccttctctcgaagacttgttcaacttttgttgccggcgcttcacgatgaagactgttctgatgcttgccgaccaaatgatcggacggattgagtacatgcatgtgaagaactttattcatcgggacatcaaacctgacaattttctgatgggtatcggtcggcattgcaacaaactcttcatcatcgattttggattggcaaaaaaataccgtgactcgcgcacgcgcatacacattccctaccgagacaacaaaaatctgacgggcaccgctcgctatgcgtcaatcaatgctcacatgggtatcgagcagtcgcgaagggacgatatggagtcgctcggctatgtgctcatgtatttcaatcgtggaaatttgccatggcaaggcctgaaagcggctaacaaaaagcagaaatatgagaaaatcagtgaaaagagaatgtcaaccccggtggaaatgctgtgcaagggattcccttccgagttttcaatgtatttgaattactgccgtggtttacgctttgacgaggcacccgactacatgtatttgcgtcaacttttccgcatcctatttcgcacattgaaccatcagtacgattacacatttgactggacactgctgaaacagaaggcaacaatgaataacgcgaacagcacggccacttatccaactgaggcggccgccgggacgtctgctcagcagtgaacattatcgtcgatgatttatcattaccacaccatcatcatcatttattttgtaaacattataaagcaccacattttaaaaaa

SEQ ID NO: 48510 - DNA, 1148 bp, Heterodera glycines
  SCN-specific regions: Sequence locations=1-306,328-1072,1094-1148
gtttgaggcatttgttcactttaatattttgccatgtcttttcttgtcacattagccggctatttgacaattgccatttttctccagaaactctttcgctctctgtacaatgtggttttcccctatttgttcgctgttcctcagaatatcaaggtgctcgcgggtgccgagtgggcagtggtcaccggcagcactgacggcattggcaaggcgtacgcgctcgagttggccaagaaaaacttcaacgtggtgctcatctcacgctccatggacaaactgaacgcagtggcggaggaaatcaaacagaaatatcccaatgtggaagtgaagtgcatctcatttgacttcaccaacgcaaatctgaaggactacgagcagacaattttctcccaactttccaccatcgaagttggaatgctcgtgaacaatgtcgggatgagctacgagtaccccgagcgattggaccgtattgagggcggactgcaacgcgtctccgacattaccgtgatcaacaccctgccgactacggtactctccgcttttgtgctcaaacagatgagggaacggggacgcggcgtcgtcgtcaatttggcctcctcggcagcgtatttcaattggttttacctggccgcttattccgcgtcgaagaaatacgtgtgttggttgtcctccattctgcgcatggaatacgccgacaccgacattgtcatccaaacggtgtgcccgatgatggtggccaccaaaatggccaagattcgcaaggcttccttcttcacgcccagccccgaggaatttgccgcccaagcgctccgcagcattggcttggtcgacgagaccaccggctgtttgtcccaccaaattcaggcggagctgatgttcggctacgtccccgccccgttgctgaacaaattcgtgcgcgacaactcactgcagacgcgcaagcgcgccctgaagaagaaggaagcgacggtggcgaagagtgaatgatgagaaaaaagaaagaaaagtgatgtgaaatattgacattcattgaaacaaccaaagtaaattaaagttatttaataaccaattctaatgccatttttgttattttatattcgtataggatgggaacacacagataaaattctaaagtgcaaaaaaaaaaa

SEQ ID NO: 48511 - DNA, 508 bp, Heterodera glycines
  SCN-specific regions: Sequence locations=1-30,53-508
actgcaaggtcaaagctgtttggatcttactttattcatttaatatttatttcaatggcttttggacaaaagggaaaactgttggctgtcattggagatgaagacactgtggtgggctttctccttgggggagtcggtcaattgaacaaagcgcggaagcccaattttgtcattgttgacaaaaacacaagcgtcgccgaaattgaggacgcattccgcactttctgtacccgcgatgacattgcgattattctgataaaccaacacgtggcggagatgatccgataccaggtggaccaacacgtggccagcatcccggccgtgctcgaaatcccctccaaagaaatgccttatgacgcgtccaaagatagcattttgaaccgagcacgtggcctggtgaacactgacgacctcaagtcatagaagaagacattacaaaaaacaaattctcctttattagtcaatgaatgtgtttaattaattatgggaatgacgagaacctacatac

SEQ ID NO: 48512 - DNA, 773 bp, Heterodera glycines
  SCN-specific regions: Sequence locations=1-152,174-277,299-406,428 -617,642-737
atttaagtcgctttatttccttttgccatttaattccactttgttctcccggttcgatattcaatattatgtttaacctgcaagaccgttgtaagggcgttgaccaggaccgcgattaccacgcgactcgcatttcaattcgggacaaattgctcagccaagagaccaaagagttggaacagaaccttcgcgatttgcccacttgcaaattgattttcccctcaacgtcggcgctgcacgaaatggagctgacggttaagccgaacgtgggcctttacaaaggcggcgctttcaaattcagcatcaccgtcccaccggagtacaacaacgtgcctccaattgtgaagtgtctgacccgcgtttggcatccgaacattaacgaagacggaagcatttgcctgagtttgttaaggcaaaactcattggacggatatggttggatgcccacgcgccgcatccgtgacgtcatcctcggccttgaccaattgttcaccgatctcatagactttgacgacccgctcaatgcccaagcggcgcagcagtggcaaaccaacaaagatggatttgcccaaaaagtcaaggaatacatgaccaaatactgcccaagaaactgacaaaaagacggagaaagggaaaagacgggcgataaattggcaaggattctttaatgatggacggatttgactaaagtttgttttgatcggacattatttcaactcgtttacatttgatcgttgttataaattttctattcttaaaaaaaaaaaaaaaaa

SEQ ID NO: 48513 - DNA, 493 bp, Heterodera glycines
  SCN-specific regions: Sequence locations=1-82,104-493
tggaagggcggtgacgagcagaaaaatgtgccggtgccgagccccaaagaaatggcccagcggccggcggagtttgacgagctgacgcacacgggacaggcctgggacattgccgattggcgccgttctcgtttcgagtacatgccgaagcaagtgaacccgaacattgcggcccatttgatcgccgagctggcgcccgtgcccagcgaggagcgcgtggtgcgctgcgacgggggccaccgcgagttgggccacccgcgcgtttacatcaacttggacaagccgggcacacatgcttgtggttactgtggccaacgcttttacaatgtgcacatgacaaaggccgagggattggacattcatcatattcaagtgtagcggttgaagaacatacagatggtgatcgggaaaaagtgatcgaaatttcgttttgtttattttttcgccaaagctcgtaatttacaaggcaattattaaaaaagctgtggattgt

SEQ ID NO: 48514 - DNA, 860 bp, Heterodera glycines
  SCN-specific regions: Sequence locations=1-177,228-259,282-288,312 -540,571-860
ctataaccggctgccatcgtcaacatgaagctcaacattgccgacccctcgaccggttctcaaaagacctttgaaatcgatgatgagaagcgctaccacgtcctcatcgacaagcgcatctcgcaagagattcccggcgaccagctcggcgacgagttcaagggctacatcttcaagatcaccggtggaaacgacaagcagggtttccccatgaagcagggtgtgctcgtcaaccaccgtgtgcgcctcctcctctcggagggccactcgtgctaccgcccccgccgtaccggcgagcgcaagcgcaagtcgatccgcggttgcatcatcaaccacgacatctcggttgtttcccttgttgtcgtcaagaagggcgaggccgacattgccggtgtcaccgacgtgactgtgcccaagcgccttggccccaagcgcgcgtccaagatccgcaagatgttcaacttgaccaaggaggacgatgtgcgcaagtacgtgatccgccgtgaggtgcccaagaagtctggcaagcccgagtccaaggcccccaagatccagcgtcttgtgacccccttgacgctccagcgcaagcgcgcccaccatgccgagaagcgcaaccgcgccgtggctgcccgtgaggccgctgcttcctacaagaagttgctcgctgaccgtgcccatgagctctacgccaagaagcacgccaagcgtgtccagcgtcgctcgtccacccacgcttcgtcgaccgcctaaggtcggtgacttggaagtctgcgaaaagcactttttgtcaaagtgtgcgtgtgtgtgtgctgctctctttttggatcgggatatatacattcatgcttgcttgaaaaaaa

SEQ ID NO: 48515 - DNA, 645 bp, Heterodera glycines
  SCN-specific regions: Sequence locations=1-645
gtttgagctactcgcaaaccattcgatttcaaaacaattcctttcaaaacaaaataaatgggcacaccctccaggcgtggcaggaaaagaaagtctgaagtagtgcccgataaaagaacatcgacatcttcagcaagatcaaaacctttgatgccgcgcaaatcatttgtgccgttgtccattgaacagtttcggccaaccgcagttggcacacgcgtgctgagctgtggcgagggcgaacaattgggccatccaaatcggaacacaacgaaaaagccgcgtgccgttggcacattcccaaccgacatgacatttgttcaggtcgccgcgggcggtgttcactcgctggtgttgaccactgatggacgtgtgttcagttgtggcatcaacgagaagggcactgtgccggtccaaggcctggaggcggaaggcaccaccgacacattcagcgaaattgtgttcaccacggacatccaacggcttggcaaaattgtgcagataactgccggcgcgtcattttccgcagcgctcaccgaaaagggcagtgtcatcgcgtggggaaatttgagggatacccaaggggaagtcaatgtgcacgagacgctcacggacatacagaagaaaccgatggtggtgatgcggcac

SEQ ID NO: 48516 - DNA, 837 bp, Heterodera glycines
  SCN-specific regions: Sequence locations=1-235,257-837
agtccaattaagtttagtttaaacgggttggcgagagtaatgcttctttcgaaaatcccacctcctttttgtattgctttgcgcgccgcttccacaaatccgccggctcgtggcccaagtgtaaaaacctttgaaatttaccgctacaaccctgaaaagccggaacaaaaaccctttctccagaaatacgacgtggatttgaatcaatgcgggccgatggttttggacgcactgatcaaaattaaaaatgagatggatccaactttgacttttcgtcgttcttgtcgagaaggaatttgcggttcgtgcgcaatgaacataggcggcgagaacactttggcatgcatttgcaacatcgaaaagaaaaccaaatattccaccaaaatttaccccctgccgcacatgtatgtggtcaaggatttggtgccggatatgactctgttttacgagcagtacgcttcggtgcagccgtggctgcaaaagaacaaaccgaccaaattaggcgaagccgaaaacttccaaagtcaggcggaacggaccaaattggacggtctctacgagtgcattttgtgcgcctgctgcagcacttcgtgtccttcttattggtggaactccgacaaatatatggggccagccgcgcttctccaatcgtacagatggattatcgactcgcgcgacgacaaagccaacgaaaggttggaacggctgaccgaccctttcagcgtgttcaaatgccacaccattctgaactgcaccaaaacgtgtcctaagcaccttaacccggcgaaggcaattggcgaaattaagaaattgttaaccgggatggaaacaaagccg

SEQ ID NO: 48517 - DNA, 622 bp, Heterodera glycines
  misc_feature (191)..(191): n is a, c, g, or t
  misc_feature (209)..(209): n is a, c, g, or t
  misc_feature (211)..(218): n is a, c, g, or t
  misc_feature (220)..(224): n is a, c, g, or t
  misc_feature (229)..(232): n is a, c, g, or t
  misc_feature (234)..(234): n is a, c, g, or t
  misc_feature (238)..(238): n is a, c, g, or t
  misc_feature (251)..(251): n is a, c, g, or t
  SCN-specific regions: Sequence locations=1-622
cctatcacttcattcccaaaatgtccttccttcgtctgatcacttttgttcttctgatcactctgtgctctttgccttctctggtcgaaagcggcctcattggcattgtcggcactcccgttgaagccgcttggtgcggtgttttgggcaaagaatccagccattgccctactgctggaggcggtcaacantggcggaggaggaggagnannnnnnnnannnnnacacnnnngncaanctgttttatttanattacgagagtaccaagaaacatcccttcgcctgcttgtgcacttttcgaacgggcctgagacattacgtggacatttgctctccggtcaaatcgcatgtattgaaagcgctcgtcgaagtttcggcggacgaagagacaaaggcgaaacttacgctgcttagcacggcgtcggaggagggattgcgcgagtacccccaattcatcgtggaggagcggcgcagcattgtggacgtgttgcagcacttccccgcctgcaaaccgcctttagacctgctgcttgaactgctcccgagtctccaggcccgctattacagcatttcgtcctcgccccgcgtggacgcgtcactcgtcgcgggtactgccgttgtg

SEQ ID NO: 48518 - DNA, 911 bp, Heterodera glycines
  SCN-specific regions: Sequence locations=1-225,247-329,351-530,552-911
ctcaggtgggattgaacctgggactccctgtttggtggcaaactcacagaccactaagacaaaaaatcaattagtttttgaactgggggctcaaaattgactcggtgtgttaaactgttttaagcaattttgaattacgactatgatcacaatttttcagttttttgttcccaatccaaagagtgtagttgacaattgaattatataaaattccatgaattttgctcacctttctttgttccaattaagtgttcttttcacgtgaaatttgactaacaaattgactcttcgagtctcttcatttattcatcaacattcgcaattcgtttgtttcttcactaatgagtggtgaattgcggcttgattcgagtcttgatctgatgcggcgtttgccaccgcaaaactgtgagaagcatttgaccgatttggtcgctcttgcgcccgacctttgcgagtctttgcttactgccgttgaccaaccgcttaaagtggcgaaggacaaaacaacggggagggaatatttgctctgcgactacaacagagatggcgacagttacaggtcgccgtggaccaacgcttacgaccccccgcttgaggatggcgtgtctccttccgacaccattcgaaagttggaaattgaagtcaacgccgccttcgaggcctatcgcgacatgtatttcgaaggcggagtgtcgagcgtttacctgtgggacattgacaacggatttgcgggtgtcgtactgctcaaaaaggagacggacaattcgctgtcggggcgccagggcgtcaagggttgttgggactctatccacgtgctcgaagtcaatgagaagacgaaggcggcgaaattcgccaagtacaaattgaccagcacggtaatgctttggctgcagacccaaaacccgacaacc

SEQ ID NO: 48519 - DNA, 730 bp, Heterodera glycines
  misc_feature (727)..(727): n is a, c, g, or t
  SCN-specific regions: Sequence locations=1-134,156-248,272-281,305 -404,441-446,472-482,504-730
gtttgagcaatttctttttcctgtgtttgaaacttccttttcgaaacaactgatatttcgcaatggctcgtacgaaacaaacggcacgcaagtcgactggtgggaaggcgccgcgtaaacaattggcaacgaaagcggcgcgcaagtcggccccgtccacggggggcgtgaagaaaccgcaccgataccgtccagggaccgtcgcactgcgtgaaatccgccgctaccaaaaaagcaccgaactgctcatccgcaaattgcccttccaacgattggtgcgcgaaattgcccaggacttcaaaacggacttgcgctttcaatcggctgccatcggcgctttgcaggaggcttctgaggcttatttggtcggtctttttgaggacaccaatctttgtgccatccatgcaaagcgcgtcaccatcatgccaaaagacattcaattggcccgtcgtatccgtggagaacgtgcttgaaatggtgggcggtgcgtccgctgctgctttggtggaggatgagcaatgaatgactctgattgagctgaccttcgttcgatgattccaatgattgcgttcccctggcgatgtcttttcccctaaatgttccatcccttttaacttttggtgagcaatgtttctcttcttttccatttttgcttctttctttccattgctctgtaaatttgtcagctgtttcctttctgcataaaaaggggagccatcaaaaaaanaaa

SEQ ID NO: 48520 - DNA, 529 bp, Heterodera glycines
  SCN-specific regions: Sequence locations=1-474,496-529
tatttactttattcattcaatggacgaatattcaagggagccatgcccacatcggatttatgcggatgctgggagtgcttttgccatgggactgatcggcggttctattttccacggcataaaaggcttctcaagtgcgccgagaggacaaggacttcttaacatcgctcgagaggttcggatgcgcagtccggtgacgggctctcaattcgccgcgtggggtgggatgttctctgtgatcgactgcggcctcgtttatatgcgtcgaaaggaagaccctctaaattcgatcgctgctggcggtctgaccggcggtttgctctgtgcacgaatgggttggaaaacggcgctggtgtcggctggtttcggtgcagtcattctgacgatgatcgaaggggtgggcattttgatgaaccgagtgatggtggcgcaatccgacgcagcattggcaccttcccccgcttaattgtccaatttgttcattttgttgttttagtccggttttaaagagtaaacattttgaacaaaa

SEQ ID NO: 48521 - DNA, 645 bp, Heterodera glycines
  SCN-specific regions: Sequence locations=1-15,37-199,222-366,388 -610,634-645
ctaaaaccaacccccttgaatttgatgcgttttcttaatgggctgtccgtaaattaaggaggtcttatccataaagcactgctttcattgttagcgttgaatgattgagaacatagttcccattttcaggtgtacatgttcaactacgactccacccatggccgtttcaagggcaaaatttccacaaacgccggcaatttggtggtggagaaggaggggaagagcgcgcacaccatcaaagtgttcaacctcaaagacccggccgaaatcaaatggggcgaagcgggcgcggaatatgtgatcgaatccaccggagtgtttaccaccattgagaaggttgtgggtagaggacccgggatggctaattataagcaaatttaacatttaatgatgagttttttaaggcctctgctcatcttaaaggcggtgccaagaaggtaaagctttaattgctgtcttttggtgcattttttacgtctcaaaatcaatcccataaatttactacgtcatcaaatttttgcatttgtcacactgattgtaaaaatacgaataaacccaaaaggtggtcatctccgctccgtctgcggatgcgccgatgtacgtgatgggcgtcaacgaggacaagtacgacccggctaaggacga

SEQ ID NO: 48522 - DNA, 632 bp, Heterodera glycines
  SCN-specific regions: Sequence locations=1-483,505-632
cttttttcgtcaattttgacatgagttcagaatcggacgaacagagtgccgatgttaacggactctgttcgcaatcgcttcgatcagatgaaaaagtgtgtcccgacccggacacaattaaaatgtttattggccaaattccgaaggcgtgggacgagttacaactgaaggaatactttgaggagttcggtccgatttatcagctgagtgtgctgcgggacaaagagacggcctccagccgtggctgttgcttcgtcacttattatcaccggaaggatgcgatcagtgcccaaaatgagcttcacaatgtgcgcactttccccggactcagtcacccgattcaaatgaaaccggcggatgtcgaaaacaaaaacgagcgcaaacttttcattggaatgcttcccaagtcaatggacgaagagagcgtccgggcgctgttcaaagagtttgggcaggtggaggactgcagcattctgcgagaggacggcaaaagcaaaggctgtgcttttttgactttggtttctcgttcctgtgcccaacaagcgattcgaaaaatgcaccattcgcagattttcgagggctgttccaaaccggtggtcgtcaaattccccgattcctgtcgagaaaaaacg

SEQ ID NO: 48523 - DNA, 637 bp, Heterodera glycines
  SCN-specific regions: Sequence locations=1-415,440-456,488-637
cggcggtgggggaggatttggcggatatcgcggcggtggggcaggtggtatgggaatgaaccgcacgcaaagttctcgttatggaccgcctatacagacgcgttatcgaatgttggtgactaatttgtcaacacgctgttcatggcaggacctcaaggatctgatgcgaaatgccggcgaagtcacttatgcggacgcacacaaaaaagtgagaaatgaagcagttgtctgcttcgccacccatgaggatttgcgacgtgcagtcgaacgttatcagggcaaggatataaacgggcgcagaatcaaactcgtagatgactccgaaggctatgccgggcgcaaaagtcgctctcgttcgccccgttcgcgttcccgctctccgcgttctcgtactcgttcaccgccttctcgttcacgctctcctcgttcgcgcagcgcttcgcctgctgaaaatggtcggtctcgttcccgatctcgttctcgctccccaactccaagtcgttcccgttctcgttcgccaaatgatgaaaagtgaaccaacgaagaagagtcgatgatggagcacctctttgttggatggattatttttttcctctttttcaaaaatgaccaattctgaagttatcttgttactttt

SEQ ID NO: 48524 - DNA, 691 bp, Heterodera glycines
  SCN-specific regions: Sequence locations=1-528,575-628,651-656
ctataacacataaatttcataaacattcatcattgaaaatgggcgagaaatttgttggcaaatggaatttggagtcgtccgaaaactttgacgacttccttaaagagattggtgtcagttatttgacgcgaaaggctggcgcatgcatcaagccggtgctcgagtttgaagtgaacgggaacaagtggaagatgacgtccacttccacattcatcaccatctcatgggagttcgagttgggccaggagaaggaggtgaagacggccgacggacgcattgtaaagacaaccttcacctttgtggacggcaaactcattgagaaccagaagaagaccaaggcggaggaaaaggacagttactatgagcgttatgtggacgcggatggaaagctcatgatcaccatggactgcgacggagtgaaggccaaacgagtgtacatcaaggcatgattaaaaactaattgatgaggaggaagaatggacgaaaacggagggactgagagggacacaatgccaaacaaattgcgccaaaaataaatttaaaaaataattgttgtttgtttttgagaccaaatttgatagaccaaagaatgcctagatacaagttggatgattttgaattgttgtagttttttggagtgaaaaataaaacaatttaaaataaaaaaaaaaaaaaaaaaaaaaaaaaaaaa

SEQ ID NO: 48525 - DNA, 660 bp, Heterodera glycines
  SCN-specific regions: Sequence locations=1-166,190-621,643-660
gttccacggatttttcttgtaatggtggatttcgacacatcgtctttatacagtgtcaaggccattcttatccttgaccaggacgggaagaggataatggcaaaatattacgacaaacagctttttccactcgaaaaggagcagaatgtctttgaaaagaatgtttttcagaaaacccacaaagctaatgcggatataatccttttggatggcctcgtttgtctttatcggtataacgtcgatttgtttttttacgtggtcggaagtgcaaatgaaaatgaattgattctgcaaagtgtgctcaattgcctttacgaagcgttttcgacaattcttcgaaaaaatgttgagaaaaaggctctgttcgagcacattgacacgtcttttctcattatggatgaaatttgcgatgatggcattattctggagaccgatccccaggcagtggtcgcccgttgtgcggtcaaagcggacgaattggcatttggcgagcaaagcatttcccaagttggcatgtcgctgttgggctctgcgaaggaccaattgaaatggtctcttctgaagtgaccgaaggataaaccaattttgtgattaatttttgttgtgggaaaataacaaaagtgttttatttgtattttttctataaataaattggttatt

SEQ ID NO: 48526 - DNA, 410 bp, Heterodera glycines
  SCN-specific regions: Sequence locations=1-36,58-153,190-315,337-388
gtttgaggaaatggaaaaaagggtcacagaatctttggtgtttcacgacgaagtggaaattgaagactttgaatttgacgatgagtttcagctgtatcacttcccatgtccgtgtggcgacagattcgaaattacgcgagagcaactcgagtcaggagaagatgtggcgacgtgtccgagctgctcgctaatgttgcgcgttatctacgacatggaacagttcgtcaaattggagacactgcgcttggaaccgacaaacgctgttgaagcggtcaagtgaatgaatgaatggaagttaatttattaacaaaaaccatatatttattatttaattaagtcatttatcattgataaaaaaaacaccggaataaacataaatttccacgccaaaaaaaaaaaaaaaaaaaaaa

SEQ ID NO: 48527 - DNA, 1092 bp, Heterodera glycines
  SCN-specific regions: Sequence locations=1-297,319-458,480-790,814 -951,975-1051,1088-1092
gagaaatgctttgcaatttccgcaacttcaattgttcgtcctcgcggcacttttcgctcgcttctgttttacttcagcagcaaaaattcgctgctgtttcttcaccgcccaataaaaattggaatgctgtgcttatcgaagcgatgcgtttgaagtcaaccagcatcgtccaggatgatgcaatcactgaacatggccatgatgaccacgggcatggacaccacgcagtcaattatgggccgccgattacctatgactacactcctataccatctcaaccttataagaaggtctataaggaactgaagcagaaattcatcacgtatttggcgatgagcttcgtctttttcatgttttgctgttacgttggctattccactgatgtgctgggacactccgcttggaaacttccgggcagctaccgtaacagaaaagcgattaacgcgcgtttggacgcggaggaagcgaaggcaaaggccggggaaggcgagcaataggaagaaagattgtcaaattgtaggctataattttgttctaattccgagatgtattgtaatagtgcgatcattaattcgttttcgaattgtatttgtttgttgaatgcaacattggacttggtaaggttttgtggcacaaatatgttgtttttctcttcaaagtcactggaattattatttgagcgaaaaccaactcgtactgccctgactcgtaaaatttttcgacaaaaagaaatcgtaataatttttaaagtcgaaattaaacatttaactctcttaaaattctctatttccttataaaatttcaaaaatgatatgattttcatccaaacaaatacccaaacccgtattcgaacaaatagttgaaaaaccaaatcgtattttcactcaaacctacttaaacatacactcatgtcaaaagtattgcaccaaaacatgtatgcacaaataactcaatttttttatttatataaaattctcaaaaattttctgctaggctaacttttgatgctgataaaaaaaagtcttttggaccaactttatcagatcactccttcatggtgatctgaaaagttaaaaatggcttgaaaccggg

SEQ ID NO: 48528 - DNA, 720 bp, Heterodera glycines
  SCN-specific regions: Sequence locations=1-250,273-720
gaaatgctttacaacttccgcaatttgaattctttgtcttcgcggcacttttcgctcgcttcggccttacttcagcagcaaaaagtcactgctggaacatcaatggccaataaacgtgtgctcatcgatgctgtgcgatgcaagtcgactggctcctcccagcagtacattctcgctgcgcatggccaggacagccacgggtatggacatcgcgcattttcgacttcaggtgctgcacaagaactgagcagcgcgttggacgaggagatcaaagcggagaaggaactcgttcaggacaaattgggtggcacttccgcgccttcagtgcccggcttcaaaatcaccacgaaaggggccgaagtgcgactgagcaaaacgcacggaaacgaaaagattgaagtcattctgaacgtgaatcattcggtcgacatcgaagaggacgaggagtacgaagacgagccacaagcagaaatggagccagagtctgtgcccgtctcgttgccacacttcaccattagcatcacaaagaacaaccagagtatgttcttcgctcttgaaatggtgaagacggaggacggcggatttgacttcaccgtcgaagagtttttcatcgcaccgtcggtgaatggcgaacccgtgaacgaagttggcgacgacgtgtacagctcgtccggcaaatacattgacccgaaattgcacgatttgctgttcgtcagatat

SEQ ID NO: 48529 - DNA, 678 bp, Heterodera glycines
  SCN-specific regions: Sequence locations=1-128,150-255,279-678
gaggttttatatttctgtctcacgagcaggaaaatgtcgggcggttgtcctcttgcgggcggtgctagcgttaatgggtgtcctatgtcgaatggcggcgaccaaattgacccatcgaatgccatgccaccaccaaatcagaagccagcccctgatcagcccttcgttctttcaacaaaccgtcaaaagtcaaccattccaaaagcgaaagtgatggtcgatggccaattggaaacttgggaatatccttcggctcagatgttttggaatgcaatgcttaagaaggggtggcgttggcgcgacgatcagttggaccagcgcgacatggacaacatcatcagaatacacaatgctaacaacgaattggcttggcaagaagtgcttaaatgggaacactccttgcatcctgagtgcgatatgccgaagctgaaaagctttcatggagacgcaaaaaatttgtcgcctcgagcgcgcttccgttcatggcttggttatcaattgccgttcgacagacacaattggctggtcgaccgatgcggacgcgaagttccttatatcatcgattattacgacgtcggacatgtgaaccccgaaacgaaattgtttgcccatttggacggtcgaccggcaattcgcgatgccagcacaatgtgggaccgaatggttgtgggatattgg

SEQ ID NO: 48530 - DNA, 337 bp, Heterodera glycines
  SCN-specific regions: Sequence locations=1-294,316-337
ccaagtttgagcaatttttttcctaattggtactcaactgagagtaaattaaatggttcacgaaaacatccattggtcccggccacgcaaatttgggcctggctcgcgctcgtgtcgcgtatgtttcagtcatcatggactcattcgaaaatattcactgaacatttgccgtcgctgcttccgcgaatacgcctccgacattggattcaagaaactcgattgaattgatggagaaagcccgagtatttttcattgttttcccggaagcattgttatcaatcacaaattattgttgaattttttgttttgataaatcaaaaagttaaaaaaaaaaaaa

SEQ ID NO: 48531 - DNA, 898 bp, Heterodera glycines
  SCN-specific regions: Sequence locations=1-66,88-192,216-243,268 -401,423-802,825-851,885-898
gttttaatatacaaagtaatgaaattgaatattgcttatcctgcgactggggcgcaaaaactcttcgagattgaagatgaaaagaaacttcgcattttcttcgacaagcgaatggcgcaggaagttgaagctgactcgttgggggatgaatggaagggctatgtgctccgaatttcgggtggtaacgacaagcaaggctttcctatgaagcagggagtgatcaccaactcgcgtgtgcgccttctcctctccaaaggccattcctgctatcgccaacgcaagaagggagagcgcaagcgaaagtcggttcgcggatgcattgtcgactcgaatatgtccgtgctggcattggtcgttgtgaagaaaggtgaacaggaaatcgaaggactgaccgacagagttgtgccccgtcgtcttggtccaaagcgtgccacaaagattcgccgtctgttcaacctgaacaaggaagacgacgtgcgaaagtacgtaatccgtcgcacactgccggctaaggaaggtaaaaagccgcgtacgaagacgccgaaaattcagcgtttggtcacgccggtgacgttgcaacggaagcgcaggcgcattgcgctgaaaaacaaacggcgtgttaagcgacgcgaggaagccgctctttaccaccaaacacttgctaaatacgcaaaggaaaagcaggcggaaaaggtcgctcgtcgccactcttccgcttcgcactctcaaggctgaggaggagaaagaaagtgcgaattgacttccgatatgcgctcttttcgtctatgtttggctgttattgttttgttgttttgcaatgataattctttgcgataaattggcgaattgttaaaaaaaaaaaaaaaaaaaaaaaaaaaaaaaaactcgagactagttc

SEQ ID NO: 48532 - DNA, 543 bp, Heterodera glycines
  SCN-specific regions: Sequence locations=1-58,117-126,148-513
gtccaaataagattctaaaaataaatattaaatcgccatgacgaaaaagagacgcaacaacggacgcaacaaaaagggacgcggccacgtgcagcccatccgttgcaccaactgcggccgctcatgtccaaaggacaaagccatcaaaaagtttgtcgtccgcaatattgtcgaggcggcagccgtccgcgacatcactgacgcgtcggtttacgatcaatacgcactgccgaaactctatcacaaattgcactattgtgtctcgtgtgccattcacagcaaagtcgtgcgcaatcgttcgcgtgaagcgcgtaaggaccgaaacccaccgccacgttttggccaacggtctgccgtcgatcgtccgcaacgtccggggggagcggcccctggaggccccggaggcgttgggatgatgcaagcgattcgaacttaaagtgggcgaccgaagatgcatccttcgctgttttgttgttaccgttttttgtctttgtcaaaggataaaagttgttgaaaaaaaaaaaaaaaaaaaaaaaaaaaaaa

SEQ ID NO: 48533 - DNA, 833 bp, Heterodera glycines
  SCN-specific regions: Sequence locations=1-518,540-702,731-787,811-833
attagtttataattttgcataaaattcactgactgttctttttcaccttccttcaattcaacaaaatggcgaaatctgcaattgatgttaatcgcggcatcacagaagaccaaacagctaccataagaaattatttcacacaaccgcacttaatttacaaaactgtcactggagtgcgcgggcctttggtcatattgggcgatgttaaattcccacaatacgctgaaattgtgaaacttacactgcctaatggagaaaaacgcatgggacaagtactcgaagtaacgaaggacaaagctgtcgttcaggtgtttgaaggtacgtcaggtatcgatgcaaaaaacacaatttgcgagttcactggcgatattatgagaacacccgtttccgaggatatgcttggaagaatattcaatggatccggcacacccatcgacaaagggcccaatgttttggcggaggattacttggacatcgatggacagcctatcaacccatggtccagaatttatcccgaagaaatgattcagaccggcatttccgcaattgatgttatgaatagtatcgccaggggacagaaaattccaattttttctgctgcaggtcttccgcataatgagatcgctgctcaaattgtacgccaagggggcctcgtcaaacagccgaacagaaagaaggaaaatgaggtggagggtgacgacgactttgccattgtgtttgctgcaatgggtgtcaacatggagacggcgcgctttttcaaacaagactttgaagaaacggttccatggaaaatgtgtgcctttttcttaacttggctaaatgaccaaccatcg

SEQ ID NO: 48534 - DNA, 599 bp, Heterodera glycines
  SCN-specific regions: Sequence locations=1-599
gttggattaaatcgaaaagattcaagcgaaagtcaggagcccggtcttcatcctttccagtatgtccaggccggtttctttacgggtgtcgccacaagggcgattatacaaccattcgatgtgctcaaaatccgactacagcttcaagaagaacctttacgtgggaaaagtcgtggaaaatacagtggaatttttcaatctgccaaattgatttaccacgaagagggaatcgcagcattttggcgtggtcatatcccagcgcaaggcctctcaattgtctatggtctggtacagttttgcactttcgagctgctcaccaaacaggccggcgacttcggctttcacaatttctcaaaatcagtcgattttgtctgcggtgcctctgccggctgtttggccaccacttgtgcaatgccttttgatgtcgttagaacgcgaatggtggcacaaggcgcccatcggacctaccgtaacatggcacacgcattcatcaaaacgtggcgttatgaagggccggcggggtatttccgcgggttggtcccttccctcgtgcaaattgcgccattcaccggtctccaattcacattctacaacttggt

SEQ ID NO: 48535 - DNA, 407 bp, Heterodera glycines
  SCN-specific regions: Sequence locations=1-13,36-300,322-335,360-407
ccaagtttgagctttttccaaattattttcattcaacaaaatgaaggaaggccaaaagccccgccagtcacgacacaagggacgactctcaaagaagacgcgcattgtgcgcgagcttgttcgcgaggttgttggtttcgcgccgtatgaacgccgtgtgcaagagttgctcaaaatcagcaaggacaaaaaggcgctgaagttcttgaagaagcgcatcggacagcacacgcgggccaagcgaaagcgtgacgaaatgcagcaagtgttggtggcccagcgcaaggcgcacaaatagacggagagaggagatagaggcgggaaaattttcatggatttccttgttttcctttgttgaaacttggatgatggatggataaattgtttgttgtttaaaaaaaaaaaaa

SEQ ID NO: 48536 - DNA, 638 bp, Heterodera glycines
  SCN-specific regions: Sequence locations=1-7,29-638
gtccatttaagctgtccaaaatgatgagtgccaaattttttacgcatttgattaattcggcatcggtacgacccatctccacctcatgctgcagaaaagaattgcgtgaattgtggaaattggacaaacggaacccttttcaagaaattcccgaagcatgggtcacttccctggacgatattgagcagaaaaattgtggactcattcaactccatccagacattttccgtgtcaaaccgcgcttggatttgcttcatcgaaacatcacatggcaatccaattaccggaatttgacgctcctcaaaatgttgtcccgcgccgaaatgccgggcggtggccgaaagccgtggcctcagaaaaagatgggccgtcaccatgcaggaagcattcgttcaccgcatttcattcgcggcggttttgcgcacggcgttcgcggcccgtgcacccaattttacatgctgcccaacactgtccgaattcacgggctccgcaccgcgttgaccctcaaacatgcgcaggacgacttggtcattgtggacagctacgacacgctgaacagcgcggaaccacaatttttgaacgatttggccgacgcacgcaattggggctattccgtgctgtttgttgatctcactgtc

SEQ ID NO: 48537 - DNA, 481 bp, Heterodera glycines
  SCN-specific regions: Sequence locations=1-53,75-380,403-404,426-481
aatttattcaaaataagggaaaatggtcgaagccgccgaacagtcgcaacaacagcccatccgtcgccgtgccggaccgaagtcggcacgtcgcctttatgtgaaggcggtgtttaccgggtacaaacgcggacaccgttctcagcacgagaacacgtccctgctgaagcttgacggggtcaatgacaagtcggatgccagtttctatcttgggaagcgtgctgtctacatgtacaaggggcacaaaacaatcgcacgcggtggtgggccgaagacgcgtgttcgtgcaatttggggacgtattacgcgcgtgcatgggaattcgggagtggtgcgtgccaagtttcgtcacaatttgccgccgaccgccatgggcaagcgaatccgtgtgatgttgtacccgtcaaacatttgaggaaatacagaatgttttttgttacaccgtttttttttttgttgatcgtttataaatgttgatgac

SEQ ID NO: 48538 - DNA, 618 bp, Heterodera glycines
  SCN-specific regions: Sequence locations=1-43,65-215,237-618
gtttgagataaaataagccaattcaaactgttctaaggaaatggctcaacttcttgctggagagaaagttgtgctgagtgacggttcgaaggtagaagcggaagtgttccttaaggacaaagtggtcgctgtttacttctccgccgggtggtgcccgccgtgtcgcgcgttcactcccaaacttaagaaattctacgaggagctgaaaaaggcaggcaaaaacttcgaggttttgttcgtctcgcgcgaccgtgctgctaaagacctcgtcgaatattaccgtgaccaccacggcgcttgggcctacctcgagttcggaaacccgaaaattcaggaacttctcgagaagtacgaagtgaaaaccattccgacttgcaaagtgataaaacccgacggaacgatcgttgtcaatgacgcacgaaccgaagttcaggaaaagggcgtggagaatgcacttggtctttgggaggaatggctgggattctatgaagcttgaaaaagcccattggcaagcgaaccgacgaacgaaggataatttgataaactttcctcaatgcttatttatatagccttaggcatttcaacattccccgataaagtaatcgcgtgacaaaaaaa

SEQ ID NO: 48539 - DNA, 729 bp, Heterodera glycines
  SCN-specific regions: Sequence locations=1-673,696-729
ctggtttctattctaattcattaaaatgacaactgcacatcgtccaacatttgatccggcaaagggtggaactggacgcaatgaaggcgatttagcgaagctttctcaacaatattctagcagggacatgccttcgcatatgacattgaagtacagacaaaaaggacaggcccaccccgaggaagtcgttgcaaagaacctccgccgtgacattgaggaacgtgagcagcattcgcgtgagcgtcgttcacgggattctctggacagttttggcacgggtcccacaaacaaaaaacaacgcgttgaggacacttcatctgcacgtaatcttgacgctgatgaaccatttgatgagctcaacgaggacgacaccgacttggacgaagactctgataacgaggccgaacttatggcggaactcgagcgcattcgcaaagaaagagctgcggaaagggcctcaaaagaggcgaaagaacgcgaagaacaggaacgcattcgagaagagaacattctccatgggaatccgctgctgaaccccgcatcgtcggagtttaaggtcaaacgccgttgggatgacgatgtcgtcttcaagaattgtgcacgaggaattgacgaaaggaagaaaacgccttcattcataaatgacgcaattcgatcggagttccatcgcaaattcatggagaaatacattaaatgagtcgcttactgtgaaaaagcgtttttctgaat

SEQ ID NO: 48540 - DNA, 806 bp, Heterodera glycines
  SCN-specific regions: Sequence locations=1-806
agataatcgaacttattcctttgcattcgacctacaagaacagttttatttactaaatttgaagtatggaaatgcaagcatcgcccggtcctgactgtggctttaccaccccctcaagaacatccacaaacagtaaatttatcgtcgatgtgcctctttcgacaaaacgtgaaaagcttttgcgtggaactccgactcgttttcgacttcctcctgtgcgtcgtctgatgaagtccgctccgaatattcaccacagattctatttggcacgtgaccatatcgaaccatttgcgcaaatcgtttcattcaagcgatcagaagacaggccttcacttagcaaccgatatcggcccgaattggaggagacttatctccaacaatgctttgtacttcagggcagattgggccaaggcgatttcggagaggtggtcagtgtgcgttccaaagacgacggcaaattgtatgcggtgaaaagctctttggacatttatcggaacagcgctgatcggcgtgaaaagctgcaggaagtgcaaaagcacgaaatgctgccgccccatcccaacctcatccattgcgtgaaggcgtgagaatagcgcggccgactttacattcagacggaactctgctctcgaagcttggacgacatggcgagggagcgccacgaaataccggagccagaaacccggtattacctgatcgactcattgaaggctctcgaacacatgcattcccacgacatcattcatgttgacatcaaaccgtcaaacatcctcgttagcacggatggcatttgcaaacatggagac

SEQ ID NO: 48541 - DNA, 756 bp, Heterodera glycines
  SCN-specific regions: Sequence locations=1-756
cccgtattgtgcttccatccgatttcatcaccggttcaaccatttctgtggccacacaagtgccaaaactgattggccatggccttgagaaacggccggacggtgtgtacgcacttatggccggtgtgttacatgaaaatgagcagaaaatgtggcttaatacttccacgaaaagatatgttccacattcgggtgatcgagtgcttggcacggtgacatcgaaggccggagactattttaaggttgacattggctccatcgacttggcactgctcaacttcacttcctttgagggggccaccaaacggaaccgaccgaacgtcaaagtgagcgacctcatctacggcctggtcattctgacatccaaacaacttgagcctgagctgtcctgcgtcgattcggagggccgtgcccgtggcatgggactgatctccgcgcccggcctcgtcctgtcggtgtcgcttggctacgcgcgccgtctgctctcggcggactgcaaaattttggccgagctaagcaagcagctcaagttcgagacaaccattggcatgaacggcacaatttggattggtggcgatgaggacgtcgtattggccgttcgaaatgccctcatcgccggcgagacaatgttcgactcgaacattgcgctgctcgtgcaaaatgccgtacaaaatgttcacttccaaaagccaccagctgatgataatgccgatggtggcgcagaacaaatgccaatggaaaccacataaaaattga

SEQ ID NO: 48542 - DNA, 573 bp, Heterodera glycines
  SCN-specific regions: Sequence locations=1-182,221-226,252-293,315 -362,401-469,496-573
attcaccagctctcttcaacaaaaccttcgcctctccacatttcgacgacaaaatgcctccaaaaccatccggcaaaggagcgaagaaggcggtcaagtcgaccaaggcggtgcgcacgggagacaaaaagcggagaaaggcccgcaaggagtcttactcggtgtacatctaccgtgtgctcaagcaggtccacccggacaccggcatttcctccaaagcgatgtccatcatgaactcgtttgtcaatgacgtgttcgagcgcattgcggcggaagcctcgcgattggcccattacaacaagcggtccaccatctcatcgcgcgaaattcagacggctgtccgactgattctgcccggcgagttggccaagcatgccgtgtccgaggggaccaaggcggtgacgaagtacacctcgtcaaaatgagcaggagatgatgaaagcggtggtgatcggacggaaaaaactatcccaaacggccctctttagggccacaatcactcaaatggacgcgaatgacactttttttcctgttttgtatttgaacgcaaataaattggctttacgcttcaaa

SEQ ID NO: 48543 - DNA, 708 bp, Heterodera glycines
  SCN-specific regions: Sequence locations=1-708
attaaaatggcatcgaatttgacggttaaagttcaccccatcgtttacatgtccatcgtcgacgcctatgagcgtaagtcatcttcgaacatcaacagtcgcgtgggcaccgttcgttccgtggaaacaacggaaaaccgagcgttgggcacgttgttgggattttacgagaagaatgtcgtccaggtgacaagctgttacgccgtgccgttccgcgagacctccgacgacattcccgaaataaatgatgcattgaacagacaaatgtggcacatgtccaaaaggacttcgccgtccgaacaaatcgtcggatggttcttcactgtgcccgacctttctgaaatgtgtccgcattatcacggctattacacggggttagtcaatgaaacgccgcgaaaagagccgccgcccattattctgatcaccatggatttcaccttttcgggagagagcgccgaccgacttccgatcaaagcatacgcggcacgcgaggcgggggtcccggggaaaggagcgactcaagcgacgattttctacccgttaaaagttgaaatggacgtgttccctggcgaatccgttgcactttcatttataatgaggggtttggactcggaacggcgcgagattaaaattgccaacagtcaagagcaatttttggagaatgggaaacagatggtccactggttggagaagatgctcggctacctg

SEQ ID NO: 48544 - DNA, 417 bp, Heterodera glycines
  SCN-specific regions: Sequence locations=1-98,121-357,380-391
ctcttgctgaatcgcctacattccaaatctttctttagcattttggcactttcattgaatatttcatttcaaaatgagcaaaactcatccacccgaattgaagaagtacatggacaaacaagtcaacatcaagctcaatgggaacagaaatgtgtccggtattctgcgtgggtttgatccatttatgaacatcgtcgttgaagattgtattgagcacctcaagaccggcgaatcgcagagcattggaatggttgttgtccgtggcaattctgtcgtcattatggaaccgatggagcgaattgggtgactgtcgcagacagaaaaaaattggcagtgatcattggtctctagctttgttaattttactctttttgttcataaattttgctttaaaaaaaaaaaaaaaaaaaaaaaaaa

SEQ ID NO: 48545 - DNA, 622 bp, Heterodera glycines
  SCN-specific regions: Sequence locations=1-19,41-541,563-575,598-622
gtttgagggtttaaaatatttctgaatttgttgtggtattttgtccaatgtctgtgctaatcaccgagagaaatcaggatgcgacaatttatgttggtggtctggacgagaaggtcaccgaggcgatcctctgggagttgttcgtcaacgctggtccggtgaccaacgtgaacatgccgaaggatcggatcaccggcactcaccagggcttcggctttgtggagttcatgagcgaggaggacgctgattatgccataaaaatcatgaacatgatcaagctgtttggcaaaccgatcaaagtgaacaaagcctctgcgaatgagaagaacatggacgttggggcgaatttgtttgtgggcaatttggacccggaggtggacgagaagttgctgttcgacacgttcagcgcgttcggtgtcattttgcagcccccgaaaatcatgcgcgacgtggagacaggcagcagcaagggctacgcgttcatcaattttgcatctttcgaagcgtccgatgcagcgctcgaggcgatgaacggccaattcctgtgcaaccggcccatcacgtgttcgtacgcgttcaaaaaggacaccaaaggggagcggcacggcacaaccgcggagcg

SEQ ID NO: 48546 - DNA, 666 bp, Heterodera glycines
  SCN-specific regions: Sequence locations=1-39,66-375,410-505,527-666
gtttgaggtgcaaatgaccatttccatttttccgcgtatttgtccctcttttcctccttttctccggcattttccttcttcgtccgctaattcgctcgcttttcgtcgccacttttctctgaccggcccccgtcacagctttttcttcgattatttcactaaacaccccaaggacatgccccctctccgcgactatttgccccgtccgacgtgggtaaaacatggcaatgaatttccgttgcgacagcttttaccaggacattatgatgatcccgagtggcaccccaaagaccgcggttacgccggttcaccgcgttttggcgacaaaatacccgaagacatcatgatatatcgtagaagtcccaccgaagaagaagtgccatttctccacaaggcaatgcacaaattgatgtccatggtattttggtattgggttttctacacaatctattggcatcatcaagagcagtttacgggtgaatggtacttcccgtaccattacgaatggacggacgaggagctcggcgttccgcccgacgacgcgcctgacccggaggaacgccaattctggggccatccgggcgaactgatcggcacttaccgcgcatagaaagagccgtttacattaggagtcttcattaatgacgagttgatcgaaagcaaata

SEQ ID NO: 48547 - DNA, 1115 bp, Heterodera glycines
  SCN-specific regions: Sequence locations=1-1115
caacggttcgccgccgtcggatgagtccgtcgtttattcgtcctccaattgcttttcaaccgccgatgcaatggcaccaccgccggcaacagtcgacgaatacaccctgtcgcagtcacgctttccttccgttgcttcactggcgccgcccaccgttttgatgatgtccaccgctggtcaaacgcccgtccaccgcaggcgacactgtagcgccggctcaaacaatgcgcagcccaacaacagtcacgaagcaatctccagaatggacgtgttaagtgagcggatccgtgacttccattacaacgaggaccaaacgcacgcacagctcaatcgaaaattgcaattacgcgaccaactttattacgcaatttcaccgattttcccaatgtgcggactttacattgtcggctcgtcactgaacggattcgggacgaagcggtcggacttggacctttgtctgatgataaccaatcgcgatattgaccaacgcactgatgcggttgttgtcctgtcgtcggtgatgcggacattggagagcaatcaaattgtggccgagcagaatctgatcctggccaaagtgccgattctacgcatcaaatttatcggcactttccacgacataacggttgacctgaacgtcaacaactcggtggccattcggaacacgcatttgatgtgttactacagctcttttgactggcgtgtccgaccgttggtgatggtggtcaaagagtgggcaaagcgtcacggcatcaacgactcggcctgctcctccttcacatcgtactcgctggtgctgatggtcatccactatttgcagtgcggtgcacagccaccggtgctgcccaatctgcagcaaatgtacccgaaacggttcagcgtacgtgcggatgtgcgcacgctgaacgtgtcgttgccgttcgagccaattccaaccgcgatgggctggcagttcaaggacgacgcgacgctcagcgagttgctgctcggcttcctccgctactacgccttccaattcgactttgacgcggacgcgataagcattcgaatgggcaaaaaggtcaacagggcacaggtggcacaaaatcaatcgcccttcaacacattgtcccaat

SEQ ID NO: 48548 - DNA, 992 bp, Heterodera glycines
  SCN-specific regions: Sequence locations=1-4,33-828,850-992
attgaattgatttatttatttattttgctgctatattcttccaattgtttgctctcaaatggtgctcaccgactcggcccatgccgaccccaaaaatgccgtgcccttccgtctgcgcatcgacggccattgggtgcgcgtggacgagcggctgctgcgcgcgcacccgggcagcggcgcaatgctcgcctaccgggacagggaggcgagcactgtttttcattcgttccatgccggctcaaagcgtgcctaccgatggatgacggaacaccgtgaaaatggtggtgccaccgccgaaactgaggcgacaacagaggcaaacggaacggcagcaaaaaccaaaaaaagcaatggcacgggcgccggcgccgccctttggccggacaaaatcgacgccataaatatgggcaaatttgggaggagtgccgaggcaaatgaaaagatttgccgttcctttgatgttctccgctcccgcgtccgttcgcttggcttctccgcgcagacgacgcccttttcgtgctcaaatttattcaatgcgttgctctgattgcgttcgccgttttcctccagtcgcgcgactttttcctcgcctccgccctttgcatgggcatcgcctggcctttgaatacggtcatcagcagcactttggctcctggtggtggaacgacgtttgtggctatgtgtgcggcaatttgatgcaggacttttcgcttggcggttggaaacgcattgacagtgtttctccgctcgcccatttgttgcccttccagcatttgtattggtccttcgcgttgccgttgctccgtttttcgtggctgctccaatccgtccaatttgtgtgccaaattcggcacagttttcacgacatcatcgccagagggccctggtggagcagtgttcgttggcattgcattggtcgctggtgttcgtctaactaactgtaaggcggtgaagaaggcggccaacgggaagctgaagggcattttggcgta

SEQ ID NO: 48549 - DNA, 558 bp, Heterodera glycines
  SCN-specific regions: Sequence locations=1-167,190-193,217-448,470-558
gaccattcaacaaatttgattttcaacaatggaaggtgttgttctagaagagactatggaagagaatgtaatggatacagaattggacgacctcaaaaaaggagcagcggtaaaaaggggccgtggttttgaggggtcgcagaaaagtgctgtccaagtctatgaaactttggacgaggagggctccgtcggaggaccacagcgttctgttgaaggatggatagtttttgttacgaatgtccacgaagaagcacaggaagacgaggtgaaagatctgttcaaagaattcgggaatgtgatgaacatgcatttgaatttggaccgtcggaccggctatttcaagggctataccattgtgcagtacgaaagccaagaggaagcggcagaggccattgccgggctgaacggctacgactttttgggacaggaattgcgagtggattggtgttttgtgaagggcgggcgcgagagaaagcgatgaatcggatgagaagaagacccaatcactcattatttgttcatccattgatcattagtttggatttcctgcattatttc

SEQ ID NO: 48550 - DNA, 664 bp, Heterodera glycines
  SCN-specific regions: Sequence locations=1-297,319-664
catgtcaggcgatggttcggaaactgcacgcggaattggattatgcaagacattttccgaaggcttatctggacaaagcgcaaaggcatgtccctatgaaagtgtacgacaatcgctttggcgctccgccggtcattcgttgggcaattcgacccgatgattgggcgatgagaacgaaacgtccgtgggagtacggagaagtggaaaatgtgatcagacaggagaagatgtaccaaaggcaactgttttccacaaaattctaccgaaaaaaatggaacaaaatgccgataattccggcagaaaattggacaattttccccggcgacactgtccaagtgatggtcggcaagcacaaaggccgcaaaagcaatgtatcccacgtgatcaaagaatcaaatgcggtttttgtggagggattacacactaaactcgtggacaaattcaacaaggacagaatgaaagaaatgggaattggcgatgtgttcttcgaccagtgggaggagcagccactttttctgcacaaaggcgaagtgcaattggtggacccgagcgacggtgaaccgtgcatggccaaatgggtgctgaacgactcgaagacggaataccagcggatcagctcccgcaccggcttcctcatccctctgcccagtcgcgccttcaccac

SEQ ID NO: 48551 - DNA, 951 bp, Heterodera glycines
  SCN-specific regions: Sequence locations=1-282,304-951
cgggaacataacctaacaccaaaagttccaataatggattatgaattatctaatcaacaactgcgccccttttctcgatcctttacttcttcatccttttcacagcaacgatccaacaacccaagtctttttcagtatatcaatcccaactctgacaaagcgttacgcgttttccaagcccacactcgccattctgggaaggcagaagagaattacaaaacggtgatgtgccagaattggctggaacaggcggagtgtcgtttcgggtcaaagtgccgttttgcccacggtcctgaagaactgcgagttgcaacaacgcctcttccgatcaacaacaaatacaaaacgcgtctttgcgaaaagtacacgaagaacggcgtctgtccttacggcgagcgttgtctgttcattcatcccgaccagcagttcggactgccctcgtccacattcgccgcttcactgcctctttcgctgttccgtttccaacagatgacaacggccactttccatcatcgctcgcatcagaaattcccatcgaatcgtcagattcgcaatttgttgccacagattgaagaagaattgcgtcgtgaacgtgaagagataaagcaacagaaccatcagcagaagtgcaacggactgcgagtggaaatccctcagccatctgtgggcgcgtcttcgtcacacactcctgaacaaatcgaatggcgtgggatggtcgaaatggtcgacaaattgaccttgacgccgtccgctaacaataagttgtgtccagctgacttcccctcctaacacccctaaccctaacccctccctccttccccacatgttccccgccgacttccccctaacccctcccgcccctccctaatactaacattttttcaattataaatattgtttagtattttatttgcattccacatacatacaaagaataaataagagcaattc

SEQ ID NO: 48552 - DNA, 596 bp, Heterodera glycines
  SCN-specific regions: Sequence locations=1-140,167-344,367-575
ttttcttttccctttcattttttattcgttcaatcccttctttctttttgcaatgcttctccgtttctccctcactgttcaacttttgctgcttttcttcgcttttgaagttcttggcgctgaaccgccagaaggtgcacaaaatgaagaaggccaacgagacagcaaaagattggaaatggccaggaaagggctgaacgttcacatgttttcctcccccaatttcgccccaatgtttggcattatcgccggcctttccgttgttcttatcattgccattgttttcattgtcgtcggattgctcagcatggaacccgcgaaggattcgattatctatcggatgacaacaactcgcctaaagaaggactgattgtgagcaaagtgtgggagagagtgccgtgccgaaaaggaaaagtccgtcccccattaaatgatttgtttcatttgatagtgaatggtcacccaccctttgtcggtgttgcaatccgcaacgaatcatcaaaacatttaattttatagaatgtctatttcttcccattcattgtaatcatgtagagaataaattttttattttcaaaaaaaaaaaaaaaaaaaaa

SEQ ID NO: 48553 - DNA, 613 bp, Heterodera glycines
  SCN-specific regions: Sequence locations=1-257,296-613
cggaacttttcatcatgggtatctctcgcgactctcgccacaagcgtgcgcacaccggtgccaagcgcgcccactaccgcaagaagagaaagttcgaactcggtcgccaagccgccaacaccaagctcggcgcgacccgtgtgcaccaagtgcgtgtgcgcggtggcaacatcaagttccgtgctttgcgtctcgacaccggcaacttctcgtggggctccgagtcgtgcacccgcaagacgcgtatcttgggcgtcgtgtacaacgcctccaacaacgagcttgtgcgcaccaacaccattgtcaagggcggtattgtcgagattgacgccaccccgttccgtcaatggtacgagtcgcactacgtccaagcccttggccgcaagcagaaggatgttgccgaggttgaggagctcaacaagaagcgctcgtcccgcgtcctccgcaaggttgaggcccgtcaagccaacgccaaggtcgacccccatctcgcgtcgcagttccagaagggccgtctctacgcccgcattgcctcgcgccctggccagtctggtcgcgctgacggctacattctcgagggtaaggagcttgacttctacctccgcaagctcac

SEQ ID NO: 48554 - DNA, 906 bp, Heterodera glycines
  SCN-specific regions: Sequence locations=1-76,98-108,130-148,170 -231,253-555,582-609,636-682,715-906
attctctgatcaacaatgctctcaaaaaaacttttccagtctatcttgaacaaatctccaaagactgctttctcaacttcggctcgtttgtctgcgtcaagtgctgaagtttccaggattttggaggagaaaattcttggacaggcgtcacaaatcaatttggaggaaactggaagagttctttcaattggagatggaatcgcacgtgtttatgggcttaagaacattcaggcagaagaaatggttgagtttgactctggaatgaagggaatggcacttaatttggaaactgacaacgttggtgtggtcgtctttggaaatgataaagtgatcaaggaaggtgacgtggtaaagcgaacaggttcaattgtcgatgtgggcgttggcgaggctttgcttggacgtgtcgttgacgcgttgggcaatcccatcgacggaaaaggtccaatcaatgtcagcaaacgctctcgtgttgaagtcaaagcgccgggaatcattccgcgtgttggtgtgcgagagccaatgttgacgggggtaaaggcggtagactcattagtgcccattggccgtggacagcgtgaattgatcatcggagaccgtcagactgggaaaactgccattgccatcgacaccataatcaatcaaaagcgtttcaactcaagcacagaagaaaagaagaaattgtactgcatttacgttgccattggccagaagcgatcgacggtggcacaaattgtgaaacgactcactgacacggacgcaatgaagtacacaatcatcgtttccgccactgcttcagatgctacgccgctgcagtttttggccccctattctggcgccgacatgggcgagatttttcgcgataacggcaaacacgggatgaatatcgacgacgaatctctccaa

SEQ ID NO: 48555 - DNA, 658 bp, Heterodera glycines
  SCN-specific regions: Sequence locations=1-410,433-601,623-623
caagtttgagatagcactttttgattaccatcgctgtacgcaatgaagacagagacgtgcgtttattccggctacaaaatccacccgggccatggcaagcgagtggtgcgcgctgacggaaagatccaaatctacctgagcaagaaggcacagcgtggtgcagcactgaagcgcaacccgcgtgacgtgccgtggaccgtgctgtaccgacgaaagcacaagaagggagtacacgccgaggagggcacgcagcgaaagcgcgtgaagcgcaccgtccaaattgcttctcgacccatcgccgacctcaccgtggaggcactgttggcccagcgcaatcagaagcctgaattccgtaaacagcaacgcgatgcggccatcaaggctgccaaggagtccgcccgagtcaaaaaggacgagaccaagaagaagcagcagaagattgacaaaaaggcagcgccaacgaagacgaaggcggccaagcaggtgaaagcgccgaaacaatttgtgggcggaaagcgctgattttgtgatggttgacgaaaagatgggatgtgcttgtgtgaattcggggcgggaattttgttcgagttctttgtcctcctcatttttgttgttgaaaaattaaaaaacaaacaaaaaaaaaaaaaaaaaaaaaaaa

SEQ ID NO: 48556 - DNA, 782 bp, Heterodera glycines
  SCN-specific regions: Sequence locations=1-137,159-782
gttgtgcactaaaagccaacatgatacaggcttggcgcacgcattttgttctcgaggaaggcatgttggaagtcgagtgcacttcacttacaccagaatacgtcttaaaagcttctggccatgttgaccggtttatcgactggatggtgaaagacaaacaaacgggtgcttgttttagagccgaccacttggttaaaaatcaagcggaaactttgattcgggacaaaaaaactgatgaaaaaacaaagtccgaacttatgaatgtgcttgttatgcttgatgggatgagctgtgatgacttgcacgaagtcattaagaaattcaatttcaaatctccgctaaccggcggtgacttgtccgaacccgtttctttcaatctgatgtttcccactgaaattggacctacctgtgatcagcgagcctttctgagacccgagacggctcaaggaatctttatcaacttcaaacgccttttagaatttaaccagggacgacttccttttgctgcagcccaagtcggttctggctttagaaacgaaatttcgcctcgacaaggacttatccgcgtccgagaatttacaatgtgtgaaattgaacactttgttgacccgaccgacaagagacatcccaaattcgagaaaattgcacatttggaacttactttgtttcctgcttgcaatcaaatggaatcaaaaaatccccaaaagatttcaattggaaacgcagtcaaattgggtatcgtaaacaatgaaactttgggttattacatggcgcgaactcat

SEQ ID NO: 48557 - DNA, 504 bp, Heterodera glycines
  SCN-specific regions: Sequence locations=1-24,46-446,469-504
caagtttgagctcataaattgtcttgcagaagtatttaattaaaatgattgaaacactcgagacgagcgaagtgttgaagcgggtccttaagtctgcgctgattgtcgacggagtggcacggggtttaaacgaagcggcacagactttggacaagcgtgaagcgcacttttgtgtgctggccaaaagctgtgacgaggcgtcctttgagaaattggtgcgctcattgtgcaaagagcacatcattccgattttggaggtggaggacaaagccgaactcggtcaaatggttggccagtgcaaatacgacaaagacggaaaagcgcgcaaaatcgtcggctgttcggtggcggtggtcaaagactacggacgggacgaagaggcgaagaatgacttgcaggaagtgctgaagaaaatcagcgactgatgaggttcctatgtcatcatattgttgtttttgtttggttgttaccgcggctataaaagactcttctgtttaaaaaaaa

SEQ ID NO: 48558 - DNA, 421 bp, Heterodera glycines
  SCN-specific regions: Sequence locations=1-252,274-385
gtttgagaaaatttcacatttaacagaatacaaacaaaatgtccaccggcgttatccaaccattaaatcctaagccgtttttgaacaatttgacgggaaagccaatcatttgcaagctcaaatggggaatggagtaccgtggcattttgatgtccattgacggttacatgaatttgcacttggccaacacggaggagtacattgacggaacaaacactggcgcattgggcgaagttcttatcagatgcaacaacgttttgtggatctctgctgctgaagagggtgaacagtgaacacaccaagcaccaaatggttgaacacttttgttgatttcacttttaatcgatctgtttttcctatttttcaaaaaaatccatcaaccatgaaaaaaaaaaaaaaaaaaaaaaaaaaaaaaaaaaaa

SEQ ID NO: 48559 - DNA, 1141 bp, Heterodera glycines
  SCN-specific regions: Sequence locations=1-3,25-782,805-927,949-1141
agattttcaaaatacaatttttatgtgtaataattttcaacgcattgcttttcgattcgcggttaaatgaatcgcgaagaaacgaataaacacccattgattgtcacttacgccggccgtcactatgacatctccggctttgtcagccgacatccaggtggtgagcgggtgcttcggatggttgcgggtgctaacgtggacagttttatcgacggcacttcggagttgttgggcctaaggcacgaacattccgccgccgcttatggaattttggcccgttattctttggaccaggagtttaagagagaccctttggtcgatagcaaagcgccgatgctttggagggtgggcgaattgagggaacgctattggacatggattcaccacccttacgacggagtgcttcggcttttcgagtccgaccttttggagcaattgactcggactaaatggtggcttattcccctcatttggcttccaatcgtttcgtattttttcttcaccggcctttcccttctgcgggaggacttcggcttttccggtggtcctttgctggccttcggtctgttcgccttcggctgtttggcgtggactcttctcgaatattcgcttcaccgtggccttttccattggcacccaaatgcccattcctaccgccaaatcactctccattttctactgcacggtctccaccacaaaactccgatggattccgaccgtctcgtctttccgcccgccgccgctgtgcttatcgtcggctttttctacaccatttaccggtccctcctcccttttcccattttttgttgcttcgcgagtggaaaactcttcggttacattgtgtacgacatcacccattattatttgcatcacggaaggcccgagacgaacagcggatggcactaccgaaaaatttaccaccacaaccaccacttcaaagactccgattcctcctttggcatttccaccactttttgggactacgttttcggcactgtgggcactttcaactgaatccgtgagaatgcgatgtccatgtgaaatgtcaaattgagcaattctcatcagtcatttatcccggcgcttctaattgtaaaaaagctcccatatttttgaaaacatttgcaaatttttacttgac

SEQ ID NO: 48560 - DNA, 805 bp, Heterodera glycines
  SCN-specific regions: Sequence locations=1-427,449-473,495-805
acggactttgcagaagagcacacagattttgtacacgccggacattggaaccattctgctgctgttggacgtgaagccgggcgcacggatttgtgagaccggcacaggcagcggttctttgtctcacgccattgccaccgcagtggcaccggacggccatttgtattcatttgacatcgatgagaaacgtgccaaaactgttcataatgatctcaaactccacggtttgtcccaaaatgccactgtgctttgccgtgacgtgtcccagcatggctttgccgcaaccgattgtgcggagaaagagtggcgttgtgacggcgttttcctggacttgcccgccccgtggttggccattggccatgcccacaaagtgttgcttcaaaacgggcccgagcgccgtccgtctcggctggtcagcttttcgccatgcattgagcaggtgcagcgggtgtgtgccgagttggagcagcacggctttgtggacattgagacggttgaggtggtgccaccaaaactgaaggtggtcgacttgccctgcgaaagtttgtccgaatacgcagccaaaggagcgaacgcacagacattcttccagaaagaatctcagcacaacaacactgattgtgaacagcaacggcagaagggacgccggggtgccaagcgcaaggcggacaatgcgggggaaaagaccaaaatggaggaggacgcggacacatgccaaaatggactgaacggaaaagtcgctgctgccagtattgcgcaggaaagcgatggtcctcagaccgagactgatgccatgccattccct

SEQ ID NO: 48561 - DNA, 1286 bp, Heterodera glycines
  SCN-specific regions: Sequence locations=1-1146,1168-1237,1269-1286
gtcttttctttccgatgtctgaaattggtaatttcgaaataagaaatgtgtctaaagtcgaacgtatcggtgcacattcccatatcactggtctcggcttaaaggcaaatttcgaaccaatttttatttccgatggaatggtcggacaatgtgcggcacggaaggcagccggattgattgttcgcatgattaaagatggacaaattgcgggcagagctttgctaattgttggcgagccggggacgggcaaaacggcggtggccatgggaatttcgaagtcaattggcggcgatacgcccttcatttccatttcggccagtgaagtgttttccatggatctgagtaaacccgaagcattgactcagtcattccgaaaggcaattggagttcgaatcaaagaggagactgaggtcctttgcggtgaggtcgtacaactcgaaattgaccgtccccagtcgggtgccgggccacgagttgggaaattgactctgaaaacaacggacatggaagcaatttacgacattggaaacaaaatgactgaatccgtcatcaaagagcgaatcacggccggcgacgtcatccaaattgacaaggcaaccggtaagatttcgaaaattgggcggtcgcttgcccggtcaaaggatttcgacgcacttgggccccaggacaaattggtcgcctgtccgtcgggggaaattcagtcccgcgtggaaacggttaacacaatttcattgcacgacattgatgtgatcaattcgcgttcctccgggtatttggcggttttttcgggcgatacgggcgaaattaaaagcgaagtgagggagcaaattgacaaaaaggtgatggcatggcgggaggaaaacaaagcgcaaataatcccgggtgttctgttcgtcgacgaagtgcacatgttcgacctcgagtgcttctccttcatcaaccgttacatcgaatcggacctttcgcccattttggtgatggccaccaaccgcggcattgtgaacattcgtggcacttccgttgagtctccccacggcgtgcctttgttcttattggaccgcagccttatcatcaggacgtcgagttacaaagaaaatgaaattggagagatactgaaaatccgtgcttctgatgaactcgttgaaatggaggatgccagcatcgcagtgctcgtccaaatagcattggaaacatcgatgcgttactgcatgcaactcatttcaactgccgacattttacgacagagaagaaaaggcgaaaagacaaaatgtttacgtcactgaaga

SEQ ID NO: 48562 - DNA, 733 bp, Heterodera glycines
  SCN-specific regions: Sequence locations=1-18,42-167,199-733
catttaagcttcaaatggttttaaaaatccattcaactattttttgagattaatttgtaacatccttttcactggtataatttgaacagaaataaacaacgaattgcagcaaatgtctgtgcctggctctcaacctccgcaacagggcgaggacgccgaggagcggctgatcaacgaggagtacaaaatctggaagaaaaactgcccgttcctttacgacatggtgatgactcatgcgttggaatggcccagtttgaccgtccaatggctgcccgacgtgcaacgacaggagggcgccgactacacaatccatcgcctcattttgggcacgcacacgtcggacgagcagaatcatttggtcatcgccaaactgttactgcccaacgacgacgcacagtttgacgcgtctcgctacgacactgaccgaggcgaatttggtggctttggcacagtgaccggcaaaattgaggtggaaatcaaaatgaaccacgagggcgaggtgaaccgggcccgatacatgccacagaatccggttctgattggcaccaaatcaccctcctcggaggtgtacgtctttgactacacgaagcatccgtccacgccggctgacgtggagtgcaagccgcagttgcgactgcgtggacacaccaaggagggatacggcttatcctgaaacaacaatttgcctggtcatttgttgagtgcctccgacgacatgaccgtgtgcctgtgg

SEQ ID NO: 48563 - DNA, 558 bp, Heterodera glycines
  SCN-specific regions: Sequence locations=1-3,25-243,265-558
aagaaatgaactatgataatggaattagcgatgatgatgatttggaaatggatgaaaatggaagcgatggcgtagaaattgtggattttgttgaagagccgcacaaggaagacaattccgccgcaaaaattgctgcgcattcgaaagatgtgttttgccttgccctttccccggatggccattggctcgcttcggggtcggaggatgaaactgcagccgtatgggacttgcggcacggaatgacttctcccctcctccaccgcacaatttcttcccattccgactctgtccatttgttggcatggaacgtttccgcaaatattctcgccagtgcggacatggccggtcgcataatttgcacaaaagtgacgggcgatgaagccacacaaacggcgtcacttacaatcgacgattgcttcgtcgaaccttcacggagagacgacgacaacggggaggacgaggaaggccaaggctctgaccctgagcaaattggctggctgttttggcactcgactgtcgagggcattctttttgcgggatgtaacgacggatcccttt

SEQ ID NO: 48564 - DNA, 675 bp, Heterodera glycines
  SCN-specific regions: Sequence locations=1-675
ctaaaggccatttaactaaaacataacttaatattcttcttctccgttcacccaaacacaatgtcggactttgaaatggacgatggagaagattatggcttgcaatattcggacgactcgggcagtgagccggacgtggcgctggagaaccaatattatgcagcaaaaacgctgaaatcggacggcgaccagcgcggcgcgttggacgcctttcgccgcgtgttggagttggagacggagaagggcgactggggcttcaaggcgctcaagcagatgatgaagctgaactatgccatgggcaattttgaagagatgctgcgccattatcgcaatttgctcacttacattcgttcatcggtcaccaaaaattacgcggaaaagtccatcaactccattctcgactacgtgtccctctcgaagaacacggcactgctgcagcaattctacaaaatcacgctggaagcgctcaaggaagcaaaaaatgagcggctctggttcaagacgaacacaaagttgggcaagctgtactttgacttgaaggagttcgaccggctcaagcaagtgctgaaacagttgcgcaactcgtgccagacggagcatggggaggacgaccagcgcaagggcactcaattgttggagatttatgcgctcgaaattcaaatgtacacggagcag

SEQ ID NO: 48565 - DNA, 785 bp, Heterodera glycines
  SCN-specific regions: Sequence locations=1-257,279-354,376-577,599-785
ccctcataaaggttttgacccatttttggagtcgcaaaacggaagaaatccgttgcattgccttcgtggcgttgtgcaaaattgccaggctcgactccgagtgtttccccgccgtttacaaaaattgttacacggcgtatgtcgccaattgcaaaaccattgacgatgaaacattgcctttcattcactttatgcagtgttctctcgccgaactgacttttgtccatccttcccaagcttaccaatacgcattcgtttacatccgccagttcgccattcaccttcgaaatgcaatgattgccaaacgaaaggatttgatccaaaccgtgtacaattggcagttcgtcaagggccttcaactttgggttttggtcatttgcgaaggctctaaacgctttcggccgtcgtccgacaaaagtgccagttggttctatgagttggtccatccgctcgtggaagtgatcaattccctttggaggcttttcccttccactaaattcttcccattgcgaattcattcgattcaaatgcttttggacatccaaagagagtccgaagtgttcgtcccgagtttggcctttgctgttgagcttttggatgagttggcacagatcgacgccaaaaggccaacggcgggcaaaggtcgaacacgcgaaccgaacgccgaacgaatgctccgattgtcgggcgaacagttggacgacgccggagtccgtgctcatttggcccagcgactgttcgcactgatcaccgattgtcttaacttgctgaactctcgagaaagc

SEQ ID NO: 48566 - DNA, 970 bp, Heterodera glycines
  SCN-specific regions: Sequence locations=1-116,143-970
ggaatcgctagtaaattcctgtctaaattttccggtgccatcccccgtctcgacgaatttgctgactgtcgcttggccgacataattccaatcaccgaccaacacttcgtgaagagcacctttttaattgaaattttaaaaatctgaaatattgtggcgtcggaaaaccgaccaatgggcgagccatgcgagacaaaaacgatggaggcttaaactgaatttgtaccgggaaaaggcattggatggcctacttgcttcgttgtatctcctcagaatctcttcaagagtttggcgtattcgttgaatgcatgactcatctccaaagccttccctgggcattggtttttcgtaaattgagcgatattcggagtcgacgagaggaaaccgcctacggagttcagccgattcctcaaagccaggcggactttcgcaaagttacatataaccatatcaaatggctacttacaatcccaactatgaatccattgggcaggcctttgtccaacacttttacaccaaatttgatgtgcccgatggtccgactcgcaccgtcggccttcatgatttgtatgatgctgaacactcttttatgacttttgaggggaaccaagtgaaaggtcgacaggccattttggacaaatatggagcgctacctttccgaacgattcaacatgggattacaaagactgacagtcagccgcttccggatgggtcaattttggtgacggtgattggtcagcttaagaccgacgatgacccagtgaattcattcaaccactgcttcattctgagaccaaattcttccgggggatttttcatttcgaatgaagtgttccgtcttgttttgcattgaagtgctgaagccgttctctcgtggacatttgcaacctgttgttgttctttttcctctacaatttccattgattgcgcagtttgatttgtttcgcctttgtttcaacttttgccctca

SEQ ID NO: 48567 - DNA, 750 bp, Heterodera glycines
  SCN-specific regions: Sequence locations=81-117,139-706,737-750
agagagagagagagagagagagagagagagagagagagagagagagagagagagagagagagagagagagagagagagagcctcgtgccgtttgagcaagacaaaaaaatcagaagcgaaaatggtcaacccgaagggataccgtcgcggcactcgttacatgttcgcccgcccgttccgcaagcacggcgttgagccgctttcaacattctaccgcgtgtacaagcggggcgacattgtcaccgtcaagggcaacggcgccttccagaagggcatgccgttcaaggcgtaccacggcaagaccgggcgcgtgttcaatgtgaccaaacatgcgctgggcgtcgtcgtcaacaagcgtgttcgccatcgcatcatcccgaaacgcatcaatgtccgtgttgagcatgtgaaaccgtccggctcccggctcgagtttctgcagcgatgcaaagcgaatgacttgcagaagaagcagcacaaggagggcaacgcaccgtttgtggcgctgaagcggaagccgaaggagccccgggtggcgcacttggtcaaagtgaagagcaccaaagttgagcggctggcgcccgtcaaattcgaaattgtcgcctgaggcgttgtcgggggcaaacgaatggacgagcacagaaaaccaaccgacaattgttatttttaatttgttgatccgtttcgtgttaaagaaaaagttttgaaaaaaaaaaaaaaaaaaaaaaaaaaaaaactcgagactagttc

SEQ ID NO: 48568 - DNA, 501 bp, Heterodera glycines
  SCN-specific regions: Sequence locations=1-501
aagtttgagaattttttataagtagactttaattaaatcaaaatcagcaaattacgaatgaattctcctgtaatttcccgcggaatgcatggtttttcaactactatctccaagagattcgcatcaagcattagcgaaggacatgccgaatattaccgagagttcaatcgacttgcttctgctggaatttgggaccagttaaacatgcgaccaaaagttttcagcactaaaactgagaaagcagcggctatgaaagtctggcaaaaaatgcttccggaagatgccggttggttcgataggcgtcctggtggagtttttctcaaaatgcttttgcacatttctctggcctgctttgctgtttttatgattccctacacttacgaaaaagtcgtgcccgaagaataccgttgcaagatcaaatacaaaaagaacgacggacaccattaggtgtattgctcactcattaggaaatgttcatttgataaatattttccaaaaaaa

SEQ ID NO: 48569 - DNA, 568 bp, Heterodera glycines
  SCN-specific regions: Sequence locations=1-50,72-138,162-401,423 -501,529-568
gtccaagtttgagttaatctagaaaaagtaatggcttcacgaaaaggaaaggtcaaggaagagcagccggctgtttctctgggtcctcaggttcaagaaggcgaaaatgtctttggtgtggcgcacatttttgcgtctttcaatgacacttttgttcatgtgaccgatttgtctggacgtgaaaccattgtcaaaatcaccggtggaatgcgtgttaaggccgaccgagacgaggcaagtccgtacgctgctatgctcgccgcgcaggatgttgcggaacgttgtaagcaggttggcattaatgctcttcatgtcaaattgcgtgcaaccggtgggaccaaaaccaaaacgccggggcctggtgctcaggcagcgctgcgtgccctcgctcgttcgggtatgaagattggtcgaattgaagatgtcacgcctattccttccgactcgactcgccaaaaaggaggccgtcgtggacgtcgtctttgagttgattcaaatgcgtcccgatttttgttgttgtttgagttctctatcgcttttcttcaaataaactttttgttgaaaaaaa

SEQ ID NO: 48570 - DNA, 1309 bp, Heterodera glycines
  SCN-specific regions: Sequence locations=32-225,249-304,327-426,453 -462,486-522,546-571,600-669,697-762,786-789,832-1059,1084-1142,1167 -1283
cctcgtgccgattcggcacgagggtccaattaagattattttctcaacaaacttccgcttaatcttcagaccttcactattttcttgtttaaaaaagttgcaacgatggtgaaaccaaaggttggcatcaacggttttggacgtattggacgcttggcattgcgtgcagcgattgaaaaggacactgtccaagtggtggcggtcaacgacccgttcatcgaactcgactacatggtgtacatgttcaactacgactccacccatggccgtttcaagggcaaaatttccacaaacgccggcaatttggtggtggagaaggaggggaagagcgcgcacaccatcaaagtgttcaacctcaaagacccggccgaaatcaaatggggcgaagcgggcgcggaatatgtgatcgaatccaccggagtgtttaccaccattgagaaggcctctgctcatcttaaaggcggtgccaagaaggtggtcatctccgctccgtctgcggatgcgccgatgtacgtgatgggcgtcaacgaggacaagtacgacccggctaaggacgacgtgatcagcaatgcgtcgtgcaccaccaactgcttagctccgttggccaaagtgatcaacgacgagtttggcatcatcgaaggactgatgaccactgtgcatgcggtgaccgccactcagaagacggtggacgggcccagcggcaaacagtggcgagacggacgtggtgcggcgcagaacatcattccggccagcaccggggccgccaaggcggtgggcaaagtcatcccggagttgaacggcaaactgaccggcatggcgttccgtgtgcccactccgaacgtgtccgtcgtcgacctgaccgcccgtctggagaagccggccccgttggacgccatcaaagaggcggtgaagaaggcggccaatgggaagctgaagggcattttggcgtacacggaggaccaagtggtgtccacggactttcttggagactcgcactcgtccattttcgacgctggcgcttgcatttcgttgaacccgcactttgtcaagctggtcagttggtacgacaacgagttcggctactcctgccgtctggtcgatctgatcactcactgtgcttccaaggcatagaaagacgacgcgcaaaagagggaggaggaaaagagaaatatgctaattttgactctgcgtttattccatttctcttttttgatgccgtccaatgacttgtttctcctgaatttttttaggaattagagcgcacttttaatcacgttatacgtaaataaaaaaaaaaaaaaaaaaaaaa

SEQ ID NO: 48571 - DNA, 646 bp, Heterodera glycines
  SCN-specific regions: Sequence locations=1-88,126-126,210-210,304 -304,387-646
gtccatttaagatatactattagtgggtgtaatgcgtgttctgtcatttgctggattacaactcaaattggacacaatcggagatggtgagaagatagcggccaaaatccgcgagtgtgccggcttggaggtgttggaaatgcgcggcaatacgcttggtgtgggtgcgaccgctccgatcgccgaagcattggagtgccagagcaacttgaagagagccctttggagtgacatgttcaccgggcgactcaaagaagagattcccaggacattgaaaactttgtgcgacgcaatgattctgagtggagcgaggctgaccgagcttgacctgagtgacaatgccattggtcctatggctgtgccggggataaaagaatttcttgctggcgaggcggcctttgccttaaagacgctgaagcttaacaactgcggccttggaattgcgggaaagacaattgctcactgtttgatagaatgccatcggcgatcagttagccatggcactccgctttgtctgaaaatctttgtcgcccgaaggaatcgcttggagtacacgtcaacagctgcgctagctgaagcatttcagataattggcacgcttgaggaaatctccatgccacaaaacgggattagcgctgaagggata

SEQ ID NO: 48572 - DNA, 890 bp, Heterodera glycines
  SCN-specific regions: Sequence locations=1-847,869-890
aagcagtcacagaacaatgcttttgcaaacgatgggctttcagtctgaagaaaagcatggaaagcgagaatttcgaaaggcatttccgtttggccattcaatcggtcactgcggaagactatgaaaagatgcgtcagtatcggcaccgggaggactctctcgcgactttggccggtcgtctcttcctccgtaaggctgtccaatgcctttgcggtgtccgttgggccgacattgaaatttcacgaacggaacggggaaagcctttcattgttcgacccgagaacatttccataggactgaacgtttctcaccaaggcgactacaccgtttttgccagcagttgtaccaaccaagttggcgtggatgtgatgcgattggacatgtgccgaggcaataaaactgcggatgaatacatcaattcgatggcgaagtcggcttcggcgggagaattgcgaacgatgcgcggccagccgacagaacaaaagaaaatgaccgttttctaccgatattggtgtctgaaagaaaccattatgaaggcgacagggcatggactcgtgaacgacttgagccgttttgatttcatcatcgatccaaatgaacgttataagcaaggcagtttcatcacatcgacgaccttcacggaggacgcaattaagcagccccaatgggttttcgaagaatcatttgttgatgcgaatcacgtagccgcggtttgcagagagaaagctcttcccgcggtctgtacgtttaggaaagagcagtgcgcgaaaatatttttctccaaaatcgattttgaatttttgttggacgatgcttccattctcaaccctttggctgatgggggcgcttcagagtacaacaattttatgcaaaaaccgcggaagaaattt

SEQ ID NO: 48573 - DNA, 914 bp, Heterodera glycines
  SCN-specific regions: Sequence locations=1-40,182-185,239-417,472 -723,746-914
gtttgagcgatcgaattcaacaccctttcaatttggctatcatgcaaatcttcgtcaaaactctcaccgggaagaccatcacccttgaggtcgaggcgagcgacaccatcgagaacgtgaaagcgaagatccaggacaaggagggcattccgccagaccagcagcgccttatcttcgctgggaaacagctcgaggacggacgcaccctggccgactacaacatccagaaggaatcgacacttcatctcgtcctgcgccttcgtggtggaaagaactagaacgacgaacggaagagatgattgatccgtatcgatccatatattatgtaacttgagaccgtcctgtattgtgttccgttttattcatcatcatgaaatgtatttcaatgatcacggaacgataaacccatcaaaactcaaaaaaaaaaaaaaaaaaaaaaaaaaaaactgggcggtcactaccggcggcttctttgagtttaaatggcgagtggcgaacgccaaaagttggtcaacaattcgacagctgaacgtccaattccgtcccaacatttttccgtccattcgaatggttacggcgccatcgccgccgatgcgacgcggccatcggtcagcggttcgtccaattcgtcgtccgatggctttcattgtcacgcggacggcgaccgacggccaacggacgcgcaaaacggcgcaagtgatcagaggagggcacggacagtgctgtggatgtccgtgggggtgtgctttgtgtttatgatttgcgaagtgatcggcggagtgttggccaattctttggcgattataacggacgccgcacatttgctgaccgacttggcgagcatgctcatttcgctgttttcgctttacattgcctctcggcccgcttcccagcgcatgagtttcgggtggcat

SEQ ID NO: 48574 - DNA, 650 bp, Heterodera glycines
  SCN-specific regions: Sequence locations=1-650
gtttgagttacctaattactagtaattagccggcaaaaatgtcctcttccaacacaattttgttggactgcagcgacgacagtgccgtcgtcgtcggcttcgagcagtgcgccaccagcgaaggcggaggggcggtagaaccgcagcagaaactgactaagaatcagcagaagaagcgcgcacgcatggaacggttcaatgcggggaaagcggaatggagacggaagcaaagggagcggcataaggagcggaaacgcgcgcggaaagcggacggacagacggcgacggttgtgcacaacgacaggccgaacaaactgaacacgatgaacgagtccaaatgtcgcgttcgcgttgctgtcgacatggcctacgacgacttgatggacgaacggtcggtgtgcaaaacggtgtcccaacttcgccattgctacgcgtccaatcgccgggcggcggaccctctccaattttatgtggtcaatttggacgaaaaggccaaaaaggttttggacggcatcaccggctggcaacaatgggacgtccatttgttggcccaacccttggccaaactgtgggacgaccgcgaaattgtctatctgacagccgactcggaaaacgtactcagcgcattggacgagcagaaagtgtacgta

SEQ ID NO: 48575 - DNA, 911 bp, Heterodera glycines
  misc_feature (879)..(883): n is a, c, g, or t
  misc_feature (887)..(887): n is a, c, g, or t
  SCN-specific regions: Sequence locations=1-482,505-776,800-812,834-911
attaagataactgtgggcactaaagttttcatttttactgctattcactcaaaatgactcaaaatgggatgacaacagccagcaatgagttcaacgagctcaatgatttcctgtcaacgcgtgcttatcttcacggttttctgccgtcccaagaagaccaatatgtgttcaaatgcattgcggctgctccctccgccagcgaatatccgcacattgcgcgttggtacaagcacatcaaaagctacgaggatgctgaacgtgccacttggccaaagaaggctggacagccgccgcagaaagtcgtttcgaaagacagtgcaccaccggcaaagaaagccgacgccgaggaggacttcgacctgttcggcgacgaggacagcgatgatgaggagaagaagcgcatcaccgaggagcgcctgaaagcgtacgcggagaaaaaggcgaagaagccgggcccggtggccaagtcgaacgtcatctatgacgtgaagccgtgggacgacaccattgacatcaaggacattgaggccaatgtgcgctccatcgaatgtgacgggctcgtgtggggcacgtcccgaattttgccggtcgcattcggcgtgcagaagttgcagattggatgctgtgtcgtggacgagaaggtgtcgacggattggctcgaggaacaaatcacaggcttcgaagacctggtccagtcggttgacgtggtcgcctttaacaaagtttgaatgatgacagacgaatatattgacaatgactatttcacacacacacaaatattattattatgatgatgatgcccattgttattttgttggtggtggctgttttgtccattgttgttgatgttgtatagtaagtaaaaatggttgacactcnnnnnaganaaaaaaagaaagaaataatggaaa

SEQ ID NO: 48576 - DNA, 638 bp, Heterodera glycines
  SCN-specific regions: Sequence locations=1-38,60-598,620-638
acgttaattgttttattcatttattcggcaatgaatgcagaaaaaataaagaaactgcaacaaaatgcagaacatgtgcgcacaggtggaaagggtactgcaagaaggaagaagaaagtcgtgcacaaaactactgcaatggacgacaaaaagttacagacgaatctgaaaaagctttcggtgactaacattcctggcatcgaagaggtcaatatgatcaaagacgacgggacagtgatacactttaacaacccgaaggttcaggcttcggtaccggcaaacaccttctcgatcactgggacagcggagaacaagcaaatcacggacatgttgccgggcattcttaatcaactcggggcggagtcgcttactcatctgaagaagcttgccaacaacgtgaccacgcaattcaaaccatcggctgaggacgacgatgtgccggatttgattggcgattttgaggaggcgtcgaagaacgaatcgaagaccacggaggaacttgtccattagtggtttttaccatcgttacacgagccacaactgttgcagtgggattggccaaccaatttccacattatcaaccccaccgttatgacaaatcagattgagttgttaaagtttcattctttattcattga

SEQ ID NO: 48577 - DNA, 651 bp, Heterodera glycines
  SCN-specific regions: Sequence locations=1-8,45-488,512-572,594-651
caacgaagttgttgcctggcctttttcttcgctcttctgcattttgtgcaccaattgcttgcagtcggatggcaaagtcggacgtgccggcgctgagcacgacgaatcagccctacccgtacaaggaacagactccgaagggtattttcgagaagatgggcttgcagaaaacgccggacggcacttcaatcggcgaattcgcagttatgcgtatggacgacatgatgaacttgatcgggcgtggctctctttggccattgaccttcggtttggcgtgctgtgctgttgaaatgatgcatttcgccgctcctcgttatgacatgatgcggtttggcgttgtttttcgtgcaactcctcgtcagtgcgacttgatcatcgtctctggcacagtcacaaacaaaatggcaccggcactgagacggatctacgaccaaatgccgcatccaaaatgggtgatcagcatgggctcgtgtgccaacggtggcggttattaccattattcctattcggtgttgcgcggctgtgaccgggtcatccctgtcgacatatatgtgcccggttgtcctccgtctgccgaggcgttgctctacggcgtgcttcagttgcagaagaaaattaagcggctcaagaaagtgcaaatgtggtatcgca

SEQ ID NO: 48578 - DNA, 629 bp, Heterodera glycines
  SCN-specific regions: Sequence locations=1-535,557-629
gttttagctaaaccagccaaacagataaacgacgacaaatgggtgtcgccttcgtcctgtgctgtttctccgtcgcctttacgccttcgctgttcatttttcgccgtttcgttgcccccgacccgttgcgcatcattctcttcgtgctcggtgccttcttttggctctgttctctgctcttgtccgccgtcgttttcgccgtgttcggccaacatctgttgctggtcgccattttcttctccattctgttccaagaagtggcgcgcgcactcttctacctgttgttgtacaaaacgcaaagcaatttggcccgactgatggccgccgatgcgaaccgcaccggcacagtgtccagcatgcgcttgctgtactcgtcccggcacattttggccattgtctgtggcctcggcatgggcaccgctgcggcactgtttcatctggccaacgtgttggccgcctattgggacgacggcgttgtgggcctgccgggcgctgtgcaggcaaatcgtaccatggccgaaccaacggacgcgtcagcaacggcacagccaaacgcagtgccattgccccatcactcggacccggccattcttctctctgccgctgctgacggtggcgtcaccgccgtc

SEQ ID NO: 48579 - DNA, 1122 bp, Heterodera glycines
  SCN-specific regions: Sequence locations=1-134,158-191,213-686,708 -801,827-878,905-1122
gaagaataagacttataattgctattattcaaaggatgtcggattcaatcaaacgtatttttgcacgttatatttatgactctcgtggaaacccaacggttgaggttgatttggaaacggaaaaaggtcttttccaagctgctgtgcccagtggtgcatcgactggagtctacgaggccttggaattgcgtgataatgacaaaactgttcatcatggaaagggcgttttgaaggcggtcgataacatcaattcaaaaattggtcctgctttagtcggacaaaactttgccgtaatgcagcaaaaccaaattgacaaatttctcatcgacttggatggcactgacaacaaagggaaacttggtgcaaatgccattttgggagtctctttggcggtgtgcaaagctggcgctgtgcacaaaggccttcccttatacaaacacatcgctgagttggctggaacgcggaaggtgattttgcctgtgccggctttcaacatgattaacggtggatcgcatgctggcaacaaattggccatgcaggagtttatggtgctgcccactggagcgaaaacattcaaagaggccatgcaaattgggtccgaaatttaccaccatttgaagaaggtcatcaaagaacgctatggattggatgcaacttcagtcggagatgagggaggatttgcgccgaacatccaaaacaacagagagggattggatctgctcaaagaagcgttcgccgcatctggacaccaggacaaggtcattattggtatggatgttgcggcaagcgaattctataaagagggaaaatatgacttggacttcaaaaatccaaacaccgataaagcgcagtggctgaccggagaacagctcgccgatatgtacaagtccttcatcaacgactatcccgttgtgtccattgaagatgccttcgaccaagacgactgggaaaattggagcaagttgcaggctgccatagacattcaacttgtcgtcgacgatttgacagtcaccaacccgaaacggattcagaaggcggtgcagaaaaaggcatgcaactgcttgttgcttaaggtcaaccaaattggcacggtcactgagtcaatcgaagcttcaaaactgg

SEQ ID NO: 48580 - DNA, 622 bp, Heterodera glycines
  SCN-specific regions: Sequence locations=1-622
gttattttatggtcggatagactgcagtaccatcttacaccccttttttcttggtgttggctgttctacataaaccaacacgtgaatcagaattttttttctgcttgctgtcacttatccccccttccccctttaaagcttaatacccattttaatggctgggattgattttgggaatttgacttgttacatggctgtggcgcggaacaaaggaatcgaaattgttgagaatgattactctttgcatgccacgccttcatgcgtttcctttggacaattcgctcggatgatgggtttcggggccaagcagcagctgaacgtcaattacgggaacagtgtcgtgaatttcaagcacatcctcggacgcactttcaatgacaaagtcgtgcagacatttcgtcagcacattccttgcggactgatggggaagttcaccgatgaccaaattgagataaaagtcactcatttgggcacgacgcgagtgctttccccggaacaggtggtcgcctgtctcttgacacatttgcgggttcagctcagccgttctctcgggacggatgccactgaatgcgtcattaatggcccgattttctaccaagaaaaccaaccccgagctttgctg

SEQ ID NO: 48581 - DNA, 787 bp, Heterodera glycines
  SCN-specific regions: Sequence locations=1-86,109-727,753-787
caacattggaaatggcttttccgcctccttttccgaatccattgcttcctcgccttccgaatcagtcggttcaattccctggacagaagtttggcttcttttctccacaacgtcaaagtattctgcccgggattccgctgctccgtccacgttttcgtccgaattttattccaagggaactgcggccacccaatccattggcaagacccaccgggccaccaacgaccacaacagtttttattgggaacatttccgataaatgtccggaccgaatcatacaggaagttctaaagaagtgcggttccgtgtgcaattggaaacgtctccaagactcacgcggaaaatttaaagcgtttggattttgcgactttatgtacccagacggagcaaagaaagcactgagtgtcctcaaggacttccccatcggcgacaaacgtctgaatgttaaagtgagtttggtgctcaaagtcagcgaaatagtggccattttcaggcggacgaacaaacggagaaactgctggatgaattctccaagaataagctcatcgccgccaacgaggagagcgacgacgccgtcagagcttcgatccgaaagtttttggaggacgaggcggccgacctggtggacatgccgacggacgaaggttttcggtgagggaaggcgaattgtgaccaaacaattcaggcgaatccaaagaaaaaagcccggccgaaggaagcactaaggtttttagcttctttcattatttaaactttgctctttccgagtccgtccttcttaaatcac

SEQ ID NO: 48582 - DNA, 812 bp, Heterodera glycines
  SCN-specific regions: Sequence locations=1-812
gtttgagcaaattttgaaaattgcactcatttttcttaattcataaacccacaaattctcgatggcatcgtcaataatctttgcaccactggccctcaaaattccactaaaatttgcaaaaatggacaattttggtaaacaaaagatttgcccgattttattaatggatgaccacgaatttatggaggggatggagcaggaagatgaggatgagtttatcgaagagccaatgtctgctgatttcgacttagggaatataaatgatccaattggtgttgacgaacctattaatcacgaagttcaaccgaagcctcccacagttaactccgctggcatcgatttggattcgctttccaatgactacacagattatgctctgatgaacaggctgttgttcattgccgacgtttgtccgccgcttaaagttgaagccttgaaaatgctcatcacttatgtcattaaaaaaactcaaaattggtcgatgcttagtgccgcgtatcagcgcgtggaatctgcgaaggcgagcggaattcagggggtagagagcatcccggaattggacaggacttgggtggaagttaccactgtgaagggcaacagccgattggaggcactgctcgccgagttcaaacggcagaaggacgaggcggttaaggagtcaattagacgtgcccttgaggatttgttccagcaatacgtccaaatgggaaacttgcaagaagcactgaagctgtacgggcgagggatgcgtgaatattgcaccgctcccaaccaaatcgtacagatgctcatcaattggattagcgttacag

SEQ ID NO: 48583 - DNA, 1070 bp, Heterodera glycines
  SCN-specific regions: Sequence locations=1-1070
atggcccacctcatccaggacggttttgtcgtcaatgacgcaacatggaaactaggcattttcatcaccgatatgaacatatcgcgagagttattcgttcgcggtgacatgaccatcggtagtctgatgatgcagttggtggggcaaattggcgagactcaggactggagtgaccattacatgtggtggcctgaccgccgtaagtggctgaaacacacgcgaagcacgttggaccaaattggaatcactgcagcgacttacttggaatttacaccgatgcataagcatgccaaggtccaactccccgatttgcagattatcgatgcccgactcgatttttccgtgcccattttgaaggtcacccaaaaaatctgccaagaacttgccatccgtcacccggaagaactgtcgctgaagcgtgatattccgccagatattttgcgaaaaggcgcatctgtcgaatcggaggctcagattcagccatacatgaagccgggcgaggagtccattggacccggcactctccgaacggccaaacccatccgcgcttcaactgtcaacctcactagcgggcgaggctcacctgcactttcgcaggcatctgcaatgggccccggtcacttgtttaacgcttctgaaattggcacactgccgaagatgggaacgattccgcgcggaatgagccccgggccagccgcatatcgcgaagtgcttggacgaacaccggagcccggttactctgaaggaggcggtctcgaatgtgaccagttcgacgaaaatttgataaactcaccgaaaataactccgggtcgtgaaacattcagaccccaaaattatttggagaaagccgcgttgaaccggggatggttggactcatcgaggtcgctgatggaacaaggcatttgcgaaggcgatgttgtgcttcttcgttttaaattcatgcagtttttcgacatgaatccattaagaaagtgctgcagatgcaagcaggaagggcagcggcagcgcaaaacggtgcacaaaacaagaagaaatcgcaaccggtgcagctgcccacggatttcaattcg

SEQ ID NO: 48584 - DNA, 1484 bp, Heterodera glycines
  SCN-specific regions: Sequence locations=1-1484
ggcttttttgcttgccgaatgaggcttttgaaaattttcatctgcgagccctgggcatatatatacataattatttacacaatctgttgaatatcgttgttgtatgcataatatcgtccatctgattggtcagtcagttcggcactttcttctcaggccgtcttggtgtggctgccgccctccggtgtccacaattccatgttttccctcatcatgcgcaagttgagcgaggcgtcatcagccaatggtaccgtcaatgtggcaatctccgcctgggccaagtcaattgcctaaaaatccggggagaatttagccacattatacaatgaaagaaaaagcatgatgaaaatcatcaaattggtcccactttttgggccaatttgcgcgcctcgtccaccgattttaagatttcgaagttgaacacggagaagttgagtgcaaggccaagacgagtcggattgatcgctgcaattttggaggtggcgatgtccatggcttcttgcaaaagaacaaacttcgcgtgctttcccgacccactgaactcgtaagtttggggcgctgatttttggcagacaatacattcaacggtgacccgaacggcgtgatgccgaaacaccttgtgtggctcgactttgttcgtttggtgtgccaaaatagatgcgtttgtgcatatgtaatttgtcgacaaatcgctgcacatcgacgcattgtaccactgggataacgaagccgtatccggattgctgctgtcagaggaagtagaacgagaacgggccatttatcgaataatgaccacgggctcggaccgaacacaactccaactgcaattacattttaacgcaaataattcttccgaggcatcccaatcacaaaattcctccgaacaaatgcaaaattgttcaaccaatgaaagagtctctggagaagattcggtgccattcatcgacagagagacttttggagacgcggagagtgacagaggaaggggaccgccgcccgatcggtttcgactggtctatctgatcgtgcttctacatggaatgggcatgttgctgccgtggaacactttcattacgatcgcaggggattattatttgcaattcaaattcgcaaatgtgagcaatgaagacaattacaaagtgtactttttcaattatctgacggtttgtgcccaaattcccaatttgcttctaagttttctgaatttatttgtcgtcataagaggcggcttttaccgtcgcatttacttcactttggccgtcatttttggcatatgtctcgtcacaattgcgatggtttacgttccaaccgataactggactttcggctttttcctcttcacaatgctatccgttgtgcttctgaatagcgccagtggtgtttatcaaaacagtatttggggattggtcgctgattttcccggggaattcgccggtgccattattcttggcaacaatttatgcgggattctgatggcggtgcta

SEQ ID NO: 48585 - DNA, 742 bp, Heterodera glycines
  SCN-specific regions: Sequence locations=1-584,606-742
gccatatatctttagacttttttcagataatcagttttgcgatctcaataaaacttttctttatttgtcaacttcaattgagagaaaagacaaaagcaattggattccgattaccaaggacagcgaagctgaccaacacgtcggtgtcattcaaaattttgggcacagctttgtcaaaaccttaaaggtgtcaatttcaggtgttgagtcttatgattccggcatttactatgcgtttagggcatatatgatgaatgaattgggattttcagaagatgtcaaaaagggtctctgtgaagcgtcctgctattatgtcgacgatgtcgaccaggatgattatacaaacagtggctttaaaaacagagcgtcacgttttgctgatggtgcaaaatgtgaaacaatggtgaaacttaattttgatctcgctcgtcagcccaattttttgcttaataactctgacgtgatttttagcatacaccgtaacaccgatgtttttctaattatggcaccgccatatgtttccggaaatgcagtcatagtgaacccgcacacatatcgtattaacatacacgatattagaatttatgtaaaaacagtagatgttacccagtcattaaataacataataagcaatcagctacaaaccaccccggccaaatatcctatgagaaaaattgagatcaggagtcttttcatcccgcgtggcacttctgatctttcacacaatgtttttacaagcatt

SEQ ID NO: 48586 - DNA, 876 bp, Heterodera glycines
  SCN-specific regions: Sequence locations=1-799,822-876
agccctctaaaattcacgaaggtgtttttgctattgttcgtaaagttggtggtgaacatattcgtttgtgccgtttgataagtgggcaacgcgtgctaattgaacgactgagttttaatccgaaagacgcaattggacatttttatgggattttcgaagtcagcaatggtggtgacatgctttgccccattgaattcgcctcaaagcttttttttaccgaattttcaaatgggaattcagcaggagataggggtcacggaaatgaaagcactcaacaacttacaagcaatcaaattatgagcttaaaagaggatggaatcactacaaacgaattagtttccaaattggtcagcggaaattgccacttccaatctcgtacaaaattttcaaaagaaaaatatatgcgaaagaaagttcaaaagcattcggaccgggttgttattttgcagcccaatattcgccttttggccgactgttactaccgaaaggaccccgaacgactcggacatttgagaattgaccagctcggactgatgcttcagctttccgggcttcactccggcaaatgcaatgcttttgtcttcgaccaagttctcggattgcttggcgctgctgtgttggaacggataaacccttttggccactgcatttttcttcaccgcggcgattggccccaatccattccatgccttgactcattcactactgacgctcagaaaagtagagggtttttgacattacgaatcacaacactgctccagcgaaacaatggacgggacgaggagaaaacgaacaatctgaaaaacacggaggaaagggagccgggcaagcgagaggatgtggcagaggaacgccgggaacagcaaatacagaaga

SEQ ID NO: 48587 - DNA, 735 bp, Heterodera glycines
  SCN-specific regions: Sequence locations=1-214,236-735
gtttgaggtatttaactaaaaatcgcatccctattaatcactttaaagccgttctctttgaattttcactttcctgctcattttttgataatgggtcgacacaggcgttatccgatgaaaaaaacagcaaagaatacaaaccaagcccaaaaaatagaacgattgtcctttgacactgatcagacgcctcttcaaacaccaaaggacagcaggaaaaacaagaatatgaacaaaaagccatccaattcgatgttggaggaacagccaacaacatggaaagagcaaatgttgaagaaactgacagacgaagttgcacaacaaaaaaataaaatacagaaaaggaacaaaaaaccaaagaatcgacttttggaagaaacgcagaaattgggttatcatcacatgccctgggaaagtgcaaaaacactgatttaccgaattcagcaagaccaaaacaaggctataaatgaagaacttttaaaggctcgatttgcaaaagcaggaagagatgttaaggaaatagcggaggaatacaaaataatggacgaaaaaaacaaaatgaaaaaggagcggagaaaagcattgcacgagaaacagagcaaattaagagccaaagaaaaagacattgacgaaggaatcggagcgaattcggaagaagaaatggaccaaaacgaaatggaagaagggaagagagaagacggaagaggcggagaagcgcaagagaaaagagcaggtcca

SEQ ID NO: 48588 - DNA, 1144 bp, Heterodera glycines
  SCN-specific regions: Sequence locations=1-116,138-397,420-1144
aattgtgccaaaatgcgctgctcccactcccttccgctgttcctatgttttgtgctcttcgctgggttggcatcgctaatttcggcccgacttgcgcacgaatcgttcgccaaacaccgccaccactcgcgcggcggtgccgccactcggccagaagcagcagcaggcgatcaaccgcagaagcgcaaaagcatttacaactcgaacaaatgctaccggcaaccgtcggacgcggaacgcgtccaaaaacgaacttcgatgcgtctttatgagttcgacgactatttgtttgacgagttgccagagacttgggattggcgcaatgtcaacggagtcaactacgcgtccactgatcgcaaccagcacatcccacaatattgtggctcatgctgggcaatgggtgccacttcttcgctggctgatcggatcaacatcaagcgcaaaaacgcgtggcctcccgcctatttgtcggtgcaggaagtgatcgactgcagcgaggccggctcatgcgaaggcggcacgccggacaaagtgttcgagtacgcgcacaaaaatggcattccgcacgaaacgtgcaacaattaccaggcgcgagacggaaaatgtgacccgtacaaccgttgtggttcgtgttggcccgacaaatgtttcaccgtccaaaattacactttgtacaaagtcggcgacttcggctcggccaatggaatccaaaagatgaaggccgaaatttaccaccacgggcccatcgcttgtggggtggcggcaacgccgcggtttgacaattattcgggcggaatttacaaagagcgaacgaatgaggatattaaccacgtcatcagtgttgtcggatggggcaaagatgcggcttcgggtgtgccgtactggatcggccgcaacagttggggcaccgcgtggggagaacaggggtggtttcgtgtcgtgacgtcggagtaccgcgacgcgggaaacaaatacaatctgaaaattgaggaggattgcacctggggcgagccaattatcatctgaatgaggagcgaacaatccgagcactgttcaagccgatgccaaaattttttccatttttgtccaagcatttttaagccaaaataattacggaatttgacaaattaggcaaatatcaaaa

SEQ ID NO: 48589 - DNA, 667 bp, Heterodera glycines
  SCN-specific regions: Sequence locations=1-94,131-175,197-275,301 -364,388-403,460-553,613-667
agagttgaaattttatcttttgaaaatcgtctagacctatttaatttttcgaaaaatgtctgacaacaaagaagaactcgttcagcgggctaagttggctgagcaagctgagcgctacgatgacatggctcagtcgatgaaaaaggtgacggaattgggtgcggagttgagtaatgaggagcgcaacctgttgtcggttgcatacaaaaatgtggtcggtgcgcgtcgttcctcgtggcgcgttatctcatccattgaacagaagactgagggctcggagaagaagcagcagatggccaaggagtatcgggagaaggtggagcaggagttgcgagagatctgtcacgacgtgctggatttgctcgacaaatatctgatcccgaaggctggcaaccctgaatcaaaggtgttctacctgaagatgaagggtgactactaccgctacctggctgaggttgccaccggtgacgaccgaaacgctgttgtcgagaagtcgcagcagtcgtaccaggaaagcgttgacattgccaaagacaaaatgcaggccacccatcccattcgtcttggtctggcgctgaacttctctgtgttctactatgaaattctgaactcaccggacaaggcgtgccaactcgccaaaaaggcgttcgatgatgcgaatggtgag

SEQ ID NO: 48590 - DNA, 525 bp, Heterodera glycines
  SCN-specific regions: Sequence locations=1-47,69-404,442-525
taacacattttccaacattggctaattaccgtccctaactaattggcttttttccctcccacttaattgtgtaccatcaaaaatgccgaaggtggactttgactatttggacatgttttcacccatcttggtggcgtttatttttgcggtcatcctttttttcatctccttcacgtgcatcaattggtactgtatcacgcacaaggatgaccttacggtgttcgaaaagttcggcacccgcttgaatcttcgtcttggcccccattcaatggcagtgatcaaacgaggcggctacgcgtccacctacgcccgcgaggaggcaaagcggtcggaatgtaccggaccacaacagcaacaactgaacacgcttggggacggaaaatgccaaattagccacgcttgacaaaaatgattggcattttttcaaaatcattttaattttgatgaaaattttctatgggttttcaattaaccaaagaatttttttttatgccaattaattcctcttcttttaatgcaataaat

SEQ ID NO: 48591 - DNA, 1090 bp, Heterodera glycines
  SCN-specific regions: Sequence locations=1-180,217-1090
caatttgggtttataaattgttttggatataaatttgccaacattgccttcgtttttcctggggatgaacaccagcacaccgcgcgatgctccgacggcgcaagacgcacgaactttgcgccaaatggcgtcacttcgccggtccatgcgcagcactctgtccccaattgtggcggaagagggggagagagaagtggggacttccgccgccgccgcaacccaacggcgttcaaccgacttggcccagtcgttgctccaacgacggtcagtgctcagccaatttggcagtgcccagtcgtcggtgtcttcctccgtcgggagttacactccgtcaatgatggccagcaaaattgacaatcggcccgccattgtcatcgaaattggcactcgactgaccaggattggctttgccggtgattttttgccccaggagattttccgctccgaattcgttgacccattggacggtccgtccccgtcctccccaattgcactgtttgaccggtcgcgcactgagcaacagcagtacgaagtgctcgtcaaattcttcaaaaacatcgttttcggcaaattgttgaccactatgagctcgcgtcgtgtggtggtggtcgaatcgcttttggtgtctaattggcaacggaatgccattgcccgggccctcttccaatgcccttctctaagcgctcattccattttgttcgctccgtcccatttgtgctgcacttttcccttcaacacaaaaacttgtctggtcattgacatgggtgctgacgaagccgtgctctttccggtagctgaaggggtgctgatgctgaacagtttggagaccagtgtggcgccctccgcgacggcgttggagcaaaatgtgcgtcgtttgatggcccaatttggccgtctgcggaccggggccgaagacgatgcggagggacggccgctcactgagactgagttggaacaagcggaccgaatgcgactgtgggaggacgtggcggtgcgcttctgtttcgccacaacggccgcgcgcggaaaacgcattcagacgtatttggccaattccgctgcttcttcgtctgccgattgttccgctgcg

SEQ ID NO: 48592 - DNA, 652 bp, Heterodera glycines
  SCN-specific regions: Sequence locations=1-652
gaaaagggaggcgatcctgaacaaattcgcaaatctcaagtgggccgcttcgcagatgtttcattagtggacaaagtgatttcggcggactccgaatggcgaaaagagcgtttctttttggacggtttgaatcgtgcgataaaagtgtgcagtactgcgattggtgacaaaatgaagaagaaagagtcggctggtgactccgatgccattccggaaggacaaatcaaatcacttgcagaactgaaaatggatgacatcaaagaaatgaaaatttcgcaaattaaaacagtcaagggaatggtggacgaagaagtcagacggaccaaactcagaatggaaacgcttgagggggacagaaatgagcatttggccaaaattgggaatttgctgcataattcggtgcccatcagtgacaatgaagacgaaaatcgagtcgaacggacatttggcgactgcgcaagcagaaaaagttattctcatgttgacctcgtggtgatgtgcgacggatttgaccgagagagaggcaccaatgtggcgggaggacgaggctattttctgaaaggaccggtgggggtccttgaacaagcgctcatcgcattggcattgcaaatgctcaacaagaagggcttcacgccgctttacacgccctttt

SEQ ID NO: 48593 - DNA, 651 bp, Heterodera glycines
  SCN-specific regions: Sequence locations=1-406,428-434,468-651
acggctataaaagccagctacagcaccaccacctgcaaaacagtttcctccgtcgccgtctccaccaccagcacagacgcgtccgacggagcggccagcaaagcgcgacggccgccttttcactggacaacggtgcgacggcacccgcggcgagcccattgcgatttgacgacaaagcaccgcccgcgcgcattaaccaagctgttttccggcagcaaagtctgctgaacgccgcttccgccgagctcagtccgtgcgtgcagccgcttcgccgcggcaattgtcaggaagcgagtctgcgctatttctacgacttggccctggaccagtgcagactgttctacttttcgggctgcgacggcaacgaaaacaacttcgccacgttggccgagtgcgaagtgcggtgcaaaattgggtttactcccaactcggtaccagcccaacaacaacagcagcaacaacaaaaaggcagcattggcccatgccccagcggcgaattgcccctcgggggtaaaaacccggtgttgtgcggcgatcggtcggactcaatcggctgtccttccggctttttctgcgccgatgggcccccgtcggtgtgctgtcccggccacaaaagtgccgcttctgtcggcgatgtccgacgaaagccgt

SEQ ID NO: 48594 - DNA, 1163 bp, Heterodera glycines
  SCN-specific regions: Sequence locations=1-190,216-300,322-388,418 -441,463-466,493-496,535-541,564-645,667-712,748-765,801-1046,1068 -1163
gtccatttaaggcaaccaattactatttgcgttgaaaaaggcattggcagtaacgacattttgtcaaacatttcgtccgtctttgtcggtgtgatcgatcacccaagtccaacccatcagaataacaacaattaaacggtcttttcaaattcccaactcattcggctgactgattcgataatcgcgagtcgtcatcttttcccttttcttttccatcgacatttttggctgggttaaactaccaaccaacaaaaagagagcgaaacgaagggaggcaaaaccaatcaatttagtcgagaaagccgagtgaaggaaacagcctcaacatattccatttgtcttataacggaactacaataaaatggcggatcagctaaccgaagagcaaattgccgagttcaaagaggctttctcgctgttcgataaggacggggatggcacaattaccaccaaggaattgggcacggtcatgcggtcgctgggtcaaaaccccacggaggcggagttgcaggacatgatcaacgaagtggacgcagacggaaacgggaccattgactttcccgaattcctcacaatgatggcacgcaaaatgaaggacacggacagcgaagaagagattcgggaggcattcagagtgttcgacaaagacggcaatggcttcatctctgcggccgaactgcgtcacgtgatgacaaatttaggagagaaactgacagacgaagaagtggacgaaatgatcagggaagcggacattgacggggatgggcaagtcaactacgaagaattcgtaacgatgatgacgacgaaataatcgcttcggcacagccctcaacaccgtcactgcatcgatcttttcatttccttcgttcatttaaattatctcctctccacccatccattcattcaccgaccatttttcccgtggattcgattgattttatgtattctataattttttatttgcttttccgtgttcttttgagcagatactgagaatatttgtattgcgttttcttggtctccatcccatcaatcgtctcgtacacctttaatttgtttgtgtttctgtcgggaaacatcgctgggggccaattcgatgagacacattcaaaccagacgatcattgattgtatttcgttttctcaataaacgatttaaaagtt

SEQ ID NO: 48595 - DNA, 664 bp, Heterodera glycines
  SCN-specific regions: Sequence locations=1-579,603-632
tttgagctcaattcgccaaaattcttaacttcaaccaacttcacaaacttcacaccgacatttctctcctgaacatgtccgagaaatttgtcggcaaatggaatttggagtcgtcggagaactttgacgacttcatgaaggaggtcggcgtcaactttctcacccgcaaggccgccggctgtgtcaaaccggtgctggaattcgaagtgtccaacgccggcgagcactggaagatgacgtccacgtcgacgttcaccacctggaactgcgagttcgacctgaacaaggagttcgaggtgaagacggccgatggacgcacggtgaagaccattttcgcctacgaaaacggcaagctgaccgagaagcagtccaagctcaaggacgacgagaaggacagctactacgagcgctacatcgatgaaagcggcaaactcgtcattacgatggaagccggctcggtgaaggccaagcgcgtgtacacgaaggcggcctgagaaccgaagaagatgacgccgatctccgaagacgacggacgcttctgacccgttttcgtcattcttgaggccttttgatccgcaattcttaatttccatctaatttatttaatgcgatcaataaaagggttctctctgaaaaaaaaaaaaaaaaaaaaaaaaaaaaaaaa

SEQ ID NO: 48596 - DNA, 650 bp, Heterodera glycines
  SCN-specific regions: Sequence locations=1-313,335-548,571-650
cattaatggtcctacaaaaaaagaagaaatcgttttccggttttaaaatacagaattttgtttatgggctagattcacagataagttcgctggataagtatttgttgaactttaaagcaaagaaaaatggcggttcttgtctcctctcgggcagaacaaatactggaaagacgcttgttctcgaatcactaatccagaaacatttctctgatgatgattgtgatataaacatcagaagagttgacgggctttcgaagatgacaaaattatttgaaaagttagatcttgaagggccggtcttgattgttgtcgatcattttgaacttttcgcatataaacaacaacagaatttcctatacagcattttgaacggcagtcaaactcttccttggtttgtcgttctaattggcacaacggaaaacagcgttaatctattggagaaaagagtgaaatcaaggttctcagcgctaagagtcaacttcaatgtgacattttcactcgaacaattcgacgaaggatttggccaacttttggattgttcttccctctccaaaaagatgattaagaaaacaaaggaagatgacaatggcaaaaaattactgtgtgcttttgattgtccggaccattggtttggttatttgaagaaaaat

SEQ ID NO: 48597 - DNA, 780 bp, Heterodera glycines
  misc_feature (705)..(705): n is a, c, g, or t
  SCN-specific regions: Sequence locations=1-198,221-410,433-780
cctgtcgctgtgctttgtactatcatttccttatcaaatgcctcccccaatttcctctcacagcccaaaatatgagaaaaacgagttgcacacacagaacaaaccgtcgaatgttgttgaggcattgacactctctctctgcccatggcttcgtcgtccgctgccagcgatgactcatccgccgtttcttcgcctcctccgccgcttctctcttctcccatccgatcggaaatggtcgctgctgccaaacagtttctggccaacccgcgagtccgcaacactccaatcagtgaacagaccgaatttttgcgtggcaaaggactgacagagacggaaatacaaaaggcaatgaaattgacaacggacggagggggagaggtgccgtccacttcgctttcgtcccttcctcccgcgtccgctccctctccctccgctcgtgccgtcgtcgacttggcacgttccgcgcttctcttcggcactgccggttacatggtctacagatttgttcgttcgtggctgctcccgcagcttctcaatgtgccggacccggccgaggagcgtatgcaacgacttgagcaacaggtcgaaaggctgagcgattccacgcgatgcatcgccgaatcggtgacacaaacactcgttgcggtgacggaacagaacgagcagctgagccgaacgatgatgatggtgcagggagggacgaangggacggtttgcaccgccgacattgaccgtgtacataccgaaattggcattgtcaagtcgctgctactcaaccaa

SEQ ID NO: 48598 - DNA, 710 bp, Heterodera glycines
  misc_feature (682)..(684): n is a, c, g, or t
  SCN-specific regions: Sequence locations=1-5,28-635,657-678
cagcatcatcatttgcttctgttcatccatatgattgtgaagcctgttaaaaatttttttcaaaagaatgtgaccaaagtttggctgaagccgccgcctcatgacacttttattgagccttggtttccctatgctttaattctaaagccaattggtcgagcatttcagcgtttgggcgtatacacttacaacaatttcatcgcccgaaccacttttggtctttacccgcgagaatggaacccgcgtgtccacggcccatatgttcattatcgttactacggaacaaacaatgacattccgctaatggaagtcaaagtcaatgacttggccgcgtacatcgcccgtcgtgacaaatctccgcgtgccatttggcgcgaatttatgcgcaacttctacaagcttcagtacttctacttctcggggcccgagttcggcaaccctttgacaatgatttggcgctatctcgtcattttcatcgtcggctttttcttgaccctccgagttgtgaccggcgcggacacgcgtttccgacacgctttgtaccattggtagacggacggacaaagagggccgatgagagaaaaaggaaacagagcgatagagcagaaacaccgtccgaattattgttaggcaatgtctccatattttctgtgctgttattaaagcctattgtagtttaaannnaaaaaaaaaaaaaaaaaaaaaaaaaa

SEQ ID NO: 48599 - DNA, 634 bp, Heterodera glycines
  SCN-specific regions: Sequence locations=1-108,130-634
cccgtctccaatatttcctcgtctccaatctgttcgccggtttcctcatcgcacacgtggtcacctacaaccactactccaccgacaaattcgcatatgacgacccaatcctggagaactttgcctgtctgcagctgtacaccacgcgtaacatgcggcccggcccgttcatcgattggctttggggtggtctgaactatcaaattgagcaccatttgttcccgacaatgccgcggcacaacctgaagaaggtgatgccgttggtgaaggaattctgtgccgaaaatgacatcccttacatggtggacgattatttcacgggctttcgcctggtcatcgaacatttgcgccgagtggcggaagcggccacagaaacgctggtcagccatcacagccaaaaagtgccatgaacggacacagcagcagaaagtgatcgggtggaatgggagagcttttcatatgatcaatccgatcactcactcactgctgttaattacgattttaaagagctgaaagcatttttcctctgacacattccatcgttttgttatttttccgctgtcatttaatacaacaaatgatacggtttctcttcttctgagactgttatatgtattcacactttttgaattat

SEQ ID NO: 48600 - DNA, 604 bp, Heterodera glycines
  SCN-specific regions: Sequence locations=1-80,104-507,531-569,591-604
agcaaacttccgccggagctcactcagcaagtgatgcgcggtgaaatgcccgacttgaccaagttgccgttggatttgcagcagtggatcaaagataactttgaccggcttgttgcttcgttggagaacaatcccgatctgagcattgacgaaatcatgaagaagttgcccacgttcgagcacccgctcatgtccaccttctccccctacgacatcaacaaggtcgacgccgatttggtggtccaacagcgcaacgaggaggaggccaaccaccgtttctggcgcattttcgccgccagcgccttggctttggctggtgccgtgacgctgggcgttctcagtgccttcttctggtacctgaaacggagcagacgtctggcggacccgccgatggcgccgccgattggcattgacgggggccccgagctgccctcggtgattcgtgagcagtacttccgaccgtctgcctcttcaacgctcaagtgatcactgatcagtcgcgatgttcttgttcgggtgtgattgattagacttttatttagtttccgctttttatttccttaacattcctaaaaagtcatctgttcattcctgtgccgacttc

SEQ ID NO: 48601 - DNA, 708 bp, Heterodera glycines
  SCN-specific regions: Sequence locations=1-332,354-412,435-469,492 -638,662-708
tacagtgcactggacatgcacgagcaggcgcaagaatttttgaagcgggcgattaaattgtgcccgacaaatgcgtccatttgggtgcttttgggacacgaatatttggagacgaaaaaccaccaattggcctcaacggcgtacaaaaaggcaacagagatcgattccgtttgttaccgcggatggtacggactcggccaactttacgaaatactgaagcaatcggagaccgccctttactattaccaaaaggcgcacaaatgtcggccagcggactcgagaattttgatcgcattaggtgtgattttctccaaaatcgaccggaaatcggatgcagaaaaatgctttaaaaaggcatttcaaattggcgacgtggagggaaatgcgctgacgcatttggccaaactttacgaagaacaggaaaaccagcaaaacgccgccaaagcatatgaagcttatttgacgctttacacggaggaattggtcggcgacctcagtctaatcgctgaagcgtgtcgctttttggctcgtcacaatttggaccttggcgatttggacacgtcctacgcctatgcccagcggtgtttgaattatgacctggccaaagaggagggccaacgcatcctccgactgataatgagcaaacggaaggaggagcaggagcgcaagctggcactccctgtcggaacgcctcagcagcaaaacatt

SEQ ID NO: 48602 - DNA, 683 bp, Heterodera glycines
  SCN-specific regions: Sequence locations=1-683
attttgcagaactgtggaccgaattcgtttccaaaatgctattctttcaaaacggtccggtcgagcagtgtccgcaccaacagcagcagaatgccgcgccgctgtcccaccgccccacggcattttccctccccgcaacttcgcctttctcaacaatttcatcggtgggctcactgccgtcggagccaacaacgcccacagaaagaatgagcacaggaaatgtgatgatgatgatgagcccgaaaagaatggacaaaggaaacggaggagagaaaggacaaagacagaaagccccgggcaaagagcggccaaaggacggcaaagagcgcgtgcacaagtgcgaccagtgccaaaaggcgttccgcttcaagtccaacctgttcgagcacaaatcgctgcatttgggcagcagcagtcggaaccctttcgtgtgccctttctgctccaaaacgtgccgtctgaagggcaatctgaagaagcatttgcaagtgcacgtcaccagcgcggaggacttggaatgcttgtggaaacgctctttctcacgcagttccggtcgtccgagtaaaaatgcaccgcccgctccgttgccaaagcccggcgacgacctcggcatggtgccggtgctcgtctctcagcaggatgcttcttcctcctctccatttggctcctcccccaccatcaaa

SEQ ID NO: 48603 - DNA, 516 bp, Heterodera glycines
  SCN-specific regions: Sequence locations=1-516
attaagtttttaaagcttatattaatagcaatgactgaaggaggtgaagaagtgaatccaaaggcctaccctttggcggatattcaactttctcagaagttgcttgatcttgttcagcaggcaacgaactatcatcaattgaaaaagggtgctaatgaggcaaccaaaacactgaaccgaggcattgctgaggtgatcattttggcagctgatgcagaaccattggaaatcattttgcatttgccattgttgtgcgaagacaaaaacgtcccatatgtattcgtgaaaagcaaggctgcacttgggcgtgcatgcggtgtgactcggccggtgatcgcaacttcgatcattcaaaatgaaggatctcagttgaagtctcagattcagaagattaaagaagatgtggaaaagttacttatttgattaaaaatttgcaagcttatcactgttttgttattccatcttgttttgttgtttcatgatttgttcgacgacaattaaaatgactctgaaaaa

SEQ ID NO: 48604 - DNA, 669 bp, Heterodera glycines
  SCN-specific regions: Sequence locations=1-169,192-377,399-572,594-669
cttggtttttagcccgagaatgttcaaaacgtacgggccaaggcccgagtcgttcacgcttgacgacggtgaacgttattatgtcggtgcggacgtgggccagtacttgaaataccatcgcggcacgctgtacaaacgctacccccaactgtggaagcgaatggcatcggtggaggagaagaagaagatccaggagttgggctgtgccacctcctacatcaactcgaacattatgctggtcaaagcgaacgaggttgaagacatttttgacggacaagaggagaaatatcgcgcgtcggtcagcggcggcagtgcgtacggacgcgcggagggtgcgcaaacgctgcgaagtcggggcagtgctccgtggctgaaccagcaggtggccaaaaaacaaatgtgaccagcggttcccaccacctcgagtccgtgccctgctccaccccttcggcgcacgggcgaggccatttcaaaaatcgcgactacgcttacgtggcggatgacctcgagtcgtatcgccgggtgatggaaaatgcgcaggccggcgaatgtttggtgcccattcggctggacatggaattggacaatattaaactgcgggactgcttttgctacaacaaaaatgacaaactgatcacaccagaaatggttgcagaagtgttgtgtgaa

SEQ ID NO: 48605 - DNA, 867 bp, Heterodera glycines
  SCN-specific regions: Sequence locations=1-174,206-206,241-271,295 -325,361-444,466-485,508-528,555-708,730-867
catctgtccaattcgtccgtttcttcagggccttcttcttccatcggttgttgagcacgaacgtgaactcggcactttgatcggatcgtaagcgcagcagaactcgaacagaagcagcagagaatctgtagctcatccatctcttctcatcttcatcctctacttttgtccttctccccatcgccatgtctgaagaggaatcgcaatattccgacgaagaggttgaggaggaaagcattgccgcggatgaagtgagcgtgcaggaaccggcaccgcccaaagaagaggagccggcgccggaagccgaagcggaggcaccgccggcggaagaaaaggaagaggaggaggaagaagagccggggtcacccggaggggcaggcgatgcgccgaaagaagaatttcgtcgcaccagtgttacggagtccgtcgcgccgacggcgcaacttcgccgcgcgccgccccctcagccgaagccggcagaagaatcgatgacggaggcggaagcggcgatgctggcggtgaagaagcgccacgaggaggaggaggaagccaaaatgcgcgacaatgacgagcgacgccgccaggaactcgctgcagttgaggacgaactgcgcgttttgaaagaacgccaagcggagaggcgagcggagcgcgagaaggaggaggccgaattcgccgaacgacggcgtcaagacgaggaccgacggcggaaggatgaggaggaacgaaaggcacgactcgaagcggagaaagcgaagcgcgacgaggagaagcggaaagcgccacctgatgatggccggcggaattggcggatttgtggcggcggacgcggaaggagcaggcaaaaactttggagttccccagaaa

SEQ ID NO: 48606 - DNA, 1328 bp, Heterodera glycines
  SCN-specific regions: Sequence locations=1-655,678-701,723-1328
aggtaatatttatttgcttacagcaatttaaaaaaatggctgcatttttgaatggcaatgctcacagcagcattgaatgcaatggtgtcgtccatgacaaaaatggcattgatcagaatggcaccaaattggctgatcgcttacaacattcggtgcaaattgggaccaaaaaagcgccggtgtcaaaggggagcatcaatgtcaacaaatatgtgctggaagtgatcagtgacactgatcagctgcacacattggaacaatatgccattgactacgctcattcaattggtttggtggccccactttcggacccgccggagggaaaattcaccaacatttatgccgttccgcctccaatcgcattgcttccatccccgttcccgcgcgaactgtacgaccacgcagtgaacgtgcaacaagcgatgaacgagctgtactttcgtgttgcatcggaccatgactttttgatggacgcatttaaggacgtggtcaaaggcgacccatttatggcacgccttgtgcaaatcgcccaagtggtccacgacgagggcattcatcagccattggctgttcaactccaacgttcggattatatggcacattgggacccgtcagatgggagcatggcactcaaacaggttgaagtgaacatcggaccaattgggggccctggctttgcctttggggtttccaaattgcatcaaaaaatgctggacaaacttgcgattgcgcatgatggaaagccagcaattttggccaattcggaagcgcccctgaaccgctctcgccaaaacattgcctacacactttatcagtcatggaaattgttcggtgacccaaaagctgtgcttctttttttggacacgccgaacatcacgcattttgagcagttgcaattcattcagtttgaagtggaaaagttaggcaaacaacaaggcaattttgtgaaggtgttggtgctttcgctgaccgaagcatcgaaaagaatttcgcttgacgaaagcggcgacttttcattgtatttggacggcacaaaacgtgtggcattggtgcacattgctgacggcaatgtgccgcatgagtacccaacggagcacgaatggacggcacggacaacgatcgagcgatcaaatgccattttgtcgccaaacattcgcttccacctgagcagcaccaagaaaattcagcaggtgttggccaagcctggcatggtggaacgcttctttcccaacgatccgaaacgtgtggcactgatccgcagcacattcaccggactgtggggccttgaggttgaagacgaggcgacccgagaagtgattgaggatgct

SEQ ID NO: 48607 - DNA, 636 bp, Heterodera glycines
  SCN-specific regions: Sequence locations=1-232,256-291,316-636
gttcatactcgcacaaacagcgagatggagaacgctcatacgaaaagtgaagacgaattgtttcggtttttcggcacagggccagacggactgacagaggaacaagcagacgaattgcgggataaatatggctataatgaaatgcccgcggaggaggggaaaaagctgtgggaattgattctcgagcagttcgatgatctccttgtaaaaattttactcctagccgcaataatttcttttgtccttgccttgtttgaggagcacgatgaccagacgagtgcagtcactgcgtttgtggaaccttttgttattctcctaattctcattgcgaatgccacggtcggagtttggcaggagagaaatgcggaaagtgcaattgaagcgctgaaggaatacgaaccggaaatggcaaaagtcatccgagcgggcaaacacggcattcagatgatccgtgcaaaggaactcgtcccgggcgatctcgtcgaagtttcggttggagataaaattccggccgatttgcgacttgtcaaaatttattcgacgaccattcgcattgaccaatccattctgacgggagagtctgtgtcggtcattaagaatttggacggggtgcccgacccgagggcggtcaaccag

SEQ ID NO: 48608 - DNA, 666 bp, Heterodera glycines
  SCN-specific regions: Sequence locations=1-217,397-483,505-666
ccttatcctcgaaaattcctttctggactaaactctgccccttctccaaacaacagccggaacagcagcagtcttcccccgtcgcagaagacacaattccgccccagcaacaaaaagaaggtgccgcaatgtctgccgaaggaaacgacgcaccgccagccgcagagcaaccgccaccagccgaagcagcaccagctgaagcggtccctgtccaggaggcggcggcaccgccagtagaagcggcggccgaaactgcaccagcggaagcagcgcaaccggtagaggaggcggcaccgcctgctgaggcgcccgttgaagcggcaccagcggaagcagcgccaccgatagaggaggcggcaccgcctgctgaggcgcccgttgaagcggcaccagcggaagcagcgcaaccgatagaggaggcggcaccgcctgctgaggcgcccgttgaaccggcaccaccagtggaagagccaaaggcagcagagcctgaggcacccgtttcggaagctgttccagcggcagaagcgccagtgaaagaagctgttgctgcccccattgaagtcgcgcccgcagaggcagagcccgtctctgccccgccagctgaagcagtaccagccgaagaagcgccggctgctgaggtcgcccagctgagtttggaggaacaag

SEQ ID NO: 48609 - DNA, 669 bp, Heterodera glycines
  SCN-specific regions: Sequence locations=1-669
acaagtttgagcaggcaaaatggcctccaaatttgtattcagtcttcgcttttcctacccaaggctcttaaccagcagtgccctcaacaacaaaaaattggtgccaaatctcattcagtctcggtcaattgtgaccaaatttgacctggaattgcctgacgattacccggagccttggccctacaaacaatggggcttcaaccaattcatgcaacatcttgacaaaacgctgaagcgttggcacatcaactcgaaactgatcgttttcgaaagcaacattggcgtgggccggtcgtcgatcgcaaaggaattggccgatgcgttgggcttttattatatgccggcctttaaaatggacgacattttggttgaccgttacaacaatgacatgcgcgactattatcatttgtttccgaaacgctttcggttcccggacatcaacatgttctacaaggacccggccgacgaccaaacggccgtcatgcaagatctgatgtacgactgccgttgggagcagtacctaaacgcacaggcacaccttttcaacacgggccaaggcgtcgttttggagcggtgcgtccacgcggactttgttttcgcaaatgcaatgcgtgccaaggattggatcagcagagaatacctcaatttttacatgtacaagcgcaagca

SEQ ID NO: 48610 - DNA, 1140 bp, Heterodera glycines
  SCN-specific regions: Sequence locations=1-187,209-651,673-886,908 -1140
tgatgacctattataatgattcgaatagcccctttctgatcactctgttgggaaggatttgtctgagtttgctgctggccaaagtgtgtcgctctctgtacaacattctctacccttatgtgatcgcaaaaccgcgcgacctgcacgaacttgcgggaggggatgccaattgggccgttgtaacgggtgccaccgatggcattggcaaagcctatgccgcggagttggccctgcgcggcttcaacctggtgctgatctcgcgctcggcccacaaattggaggcggtggccaccgagctgaagcagtattcggccaccagcggacagcggggcgaagtgcagctgcggacggtccaattcgacttcaccaacgccaacccggcggactacgaacgacacatttttggtgccatcagtgacttgaacattggcattttggtgaacaatgtcggcatgggcaacccaaatgattacccggaacgatttgacgaaatgtcgaccaaattgttgtccgacatgacgattgtcaacactttgcccgttaccgttttgtcctcttttgtcctccgacaaatggtcaaacgccgtcgcggtgctgtcataaacatttcgtccgcatcggcgtatatgaaatggtaccagtacgccgtctattcctctacaaagagcttcattgtccatttgtccgaaatcttgcgcaaggaattcgcctccgattgtccgggcattgccatccaaacggtgtgtccaatggtcgtggccaccaaactgacgcagcgttcgtcccgtgacggcctttcttcccttttggccgccagcccaacggaatttgcgcgtcaagccatccaaacggttggcctcgtgccggagacgagcggatgtttgtcccaccaaattcaggttgagctgttgttctcccttttgctcactttcgtcccaaattcgctgttcgactttttcgtccgtttggaggcgcatttgcacaaaagtgtgctgaacacggcatccaaacagcacgactaaatacataaaatggcaacatcattaacgatgccaccaatttaaaaattgagcgatcttttcaatttccaatttcaaattattaattttgcttatcccaataaattctcaatttttaaaa

SEQ ID NO: 48611 - DNA, 638 bp, Heterodera glycines
  SCN-specific regions: Sequence locations=1-95,118-403,425-448,470-638
gatcagttcaatgttagcctctgtgatcaacgaccgcttcaaccggcacagccaatacgcccctttcttttctttggaattttaccctccgctgaaagaacaccccaaaaatttggcggacttcttcgaaatgttggatcatctgaagcaggcgcagcctctgtttgtggacatcacttggtcaagacgaaatgacccgggaaatttggccaaattgaattcttcgtcggccattgccattgccaccgcggcttcattttcggcaaagaacgcacaatgctgcatatctgctgcaatgatcacacgaggactgagtcgattagtcatgtgaagcaaacattgagccatggcattgcgaatattatggcactgaggggggacgacatgccaacggagcaaacgcttctcaccaaaaacacaaaacacttcgccatcgatttggtcaaatggactcgagaattggaagagaccgacggatattttggcaatgatcggctaacgggggccgttgcgggacacatttatccgccgatgaaaaatatttcttacagacaatgcatggaacatttgagggccaaagtcaatgccggcgccgacttcgtcgtcactcaattctttttggatgccaatttgtttga

SEQ ID NO: 48612 - DNA, 595 bp, Heterodera glycines
  SCN-specific regions: Sequence locations=1-534,556-595
actgtaccggcttcacacttcgaccggtggccggccttctaagttcccgcgattttctggccgggctggcattcagggtgttccattccacccaatacattcggcattcgtccaagccccactacacacctgagcccgacatttgtcacgaactgttgggccattgtccactgtttgcggaccccgattttgcccagttttcccaagaatttggactcgcatcgcttggcgcctccgatgaaatggtggagaaattggctacgctctattggttcaccgtggagttcggcatttgcattcaaaatggggcaaaaaaggcgtacggtgcgggactgttgagctcatttggcgaattggaatatgcgctcagcggacagcccgaattggctgcgttcaacccgccggagacgtgccaaaccaaatacccgatcactagctaccaacccaaatattttgtggccgaatcgttcgcggatgccaaaaacaaactcgctacatggtcaacgagcataccaagacagttccaagtcaactacaacccatacacacaacgcatcgaaatgttggacaatgagagtgcagcaaacaagcttgt

SEQ ID NO: 48613 - DNA, 706 bp, Heterodera glycines
  misc_feature (669)..(669): n is a, c, g, or t
  SCN-specific regions: Sequence locations=1-72,110-110,142-142,168 -168,210-706
ccaagtttgagttgttgaatgcaataatcctaaaatgttccgcaaccaatacgatagcgacgttactgtgttcagcccgcagggccgtcttcaccaaattgattatgcagtcgaagcgatgagacagggcagtgcagcagtagcaattcgtagcaaagattatgctgttgtggtcgcacttatgcgtgcacaaaacgagctttcttcatatcagcagaaagttttcaaattggacgatcatctcggcttgtctatgtctgggcttatttcagatggacgcattttggcacgctttatgcaaagtgaatgcgccgagtttcgctggaactatcataatccaatttcggttgaactgctcaaccgtaaattaggcttgaaacttcagtccaatacccaatattacggacgccgcccatttggtgtgggactgctcatcattggatatgatgacaaagggcctcacgttgtgaaagccgaaccctcgggggacgtgtccgaaatgtttgctgcttcgattggcgctcggtcacaaagtgcgcgaacttatctcgaaaagaacctaccagaatttgagacggctgacagagacgcattgattcgccatgcgattcgctccctcaaagagacgctgcaggcggacgctggcagtttggatgagaataacacgtntattgcgatcatcggattggacaaccttctacctttt

SEQ ID NO: 48614 - DNA, 659 bp, Heterodera glycines
  SCN-specific regions: Sequence locations=1-58,82-473,498-659
ctcacgaacggacgtgccctggtgcaacaatggcaaaggaggaatactgtttcgatgcaaaggcggcggcagcggcggggcaatctcgtcgtccttcgacaacggcatcagtacttgtgcaaggagatggccagtcaagcagatttgtggatgcgatcatcagaaaagtcacgcagccgcctcttcaacgcttcacggatgagatcaccgacgaggaactcaaacaactctgcaaggcggccacggacgtcttccggatgcagccgacgctcgtcaggatccgcccgccggtcgtcgtcgtcggagacatccacggacaattctcggatctgcagaggatcttcacaacgcatggccccccgccggagcagcagtacatgttcttgggcgactacgtcgacagaggagcacactcgatggagacaatcatccttctcttctgctacaagatcaagtacccatcgaacttcatgctgctgcgcgggaaccacgaatgctccaacatcaacaaagcttatggcttctacgaagagatcgaccgccgttacccgcgaacgggcgctcgtcgactcttcgacctcttcaatcaagtcttcgcctggatgccattcgtcggactgatcggcgagaagatcctctgcatggacggcggcatctcc

SEQ ID NO: 48615 - DNA, 1022 bp, Heterodera glycines
  SCN-specific regions: Sequence locations=1-725,749-1022
attccggccccatcaacggtctctctgttgatgcatctgacggtttgcactttgtcacggttggccaagacgcgcagttcaaagtgtggccgttgccaattgaatttgatggaaatgctcagccaacgcagcccgtccattcgttgtcccttgacggggtccctcacggctgttcccacgtggcgatgtccagcgatttcgtcacctgtggtgagggcatttcggtgtggcggttgcacagatcttcgcccattcgccattacgctgttgggcccaacactgtgcagcatattaactgcaaccccatagaggaaggcattatggccggatgtgccgcagatcgctccatttttctgttcgacacccgccagaaagtgccgctgagccgcgtagtgctcaaactgaggacgaacagcattgcctggcatccgcttgagccgttcacttttgttgctgcaaatgaagactacaatttgtacaccttcgacatgcgcaggttggactccgctcgccacgtccaccaagggcacacctccgctgtgatggacgtcgactttgcgccatctggtcacgaatttgtcagtgggagttttgacagatccttgcgcattttccctgttgaacaatggcgaagtcgggaagtgtaccacaccccgcggatgcaatatgtgctgtccgtcttgtggtcttccgacaacaaatttgtgttgtccggcagtgatgacatgaacattcgcctgtggaaggcaaacgcagccgaaaaacttggcccgctctgtccacgcgagaaagcggcgatcgaatacagccagaaattgcgcgacactttccaaggccatccggaagtgcggcgtatcgtcaaacatcggcatgtgccgaaagctatttacagtgccacgcgggagcacagaatcatacgtgaatcacagagaagaaaggacaaaaacaggcggaagaacacgaaaagtgccgcaacagaaccatttacgtcggagagggcgaaagccattgtcagcgaaggg

SEQ ID NO: 48616 - DNA, 625 bp, Heterodera glycines
  SCN-specific regions: Sequence locations=1-625
gtccatttaagatttgtttttctgtttaatttctcgaaatgcatgcaattcgcacaatttcccgcacattttccaggtcgaccaccgcgccagtgggcattccattcgtggtggacaatgacgggaaaacagaacgcgtctacgacatttattcgcggctgctcaaagatcgcatcgtttgcgtcatgaacccgattgatgacttttttgctgcctctgtgatcgctcagctgctttttctgcaaagcgaaagtggcaaaacggcgattaacatgtacatcaactgtccaggtggcagtgtgacggctggcctcggcatttacgacacaatgcagcacatttcggcccctgtcgccacttggtgcattggccaggcgagttcaatgggcagtcttttgttgacggccggtgccaagggaatgcgcacttcgctgcccaatgctcgcattatggtccatcagccgagcggtggcgcttacggcacggcggcggacattgtgatcagagcggaggagatcaaccgaatgcgaaaacggctcaacgaaatctatgccatgcacacgggccaaacggtggaaactattgaccaggcattggacagggatcgtttcatgagcgcactgga

SEQ ID NO: 48617 - DNA, 638 bp, Heterodera glycines
  SCN-specific regions: Sequence locations=1-638
cacaaacaagcgcattgtttggattgacggaggaatgcatgccagagagtgggcttcaattcacacggcactttggttcatcgatcagctgatctcactgtatggagtggacccgcaagtcacagcttacatggacacgttgaacttttacgttttgccgttggccaacccggacggatttgaatactcgcgctctgacgtcaacccgcagacgcgcttttggcgcaagaaccgaggccagcaagtgtgcaagaaggaccgctggagacgggaacgatgctgcggcggggtggacctcaataggaacttcgacttccactggggagagactggctccagttctgacatgtgctccgacatttaccaaggtgcctacgccttcagtgagcccgagtcgcgcgcaattcgcgacaaaatgatgtcatcggaattgtacggcaaagttgacgcgttcctcacactgcacacatactcacagatgtggatccatccctacaaccatgaacgcaaatcattcccaaatgacattgaagatttgcaagaagttggccgacgtggcgtccgtgcgcttgaacaattgtacggtactcgctaccgttttggtaccggcgccgacatactgtacccgtccgccggag

SEQ ID NO: 48618 - DNA, 654 bp, Heterodera glycines
  SCN-specific regions: Sequence locations=1-654
cagatcatggcgcaagagccgcccttacaaattgtgattcccagattggatgatgataaaccgttggtgcgtcgaccgacgcctcaggcacaaccggcggctccagcggtgccggctgaactacgcgtgtccaatcgggaggaggacgcgcagaacatcgaaccgtcaatgagtggcaaacaaatagtcgggttgatcattccaccgcccgacattcgaacaattgtggacaaaacggcgcttttcgtggctcgcaacggattggaatttgagatgaaaatcaaagagcgcgaggcttccaacatgcgtttcaactttctcaaccctaccgacccatactttgcctactatcgcaacaaggtcaatgaatttgagacgggcgttgcatcggcggacactcagtccaaagtgaagttgccggaggctgtccgtgagcatgtgcagcgggccgaatttattccgcggctgccgcccaaaccgttcgaattctgtgccgatcctttgacgctaaacgcattcgatttggatctcatccatttgaccgctttgtttgtggcgcggaacggccgtcaatttctcactcagctgatgaaccgggaggtgcgaaacttccagtttgaattcctaaagcctcaacactccaccttccaatac

SEQ ID NO: 48619 - DNA, 1204 bp, Heterodera glycines
  SCN-specific regions: Sequence locations=1-47,70-1204
ccaagcgcacaacgacaatgaacacggcgacaaattgggagtcccctccccgcagcgtctcttctctcccaacacttcgttccacacggaactgcccgcggacggccccggcggcactcagtccaacgcggcgagtgaagcaggcggtgtcgctgccagtgaccaaaaccagcgacactttcacatgcgcatcaaaaaacgcattttccgcggagaattgatgagccgagaagttcgcgccagtggggtgctcgccattggcaaactgtgccttttggacgaacagttggccaagaagtgcatccccgtgtttgtgcgacaattgcgagaaaacccggaccattttgtgcgcaacaatatcgtcgttgtcatctgcgacctttgtattcgttacacttccgaagtcgaccggtacagcaccattctcgcctcgtgcctttgggacagttccattctcatacgccgccaaacgttgctgctgctcaccaatctgatcaaagaacagtacctcaaatgggaagggacggtcatttaccgttttgtgaccactcttttggacccggagcagtgcattgaagaatatgccaatttttgtttgacggacattttgttgccccaatttcgtgagcggatgttcttccatcactttttggaatgcatgttcaatttcaacggagttcggcatgtctcttggatccccagcgctggctatgaactgagtgaagaggtacaaaagcgttgttccctcgaaggtcgcgaattgttcgactcgcgaatgcgcctttacaaatatatgctgaacactttcgaagaccaacaaaaggtgtacattttggagaagatcggtttggagatatttgtgccgatcgttgagggtcgactgaaactttcggatgtgaaagtgcgcaatttgttatttgatgcttttaagattatgggcactgaagagataaagttgaaaatgcaattgggcaaaatggacgcggattacgagggggacgacgacgaaccgcccgaattggttaagactgctgctaaaaaattcatcgcgacgacatttcgcaaaagcattgcggagacggtgatgccccacttattcctgctgaagtcctttctatgcgagaagcgaagtccgttggccaaaaattgttattcggtcattttggatttctgtcgggagcacgaggagcagttggacgccttt

SEQ ID NO: 48620 - DNA, 769 bp, Heterodera glycines
  SCN-specific regions: Sequence locations=1-769
ccaagtttgagctttaaaatgagtttggagaattttggcaatggtttcatgcgacggttgggatggaagcaaggggatgaggacgagggatggtccaaaaaggcggttgacagtttgctgaaaaagttgcaaaagcagcacaacaaagagggtttaactctgttggaaaatgctttgcgtacggagggcaaagagccgagcgaatgcgtcaccattccgcgctcattggacgggcgtctgcaaatttcacatcgaaaagcacttccgcacgtcatttactgccgcgtctaccgatggcccgatttgcaatcgcatcacgaacttaaagcgtcccaatgctgccgtttttgtttcgaatccggtcaaaaagatgtgtgcatcaatccttatcattacgaacgcgtggacagctccaacttgttgccgcctgttcttgtgccccgcttcagcgattcgccaccgaaacgtcagccgggcggcgaacatcgcgttcttctcggccacgaccctattccgtttgtgccatgccagcactgggccaccattagctattacgaattgaacacccgggttggtgaacaggcaaaagtcagtgcaattgaatgtgtggttggtttttaatgctttttcccaaattcttttgactttcggtcgatgggttcacagatccgagcagcggagaaacgaacgaccagcacaaaatttcactcggtttattttcaaatgttaatagaaattctacggtggaaaacacgcggagggaaattgg

SEQ ID NO: 48621 - DNA, 659 bp, Heterodera glycines
  SCN-specific regions: Sequence locations=1-36,58-179,209-322,344 -418,454-490,535-635,658-659
caagtttgagacaatgcaacacatcagtcgaacaagcaaacatttcttgaacaaattttcacccaacactttttggcagccttctcgaaatgcctacaaatatgttggcgaaactgccgcttcggacggcactttgcaaggcgataccagtgctgcaatggcgagcgcgctttttcacgaaatgatcaaaggtgctgctaccattgtgggccacactttcatggagccggtcaccattaactacccgttcgagaagggtccgctgagcgcgcgttttcggggtgaacacgccctgcggcgctacccgtccggcgaggagcggtgcattgcgtgcaaactgtgcgaggcgatttgtccggcccaggcaattaccattgaaacggagacacggccggacggcagtcgtcgaacaacgcgttacgacatcgacatgaccaagtgcatttactgcggactttgccaggaagcgtgccccgtggacgcaattgttgagggccctaattttgagtactccaccgagacgcacgaagagcttctatacaacaaggaaaagctgctgtccaacggggaccgatgggagcctgaattggccgcaaatcttcagtccgaatttctgtatcgataaacacacaaaaattttcgggaaaaattttcaacat

SEQ ID NO: 48622 - DNA, 960 bp, Heterodera glycines
  SCN-specific regions: Sequence locations=1-225,252-344,370-657,687-934
ctgggctttgacggaattgaccgggaccgagctgccccgtaaaagcccccaggctcgtccgctcaatattaaaaactgcgtttgctcttgcctctggtgctagaaacgaaataaattccaagacggaagagattgtttttcattcattaataattgggagcaacacacacccgaaaaaaaaatacacaaatcaaaaattagcatttgccatttataccgagcgaaatgggtgcctacaaatacatgcaggaattgtggcgcaagaagcagtcggaggtgatgcgctatttgctgcgcatccgctgctggcaatatcgccaaatggaggccatccaccgctgcacgcggcccacgcgtccggagaaggcgcgccgcttgggctacaaggcgaagcaaggctttctcatttaccgcgtgcgcattcgccgcgggggtcgaaagcgtcaagtgaccaaagggcaaacgtacggaaagccgaaaacgcatggcgtcaaccagctgaagaacacgcgcagtttgcaggccgttgcggaggcccgtgccggccgccgtttgggcgaacttcgtgtgctcaattcgtactgggtgggccaggactcgacctacaaattcttcgaagtcattctcgtcgacccatcgcacaaaaccattcgtcgtaacccggacacccaatggatcaccaaacccgtgcagaagcatcgcgagcagcgcggactcacctcggccggccgcaaaagccgtggcctcggcaaaggaatgaagcacacgaagaccattggaggctcgcgcagaaagtgttggaaacgccaaaacaccgtcgaattccatcgcaagcgttgagcaattcattcatttattatggtccattggacagaacggagattctgctgttacttttttctttttttgttgataaataaagcaaaaaattattaaaaaaaaaaaaaaaaaaaaaaaaaa

SEQ ID NO: 48623 - DNA, 1356 bp, Heterodera glycines
  SCN-specific regions: Sequence locations=1-159,184-338,360-600,623 -1291,1313-1356
tattgttaccgaagagggtgaggatagtttgtaccctatcgctgtgcttattgatgagcttcgtaacgaagatgttcagcttcgtctcaactcaatccgtaaattgtcgacgattgctttggcattgggcgatgaacgaacgcgcaaagaattgattcaattccttacagacaccatttatgacgaggatgaagttctagtggcattggccgatcaattggggaatttcactccgttgggtggcggacctgagtatgtacactggttgctgccgccacttgaaaatttggcgaacattgaggagactgtcgtgcgtgacaaagcggtggaatcgctgcaaaaaatagcagaaaaacacagtgcagctcaactcgaggaatatttcattccgatggatctgcgattgtcagctggtgattggtttacttcgcgcacctccgcttgcggattgttcagagtggcatacgctcgggccaatcctgctcaaaaaactgaattacgtgccgcattccggggcctctgtcgcgacgatacaccgatggttcgccgggctgccgcatacaaattgggcgactttgccaaagtgcaggaggaggactatttgaaaaatgaaatcacccaaatgtttgaggacttggccaaggacgaacaagactctgttcgactgctttcagttgaggctggcattgtgatcgttggtctgttgtccgaagactcggcaaaattggcccaagtgaaaccgatcgctgtttcgttggtgcaggacaaatcctggcgtgttcgttatatggcagctgataaaattgttcaaattcagcaagcattccgtaccaaaattggcattgaagaaattgtcggatggtacaccggacttttgaaggactgcgagggcgaagtacgcgatgcagcggcagagaaactacaatcattctgtgctgctctgtcggaggaaggccgaaaaaagggaatcattgaagaaattttgccagtgattcgaccactaacaactgacgcgaatcagcatgtcaaaattgcgttggctcaggttgtgatgggattggcgcctctgctcggcaaccaatgcaccattgagcatttgttgcctatttttttgtcaatgcttcgtgatgatacacccgaagttcgcttgaacatcatttcttcattggaaaaggtcagcgatgttattggtgcagatgagctccaatactcacttttgcccgccatcatcgacttagcacaagatggaaagtggcgagttcgcttggccatcgtggaatacatgccgttgcttgccaaacaacttggccagaaattttttgacgagaaattgcttaaactgtgcatgaattggtt

SEQ ID NO: 48624 - DNA, 584 bp, Heterodera glycines
  SCN-specific regions: Sequence locations=1-48,70-91,113-584
tgagcgcggcgtggccaaccgatggcgctcactgttcatcatcatcggggacaaggccaaggatcaggcggtcactttgcatcacattttggccaaggccaccaccggggggcgtccgtcggtgttatggtgctacaagaaggagacggagttcagctcgcacagaaagaaacgcatcaaagagttgaagaagcgcaaagagtcgggcctgttccagtcaaaggaggacaacctgttcgagcagttcatcctgtccactcaaattagctactgttactatgccgactcgcatcgcattctgggcaacacctttggcatggctgtgctgcaagactttgaggcacttacgcccaaccttttggcccgaactgtcgaaacggtggagggcggtggcctcgtcgtgctgctcatccaatcaggcacctcactgaaacacgtgttcaccatgaacatggacgtgcacaaacgctaccggacggaggcgcacgcggacgttgtcgggcggttcaacgaacgcttcatcctttcgttggccagctgtgccaactgtgtggtgatggacgactgtctgaacgtgttgccca

SEQ ID NO: 48625 - DNA, 632 bp, Heterodera glycines
  SCN-specific regions: Sequence locations=1-265,291-632
gtatgtatcagtttctttaaaatttgagaattaataattttgtgttcaaatgtccaacgacaacgacaaaagagatgcatcatcaattccaacgaatgcccttgttaacaaagaagagtctccggacggaaatgaagagaagaaaattttctgcggtgggataagctacgaaacatcgaatgaagatttggctgtttatttcgggcaatatggcaaagtgaaggaagtacaagtgaaatatgatcgagtgactggacgttcgcgcggtttcgcctttgtggagtttgatacggttgcagcatgtcaggcatcgctcgtacaacgtgaacaagtgataaaaggcaagcagtgtgagataaagccggccaaatcgagggaagttggctacatgaacaagaaggtatttgtcggtggattgcctggagatttcccagaagaagaacttcgaaagcacttcaaccagtacggcaaggtggaggagatcgagtggccgtttgacaaactttccaaaacgcgcaagaactttgcatttgtcgtgtttgaagatgaggagtcggcggaccgtgcaactgcattgcccaaacaaaattttgcgtctcgggagtgtgacgtcaagaaaggcgggccccaaa

SEQ ID NO: 48626 - DNA, 651 bp, Heterodera glycines
  SCN-specific regions: Sequence locations=1-43,65-435,457-514,536-651
gagatttgttacaaacgcttggaacttgcagtgagaacaacaattgcaacaatttttggccttgagccaacacaccatcagttattctgttcaacacttagtacgaccaaagaagacccctttcaattgcatgtgaacatggccgagaaaaggaagcttctgaacgaaattgataaatgttataaaaagatcgacgaaggctttgaaattttcgatgacatcatggagaaaatgaacgaagcaaacagcgacaatcaacgagagaaattccaggacgacctgaaaaaggagataaagaagctccaaaggttaagggatcagatcaaaggatggcaaaactcttcggagatcaaggacaaggactctctgtcaaagtttcgaaaactgattgaacaaaggatggaaatattcaaggacgtggagagagaaaataagacgaagccgcacagcaaacagggactgtcagcggaggacaagttggacccgagggagaaggaaaagtgcgagaccattgaatggctgaattgccaaattcggagaatacaggacgaaattgacaggacggagtctaaactggaaacaatgtcatccatggccgactcaaataggaaacggggcaagaaagacgaagccgaaaagaatgagaaagag

SEQ ID NO: 48627 - DNA, 1032 bp, Heterodera glycines
  SCN-specific regions: Sequence locations=1-69,92-110,150-227,257 -382,417-863,885-932,954-1032
cactcatattattgcaagttttgtgaaaatgtcgcaatgaggatgaatatgactatctttttaaagtggttctgatcggcgactcgggcgttggcaaatccaatttgttgtcccgtttcacacgcaatgagttcaacttggagagcaagtcctccgctggtgtcgaattatttttcgaattctcaccttccattaaggtggacggcaaaacaatgaaggcacaaatttgggacacggcgggccaggagcggcaccagcccattgtgtcggcattctatcggcgtgccgtcggcgcactgctcgtctacgacatttccgtgcggctgacatatgaaaatgtggggcgatggctcaaagaactccgtgaccactccgacccgaacattgtgatcatgttggtgggcaacaaaagtgatttaggcaatctccgagcagtgccgaccgacgaggccaatgcgtacgcggagcgcaaccaaatggcattcattgagacgagcgcgttggacggcacaaatgtgggcgcggcgttcaccaacattttgaccacaatttgtcgttcacagtcaacaactgcgggcagcacaccgaaaattgacattaatgatgatctgattgacgaggacgcattgctcgagcccgaggacttacagcgccctgaacaatctgccgcttgcggtgtgccatcggatggcgatgagcagtcaaaaaagcgtcgggcatgcaaaaattgcacctgcgggttggccgagcaaatgcaaactgcggcggacgccaatggcgacactaacaacaaaatggaggcgaaatcggcgtgtggaaattgttatttgggcgatgccttccgctgctccacgtgcccccatttgggaaagccgcccttcaaagcgggcgaggacggaacgattaaattggcgtcggttgatgacttttaaacagtgtctttatgtgtctgtctgtctgtggtctttttttggtgtgttattccgtttgatgtccaacaataaataagcaataaaaatattccattttaaa

SEQ ID NO: 48628 - DNA, 647 bp, Heterodera glycines
  SCN-specific regions: Sequence locations=1-20,42-647
ggagaattcactgctttggacaagaaagtgataaacgccttattcttgacttggatgaccaacaagcggggccttcggagcaaaaagtcggcaggagagggcctggacggaagtcagcgaatccgacattggacaatcttctgggccatgcaaacttagaacatgcccgtgggcggacaaaggaggccatgacttttcttttcgaagtagtcaagctggccccttaccatgtgcagacatacaaagaactttcggatttgtactcggaattgggccaaaaagagaagagctttgaattcaaaatgttggctgctcttttaaactctaagacaacagccgaagaatgggatgaaatagccgggactgctaagtcgtttaaccggttggaattggctgtcgcatgtttggccaaagcgattcgatgtgaccccgagaattggctttactacgaaaaacgcatccaaattcttgatgcatccggtgaaacggatcttgcaatgaagacacgactccaagctgcccaatcgatcaattgtcaaacttccaaaatcaacttcgcatggatcgataaattgataaaaacggcagccgattattattgcacgctgaaagacgaagaacgggcgaccgaagcattggaaacgttc

SEQ ID NO: 48629 - DNA, 747 bp, Heterodera glycines
  SCN-specific regions: Sequence locations=1-6,29-99,126-359,381-747
gactattcattagaacaaatggatggattgactgagccaatgctttcgacacggccaagcccttcgattggagccgagggaaaagagcgttttgcgcgtgaaaatcacagtgaaattgaacggcgaagacggaacaaaatgacacattacatcaacgaacttgcggacatggtgccgcagtgcgctgcacttggtcgtaaacctgacaaactgaccattctgcgtatggccgtttcacatatgaaagtgattcgtggggccaatgcgcaaagcaacaatttgtctggcacaatgccaagccaaccgtctttcctcacggatcaggaacttaaacatttgattcttgaggcggccaatggctttttgtttgtggtttcctgcgaaagtgcgagggttgtctttgtgtccgattcgattgggcccattttgaatgtttcgccggaacaatggttgaactctccctcgttttacgatgtcattcatccgcaagacgtggaaaaagtccgcgggcatctcctcggtaccgatttcagccacaacagtcgcgtgctcgacctgaagacgggcaccgtcaagagggagcacagctctgcccgcgtgcatttgaactgtcgcaggggattcatttgtcgaatgcgaataggtgacgtcaattgtttgccacgtctgcgcaatcgccatccaatttttgagtctgaagggcgctctttcatccccgtccattgcacgggttatgtgaagaaaacg

SEQ ID NO: 48630 - DNA, 646 bp, Heterodera glycines
  SCN-specific regions: Sequence locations=1-595,641-646
attacgctgaacaaccctttttaatcgaaagctttgacttgacatgactgatgcgaaaactgaccaaaaagataatgtgaagagtgaagttggagatgtgcccaatggcgggacgtcattcactgcacagcttagcgacgatttcactatccaatcgaatacgaatgaggtggtcgattcattcgacaacatgcaactcaaggacacattgctgcgtggcatttactcattcggttttgagaaaccatccgcaattcaacaacgtgcaattgttccatgttgttcagggcgtgatgtgatcgcgcaagcccaatctggaaccggaaaaacggcaactttctctatttccgttcttcaacgtgtcgatgagaatgcaccggatgttcaggcacttgtgatggcaccaactcgagagttggcccaacagattcttcttgttatgcgtgcacttggcgagtatatgggggtcaagtttcacacttgcatcggcgggacgagtgtgcgcgacgaccagcgcaaattggaggggagcgttcaagtgatcgttggaacaccgggacgagtcaatgacatgatcccgcccggagcactcaagaatgacaaaataaaaatggttgtgcttgacgaggctgatgaaatgttgtct

SEQ ID NO: 48631 - DNA, 1029 bp, Heterodera glycines
  SCN-specific regions: Sequence locations=1-838,860-1029
aatgtcatccataagtttgtccgtgacaaatacgaaaaacggttccccgaattggagtctctcgtgccgatgccattggattacattaacacggtgaaactgctcgccaatgacattgacacgaactcgcgaaaggaaatcatccatcaaattctgccggctgcaacttgcattgttgtcagtgttaccgcctccacttcccagggaaagccattggagcaaaatgagctggatgttatcatcgaagcttgttcaatggctgaggaactgtatgatttgcgcatgaaaatgcatcttttcgtcgaattgcgaatggctctcatcgccccaaatctctgccgaattgtcggtgccggcaccgctgccatgctaatttctcaggcgggcggactcgtaccgttggctaaaatgccggcgtgtaatgtgctaatccttggaaaacagaagaggactttggccggcttcagctcctccgtgatccttcccaacaccggcttcatttaccaccacccaatcgtccaaactctgccgcccgaccttcgcagaaaagcggcgcgattggtcgctgcaaaatgcacattggcttcccgagtggattcaattcattcttcgttggacggacgaattggggagcgattgtcggtagaaatcaaagggaaattggaaaaaatgcaagagccaccgccggtcaaaaatgccaagcccctaccaaaaccacttgacaaagccagcaaaaaaaggggtgggaaaagagtgcggaagcagaaggaactgctaaaggcgaccgaactcagaaggaaagcgaaccgaatgaatttcggagagttgcaagaagatgtgatgcaggaccatttgggcttcactttgggacaagcgaacagtcactcacttccctcgggtggaagactgagggcgtcacaagtggacaacaaaacacgagtaaaggtgtcacaaaaattacagcggacaattgaaaagacgcgccaacacggcggaatcacttcgctggccgcgaagagtcacgggtcg

SEQ ID NO: 48632 - DNA, 908 bp, Heterodera glycines
  SCN-specific regions: Sequence locations=1-401,426-908
aaaccatcggaacatcgccaatttgcattttcaataaaaatctgtcgtcgacaatgagtgcttatcaaacaattgaaaagggttctcttcatacccttaactatcgcgtattttttaaaaattcggatggaaaattgatttctccttggcatgacattcctctctatgcgtccgagtcaaacaaattgttcaacatggttgtcgagattccgcggtggactaacgctaaaatggagattgccactaaggaagtgatgtctccaattcgtcaagacgagaaaaagggtcttccccgcttcgtcaacaatattttcccgcaccgcggatacatttggaattacggagcgcttcctcaaacgtgggaagacccaggacataaggacgagaacactggcgaaaacggagacaatgatccaattgatgtgattgagattggaagcaaagtgcagaagaggggcgccgtcattcgggtcaaagttttgggagttttggcacttttggacgaaggcgaaacggattggaagttggtagcaatcgacgaaaatgatgagttggctccgaagttgaacggaattgaggatattgaaaagcatttgcctggactgctaagtgccactcacgaatggttccgcatttaaaaaattccaacgggaaaacccgctaacaaattcgccttcaatggccaattcaaagaccggaacttcgcccacaaaataatcgaacaaacgcatcaattttggaaaaagcttgtcacttccgctagtccgcatccattgaacactgactgtcacaaggaagaggctgttttcaaagcgaatctttcggattgggaaagctttatatcgaaacagccaaagtttggtcatgcccagcaggtgccggaacatgtcgacaaatggcactttatt

SEQ ID NO: 48633 - DNA, 1090 bp, Heterodera glycines
  SCN-specific regions: Sequence locations=1-85,107-997,1020-1055,1078 -1090
gaaatgccggccttccgcctcattctttcgccttttccgtccgtttttgctcgtctctcccattcccatgtcccattgttccgccaatgttctgctgctgcttcgtccaattcgccatctgtcaattttctcagctccaattttgcccttccggctgagtgggacggtcggctcggccatttgagcgtggagcaactcggcggtgacaatttcgaatggatcgtcgcggttcagaaaaagttcaccggggttggtaaggctagtgcgatcgacttggacttggcctgctccgtccccgttggctccgatcacttggccgatttggtcgacctttgctacaaatttcgacatacagactctgcgggagatttgctcccttccactgaatacactctgtgccgtcttttactggaattcggcgaatttggcgttttcatgaatttgcttaatgacccgatcaactacggcatctttcccaatgagcacatttgctgcatgttcctcgaccattttctcggctccgctcagttgcaatatgcggccaaaattgccatttatgtgatgctgcaggaaatgttcgacttccctttgctcacttttctcgccactcgcgcccttctcgagtggacgcaaggggaacgaaaactcgatgagcaaatccatccgaaaatggcaccttctctggaggacgagactaacttcaatgaggagaacgtgcgcctttttcgctacccttttctgaagaaccctttttgggatggacacttcgatgagaatgactccgaccgaatggcaggcaaagccctcgaatggctttcataccatttgaaattggcaaaaaatgacgaaacgaattacgacgagacactgatcagagtgatcagacttttggggttgagcatacagcggaaatggacggaagcgaagtcattggcggaagagatgtttatcacagttgctccatcggacaatgcgcggcaaatgatttattcctccatggaacaaatgcagcaatttttgaattttgacgaacagattgaagcggcggagaagcaaacggaaagagaaaaagacgaccaaaattcggagg

SEQ ID NO: 48634 - DNA, 630 bp, Heterodera glycines
  SCN-specific regions: Sequence locations=1-12,46-630
gttcggtgtatcaaagatcagaatgggaatcatgttgtgcaaaagataatcgagcgtgttcagccgcaccagctgcagtttatcatcgacacgatggtcaacggttttacggactcggtcacttccctctccgtccatccgtacggctgtcgtgtcatccaacgtgtgcttgaacactgcacggagggacaaaaacggcctgtgctggaacaactgcatgagaatgtgctcactttggtcaccgatcagtacggcaattacgtgatccaacacgtgattgagcacggactgtttgacgatcgggagcgcattgtgcgcgctttgcatggagacatcctgaaatatgcacagcacaaattcgcctccaatgtcatcgaaaagtgtctcatttgcgggacgacagaccaaaagaatgcgctgatcgacgaagtttgtgcggacaacggttcttccaacccacccctcttggagatgatgaaggaccctttcgccaattacgtcgtgcaaaaaatgctggacgtcgcggactcgacccatcgcaagaagatgatgtttgccatcaaaggacacattccggcactgcgccgtttcaactacgggaagcacattatcacgaagttggagaagtac

SEQ ID NO: 48635 - DNA, 609 bp, Heterodera glycines
  SCN-specific regions: Sequence locations=1-191,213-609
ctattggtcttttgttagagcaaccggtgaaaaaacgcaaaattgaagttggggaaagcgatggcaatgagcagcggagtgttgcggtccgtctcttctcggaggacggaaaagagatcggccaggcacccgtcgttcttcttgcttccaccactgctgaacagctccaagtgctttaccaccaattgttgcgcagtgaaaaacagcaaaacggcgaatgcggcgacgacggagactttgacgaagggacggcgcccgtccaatttcggaccgtcgcagacgaaaaaagtggcggaaaagggacggaaattgtcgattctttgctcgactcactgccctcagaacgcctcttcttggaaaagcccctcgagttggtctgtctgccacaggccgtgttccgagttcggcccgtcactcggtgcaccgcttcgttgcccggccatggcgaacccgtcctttccgtacagttcagtcccgacggaagctgtttggccagtggttctggtgaccggacagtgcgtttgtgggatttgcacacgaatctgcccaaacagacgttgaccggtcacaacgattgggtgctgtgcatcggctggtcgccggacggtc

SEQ ID NO: 48636 - DNA, 658 bp, Heterodera glycines
  SCN-specific regions: Sequence locations=1-140,162-311,340-546,568-658
ggaaggtcaggcattcgcctgtccaacgcttcacggatgagatcaccgacgaggagctcaaacaactctgcatggcggccacggacatcttcagaatgcagccgacgctcgtcaggattcagccgccggtcgtcgtcgtgggcgacatccatggacaattcacggacctgcagaggatcttccacacgcacggcaaccctccagagcagcagtacgtcttcctgggcgactacgccgaccgaggcccccagtcactggaaacaattgttcttctcttctgctacaaggtcaaatacccagcgaacttcatgctgctgcgcgggaaccacgagtgcgccaacatcaacagagtgtatggcttcttcgatgaggtcaaccgccgctaccagcgtccgggtccccgccgcctctacgacctcttcaatcagacgttcgcctggatgccctacgtcggcctgatcggcgacaaaatcctgtgtatgcacggcgggcctctccgaccagatcaacagcctggagcaactcagccagctgaatcctcccgcaaatacaaccccccggcttcggacgctggagaaacggatccttttgtggggagaaaccctgccgaacaggaaatatcgatggcaggcatacccccgaacaaccatggagaaag

SEQ ID NO: 48637 - DNA, 677 bp, Heterodera glycines
  SCN-specific regions: Sequence locations=1-520,542-677
ccaagtttgagcataattcagtgatgatgtacagcctggggtctttctatggtgctcctcccattgcttacaatcctacaccgctcgccgccgccactcctggcgttggtccaatgcgtccgccagttccaatgagtgtccatggagcatcgcctcaacagatctatcagttcaagccaccgacttttgacccgtacctttgcgatcagtttttcccacgaagcagcacagaggctgaggaaacagctcagacacagttcttattggccaaacacaatgacattctgccttctacggtggaacaatctgctatttcggcattggttggaaaagtgaagcagactttggacaaaatcattgttgctccggaaacatttaactctgtggccattgaggaagtgcgcgaggtcggctcttacaaaaaggggacaatgttggccaagcacaatgtggccgatttggtcattgtgctgaagactttgcctctaatcgaagcggttaatgcacttggccagaaaatagtgcttgatctcaaggcagaaaaccatgccgatatttttggttgtgtaatccgagaatttggctgtgaaattgctggcactcacgcggtggttcgagttctcattaccattttgccacaacttgcgactcaattggacaaagacttgcatttgccc

SEQ ID NO: 48638 - DNA, 477 bp, Heterodera glycines
  SCN-specific regions: Sequence locations=1-93,115-253,276-293,371 -421,443-477
ttactcaatttaaaagcaaaaacaaatcataatgaaatacgtcgctgcttacatgttggcatcgctgggcggaaatggcgacccatcgcccaaggatttggaaaaaattcttgccgccggcggacttgaggtggacatggacaatgtgaacgccgtcatcaacgcagtgaaaggcaagtccattgacgaggttattacggcgggccaaaagaaattggccaccatgccaaccggtggaggcgctgcggcaccggcagcagctgcagcaacgggcgctgctgcgccggccgggaaggaggagaaggaggaaaagaaaaaggaggaagtgaaggaggagtcggacgacgacatgggcttcggactgttcgactgatcaacggacggacggaatgccaaagtggattgtgccgtcggaaaattctttctgttttttcttgttatcccctgtcaaaaaatcataaaattgtttttgttgaa

SEQ ID NO: 48639 - DNA, 944 bp, Heterodera glycines
  SCN-specific regions: Sequence locations=1-16,47-103,139-208,246 -253,285-285,309-338,387-387,465-465,515-521,599-837,866-923
gacaaatggttgccgccaatctgaagctttccctgatttttgtggccggcttttgcctgctgttcatcgccgactccgatgccgggaagtcgtgcaaaccgggagaaaagggaccgccaggccctccggggaagccgggaaacaaggggaagcccggcgtgtgcaagcccaaatatgaaacaacttccaagtacggtacgactacttccaagtacgacaccaccacttccaagtacggtacaacaacacccgaatacgatacgacaacatccaaatacgatacaacgacttccaaatacgacacaacaacttccgactacggtacgacaacttccaaatacgatacaaccacttccaagtacgacacgacaacttcaaagtacggtacgactactcaaaagtaccgtggcaaacgctttgcggatgccgtgctcgttcgggctgctcgcgctgagtacgacgccgattgcccggccggtcccccgggagatgccggcattgccggaccgcccggcccccccggcgagccgggcaaatgctatggcagcgggtccaaagagtccaaagaaaaggagtacaaacccagcaagcgcagcattgacaacttcgagcatggcttgcgcgtcgccaggggctacaagcaagaagtcggaccccctggccccgcgggaccgcccggccctcccggaccggacggaccgcccggagaatgcgaatgcaaatactgaggatgatgctgaagatggtccacgatgtgagctcaaccgttttgttcctttgcctgattatccatcgatgtgtgaaactgtagcattagtagtactgtattgtcgatggaataaaaattttattaaagaatatttttcaatgttttttttgcgaaattaatgttaagtctcgaagcgtaaataaagcaaaagctcaaaaaaaaaaaaaaaaaaaaa

SEQ ID NO: 48640 - DNA, 831 bp, Heterodera glycines
  SCN-specific regions: Sequence locations=1-88,110-831
gtccaattaagatcaaaggaaatggtcagttttccgccttctcttatgccgtctttccaatgtttttgtgcttcctcttcccgtctcttttgctcatctgcttttgttcgacccgtccgcgtgcgcttcgccccttcccccacgggggaacttcatttgggctccgttcgcactgctttgttcaattttctgtgggcacgtaaatacaacgggaaatttgtgttgcgaatcgaagacaccgacagagagcgattggtggagggatcggagcaaaggattgagcagaccctctcccactttggacttacacccgacgaaagtccgttgcgtggtggccaatttggttcctattaccaatccgaacggttgcctctttaccgggaattggctgatcagttggttgacatcggccattcgtacaagtgcttctgcagtcaagaacgactcgactttttgcgtcgaaaagcgaactccgaacgcattccgttccgttacgatggcatttgtcgccagctttcgacagaagaaacgcgagctcgggaacgaaacgaggaacaatttgttgttcggttcaaatttgacgggagaagggccggatttacggacatcgtattcggcgattatgaacattattcggaggagggcgattttgtgatcctcaaaagggatggatttcccacttatcactttgccaatgtcgtggacgaccgacggatgaaaatcagccatgtaataagaggagcggaatggatatgttcaacaacaaaacacttgcaaatttacagtgccttcggttggtctccgccacactttgcccatttgcctctgatc

SEQ ID NO: 48641 - DNA, 656 bp, Heterodera glycines
  SCN-specific regions: Sequence locations=1-656
cgcattggaaatgatcgaggaccttagaggagctttccaacaaatgcttgtggccaacgattggatggactcggacacgcgcgaatttgcgatggaaaaggcacagcaaatgatcaatttgatcggctttcccgactttctgttcaatgacacgcaattggacgattattacaaaaatttggtgctccacccaaatgaccattacgccgaaatggtggagaaagtgtcggcgtgggcacacaaaaagctattccgacggctaattgaggaggtggaccggtccgaattcggcacttccagcacagtggtcaatgccttttattcgggcgtcaaaatatgcgatcacgtttcccgctgccatccttcaggcgccgttcttcgaccaagccttcccaaaagcagtgaattacggtgggattggagcagtgattggccatgagatcacccacggcttcgatgaccaaggcgcacaattccacggcattggcaacctcaaagattggtgcgaccccaacacgcagcagcactttgtggagcgaaagcggagcatcatcgaccaatattcttcctttgaagtgcccgacataaatttgcacgtcaatggcattttgacgcaaggacgaaaaattgcggacaatgggggccataagcaagct

SEQ ID NO: 48642 - DNA, 801 bp, Heterodera glycines
  SCN-specific regions: Sequence locations=1-300,324-570,592-801
gtgaaaacggcgtttgcggatgtggcggggtgtgaagaggcgaaaatcgaaatcatggaatttgtcaactttctgaagaaccccgcacaatacaaagcactgggcgcaaaaattcccaagggtgctcttctgactggccctccgggcactggtaaaactcttctcgccaaagcaactgctggcgaagcaaatgtgccatttatcactgtgtccggttccgagtttttggagatgttcgtcggtgttgggcctagccgagttcgggacatgtttgaaatggcgcggaaaaaggcaccatgcattctgttcattgacgaaattgacgctgttggacggaaacggggcggaaagggcgccatgggaggccactccgagcaggagaacacactgaatcaattgctggtcgaaatggacgggttttcaactgatgaatcgaacgttgtggtcatcgctgccacaaaccgcgtggacattctcgaccccgcgttgatgcgtccgggccgatttgatcgacaaatattcatccccgttcccgacatcaaaggccgtgcttccatcttccgcgttcatttgacaccaatcaaaacaaccttggacaaaatcgagctttcccgcaaacttgctgcgcacacgcccggattttccggcgcagacattgccaatgtttgcaatgaatcggcactaattgcggcccgagatgcacacgatgaggtgacttccaaggactttgagaatgccatcgagcgggtcatcgccgggatggagaagaaaagtcaggtcctgcagccggacgagaagaaa

SEQ ID NO: 48643 - DNA, 914 bp, Heterodera glycines
  misc_feature (820)..(820): n is a, c, g, or t
  SCN-specific regions: Sequence locations=1-399,432-450,480-598,621-914
aaaactatggccacaattacgctcacttcgcaacattcgcaaattgtccctgaagtaattcgtcagcaatttttggccgccgatttggaagagtccgtccgattgagggaggaggcgaaaaagggacaattcaaaactcaaattgtttggcgaaatgtgcttctctttgtgctgctccatttcggtgcccttgtcggtttgtgccaattaatttcttctgccaaatgggccaccatcggatggtgcattttcctatggttcgccgggggcgttggcattacggcgggggcccaccgcctttggtcgcacaagtcttacaaggctcgtttcccgcttcgtgttctgttggtcgttctgaactgtgtcgccttccaaaacgatgtgatcgaatggtcgcgcgaccaccgatgccaccacaaatggacggacaccgacgctgaccctcacaatatcaaccggggcttcttcttctcccacatgggctggctgttggtcaaaaagcacccgcaagtcaaagccaaagggtccacgttggatttgtccgatttgacttccgaccctttgttggcattccaacgaaaattttacctccctttggtccttctcttctgttttctgttgcccacgctaatccccgttttgttgtggaatgaatcgtcaagcgtcgccttttacaccgccgcagtgtttcgctacactttcacacttcacgcgacttggctgatcaacagtgtggcacacatttttggctaccgtccctacgacgtttcgatcagttccgccgagtccgtgtggacgactcttttggcggttggcgaangcggccacaattaccaccacacattcccccaggactatcggacaagcgaaatgcgaacactgctcaacttcaccaaggcattcatcgatttgtt

SEQ ID NO: 48644 - DNA, 1333 bp, Heterodera glycines
  SCN-specific regions: Sequence locations=1-499,521-1038,1077-1312
ctattctctgcactattacatctgatttctgctgctcaccgactccatcgacaacgacacgcgatggaagaactcgtggcgctctcccctggaatccgcgtcggccgctggacgatcacaaagaagctgggcgccggagcattcggagccgtctacctgtgcgtgaacgaccaaggagagcaggccgcgctgaagacggagccggtcaacacgccacatccgctgctcgtcatggaggctcacgtgatgaccaagctggacgcccttcgagacggagacgggaagcacttctgccgctgcttggacctcgggcgcgatgagcaaaaggaccaacaatcgggacaaatgaagaagttcaactacatcgtcatgtcactcgtcggtcgtggcctggacggagtcgtcaaggatgccggtggccgcctcagccttggaagcgcagtcggcgtctcgatccagatgctcgccgctctcagaggactccacaccgtcggctacctccaccgcgacatcaagccgggcaactcgaccatcggacgtccggaatcaaacgaaatccgcctgctctacctgatcgacttcggaatggcgcgcaaatacaccagggacgacgggagccaacaccgcccgcgcgctgtcaccaacttccgcggaagcccccgttacgctgcgatcagcgctcatctcggacgcgaatacagccgcaaggacgacatcgaatcgtggttctactgcatgatcgagctcttaaaaggcgcacttccatgggccaacgtgggggaaatgaaagcgataggcgaggcaaagatcaaacgccagaagaaacaaccggaagccgttcgacgccaggcaatcgccgacttgctctccggatgcccgaacgagttcggccaggtcctcaaatacatcgacgacatgaagtacaccgacaagcccgactacgactggatcatcgcgacattgcgcagcagcctcagcaacgccggcgtccaggaattcccctacgactgggagacgggcaagcgcaacgcggcaccgggcgctggaggcggcggaggaggagggggaggagacagctacttcaactgatgagccgtgcagcagcagcagcagcagaagaatcgccaagaagcgtcaccgtgctgaattgatcatatgaccactattactgtattgtatgtattattttgtgtccatgctgccatccccgatatacacatgtattgtattgttgacatatgtattgattgaaattgttgttgcataactgtgtttgtacatatgacttttggcgaaataaaggacattttgtaaaaaaaaaaaaaaaaaaaaa

SEQ ID NO: 48645 - DNA, 1191 bp, Heterodera glycines
  SCN-specific regions: Sequence locations=1-442,465-1088,1114-1170
gtccaattaagcttttccttcgcttttctcctccgtcccaccaaaatggcctccggtcattacgaagtttggcactcgcaaagcgtcggctttcccattttctatttgccctatgaatacgacgacaagtgggcgttggagaagcgcgtgtggaacccggcccaggccaaatggctccacccggtgttcatccgccattggcacatttccttctttttggtgttcctttatatcgccggcatccattatctcaagtggtggatgcgcgacagaaagccgttcgaactgcgcaactttttggtcttttggaatgccggattggccattttcagcaccttcggggcgttgaggttcagcgaggagtttctctacgttatgaagaacagatcattccaagattcggtgtgcctttccatttcgcccactcagccggccgctctttgggcctttcttttttcgctttccaaagtggccgagtttggggacaccgttctgctggtgctgaggaaacgcccgctcatcttcctccattggttccaccattcggttgtgctgatttacagttggcattccgcgactgaactcaccgcagccggccgttggttcatccaattgaattactcagtccacgccatcatgtacacttactacacattcgccagcctcggaatccgattccccaaatgggtgtcgatgactgtgaccacgctgcagaccacccaaatgcttatcggcgtgttcatctctctgtacgtcgcccgcctgaagcttttctcctcccgtccgacggtgtgccaacagtccgttgaaaatatgtgcatttgcttctccatttacaccgcgttcgccttccttttcatccgcttcttcgtcaattcgtatttactcggcaaaaaaccgacggcagcgaaagccgtggcgaagaaagcgcaatgagtgaagcagcataagcccgggatgctcagaacattccatccgcgcactttcgttgatgggagcagcccaaaagccgggaacacattctatgccccaaatcctccaacttttttaattgttgctggcgggaaaatcatttggcatccctccccttttatttattatatttttatttatgtatagtacagtacacactcaaattatttcctatgctttgataaatttaaagtttctaaaaaaaaaaaaaaaaaaaaa

SEQ ID NO: 48646 - DNA, 716 bp, Heterodera glycines
  SCN-specific regions: Sequence locations=1-20,73-716
ctttcttttccttccgccctctttttggccacttcctcccccactttttctgccttctcccccactttcttccgccaatgctctcatcgcccccaaaggaatttgttgcgcctgtgggagaggtgcatgcgtttgtggtcaaatgtatgcaaagtgtcggcacttcggcggcgcacgccgcgcaattggcggaccttttgttggatgccgacatcgtcggccattacagtcatggccttaaccgcctttgcatttacattgaggacgtcgcctcgggcgtaaaaggcgacggtgaaccgaaggtgctcaagcagaagggtgccaccgcttgggtggacgggtgcgatttgcttggcgccgtcgtcggtaatttctgcacagaattggccataaagttggccaaagagcacggcatcggctgggtggtgtgcaagcggtcgaatcattacggcatttgccaacattatgccaaaaagatagcaaatgccggcttgttgggactgtcgttcaccaacacttcgcccatcattttccccactcgctcttcccaaattggccttggcaccaacccaatcagttgttgtgccaattcacgcgaaaaaggcgacggattcattttggacatggcggcgtcgacagttgcgcttgggaagggcgaaatcgcaaaagtgaacggcaaatcggccattccgtccgcttggggcgcagactccgcg

SEQ ID NO: 48647 - DNA, 633 bp, Heterodera glycines
  SCN-specific regions: Sequence locations=1-42,64-126,149-344,369-633
aattaaaaaatttcgggaccaatgatcttcacaattgcccgctgcccctcccttcccctaaaatttaaattagaattgctgcaactgttgtctctgttcactcactattcattctagcaaaggaacaaaatgataaaggccattttggtgttcaataaccatggaaaaccacgactgctgaagttttacacacaatatagcgaagaagaacagcagcaaattgtgcgggagactttccagcaagtgtcgaaacgtgacgacaacgtgtgcaactttttggagggcggaaaattaattggggggtcggactgcaaattgatttacaggcattacgcgacattgtactttgttttttgtgtggacagctccgaaagtgagttgggcattctcgacctgatccaagtgtttgtggagactttggaccgatgttttgaaaatgtgtgcgagttggatttgattttccatgtcgaaaaggtccatcacattttaaacgaattggtaatgggcggcatggtgctggagacgaacatgaacgaaattctgctgaggatccaagagcaggacaaaattgagaggcaagaggctggcatcgccgctgcccccgcccgcgctgtgtccgctgtgaagaacatg

SEQ ID NO: 48648 - DNA, 1330 bp, Heterodera glycines
  SCN-specific regions: Sequence locations=1-593,615-1330
tacgtggagaccgccgatcggttggtggaaattgcgcggaacgaattgccaaatgcgaggttacccgccttccaagtggcacaagcggtcgatgtgctcacgttgggctcctacccgcggctgccacaaaatatcaaagaccgttttattccgccacttccgttgggtgcggccgaacggcgcctgacattgcgccaactgaataagttgattgaattccatttggcacaacaagcggcgcaactgtctccacgaattcgacacattactgtacaaaacggaatggcatgtctggtggtccccggagaatttgaaatggagctgactcggctgggcgatgagccgaccacccggtggacccttctgaacatccgaattctcgtggaaagtgccgaagtcggagagggacagcaaatggtccatccgctgcaaatcaatttcctccatcaaatggtgcaggaaaaactcgacacagcaaacgaacccattatggcggcttacattgttttgcattggttctgtcgctctctccatttggacattcttttatgtcaggctctccaaattgcgaaaataaaccgaagcggcaaagggagtgagggctcctcgcagcaatacatccgagtggacgagtacaatgagaaggagtgccgtttggcgatcagttattggctgaggagagagggcggcaccattcacggaaggctgtcgtctcattaccgaatgctcatttttggagacaaaaacaattcccatgtcggactgaaaattcgtcaccatccgcccagcacggaattgcccacaattgaccatgaacagagtccctccctccaacgattgctcaacgaaactgtccttttccggtgccgagaacgtctcctggcgggcaaacaactgcttgaagcagcttttagaactctctcctcccaatccaacacaaaatgtccgtcgtccgcctcgccttcgtccaccaattcggaggacacagcccaacagtttgtccaccaatctggtcactctctgctcacattgagctgtcccctcgtgctaatcggcgactgccatcccgacgaatgtctcaccgtggcagtgaacactttcagcggtgcggtcattgcccgggtggaagtgctcggtcaacgagaggagatccacaagttggagcatcagctgaacacgtgcccaactgtgctcctccactcctccgcctcgtctctgtcggccttttctgtcagttcgattggccgtctgctggcacggctccgcgttctcgtcattggcgaaagactgaacagggcgttggtcggaatgcaggtgaattcgttgaatg

SEQ ID NO: 48649 - DNA, 745 bp, Heterodera glycines
  SCN-specific regions: Sequence locations=1-745
cattggcattacgtgccacgctgggtgaagttgaggcggcatcactcaaattgggagaaccggacatgccaatgaatgagattgaccgtgccgtggaagtacgtcttgagcgagtgcaggaggtcaaaaagtcgatgctcaaggaagccggactggaaacagacattgaacccgcaaatgacggcgtttttcagggcgatttgctgttgaccaccgaacaatgtgacgagctgatcaaccaactgcaaaatgacaccacagccgaaggcaccgcggttgtgtcattggaagcgcaatcgttgctggacagtgagacggacaccgaagttggctccaattcgccatcattagccacttacaatgcgacccattcaattttgccggatgccgaaattgaggggaccgcttcagctgttgccgctttggcaccgcacctacgggcaaaacgggcgggcaacgcactgttctttgaacttatacccatcgaaaaatggccatatgacaagccaattgcctttttcttggacaaagcattgcgtaacgatgaaagaaagcaagtgcgcttcgcgttgaaacaaattcaaagcaattcgtgcattaaattcaaagaatatgcagcaaaacccacccacacaacacatcttcattatctgaaggaaacaagcttgggagcttgtggcttcagcgaaattggcatggttaagccattcaatcgcataatgttgagctttcgatgtcccagcca

SEQ ID NO: 48650 - DNA, 640 bp, Heterodera glycines
  SCN-specific regions: Sequence locations=1-479,502-640
ttagattagagtgggttgagtgatatgcatatttacaaagatccttatgctcctccgttggctccaaaagtgcctgatgatccaccgccatggtttccttcgtggaaagaatacaaacggcgaaccgaatggtgggcttctcttggatacaaagaccttgacctgaagcgtggcttgacaactggtttttatcctttttttgaggaaagggacattcgttatgttgattcgaaagtgcctgatggaacttcgatggtcgggccgcaagggaaggacagtcgctaccaccaaagaaaaatggtcaaatggggaattcccggaaagtttgaagacttccagaagcagatcagggagaactgttcgcaatacaaacaaatcgctgaaaaatgggacctcagggacgagcacccgggcattgcggtcaacccttcgctcgactcgatcattcgccaaaaataccgtccaattggcacggtgttccctctatttcctaaaatattggcttggccgcgtttttgggataaaccaatgaatgagggctgtttcaaaaagggacttgcactggccaaatattcgctgccgatcacttggattgcttatgcaggagcacttcgtggatatgatccgccagccaccaatg

SEQ ID NO: 48651 - DNA, 1062 bp, Heterodera glycines
  SCN-specific regions: Sequence locations=1-979,1001-1037
cacaatcattcatccacaggcaataataataatataatgcctttttgtccgatggcatcgcagcggacgcactgcgccctctttcagcagcgacatttggccacaaaatacgtccgatttccgctagttcctcccgacaacaaaaatagcgtgcaaactctgcagcagctgatcgcctcgcaaaaggacccaaatgcctttgtttttggcacaaatatggcgggccgagtgggccaatggctgacgaagcgttcctttgagaaaacggtggacaccgaactgcgcattctgctgttgaagtcggccaaccaaatgtacctttgctgtgccaacaaatacccattcattccgttgttgaacgaatttggccttcccgaccattactcaagctggtacaggctgacactgttgcatatttggatggcattgtgccgtgtccaacagtcgctggaggcaatggcctacatttacttcatgcaccaagtgttggaggtgttcaacacggactggtacactcgcttggacaaagcagcgaaagaaatgggcatgtcggtgaacaagcgcaaggagggcatggcattgcacgccatttacatcagcacgttgcacgactatgacgagggatttttcggagatgaccgcgtgttggccgccgccgtgtggcgctcatttttccttcagctgccggacgtgtgcccggcacaaatcaaccgggtgggccgttacatgagggcaacgatggcctcgctggcacggatggacgacacgcgcctgttgaccgacggcattgagcgctgggatgtggcggaagagttggcacgtctggtgagcgcggaacagtttggcaccattccggcagcgccgccttcatcctcgatggatggtgatggccgcaactcggcacaaccggcgccaaaagtggcggcatcaaattaattcattacttttaataagcagacccatttaaaaaaaacattgtttattagttgttttgtttttgtgaatttcaattgtgccgattaaacttgtaaataattaaaaaaaaaaaaaaaaaaaaaaaaa

SEQ ID NO: 48652 - DNA, 877 bp, Heterodera glycines
  SCN-specific regions: Sequence locations=1-150,174-877
gtttgaggttattatgatattaaaattgaaagttccaattctgctgtattgttttgttcaatgtttaagtgctgtcaaagtggacaatgccgagcaatccgaccaaccaactggcgattcttcctccggacaattcccaatttcgtatcctccaataaaatatgaaaacgatttggcctatgtggagaaaccgagtggcaacgagcgttgtctattctacgcggaaggactttctgtcgtcgtttttgccactaaaaaaagtcaatcggcgtgggcggactatcgctctgacaccaaagaaagtccgaagtataccgcgtcaattgaatgccaaggcaatatgaatgtgggcagcagctttgatgtctatttgaaaattgacggcaaagcggaaggagttgtgagagctgacattggaaaaaaggacgcaaaaagtgtcttcactgttgaaggagccgaatttatactcaacttcaacgtcacacaagtcggcttttggcaattggttggtgccaccgtggaaagaattgaagtgaaaggctcttcggatttcctgaacaaaaatttgaatgtcgacaaaaaatggactttggagccttcagttgttccatccacaaacattaacggcttcaaagactacagctttgcttgtggtcagaccaacccgatagtgtgggccctaaaggactcaaatgattacgcagtcggaattacgctgaacaatgtgcagttccaaccattcaatgcaacttacactgccggtggaaaagaagctgaccgtttaaaatttgggtggaaagtcaacgattgccaggggctggtcagcattggcacttggatgggcttggtagttgccactctgctcatcggcgtgctc

SEQ ID NO: 48653 - DNA, 1032 bp, Heterodera glycines
  SCN-specific regions: Sequence locations=1-399,421-664,707-1032
acaacccatacccaaaaactctttaatgagccgggtggcaaagatgtttatgaaggcgtaaaaatcgactacagcggaaccgaggttaaccctgaaaatttcgaagcggtccttttgggcgatgagcagcgatcggagggaaagccggtgctgaaaagcactgaaaaggacaaagtgttcgtgtacttctcggaccatggcgcggtcggagttatcggattcccagcagccgacttaacggttaaacaattgactcaaacactgaaggaaatgcatgccaaaaaaatgtacggcgaattgacattttatctcgaagcatgcgaatcgggctcaatgtttgaccacacattggcgcagagtttgaaaatttacgcagtcaccgcggccaatggcgacgaatcgagctggggctgtttttgcgacaccaaatttttgcccggaaattgtttgggcgatcttttttcagtgaattggatgcaagactcggaccaggaaaatttacgcaccgaaactctgcggaaacaatttggcattgtgcgcgaagaaacgaacaaaagccacgtgatgcactacggcgacttgcaaattcaggacgaacacgtttctgagtttatgggcaaagagcaggcgcaaaagcgcaacgaacgcccaccatcaccgcacaaatttccaatgtttccttctcgagacattcccatgttcatgatggcacgacgtcagaatgagtctaagcagattcagcgaaatctccgcgtggcgtggaaaaaaagaagctttctcgagcaatcgattaaacaaattgtgcaccaacttgtgcacgacatgaacaaccggcgacagatgttgacgacttatccgcaacaaattcgcgacttggactgtcaccatgaggtgatgcacacgttcagcaatctctgcttcagatttagcgagaatccgtacgcactgaaatatgcctatgttttggccaatttatgcgagcgacccgagttggacgccgaacgtatcagaatggcactgattgaacactgt

SEQ ID NO: 48654 - DNA, 713 bp, Heterodera glycines
  SCN-specific regions: Sequence locations=1-212,234-713
tggtcaatccttgattttgcatgtttactgattgaaataaaaagttcaaaaaatgcaatcatatcattacatttatcgtttgagctaatacaaattccctttgcctaactatgcctcttcattggacttctgtggacactcgcaacgcacttttgtgcgccgccgttccttccattggcgccttcgtgggctcgacgatggccatcaaagatcaggaattggttcaatttctcaagaatcaaaactttccttctttcgcccgttgttgcaaatacaattatttgctggccaacactgccgtcaccattccgttcggttacgcttcttatttggtctacaaaattggaggaggttttgattacacggacacgactgttgcattgggactgtacggggcgacggtgctcagcggctgttttttggtgcccatgctcaagaagcaggatactaaggcgctgactgccaacgctgttgtccttgccggactttccgtcgccacttctgtggctttctacaacatcgacaagatttccgcttattggaccatgcccttcactctttgggccattttctgcgctggacttacggtgaaggcttgaaatgtttgaagtcggctgcctttttctggattgtcattttatgttaactcatcttttgttgagttaggaatattttacttccaagtaaattgtctcgacaaaaaaaaaaaaaaa

SEQ ID NO: 48655 - DNA, 691 bp, Heterodera glycines
  SCN-specific regions: Sequence locations=1-691
atatttatataataattatctcgattactgaaacgatacactgataaatttccatacataattaagcttttagttcgtaaaatgctccgttatgtctgcctttttccaaggaggtcgtttcatttcagcacatttttgcccaaggattactacaaaatattgggcctatccaagacggccaaggagtcggatatcaaaaaagcatattacgagatggcaaaaaaataccaccctgacgtcaacaaagcgaagggcgccagtgaaaaattccaggaactctctgaagcgtatgaggttcttggggacccgaaacgacgcgctgaatatgaccgttttggggccggcggtccgcagcccggcgcggcctctggcagccccggaggcccacaaagtgcccgcgactttggctgggagttccactcgggcaaatcggcggagcaagtgttccgtgacattttccgcgacttcgacccgttcggcaatgccggcgcgtttggctccggccgccgttcctttggcgaaacgcagcacggttttgacgcagcacaggaagtggtggtcaacgtcaccttcgaggaggcagcacgcggtgttcgcaaggaagtgcgcatcaacgttgtggattcctgttggaaatgcaacggcagcggtgttcagccagggtttaagaaggtgtcttgtccgtactgca

SEQ ID NO: 48656 - DNA, 862 bp, Heterodera glycines
  SCN-specific regions: Sequence locations=1-243,266-307,330-862
ttggcgcgcgaccgaaagtatcgcattccggtggcgcttaagattctcttcaaatctcagctggtcaaagggaatgtggagcaccaattggtccgtgagatagaaattcatgcccacctcagacacccgaacattttgcggatgttcaactattttcacgacgataagaaagtgtacctcatattggagtacgctcttcatggcgaattgttcaaagttttgcaaaaaagtcgtcggttctctgagtcaacttctgcccagtacatctttcaagtgtccgatgcgctcaattattgtcactcaaaaaaggtcatccatcgtgacatcaaacccgagaatattttgctttgtgccgatggtaaaattcggattgccgactttggttgggctgtccacgccaaaaataggcgtcagacaatgtgcggcacacttgattacttgccacctgaaatggtcttgaaacgacaacacgatgaaaaggtcgattattggtcagtgggcgttttatgctacgaatttttggtgggaaggccgccattcgaaactaaaactcaggaggagacgtacacacgcattatgaaggtgcaatactcattcccgagctttatgagtccggacgcgcgagatttaatttcgaagttgctggtcaaagagccgtcccgccgcttgagtttcgagcacgtgctgaaacaccattggatcatcgcccattgcaataagaacaacgacgccgactcgtccaccgcgtccagcgaatgttggtgattggagaagcgaacaaatgggggacagcactcactgcctttgattttatttccttatttctatccgatctcttttgtgaataaatggctgtaagcaa

SEQ ID NO: 48657 - DNA, 636 bp, Heterodera glycines
  SCN-specific regions: Sequence locations=1-31,173-198,243-254,401 -404,458-636
atcgaattcaacaccctttcaatttggctatcatgcaaatcttcgtcaaaactctcaccgggaagaccatcacccttgaggtcgaggcgagcgacaccatcgagaacgtgaaagcgaagatccaggacaaggagggcatcccgccggaccagcagcgccttatcttcgctgggaaacagctcgaggacggacggaccttggccgactacaacatccagaaggagtcgacgcttcatctcgtcttgcgccttcgtggagggatgcagatcttcgtcaagacgctcaccgggaagaccatcacccttgaggtcgaggcgagcgacaccatcgagaacgtgaaagcgaagatccaggacaaggagggcattccgccagaccagcagcgccttatcttcgctgggaaacagctcgaggacggacgcaccctggccgactacaacatccagaaggaatcgacacttcatctcgtcctgcgccttcgtggtggaaagaactagaacgacgaacggaggagatgattgatccgtatcgatccatatattatgtaacttgagaccgtcctgtattgtgttccgttttattcatcatcatgaaatgtatttcaatgatcacggaacgataaacccatcaaaactc

SEQ ID NO: 48658 - DNA, 765 bp, Heterodera glycines
  SCN-specific regions: Sequence locations=1-146,169-458,480-765
tttggcctccgacgaaacggcctatctgattgcggacacctattaccgaacacacaaatatttgtccgccctctccctgtccattccctgtgtcagttacaaatggatccaacagtgtgtggccgagaaacaattgaccgaccatcggccctttttgttgccagctggcgagtcttcattggataccaagcaacaattcgaatggagaccactaaagggcgtgctgatgaagggaaagcgtgtgctgatttggtcgagctccgccgagacggaccctggcattgtcagttttgccgaaatttggacaccgatcctgcaaaatttgggcgcaacattagtcggcattggtcctggtgaaccatttgcctccaaatcgagcgctaaccttgaggaaaagatggaattctgttccaaaattgagcctcccgttgatgtgctgctggcggagacggactgccaggccgaggtggccaagctggtcgaggaacggggcggtttggccgtgtccagcgaatgggtcattcaggccatcgtcactggttcgctgcccgacctgggcgagcccggaggcgagaagttccgctacgattttgtttagtgttggctgaatgaacatccacagttttggtggtgaatgacggcggcaatggactttgactctacttgaacacacctaacaatatcataaaccattcgcttttttggaacgacacccggaaacttttctctttttgttgcagaattatctgccctatttaattatta

SEQ ID NO: 48659 - DNA, 684 bp, Heterodera glycines
  SCN-specific regions: Sequence locations=1-327,349-684
tgagcattaagtgaagtaaaaaacaatgattgtcaatggttcgttgaaaatttgccggacagcgctcggtccgtttgttcgtcgggcatcggcttccgcgctgggtcttccgcttgaggacggtccgtccgtttctccaccttcggtggaccgcgcgaaggacatttcgccgcgcgtccgttcgctcgtcgaccaaattgccgaactttcattggtcgaagtctccgatttgaattttgctctgaaaaagcgtctgaacattcccgacactcccgcgatggcaatgagtccggaaatgtttgcagctgccggaatgtttggagcacaagcgggcggagcagcgggagcacaaacatcacaagccaacgcggacgacgattcggcgtccacaaagacttcgtacgcggtcagattggccaaatttgacgatgctaaaaaaatcgcactgatcaaagaggtgcgaagtgtgatccccggcatgaatttggtacagaccaaaaaactgatcgaatcggcgccggtggaaatcaaaggggacatgggcaaaacggaggcggacgaactgaaggcgttgttggagaagcacggggcggaatgcgaagtgatctgatgaacatttgaggggcgaagggacatttttgtttctgtttggactattattttctatatttgttcttttagtcg

SEQ ID NO: 48660 - DNA, 994 bp, Heterodera glycines
  SCN-specific regions: Sequence locations=1-435,457-723,745-944,966-994
gtttccattcagtacagactcggcataatcggattttcatcgacgggcgataagcaaatggcaggaaacttcggcctttgggaccaattcgccgcgttggaattcgtttcggaaaacattgcgcaatttggaggaaaccctgcggacattaccctttttggcgaaagtgccggcgccgcgagcgtttctttcctcggactttccccgcacagccaaggtcttttccaaaagtgcgtccaattaagcggctcgcctttgtccgcgtgggcactaaatggacgcgtaattaacgaaactgcccaattagcagcagcgattaattgcgctgagaatggacgggaaggaatcaaagaatgccttaaggggaaaacggtggacgaattgttcgaaggggtcgaaaaagtgggcaaaacgcgccaggaatacgacttcaccaaatggggcccccttttggacggcgactttctgccggcggacattccgcaactgatcgaaagagcaccgccgaagcccacagtgatgggaattgccgatttagagacacttttatggacattggccatcggtcacaacgacagcatttcactttatgcaattccatgggacgaaatggccaattttgacagacgacgctttgaaatgtttgtccaaaactttgtgactaaacgcgaattatttggccagcaaatggcgacggaattgcaacgagaaattgtgcaattttacacaagagacaaagcggtggagagaattgaaaatgagggcgaatattatgtgaggaaaatcactttgcttttgtctgacctccaattcgccgtgccggtcatttgggaggcggcgcaaaaggcgcagaaggggtggccgatttacttcttcaaaaacagttacttcaacgaagtggtcttcccaaaagtggtcaaagtcagacaaaatttccacgccaacgattttatttattttttcgaccgaaaagtgtatcgttttgaattcaatg

SEQ ID NO: 48661 - DNA, 786 bp, Heterodera glycines
  SCN-specific regions: Sequence locations=1-635,657-786
ccaattaagacttattagatatttgcttccgtattccctctttgttgtcctgtccattcattttccatgctgctcaacaatcggtctcaattgccgttgagtgtttacggcggtggcattggcagcggagtttcggcactttccgccggtgccaaagaccattccgccaccgcttcttccgcgtccgttcgtcggcccccggtcagccaatatcagagcacggagtgcgtgctgttcggcagcattttcaacgatcagaaagaccaactgatccaacggctgaagggtctgtgcgacccggacggaccgacgcccttttttgagcacaacatggtgttcaagctgaagacgggcattgagtcgcctgtccaagtgcaaatgcgccgtcgtttcaaagtggacactgtgcattggcactgccgttacgtgtcccaacccgaggcacacattaaggacgtggtcgtgcgcaaggtcatcgactcgttgattcactccaccgacatgatgagctttgtcaaatcgttggggctgaggatggaatacgaatacattgccaacggtttcctgttcaccaagggtgacatccgcattctgctctaccaactccaatgctcggagaccatcggcaactacaacaagttgaagcagttcggcgactcctttctggtggaggcctccgttctgttgccgggccatgggctcgagcacttgcaacaggcggccaaatcggtgaaggaatttgcggaccaactgcacccgttgtgcaagctgagctacgtggactat

SEQ ID NO: 48662 - DNA, 629 bp, Heterodera glycines
  SCN-specific regions: Sequence locations=1-65,96-629
gtttgagattgattgactgattgatgcatgccaatttgccagctgctgtaattgattgtggcaccgggtacacaaagcttggctatgcaggaaattcggagccacagtttatcattccgtcggctatcgctgtcaaagatgcgaatattttgaaaagtgtcggcggaaaaatcccggacttggactttttcatcggtgacgaggcgttgtctccttcggctgcgaattattttgttaagtatccaattcgacatggaattgtcgacgattgggacctaatggaacgtttttgggagcattgcattttcaaatatttgcgagccgagcccgaagaccattactttctgttgacagaaccaccgctgaacacgccggagaaccgcgaattcactgccgagataatgttcgagtcgttcaatgtgcccggcctttacatcgctgtccaggctctgctcgccttggccgcttcttggcaaacccgcgagttcaaccaccgttctctgactggccttgtggtggacagtggagacggcgtcacccattgcatcccggtgtgtgatggctatgtcatcggttcttgcattaagcacattcccatcgccggacgcgacattacgtactttttgcag

SEQ ID NO: 48663 - DNA, 635 bp, Heterodera glycines
  SCN-specific regions: Sequence locations=1-635
ctaattcgtcgcttggccgtgcttacacgcccgggggaggaggtattgaaggagtggtcgagagtttgaacggtgccaaccacaacaacggaggaacgtccggacaatcggccgcacggcacgctgaccattcaggcattggccagccgtgctccagccacgtgcgcgaactgcccacgctgaacacccatttgacttctcccgcagcagccgtcgctctcggcctcatttatctgcgaacgggcgattgttggatcagagaaacgctggcaattgctgacacattttacgagattgaccaaattcgtcctgacatgctaatgattcgcactttttcgcgttgccttgtcgatttcgaagacattaaatgcacgagagaatgggtcgatgcccaaattccgcagataattcgtaaatatgtcaaacgctttttggaagtcaagtccaaggaggacatgtggtggtccgatttcattgacatggccacagttgcaaaagcttatttctattgttttgctggtgcttctttcgcaatggctttacgttttgcctcaaaatgggaaattaaagcacttcaagtcattcaaagtttttacgaaattctcaaaactgacacgagtgaacttgccacgtca

SEQ ID NO: 48664 - DNA, 645 bp, Heterodera glycines
  SCN-specific regions: Sequence locations=1-403,425-645
agaacacagtaaaaattacaaatgattcaaaccggcggtgctccactgataattatcaatcggtcggccgaacgtgaacaaggccaccgggtccaaaagcagaacattgctgcggctaagatggttgccgacgtgattcgcacaagtttgggaccgcgggcgatgctcaaaatgctgatggacccgatgggcggcattgtgttgaccaacgacggcaatgccatccttcgcgaaatcaccgtcaaacacccggccgcaaagacaatgattgaaattgcccgcacccaagacgaggagaccggggacggcaccacctcggtgatcatcttggccggtgaatttttggcacaggcggaacagtttttggagcagagcattcacccgaccgtgatcatccatggctatcgcatggctctcgaggatatcattgagtggacagaggagaaattcagcaaaccagtcgatttggcctccgagtcggaactgaccaccgtggtgaagtcatgtttgggcaccaaaatgttggccaagtacatggacctggcggtgaacatcgccctctccgcggtgcgcaccatcgacgtgaccaacaacgactttcgtgagatcgacatcaagcggtattgccgaattgagaaaatcccc

SEQ ID NO: 48665 - DNA, 652 bp, Heterodera glycines
  SCN-specific regions: Sequence locations=1-189,211-614,641-652
ggaaggcgaccgccgcccgatcggtttcgactggtctatctgatcgtgcttctccatggaatgggcatgttgctgccgtggaacactttcattacgatcgcaggggattattatttgcaattcaaattcgctaatgtgagcaatgaagacaattacaaagtgtacttcttcaattatctgacggtttgtgcccaaattcccaatttgctgctaacttttctgaatttatttggcgtcataagaggcggcttttaccgtcgcatttacttcactttggccgtcatttttggcatatgtctcgtcacaattgcgatgggactttcggctttttcctcttcacaatgctttccgttgtgcttctgaatagcgccagtggtgtttatcaaaacagtatttggggattgttcgctgattttcccggggaattcgccggtgccattattattggcaacaatttgtgcgggattctgatggcagtgctagacatcctcatcattgtgttaggtttgcgattcgtccacttcgcttttgttcggttcgcttttagtcggtgccaatgccgcactcgccgcaacagtttacttcggtctcgctctgtttaccgtcgtcctttgcattttttctttccattttcttcaaaaattggttctat

SEQ ID NO: 48666 - DNA, 788 bp, Heterodera glycines
  SCN-specific regions: Sequence locations=1-40,62-687,740-740
ctcaaacaaaaatattcacaaatgacatcttcggacgaagaatttaaaaaagaatgcacttttgcctcacttccgcgcactgtgcgtggaatgcctttggttgtttcgtcgaattcggatggaaccaaattcctttactgcaatggaaatagcgtgttcatcagagacgaggaaaatattgccgattgtgatgtgtatacggagcacgcgactttgacaaccgtggcaaaatattccccctctgagttttacattgccagtggagaccaatcgggcaaaatccgtttttgggacaccacacaatcaacgcatattctgaagtcggagttcgctcttctttcgggcgcaattcgcgacatttcgtggtctgaggacagcaaaagagtcgcaatagtcggcgaaggccatgaaaggtttggccatgtcttcctctttgacacgggtacgagcaacggcaatttgtcgggacaaagtcggccgatgaatagcattgattttcgtccgacacggccttatcgtttggtcagtggttcggaggataacactgtcgccattttcgaaggccctcctttcaaattcaaatcgatttttcatgaacattcgcgttttgtccaatcagtgcgttacaacaaagacgggctccctttttgcggcaggcggaatggatgggaaggtcattcttttcgaaggtcaagagggagggaaagttggcgaattggtggacgaaacgtgcaaaggcacagccgcgcatagcggcggagtgttcgcgttgaattggcattcgggtg

SEQ ID NO: 48667 - DNA, 894 bp, Heterodera glycines
  SCN-specific regions: Sequence locations=1-13,35-349,371-593,617-894
tccatacatctcaaactcaaaaattttcttcgtttttctactgcttctcgtcaatataattgcttatgagctcaatccatacaatactttgggaattcgtcggacagccagtcaaaaagacattaaagatgcttataagaaattagccttgcaatggcatccagacaaaaacaagaatcccgagtccaatcagcggtttatggatgtcaatcaagcttataaaattttgtcgaaccctcagagaagaaaggcttatgatactttcggcttcacagatgagcaatttgaaggcatgcgaaaggaattctttcgcgaacaacagcagcatcagtttcagtttgtcagatggccccaacctccaaggaaaaaacaaacggatatttctcaatttttgttgccattcggaagtgtgcttggaacactatttttcattttcgtcgttgggtacttccttaaccatatgaatgtttcggagcaatcgaagagacggagacagccacaaaaccgcgcagaagaagctaataaaatgggaggaggagacacgaaaacagaggacaatgaaaaagagcttgctgaggaccaaaaggcaccattgactgaggaggagcggcagcagaagttgcaagcgcgggtttggcgagtgatgggtccgatgattcgggaattgcgagctgaaactcagttcgggctgatacggctgctgaagccgggctgtcgttcgatcatcgtcctcgtggacaaggacagtaaggacaaactgctccagcagtttgcccgtcacctgtactgcttgagaaacaacaagactttctcattcggtttcctaatggtgccgaagaatctcagctggttccgttctttgctcgagctgactcttccagacgaacagcaaaa

SEQ ID NO: 48668 - DNA, 854 bp, Heterodera glycines
  SCN-specific regions: Sequence locations=1-854
gtttgagcttcaataacctttcaattggaagccatttgtctgcttacctgttaaatggcttccatcgcatgtttgaacccaaaagcggagttggcccggcacgcggccgcactggagatgaacatcagcggtgctaaagggttgcaggaagtgatgaagaccaacctcgggccgaagggcacgctgaaaatgcttgtctccggttcgggtgaccttaaagtgactaaggacggcaatgttttactccatgaaatgcaaatccaacatccgactgcttcactgatcgccaaggcgtgcaccgcgcaaaacgacgtcaccggcgacgggaccacgtcgaccgttctgctgattggcgaactgctcaaacaggccgagaattacgtcagcgagggtgtccacccccatttggtcaccgagggtttccaattggcccatgaccatttgctccaactgttggccgcctccaaaaagacgttgcctatcgaccggccgctgctcatcgaagtggccaggacgacgttgcgcacaaaattggaccaaaagttggccgaccacgtcacggaatgtgttgtggacgccgttttggcaattcgtcgggatgaaaacgacacggagcccgacttgcatatgattgaaattcagcaaatggaacacgagatggagacggacacgcagctgatccgtggcctcgtgcttgaccacggcggccgacacccggacatgccgaagagtgtgcgaaacgtgcacattttgacatgcaatgtttcgatggagtttgacaaaactgaggtcaactcaggcctcttctacgagactgcggctgagcgtgaacgtttgctgcaagcggagcgtga

SEQ ID NO: 48669 - DNA, 1056 bp, Heterodera glycines
  SCN-specific regions: Sequence locations=1-46,68-226,252-493,530-1056
gatttttccccacatttaaggcagatgctgaacatcccactgatgctgctgttgtggacaacttcgagacgcgcgctcgccgcttcttcgacctgatcaacgacggcaacatccaacacttgtgacagatcgcaaacggaaattggtagagagacgaaaatttgaaaaattccataattttacccatcatttttctcccacagccgcatttgccatcggacaacgaacttcttcttctgctgctgcttccccggttcaattacatcacagaaagcaagcaaaggacacgcaccaacaacctgcgcaccctctgtcagtgcatggcacccgcattttgttgtgtttgagtctctgaatcgcatccctttcccctctttcagcactgatgatggcaccggcaacttcttcctgagcgcatatgccatgtcagcgcaaaaaatcgccagcgattcggagtggaagaaaacggtgggtttttgggggatttggccggaaattttttatttttaaaattaattcatttatttttcagcccctcggacaaactggcctcttcaatatgggaaatacgtgcttcatgaacgccactcttcagccactgttccatacgcccggattttctcaactgttccaagaaaagagcgcgcagcgattcgtcaatgggaacaactcgtttggcacgaatgggatgatctccggctcattctctgcgctcatcgacctgatctggtctggcaagttcaacgcacttcggcccaccaccttcctggaattcttcgctcgccgtgtcaacaccgaaatggccgaccgacggcagcacgacgcccaagaatttcaactctatctgctggacgcgcttcacgaggacaccaaccgggtcaacaagcgacaatcgtttgaacagaactacgacgacaccgatttgggcgccagcgcttcggatttcaatgagaggtcgaaactgttctcttcgtcgccggtcaacgatctgttcaacctgacaaacatctctatggtccaatgcagcacgtgcaatacgacgagtgttcgcttcga

SEQ ID NO: 48670 - DNA, 756 bp, Heterodera glycines
  misc_feature (732)..(734): n is a, c, g, or t
  misc_feature (736)..(736): n is a, c, g, or t
  SCN-specific regions: Sequence locations=1-114,138-234,258-315,348 -658,682-734
gtttgagaaaatcatattaaactaaaaatgggacgtcgtcccgctcgttgctatcgctacattaagaacaagccttatcccaagtctcgcttttgtcgcggtgtccctgacccgaagattcgcatttttgacttgggtaggaaacgcgcaactgttgacgagtttccatgctgtgtgcacatgatatcgaatgaaagggaacatttgtcgtctgaggctctcgaagctgctcgaatttgtgcgaacaaatacatggtgaagaattgcgggaaggacggctttcacatgcgcgtccgaatccacccgttccatgtgattcgcatcaacaaaatgttgtcctgcgctggtgctgaccgtcttcagacgggaatgcgcggcgcctttgggaaaccccaagggttggtggcgcgtgtcggcatcggtgatatgctgatgtcggttcgtgtccgtgaccagcatcaagcccacgctcttgaagcattccgtcgagcaaagttcaaattccccggccgtcaatacatcgtcatttcgcgcaaatggggcttcaccccttttgaccgcgaagtttacgagaagcaccgcaaggaagggcgagtcattccggacggagtcaactgccgattcctcaagcaacacggaccattgacggaatggctcaaaaatccaatctgatcaattgtacgacggatatattcccttttatatgctttgttgattaaattgttggatctnnnanaaaaaaaaaaaaaaaaaaaa

SEQ ID NO: 48671 - DNA, 1549 bp, Heterodera glycines
  SCN-specific regions: Sequence locations=1-53,89-89,146-154,184 -192,215-271,356-902,927-1002,1024-1496,1519-1549
ccaagtttgagcagagccgggcccaaacacattctctcccgtgagcagcaatcagcaaaagctgaacacactccttcgaactcactgattatttgatccatctctgagagcaacttctgatcagccaaagatgccggaaagcgaaaacgacttcgatgaggaggcgcccaacgccaccatggagaccaaagtggcgggcggcggcgcggcgccgaagcgcgtcgggcgctggacgttgtcacagctgcgccagacggacggcatcatcccgtcccaggccggttggaacaagggagactcgcagaagttgatgaccaactttggtacgccgcgtaacaccaccaccaaagtcaaagtggagaatctggccgagattccggaggacattttgctgaaaagccacggggaggtgcgtctgcagtccggtaccaaccggttcgcctcccagaagggctttgtttcgttcggtaccggacgtgatgtgtgtcgtgaaggtgtgaatgtgaacatcctgccggccgacttggagccgctgccggaggagaaaatccgcgccagtgacggcattgtgcgtctgcaagccggtacgaacaaattcgactcgcagaagggcatgaccctgttcggtaccggacgtcgtgagaccaccagaatgaaggacagcaagcacccggagtactcgcacgagcgcgacattgacaacacggagattccgcttcagatgggtacgaacaaattcgcctcgcagaagggcatgactggcttcggcacaaaccgtcgtgagaccaccaaaatgttggacacctcgcacccggagtacagccacgagcagagcatcgaccagaccagcatcccctaccaaatgggatcgaacaaatacgcgtcgcagaagggcatgaccggctttggacagccacgttgggaggtgcttgacccgtccatttcgtaccagaaccgcaagtcgcaaggcatggttcgtctccaatccggcaccaaccgattcgcctcccaggcgggcatgaccggctttggcacgccgaggaacaacacctacgaggcggaggcgggcgagctgccttacgaggatatgaagaagtcggaggcgatcatcccgtcccaggccggatggaacaagggcgactcgcagaagctgatgaccaactttggcacaccgcgtgacgtgaagggcaaacatttgaagcgcatttgggaattggagtacccggaggaagccgaagtgtcgctggaccgtctctgatcagcgacacggattgaattgtgctgctgatcagcacatgaatacacacggaggaaggaggagtaggacaaatgccatcgtcctcatcaagttggagcagtacacacccaccacaccgtcatcctttgccgtccggagagtgatcgatccattgtttgatagattgattgatcagaaaacatccatccatcctccgatcacagcccctggcattttttgctgcttaaaactttgtggttttaaatacatttagtgcctgcggcaacactttttttcaaatttttgcctaat

SEQ ID NO: 48672 - DNA, 1410 bp, Heterodera glycines
  SCN-specific regions: Sequence locations=1-637,659-748,770-813,835 -924,946-1130,1152-1410
gagccatggatggatggattaacaacttcaccagcagatgaacgcgttggaattcaaaaaatgaatcactctgttatttcctcgtgtttcacaataaattctgtgtgtgtctacgcttttttctactgttttttcaactattttggttttggagtgtaccgatacatacgaatcaatttttgtacattttttaatatttttttttgcaaattttaatcgctgtttattgactcttttttttggcaaatttactggcaaatcaacaaaaaattaggcaatcgaccgctaccatgacgacgacagaaacgccgacggcaccgcgcttggaccacaccacgggctggacctgtttggcgtgcaaattggtgttctccagcgggcaattgcagcgggaccattaccgcagtgaatggcacctgtacaacatgaagcggcagattgccaacctcccgcccgtgacggaatgtgacttcctggagaagcttcagtattttttgcaacaccagcagaagaatgctttcgatgctgaccatcgtcgtctgtcctccctctctgtttctgctgctgcttcatctcttcccctcggtgcctctgctgttgcttcttctcttcccccattgtcttcctccaagttgtcgtcttcttctccgtcttctttggtttgcactgtgtgccgcaacaaacgctttcggtcgcgcaacgcctttgacaaccatttgcagtcgcgtcggcacaaagaggaagaacaactgcaacagcagcagaagacgacagcgacaattgaggctaatgagtgccaaacggaggggcgagaaaatggcggcatggaagcaaaattgccaaagattgtggcacaaaacattgatggtgaagaagaagcggttttgccaatcgaaagtgataatgatgacgatgaagaagcggagcagaaagaagacaacagttttgccaaaaaagaagacggcatcccgccaaacgaatgcctttactgtgaactcaaatccgacacttgggaggcaaatttggcgcacatgagcaagcagcacggttttctggtcccggactcgccattctgcacggaatgtgcccgggttgctcacttatttggttgtggcactttgcttttccaatttctttttctaattacatttcaaggcttcaaagtcggggacggcctaacctgcgtccgatgccaatgcgcccgtttccgttcgattgacggactgctaaagcacatgcgacgactccaaccattgcaactttcgaatctattcacaacaggaggtgcttgctgttcgttgtgtaaatgaagagcccggagagggagaaatttaggggaactaagaaatggttatttatttgataagattgaaaatgatccttagggggatgtcagacatctaatatatc

SEQ ID NO: 48673 - DNA, 1225 bp, Heterodera glycines
  SCN-specific regions: Sequence locations=1-12,38-187,209-661,683 -826,854-1225
ccaagtttgaggtttattatttataaatttataaaatgcaaaatcaacagaatatggacaattcagcaaggtcaattttcgttggcaatatttcttacgatgtgagcgaagacgaattgcggaagcttctctcagcatgtggtcaaattgttagctttcgccttgtccatgaccgcgagacggggcgccccaaagggtttggtttttgtgaatttgccgatgtgcctcaagcggaggcagcaattctttatttcaatgggttcgagtttcggggacgtccacttcgtgtcgactcggctacgggcaatgatcggagtgctgatgagatgcaacacttccaaatgactttgactcgtccgcaaaatcccaccgacgaattgagtccttatgggcccgaattggagccgggaaaagcaccggaagtaattgcccgcacagtcgcgtcaatgcctcccgaaaaaatgttcgaattgatgcgatccatgaaggaaacggtgaacaacaatccgcaaatggcgcgccaacttttgatggaaaatccgcagctgtcgtatgcattgctgcaggctcaagttgtgatgcgagtggtggacccgaagattgcctaccaaatgcttcatcgtgaacatgctcagccgcttgtaccgccgacttccatccccactcatatccctcaacaatttgctggcaaaccccctcaattgcctccccaattcaacatacctccgccctccgtcccctctcatcagtttcaaatgcaacctcctccattggtgccaggccaatttcaccacggatttccatccatgggcatggctccgccttcgctactgcaacagcagcagcaacagacgccttttacacaacaaaagccgacacccatcgctcctttggcagtgcctccggcagcgaccgctccgcaacagcagcaggctgttagtccgcctccgcttagccaacaagcacagcaaagcaacagcgacaatttggacgaggagcagcaggcgcaaatgcttatccgcgtgctgcaactcaccgatgagcaaattcgtatgttaccaccaactgagaagtgcggatgcaaatgcgtgaccatatcaaatcgcactgacagaggtcgaaaagccaactgatctcttctttctccatcaacctatttttatataatgtttgatttttttgttgttgaaaatcaagatttaatgaaaaaatttttactaggaaa

SEQ ID NO: 48674 - DNA, 862 bp, Heterodera glycines
  SCN-specific regions: Sequence locations=1-5,27-626,648-713,735-840
gctatttgagaatttattgaaaaatgactgaagccaaaaaattgccggaagtgccggagacgctgctgaagcgacgcaaaatcagagccgcacaacgggctgccagggcgaagaacagcttgaacaccatcaaaaaagcgaaggccaaaaagacggaaatcttcaaacgggcggaacattacttggttgagtaccgccagaagcagcgccaattggtcgcgttgaaacgggaagcgaagaaagtgggcaattactacgtgccggacgagcccaaacttgcatttgttgtccggatcaagggcatcaacaagatccatccacgccctcgtaaagtgttacagctgcttcgtctgcgtcagatcaacaacggcgtattcgtcaagttgaacaaagcgacaatccagatgttgcgcattgctgacccgtacattgcgtggggctacccgagtcagaagatcattcgccagttggtgtacaagcgtggttatgccaaggagagtgggcagcgcattccgatcacggacaatgccattgttgagcgaaacatgggcaaatcggacgtgatctgtgtggaggacatgattcaccagatttggacagtcgggccccacttcaagcaagtgaccaactttttgtggcccttcaaactcagcaaccccgtgggcgggttcaagaagaagtccaaccattttgtggagggaggcgactacggaaaccgcgaggaccaaatcaacaaattgcttgaaaaaatgatctaatttcggaaacaattgcgatgagttgatgtgcagcggacggcacgcttttgttgttgttattttacagataaacttttttgttaaaaaaaaaaaaaaaaaaaaaa

SEQ ID NO: 48675 - DNA, 774 bp, Heterodera glycines
  SCN-specific regions: Sequence locations=1-73,115-118,151-157,180 -274,304-312,334-346,418-690,749-774
ctattgctttctttcaatcaaatctctcaaaatgtctgaacaatccggggaaacctttgcgtttcaagcggagattgcgcagttgatgtccctgatcatcaacaccttctactcgaacaaggaaatcttcctccgtgagctgatctccaactcctctgacgctcttgacaagatccgttaccaggcgctgaccgacccgtctcagatggagagtgggaaagagctcttcatcaaaatcgtgccgaacaaagccgataagacattgaccatcatcgacactggcattggcatgaccaaagcggacctcgtcaacaaccttggcaccattgccaaatccgggacaaaagcgttcatggaggctcttcaggctggtgcagatatttcgatgattggccagttcggtgttggattttattcggctttccttgtggccgaccgtgtcacggtcacatcaaagcacaatgacgacgattgctaccaatgggagagctcagctggtggctcgttcatcattcgcaattgtgccgatcctgaagtcacccgcgggacaaagatcgtcctccacctgaaggaagaccaaacggattatttggaggaacgtcgtgtgcgcgaagttgtgaagaaacactcgcaggtcatcgggtaaccgatcaaatgggtggtgaaaaaagagcgtgacaaggaaatttcggatgatgaggcagaggaggagaagaaggaagatgaagcaaaggaggaggagaagaagccagaagatgacgtgtcagatgacga

SEQ ID NO: 48676 - DNA, 1080 bp, Heterodera glycines
  SCN-specific regions: Sequence locations=1-175,200-703,727-1023,1045 -1080
gataaacttaaaaattgggaggcattttctgaaaaaaaattcgaaaaattgaattataactttttgtacaagttcggtttcaatgttcagattggtcattaggcaaagggtccctccaaataacacgccctcaatcaacttataaagttgtatttagagacaaaaattatcgtaaatggctgtcggaaagaacaagaagatggggaaaaagggagcaaagaagaaggccgtcgacccatttacgcgcaaggaatggtacgacatcaaagcgcccgcaatgttcacacaccgaaacgttggcaaaactttagtgaaccgcacccagggaacacgcatttcaagtgactttctgaaaggtcgggtctacgaagtttcgttgggcgatctcaacagcacggacgccgactttaggaagttccgattgatctgcgaagaagtgcaaggcaaaatttgtttgaccaatttccacgggatgacattcaccagggacaaactgtgctccattgtcaaaaagtggcatacactcattgaggccaatgtggcagtgaagaccaccgacggtttcttactccgactcttttgcattggctttaccaaacgaaatgccaatcaaatcaagaagacgagctatgcaaagacatctcaagtacggatgattcgtgccaaaatggtggaaataatgcaaaaagaggtctcttccggcgacttgaaagaggtggtcaataagctgatcccggactccatcggcaaggacattgagaaggcgtgctccttctactacccgttgcaggacgtttacatccgtaaagtgaaggtgttgaagaagccgaagttcgagctgggcaaattgctggagatgcacggcgagggtgccggaacggtcgccactattacgacggccaccggagagaaaatcgaaagtcggccggacgcatacgaaccgcccgttcaacaaagcgtttaaatggtcagattgacaaaatggagatttatttgactgtttgcatccgaattgttttgctgttgttgttaaactgactttgttgaaaaggagggaaaaacattcaaaacttgataaat

SEQ ID NO: 48677 - DNA, 818 bp, Heterodera glycines
  SCN-specific regions: Sequence locations=1-103,125-164,187-368,390-818
cttcggagtttggcaaatatcgtcctttgccatccgacagaaaatgtccccgcaaaggctgcgccagcgacccgcccccggccactcattgtcagcccggacattcttctgaaaatgggactgtccaaccgacgaaaacgagcagtttgatcagctcaaagaatggatgcgctgaggcggaggaggagcaatgcctttttgtggaacattttggcccaattccccaatacagcgaaacggacgaaaaagagaatttgcggctgcggaaattgcacgaagtcgcattagaaatttatcagaaacaacgcgcttatgttatgaaattgcaactgattgggctcaattatccgaggcatttgaatgactgtgaaaaaagaatgaacaaaaaattgctccattccaaacacgtcatcagacgaatcgcggatcactttcagactattttaaatgttcatcttacgtttttgcataatttttatgacaaaattcttaaatgggattctcggaagcccgacttggccgaagtgtttcagaagaatgccgattttctaaagatctgcagacttttcctcaccgagaaacaaaaactcgtcgctgagttgcaacagactctcaatgagaaccacgagttggccgaggcgacactgacatttgagcaagcactgtctaaagaaacctcaactcgtcacagtttctccggcggaagaagcaattgcgcttctgtgaacgacttgaagggcatttccatcgttttgcaattggatgctgttcatcaaaacgttgtccagtacaaacttctgatggaacgttatcggaaa

SEQ ID NO: 48678 - DNA, 1113 bp, Heterodera glycines
  SCN-specific regions: Sequence locations=1-29,52-235,257-830,865-1113
gttatttttctgtcaaacaaatttcacaaaacaagcttaattctgcagcagaaacatccaatggagcttcaaaaacagccagtcatggcaacaaaagaacagttgcgtctggctgaactcacccagacagggcatgacgctaccattgcacatgatgacattgctgggcagaaacgtgtcaagaaggttatcgaattgacacgctgtactcagtcgcaggccgaagttgcgctaattgacagtgaaggcaatgtggaagatgcggtcgctcgtttgttggacagtccggaaaagttggtgttgtggagtcagcaaggcaaaaaacaaaagacgaaatcgtcaactccatcggttgcccggactactaccactcacaatcagaccaaaggcaaaggacagaatgagcagaattcggctgggccgcgtgttcgcactgaacgtcagggacagggattcaagggacaaaaccgcacttttaccgccggaggagcgtatcgacgtgacaatgttgcagcgaacaagcagaccaccaacaaagttgtgggaacgggaacaaacaccggcgacttttcttcaactgttgagcaatcttatggcgaaacagcgggacacgaaaacgacgaatggaaaaatgggcctcgtgtgtttatgccatcttcggctgctactgttgtgatggcggaaacatcgacaaatggtggtgtgaagtggcccgctctggacaactttacgccttccgttgagccggctgaacccgccgcggttcacaagccgaaaacatttgccgctgttgctgcggctaaaaaggcatcaccacagccttcacctccacaacatcagcaacaacaacagcagcagcagacaatcacatacgaaagtcgggagccggattggacgaaagaaaattggacaacggagccgacgaattggtcgtcagaaaattgggcatcaaccggcaaattggaaagcaccgaaatattggacaacccggaaaaattggataccaccgaaaaattggaaaacaccgacatgttgggcaccgctggcaacattgaagctgccaacaatttggacacctctgtaatgctggacaccagttgcaaattggacacg

SEQ ID NO: 48679 - DNA, 632 bp, Heterodera glycines
  SCN-specific regions: Sequence locations=1-26,82-82,168-171,193 -193,237-249,284-285,310-310,396-420,460-555,578-632
attcaataccccttcaatttggctatcatgcaaatcttcgtcaaaactctcaccgggaagaccatcactcttgaagtcgaggcgagtgacaccatcgagaacgtgaaagcgaagatccaggacaaggagggcatcccgccggaccagcagcgcctcatcttcgctgggaaacaactcgaggacggacgcaccttggccgactacaacatccagaaggagtccactcttcacctcgtcctgcgccttcgtggagggatgcagatcttcgtcaagacgctcaccgggaagaccatcactcttgaagtcgaggcgagtgacaccatcgagaacgtgaaagcgaagatccaggacaaggagggcatcccgccggaccagcagcgcctcatcttcgctgggaaacaactcgaggacggacgcactctggccgactacaacatccagaaggaatcaactcttcatctcgtcttgcgccttcgtggtggaaagaactagaacgacgaacggaagaaatgagtgatctgtatcgatccatatccgtatcttgagactgtcctgtattattgtgttccgttttattcatcatcatgaaatgtatttcaatgaccacggaacgataaatccatcaaaactca

SEQ ID NO: 48680 - DNA, 635 bp, Heterodera glycines
  SCN-specific regions: Sequence locations=1-143,167-307,329-635
ccgaatattggaaatcttacgcgaagaaattctgtgaaatctgcaagatttggtatgccgacaacaaagtcagcgccgaacgccatgagcaggggcttcggcacaaagccatggttcagcaacggctccgcgagagtgcgaagaaggcaaaggataaggaagttgaagaccatgaacttcggatgacacttttgtcaatggaacaggcggcgcgggcgagcttttcctctcgggaggaacgcgaagtgccaatggtcccagccccacggataattacatcgcaaaagcaaacggccgaaccgaccgaagaagacgaagtgaaagcaaagcttagggaacagaaaagaaagctcgccgcattgaaaaaacgttcaaagcaatcgcaattttggtcaccggacgaaggggaaatgggggaaggcgatttgccacttgaagaggaattggccgattgggtgcaggcggagacatcggacggacaattttactattggcacatttacacgggggaaactcgttgggaacaacccgagaaattttacacttctgcccaatacgccgaacgttatgccaacattgtggaagagacaactgaccagagggaagtcggacagtgtgccaattccgcctacgat

SEQ ID NO: 48681 - DNA, 928 bp, Heterodera glycines
  SCN-specific regions: Sequence locations=1-55,155-517,539-710,732-928
gtttgaggcttttcaaattaaaaaaaacgggaccagtaaactagacctttgccgtcccctgctccattttcttttcctcctcctcttcatcacattttcgcctcctcatgtcccctccctgctccttttccccttcctccgcctcctcttcctctgacagtccctcagcagaaggccaagcccagcaaaatggccaagttttggccccccgtccattgcccacgtgggaggaaatccgtgccgcggtgcccaaagagtgttttgaaaagtctctccttcgttctctgtactatttggccatcgatttgctcgtcattggcttcctttacgccgttgtgccttttgtagagacaaatttcggactgatcggactgtttttctggtactgcttgctcggcatgtttttgtcctctctgttttgcgttggccatgactgcggccacggcactttttccgattggacatgggtcaacgacattttcggccatatttcccacgctttgctaatggtgcccttttggccatggcaaaaaagccaccgtcaacatcaccaattcacttctcatgtggacaaggacaaaggtcatccctgggtgttggaagatgactacgaaggtggcggatggctgcgaaaacattttgctaagattcccttgtccggactgatcaggtggaatcccatttacactgtcgccggtctccccgacggctcccatttttggcccttttctcggctgttctccaacaatacagagcgtttcaaatgtctgatcagttcctcactttgtcttatcacttcttgggccattttcgttttgcttgaccacagtccgtgggcctttctcaaatattattatgtgccgctgatgtttcagggctattggatggtgatcatcacatatttgcaacatcaggacgagcaaatcga

SEQ ID NO: 48682 - DNA, 746 bp, Heterodera glycines
  SCN-specific regions: Sequence locations=1-347,370-379,401-746
ggcaacagcacatcatttagctaaaactcatcaacacacagaacacctgcaagaaatggtcatcaaatccaattcggtcatttcacgttcgcattctgatcattttcaagaagcttctggttcattgtcagcaacttccggttccgaagatgcaattaagcactggggttggtggaggcattttgtcgcaggtgccactgctggttgtgtcagccgatcagtgacggcaccgctcgaccggctaaaagttttccttcaggttaacgccaaccataagactccacacactttgccatccgcagtcgattatttgtatcgcgaaggtgggtttctgtctttctggagaggcaatggcatcaacattctgaaaatagcacaggaatctgctatcaagtttatgttttatgaacaggtgagctcttcaatatttgttctttaatttttggatttagataaagcaagagttccaaaaattaacggggcatcgcgatctcgacatttttgagcggttcatggcaggggcttctgctggtgttatcgcccaaacggccatttacccgttagaagtgctgaagacgagattggctcttcgaagaacaggcgaactcaatcgtgggctgtgtcattttgctagagaaatgtaccaccgtgagggcttcacctgtctttacagaggatatgccgccaattgtattgggattattccatacgccggcatcgatttggctgtttatgagacgctaaag

SEQ ID NO: 48683 - DNA, 633 bp, Heterodera glycines
  SCN-specific regions: Sequence locations=1-633
ctaatattcaattttttgaattaacataattcttttggaatggctcctgcaccagaaaaggaaaaaactgaagataagaaactgaaagacgggcaaaaaccaaatgtgaccacggatcacgcacactgtttgagcaatgtccaaccaaatcttcccgtcaataaagtggtggtgcatccgctcgttctgcttagtgtggtcgaccacttcaaccgcgtgaacaaaacgcacaaagtcaatcgagtggtcggtgttttgcttggttgtatgaagcacgacaaaacccttgacatcgcaaattgttttgctgtgccttatgacgaggactccgagaattcgaacattttctttcttgatgctgattttctggagaacatgtttgggatgttttacaaagtcgcggcacgtgaaaaaattgtcggatgggatcactctgggccgcgtctttgcaagaatgacattctgatcaacgaagtcatcaaacgctttaccccgaaccccgtgctgggcataatccaagcttcccaaggccgacaggatttggcactgccgacggatgcttatgtggaagtccaggaagtgcacaatgatggttctcccccggtgaaaactttgaacacgttcccagtggaa

SEQ ID NO: 48684 - DNA, 705 bp, Heterodera glycines
  SCN-specific regions: Sequence locations=1-140,162-340,363-425,464-673
caagtttgagcattgttttgaatttcgaaaaaatgggcaaaattcactactgcaagcgtccggacaacagcacaaagtcgtgcaaagctcgtggttcagatcttcgtgtccatttcaagaacacacatgagacggcgcgtgccatcaaacatatgccgttgaagcgtgccatccgctttctggagaatgtacgggagaagaaggagattgtgccgttccgccacttcaacggcggcgtgggacgcaaagcgcaggcgcaagcgtggggcacaacacagggacgttggccgaaaaagtccgccgagttccttctccaacttctcagaaatgcggagagtaatgccgaggtgaagggcctggacgtcgaccatttggtcattgaccacatcgtcgtgcaagcggccgccaaaatgcgtcggcgcacttaccgcgcgcacgggcgcatcaatccgtacatgagttcgccgtgtcacatcgaagtgattctgaccgagaaaaaggacgtcgttgcgaagccggccggcgcattggtcaaagtgaagaaagagtcgaagaagaagcagcgacggcaattggcacgtggcgaattctgagtgacccgaggacatccccgaaccacactctctttgtgcggcttgttttgttatttggtggcgataaaatttgttgaaccaaaaaaaaaaaaaaaaaaaaaaaaaaaaaaaa

SEQ ID NO: 48685 - DNA, 671 bp, Heterodera glycines
  SCN-specific regions: Sequence locations=1-49,71-553,577-671
tttgagtctaaattctgtttaatgtgtcaatgagcaacaacgacatcatttttggaaatgaggaaggcgttaattatttggcaccatggacatattcctgtctcatcaaaacttcgatagatcggttgaaaactgctttatctgagaatcgtgaagccatacatgctttaaatcatttacaagaagtctttcgtcaaattgaccgtgcttctccctcctttctttatgatttctcaaaacttttgctgatcgagtcgggcgttgcaggaactaatgtgcaggaatcgtaccttcgaatgcatgcaaacgcggccacagaagagctggaactgccacaatttgcacacattgcagaatttcaatatttgtcaatgagagctgtttcactgtgcaaggtgcttgccagaattccggacgaaatgactgatagaaggccatttctggagaccatcaaagagattgcttcgtccattaagcaattgttggacacgacaaacgcgatcattgctcttgtgcctcgctgctaccaacctcgtcagattaatttaactccttttctttcttatttttaaaattggttaagtgttgagaaacgtaagagggaatttgtacaagttagcaaaagggtcagcagcacattgaaggattattttaagcaccaagagcccaac

SEQ ID NO: 48686 - DNA, 723 bp, Heterodera glycines
  SCN-specific regions: Sequence locations=1-113,135-723
cacaatatacctatatgttaattatgtcatttcggtcagcagcggcattagggcttaacttgcgtaaagcatccaaatttgtgttgttcggcgcattggccaccggtggcagtgtgttgctgtactcgttggagaatagcggtgcgcgtgcctacgactttgttgtgcacccgagccattttttttgggttcgtcgcggttaccaagtgtacaagcaagtgtgtgccgcatgccattccttgaaattcatccgttacaaccattttgtcgacaatttcatgacacgggatgaggcgaagacggaggctgccgagaaaaatgctttcacaagaagaaatttttcgaaatacacgaactgttgcccaaggattggatgcattgagggaagaaaatgaggccatcaagaacaaattgttggtagggatggacgtgttgacacctgatgaacgtcaactcatcgatgagaaggcgtcaattgtggaaaaaaatcttgaaaacatccaactcggactggaagaatcgcaggtgatgttggcattggcatcgcatttacaaaatttggaggcggaaaaacaaaaatataaagcgcaagtgcgtcgtctttgtcaggaaaatgcgtggattcgggacgagctgaactcaacgcaacaacagcttcgccaatgcgaacaagacaaggcacaactcgaggaagaaaacaagcactttgaaattattgaacag

SEQ ID NO: 48687 - DNA, 653 bp, Heterodera glycines
  SCN-specific regions: Sequence locations=1-48,70-653
gtttgaggtaaaatttgtgcgtaaacacagagccaacaacatgggatctcgcagtgtcgctggtggtgttggtgcttcgattatgaacaaacaagccagcaaatacaacgagagtgagggtgagctgttgctcaactggatcaagcaggtcaccggtgccacaatgacggtgaacggaacgcgcgaaaacttccaagcacaactgaaggacggcacattgttgtgcaaggtggcactgaagctggaaccaaactcgatcaaaggggtgacggacaaggccagctccacgttccagcagatgagcaacttggagctgtttatcgaattctgtcgcaagcagggagtcatcacgcaggagttgttccgcgccgtggacctggtcgaggcgcgggacctctactcggtgtgcatgacgctcaactcgttgggccgaattatgcaaaagaagggcaaatcccacccgaagcacgtgtcggcatccgaaattgtgaacatcccctccacggatgcgcttcgtctttgatcagtgatcaaacattgaaaatggggtgggtatgcggcaccaaatttttgcagtgatcggagttattggctcataaagatgtgtgttccgtttattggcagttctgtgaataaatttggcacttggaaaa

SEQ ID NO: 48688 - DNA, 1564 bp, Heterodera glycines
  SCN-specific regions: Sequence locations=1-214,236-309,342-495,523 -525,547-660,684-733,783-864,919-975,1012-1072,1094-1104,1126 -1128,1228-1479,1519-1529
gagatttacaatctcttagggatgctcagttctttccccttattattgtccttggtcggcctcatcgccgtccacgccgaagtcttcttcaaggaggagttttctgatgacagttggactgatcgatgggtcacgtcgaagagcaaggatgactacgggaagttcgagctgtccgccgggaagttcttcggggacaaagtgcgggaccagggcctgaagaccagccaggacgcccggttctacgccatctcggccaagttcccgaagaagttcagcaacaagggaaagccattggttgtgcagtttaccgtcaaacacgagcagaacatcgactgtggcggcggctatatgaagctcatggcttctgacatcagccaagagaacttccacggggagacgccgtaccatctgatgttcggcccggacatttgcgggcccggcactaaaaaagtgcacgtgatcctcggctacaaaggcaaaaaccagctaatcaaaaaggacattcgctgcaaggacgacgaactcagccacctgtacacactgatcttgagcccggacaacacttacgaagtgcaaattgacggcgaaaaggtcgagagcggcgaattggaggccgattgggaccttttgcccgcaaagaaaatcaaggaccccgacgcgaagaagcccgaggactgggacgacaaggaatacatcgacgacccggacgacaaaaagcccgacgattgggaaaagccggaacacatcccggacccagatgccaagaagcctgatgactgggacgatgaaatggacggcgattgggagccgccgatgatcgacaacccggaatacaaaggcacctggaagccgaagcagatcaagaaccccaactacaagggcaagtggatccaccccgagatcgacaaccccgagtaccagccggacgacgacctctacttgcgagaagattggggcgccatcggaatagacatttggcaggtcaagtcgggcaccatcttcgacaacattttggtagcggactctgtggaggacgcgaagaaacacgcggcggacactttcgaccagctgaaggaggcggagaagaagcagaaggaagcgcatgacgaggaggagcgcaagaagttcgaggaggaagagaagaagcggaaggaagaagaggagaagaagccgaagattgacgaagaggaggttgaagaggacgaggaggagaagaaggaggaggagcacgacgagctttaggacggcgcccgaccattggccttgtcactttccatcctcaatgattgcaccttcccgggttctccctcatctcttcttttcggtatttaatggcaatttgttatttaattggttcaagagggactgttcgatgattccttcgaccgcccacaatggtctctctcaccgcctttttgatatttctttctgaaagtgaataatgaatgaatcgctgactcccatctttcctccgtgcttgttgtttttcttttgttcttttacataaaaatatttattgtcccaatttgaaaataaattgttaatttgttaaaaaaaaaaaaaa

SEQ ID NO: 48689 - DNA, 721 bp, Heterodera glycines
  SCN-specific regions: Sequence locations=1-506,529-721
gtttgagctaattatggcacggaatcggccaaatgctaatatcataacgagtgatctcggcgaggcacaaataaaaaagcacaaaccaaaagacacgaggttactacaacagagactcgttgcatggcagcctattctgaccgctaaaacggtcattccgttggttttcagtataagcattttgttcatcccaattggaattgttcttcttcgcataagtcaatctgtccaggaatatgtcgttcaatatgtaaacgatgccaacgagtgcaaagactaccatgcgaatggccaatgcgcagtgaacttcactctgaatgaggacttcaaaggcgatgtttacttttattatgctctcgagaatttcttccaaaatcatcgtcgttatatgaaaagcagaaatgatcagcaattatcgggcattgattttttaaataccaaagattgtactcccttcgagaaagctccggacggtcgtccgatcgccccttgtggcgcaatagcaaattcattattcaatgattcattccaactcaattatcttgggggcaatggttatgcaaatatttcatggagtcacgaagggctcgtctggccggtcgatttggagtcgaaattcagaaaccccacttgtgatggccagccatgcaaaacaatcgctgaattgtgtcacaaattttccttaaccgtccgaccgcccaactgggaaaaggacctctgc

SEQ ID NO: 48690 - DNA, 1439 bp, Heterodera glycines
  SCN-specific regions: Sequence locations=1-165,188-1172,1195-1439
tttgagataatgccaatcatactgaaccaaggcatattatcaaccacatgtgatgaccagcaaagagagacgctcaagcttcaacttgagccagcagcagaatacaatgaaacaaattttaaacgaacggtgttaaatgcgtccggtacaccaatcaatggagcgttcactttttggtcagccccttccactgctgctccggcagcgacagcatctgtctccaatttatcggccacaacaacagttatctcatctgaaccggatctcactccactcacaccgtccacttcggacgtgacagttaatggccacagcagcaatgtgaaggtgcttaagccggtgccgttggtgatccgaacccaaagtgcggacgaaattgcgggtgccgttgcgcacccgaccaaaccgtcggagatccggaaactgatccggtcaaagatggcccgatgtcgcatttgcaggaaccgttttctggacaagcacatttatgagcgacatttgcgcgacaggcatcccaaggaacacgcggcttatctgagccaacaggaggacgaagttcgacagcaaagaaaggaagaatttgaagcgaaccgattagacgaactcgtcaggggcggtttcattccgcctcaggaggatttggatgcatcgaaatacgaagtgaacatcaaagagattccattgcccggcgaattgaccggcggcgtgcccgcccggtttgaccgcttcggtgtgctctttcaaccgaagcgggtgtacaagaagaaggtgtcaccgcagtgcccattctgtgacaagcgctaccgcaacgaatattcgctgaagaaacacatcgccaaaaagcatacggaatgcgcggaatgggcccaatgtttgaagtgcttcaaggcggtgccgagcaaggccgagatggtggaccatctgggtgaaatgatttacctctgttttgaatgtgtgccgccgcgcaatctgtgcaacgacgtgcgcctgtacaaccaccggacaaaattccatcgtggccaaaattcggggttcaaatgcaacctgtgcaatcagaagtttttgacgccgcgcaagttgcgcaagcacaagaaaatgtcgcatgtgttcaccaagacttaccagtgccatttctgcgaggaactgttcatcaacgaaacggcggtgaccacccacgagcgcatccacacgggcatcatcaaatttgagtgcaaaatttgtgactacaaatgcaatcgtttcctgaacatggaggaccatgtgaaggaggaccatggctatctgtgctccatttgtcagagcaaactcagcgaatggggtgacctcaaaaatcacatgctcatggaccacggcggctatctgtcgtcagagttcaactcagggtacatcgaaagcccgcgcgtttggctgatgttcaagggggactgattgatttgacg

SEQ ID NO: 48691 - DNA, 786 bp, Heterodera glycines
  SCN-specific regions: Sequence locations=1-364,387-761,783-786
gagttcgtgatgatggttaaatcggcactttctaattcattgagtattctcaatggtttcactagtcgcgctttcaccacctccaacattaggagtttgagattccgttcgcaaaggcctcaaaatgagctgaggacagttggaaaaatggtcgcccaatcggacagtccgtacgaaaagggacaatgttttgttcacaaattgtttgcttacaggggagttattatccgatcgaaaaattgctcagtctttacgaaacgaatcagcgacacgcaaactgtgcaacaggaagtcctccccttttaccaagtgctcatagacaaagatgattggtcggaaatgaattttgagacggacatgaccacctttttgaaatccaccgggaatcgtgaagaaaccgccatcagcggaatggacatcgtttcccacgacgaaattctgccctttgagccatccgtcagtgaattgaagtcgctaagtgatgggagcggcgaagcagctcccataaaacattatctttacgaccaactgttcaagaagaaaacaggcgaagagacgaaaagggacgcgggcgtcaatcggcaaaggcctgaagaggaaatgtgctggatatttccaattgctgtgacgaaacagactacggattgttttgaagtgcaagtcagcactttcaacttgggttcaaataatttgaacagaagtcatagccctcacaattggcgcattgttttgcgggttgagaattcacagaacaacaccatgtatttgagaaataccgtactgaaa

SEQ ID NO: 48692 - DNA, 1350 bp, Heterodera glycines
  SCN-specific regions: Sequence locations=1-12,97-192,225-315,348 -408,432-555,585-645,667-810,843-912,957-1065,1102-1176,1254 -1282,1316-1350
ttagaataaatacaaattattttaaaaatgcgtgaaattgtccatattcaagctggtcaatgtggaaatcagatcggttcgaagttctgggaagtgatttctgatgagcatggaattcaaccggacgggacttacaaaggcgaaacggacctccaacttgaacggattaatgtctactataacgaggcccatggtggcaagtacgtgccccgcgctgtgcttgtggacctcgagccgggcacaatggactcaatccgggccggaccttacggtcagcttttccgtcccgacaacttcgtgttcggacaaagcggagcgggcaacaactgggccaagggccattacaccgagggagccgaattggtggacaatgtgttggacgttgtgcggaaggaggcggaggggtgcgactgtctgcaaggctttcagctcactcattcgctcgggggaggcaccggttcaggaatgggaactctgttgatctcaaagattcgggaagaatacccggaccgtattatgtcttcgttttctgtcgtcccttcgccaaaagtttctgacactgtggtcgagccttacaacgccactctttccgtccaccaactcgtcgagaacactgatgagactttttgcattgacaatgaagcgctttacgacatctgtttccgcactttgaagcttcaaaaccccacatacggggatctcaatcatctcgtttccgtgacaatgtccggagtgacgacttgtcttcgttttcctggacaactcaatgccgaccttcgcaaacttgccgttaacatggtccccttcccgcgtctgcacttcttcatgcccggctttgcgccgctttctgcgaagggagcggctgcatatcaagcgtgttccgtggcagaactgaccaaacaaatgttcgacgcaaagaacatgatggcggcgtgtgacccgcgccacggccgttatttgacagttgcggcaatgttccgtggtcgaatgtcgatgagggaagtggatgaccaaatgatgtcggtgcagaacaagaactcctcgtacttcgtcgaatggattccgaacaacgtgaagaccgctgtctgtgacattccgccccgtggcctcaaaatgtcggcaactttcgtcggaaactccacagccattcaagaacttttcaaacgcatttcggaacagttcactgctatgttccgtcgcaaggctttcctccattggtacaccggtgagggcatggacgagatggaattcacggaagccgagtccaacatgaacgatttgatctccgagtatcagcagtaccaagatgccaccgttgacgatgagggcgaatacgaggctgaggacacc

SEQ ID NO: 48693 - DNA, 695 bp, Heterodera glycines
  SCN-specific regions: Sequence locations=1-695
tgagcaaacgacgcaataaaatacaagccgaagaaaagcggaagaaggagacattgaaggcgactctcgacttggacgaaatatttggcaacgaaaacgaaggtggaaaatcggccggcagcagcagttcgtcgacgagttcttcgcgttcctccagccccgacttgaccaagtcacgttctccttctcccgaagtcaaacaagagattaaaacaagggatgaaattatccgttgccaacttttccggcgaaagctcgcgaaatttgttcatgctccgttcttcgctaaaacagtggtcggttgtttcgttcgcatttcaatcggtcccaacaaatcggatgggaagcaagtgtacagagcggctcaggtagtcgaagttgtggagacagcaaaagtttacgaagtcgagccgaacagtgacatccgtacaaacaaaggctttcgcctcaaggtgagcgatggcgagccaatgcgagtctatcggttggagttcgtctccaacagtcttattatggaaagcgagtttctgttttggttcaacaaaatgcggtcttcgaacacgcccatgctaaccgtcgactttgttgaccggaaaaggaaagaaattgtgaacgcactcaactacaaatacaatgaggcggagatcaatttgctgatcaaagaaaagcagcgcttcaaaagacaaccgaccaat

SEQ ID NO: 48694 - DNA, 1371 bp, Heterodera glycines
  SCN-specific regions: Sequence locations=1-135,177-246,268-289,825 -825,1044-1048,1083-1088,1231-1315,1358-1371
gtcgacgacagcacacacagccgaaaagcgcttcttctcatcgccttcgccttcaaaacttagaagcaccaatcccaaccagaaaaaatgtgcgacgaagaagttgctgctctcgtggtggacaatgggtccggaatgtgcaaggccggtttcgcgggcgatgacgcgccccgcgcggtgtttccgtccattgtgggccgcccccgtcatcagggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgcgtgtcgcccccgaggagcacccggtgctgctcacagaggccccgctgaacccgaaggccaacagagaaaagatgacccaaatcatgttcgagacgttcaacacgccggccatgtacgtggccatccaggccgtgctgtccctgtacgcctccggccgtaccaccggtctcgtgttggactccggcgatggtgtcacccacaccgtgcccatctacgagggttacgccctgccccacgccatcctccgtttggacttggccggccgtgacctcactgactacctgatgaagatcctcactgagcgtggttactccttcgtgaccacggccgagcgtgagatcgtccgtgacatcaaggagaagttgtgctacgtggcactcgacttcgagcaggaaatggccactgccgcctcctcctcctcgctggagaagagctacgaactgcccgacggccaagtgatcaccgtcggcaacgagcgcttccgttgcccagaggcgctgttccagccgtccttcatcggcatggagtcggccggcatccacgagtccacctacaactcgatcatgaagtgcgacatcgacatccgtaaggacctgtacgccaacaatgtgctgtccggcggcaccaccatgtacccgggcattgctgaccgcatgcagaaggagatgaccgcgctggccccgtccaccatgaagatcaaaatcatcgctcccccggagcgcaagtactccgtctggatcggcggctccatcctcgcctccctgtccaccttccaacagatgtggatcagcaagcaggagtacgacgagtcgggcccgtccattgtccaccgcaagtgcttctgagcagcagctgcacgaccgcacggaggaggaggagaagaccaacgaagccgggacactcgccatccgccgacccattcgccaccccccaccaccatctgttttttgctgaaaattatgcaaaaatatttttgaataaaatctatgaacaaaaaa

SEQ ID NO: 48695 - DNA, 1314 bp, Heterodera glycines
  SCN-specific regions: Sequence locations=1-123,145-1314
gactgaatctcaaaaatgaacggttctctgacaaatggcaacaaagtcgaccgcggcgtcaccattcttttgggcgcccaatggggcgacgaaggcaaaggcaaagtgatggattttctcatcggacatcacaagattgacattgacgcgcgatgccaaggcgggaacaatgcgggccataccgttctggcaaatggccgcgagtatcatttccaccttttgccttccggattggcctcaaaaaaggtgttgaacattgtcgggaacggagccggcctcaatttggacgcccttttcgaggaattggagagcaacaaaattgaggattcggcagaccgactgttcgtcagtgacagcgcccatttggtgttgcctgtgcacatcgcaacggatatcatgcggcaaaatgcgttgggacaaaactcaaaactcggcaccaccaaacgaggcattggtcccgcctattcgagcaaatgcttccgcaatggcatacgactgggcgaactgctccaccaaccagagaaatttgaacaaaactatcgttcgctggtcgcccacttcaaaactcttttccctgacattgaattggacacggaaagtgacgtcaaacagttgaaggcccatgccgcacgtcttctccaaatgggcattgtctgcaacacaaccgttttcctgcacaaaaagcgtttggagggcaaatcgattttggtggaaggagccaacggcactctgttggacatcgactttggtacctatccgttcgtcacttcgtccaattccaccgtcggcggttgcatcaccggccttggcattccgccgacagccgtccgtcgcgtcatcggcgtggtcaaagcctaccaaacgcgtgtcggctccggtccattcccaactgaactacttgacgccgatggacagcccagcgaagagggcaaacgtttgcaagaagttggtgctgagattggcgtgaccactcgcagaaaacggcgctgtggttggcttgacttggtgctgttgcgttattctgcaatgatcaacggattcacttctttggctgtaacaaaagtggacatcctggaccaatttcatgaaattaaaattgccattggttacgaattgaatggacggcaaattgagtaccctccagcgaccgtcgatgattgggcaaatttgtgcgtccattacaaaacctttgagggttggcagtcgccaacgaccagtgcccgtcagtgggaacagttgccggacaaatgccgtgcctatttggagttcatacaaaatcaactgggcgtacccgtcgaatacatcggagttggg

SEQ ID NO: 48696 - DNA, 1470 bp, Heterodera glycines
  SCN-specific regions: Sequence locations=1-360,382-666,696-1470
acgctctcttcgtcggacgtcggtggtggcaatcgcagtagtaacagcgagcactcctcagccgacaacactaaccgaggaaagaaagcggcaaaggtggtggtgaacaagaggagggaagtgaaggaatttgtgttggtcggaggaggtggtgacgtgaaggaggcagaagtggccgccggaacggtaacacttccggaaggagcagcaggggtgggaagagtggacgacccgaggcgggaaaacagcaaccgaatggttgccgcctgtgttgcgaccccctccgtcactgttaccgccaccgccgccacttatttcaatcacaatcagacggggtttgccggcactctcggaggtggtggtggttccaaaaaagggatggaggcgaacagtaacccatccaaagcctcgaaaggagtgaccatgaccaccgcagaggtggaccagctcaggcaacagctgcaatcggtggttgaaaatggagatctcactgcttcgaatgtgtgtgttgaacagttggaaagtgcggtgttaagcaaggatacactcgaggcaactcgtatcggccgttttgtgaacgacgtgcggaagcagactgcccagcaatggcccgacttctccaaacgttgtcgtgcgctgataaagcaatggcagaaggtggcagagtacaggcccagctcctcctgcgaaggctcttccaatggcggcactcctcagcttgtctcgccggctttgaagcgcgggctgacaccacgggcgggggccgtgacgacgcccggcaaacgcacaacaccacatcaaccgcaacaacaactacgggtcacttccacagggctttgccctccagattctcgccaacatacgggtcgttcgtcttcaactttggcctcctccgtttcgccggtggagaatggcgtgccgacagcgagcggaagttacgcgccgctgccgtcgactgtcaaaaaagagtcgcctcgacagatcacagcaactgttcagcaacaacattccatacacaagtccgcctcagttggtgcctccctgagctgtctcggcggctcatcggctgcaaagcgaacagggccaatgcttaatggcattgccgaagatgggggaacagtcagcggaggagcgcacttggcctccagctctttctacggtacccggccgtttctttagatggctctaacccccgcctcgttgtgttgtggtacagccgacgtgacgaaggatttgagagctgtacaaccgtcgctgacggcgccttccgcgccattggcctctaatccgccattgacgctgaagttgaagcgttctgccagtggagtgcaacgactgacctcctcgctgtcgccaccgtcggacaatggcattggtgcagcttcgacttcgtcgtcagcgccgcttgttgctcaacaacctcttcagcaactatcggtgcttgctgcgcgacaacaaaatgtgcaatcg

SEQ ID NO: 48697 - DNA, 1218 bp, Heterodera glycines
  SCN-specific regions: Sequence locations=1-123,145-469,491-1218
tggaattgtgccttttatgggagatacgccggaggcgttatttgccaacataattaatgaagacgtggaatacccggagggggacgaggcattggattcggatgctgagtcgttgattcatcttttgctggagaaaaatccgctggaccgactcggaaccgtcggcggtgctccccaagtgtccgcgcatccgttctttgcaccactcgactttgacacaatcttgcggcagaaggccgagtttgtaccccaactcgagaatgacgaagacacttcctacttcgactcgcgctccgaccgttacaaccacgacgccaatgagtcagcggaggacgacgacgcggcggcggtgccaatgttttggtccttctcgacggcatcgcctcggcatagcattgtcgggttggaattgcccgccgggggaatggcaatgcttcaggccgcccatgcagcagcaattgaacggagtgggcagccgctgcagcaacaagaccgaattgtggacgatgaccgggtcgagagccgcagacgactcctttcctcggcaaccaccgcttcttccggcattggcagcgggccaaactcggcattcggtccattgtcctctacacttttaacgcgtggtggcaattgctccgactcccaagattcttcccacgaaagtgccgttggcagacgagcaaccgctgctgcttctgaattcgcttgcgatgtgatgccatcggcagtcattctgcgacggcgtttctccaaccagcggcaccatacaaatgattcgtcaaccagcagttcggctggtacaacaattggtacaacagcgggcggtggggtcggttcatcaacagacgactcgtcgtccttggacatagcgacgacgatgcatttagaacagccgagacggtcccagggacagttgccgagacttgcaatatcaccatgcggtaccactttcaactcttcaactgggggtgccattgtgacacaccaacgggaaagtgcgtgtggcaccggcggggaattcttgtcgccggtcaatgaacggcatatcactgccggaggcggaagcggtggaatgaagcggatggagaagcgtccttccgccgttgtacacgaattgataaccgatgtcgtccgtgtgtcctcctcctatgggcagtctttggcccgtcagtctcgctcctcttcatgtcgcgtcagtaacatgtctcccggggccgc

SEQ ID NO: 48698 - DNA, 948 bp, Heterodera glycines
  SCN-specific regions: Sequence locations=1-33,55-259,281-472,496-948
agaattataataattacggagtcattgaaggcccattaaatggcttcataaaatgaacatttccaatggcagcgattggctttctgttcctcttctacctaatcggcctttcttttcctcagatttaaacagaagtggcgaatgttcgtcgtcgtccgctgctgccttttcccccccgccgttcggcgctccgttttgccaatgtcggccaatgcgaacggcagccaaagccaccacttccattgtcggccattaactctctttgcattgggcaacaacagcagcagaaaaaggcgacaaaaagccgaacattccgccgctggctcccctcagtcgctgacggactgttcttccgcaatgggcgtggaacttccgccgacgataaccgagcgactgagcactttgaagaaggatgtgatcgatgctttgctggacaaaaacgcggtgccccccgaactgatcacttcgctgatggccggcgtcggcggctcggctttcagcaaagcgctcgaattggtcccgtcgtacaaccaaaacttgcagaagatggccaagtattacttcacggcaaaaggcggcaaactcatccgaccaacagtttcgctgctgatgagtgccgcgtgcaatcaatgcgcgaaaaggccaacgacgccggcggacaccgccccgggcaggacaccaaccagcattgtcaatgagtcggaagaacagccaattgagatcagtatgaatcagtacaggatagcgatggtggccgaaatgattcacaacgccactttggtgcatgacgatgtgattgatgaatcgaacacgcgacggggacagccgacggcgaacgcccggtggggcaacaaacaggctgttttggtcggagattttattttggcacgcgcaacaaaagttttgtgcagcatcggagagccgcccgtcattgagacaatggctgag

SEQ ID NO: 48699 - DNA, 967 bp, Heterodera glycines
  SCN-specific regions: Sequence locations=1-685,708-902,925-967
aaccgattggaagtgttggacgcgtcgctgcgcagggccggccgattcgacagagaaattgcgctgggaatgcccgaccaaagagcgcggatggaaattctgaaaatagtgacgaggcacatgaaactggacgtggacgtggatttggctgtgcttgcccgactttcgcccggttatgttggcgccgatttgctggcattggtgcaggaatcaaattcaaaggctatcagtcgtgcgtgctctttgttccgtcgttgatgcgaatgtaaacactgagaatattgtggaaaatttcccacctaaaaacatcgacgacattcgtggagaactgacaagaaccttaaattggcttaacactcctttcgccgagcaccaaaaacgattgaatatggacgaatttcgcgtgcgaatgtctgacttcgaatgggcccttcgcgtggtcaaaccatcggcgaaacgagagggattcgcgacggtgccggacgtgcgatgggaggacattggggcattgaacgcagtcagagaagagttgaaatggtcaatattgtaccccatacaaaagcccgaactgttccaacactttggcacttccgcacagccgcaaggcattttgctgagcggaccgcccggttgtgggaagactttgttggcaaaagcggtggccaatgagacgggcatgagttttatcagtgtgaaagggcccgaactgctgagcatgtacgttggcgaaagtgaaagggccgtcaggacagtgttccaaagggcgcgtgattcggcgccgtgcgttgttttcttcgatgaaatcgacgcgctgtgcccaaaacggtcgcaaagagagaacagtggtagttcacggctggtcaatcaattgctcaccgaaatggacggattggatggacggagaaatgtttttctgatcggagccacaaaccgaccggacattgtcgaccccgccatcactcgcccg

SEQ ID NO: 48700 - DNA, 814 bp, Heterodera glycines
  SCN-specific regions: Sequence locations=1-748,770-814
attttctttaattagttagctaaaattctcaatggatgatttgttaaatgacatcgatgaagatcagcagcaaagcgaaagtgggagcagttcgcttccaccgcagtctgttaacacgatggcttggctggaacaaaacaaacagaaccaagcgcgggcattctccgagaatttgttgaaagatttgagcgctgtttcagagacgggcaaatctgctgaatttaacgtcaaagatgaaatggaatgttaagcaggagacgaagaggagaatcagttcattcagaattgtcagcggattcgttcttaccaagtggcttccgagaagaattgcaaccacgaggcaatcgtcccctatgacgttgaatatcaacagctaaaaaagaccaacaccccggcaaagctttacgagttcaaactcgacatgttccaaagccaggcactcaaatgcctggacaatcaacagtctgtgctggtctcggctcacacatcggccgggaaaactgttgttgccctctacgcaattgccatggcattgcgggacaaacagcgagtgatttacacgtccccaatcaaagcattgagcaaccaaaagtaccgtgaacttgttgaagagttcgaagacgttggccttgtcaccggggatgtgacactgaacccaaatgcatcatgtgttgtgatgaccaccgaaatactgcgttcaatgctttaccgaggctgtgaaattgtgagagaagtcggctgggtgatctttgatgagattcattacatgcgcgacaaagaacgtggcgtcgtctgggaagaaactctcatttta

SEQ ID NO: 48701 - DNA, 644 bp, Heterodera glycines
  SCN-specific regions: Sequence locations=1-644
gtttgagccaaatgttcgacttccatcaattcatgggtttgggcggtggtgctgtcgccacttattcagtgcaattgcgtgccttttctgcgccatttttccagcgacacgatgaacgaagaatcaacgaactcaattacggcggaaagattctgttgccaaattcgtgtctcgacaatttgatgcgtcgcaacattcagtacccgatgctcttcaaattgactaatgtcggcccggcccttcagaggggcacccatgccggtgtgctggagtttctggcggaagaaggccgctgctatttaccttcctggatgatggcccaactcgctctgagggagggcgacctcatcaccgtggagtacaaagcgctcccgaatgccacttacgccaagttcaagccgatgtccaccgacttttacaacatttcaaatccccgtgccatgctcgaggtcgaactgcgcaagttttcctgtctgaccaaaggcgatgtcatcgcagtgcagtacaacgaacaagtgtacgaattccaagtgaaggcactgaagccggaaaatgcggtgaccatcgtcgagtgtgacataaacattgaatttgacgctgcggaaggctacgtggagccgaacagaacgcatcaacaacggaat

SEQ ID NO: 48702 - DNA, 716 bp, Heterodera glycines
  SCN-specific regions: Sequence locations=1-27,62-716
ttatttaaatctgagaaatgccgtcgcgaaatttgtcagcaaagaaaaaacaacagaattcgttagttcgggatgagtcgacctcttcacccagcagaacgcccaaatcggtgtcgaaagcgagtaacagcaacagtagccaacagaaacttcagaagaagcagaattcatcagaactgtccacgattagcagtgaaagtgtcgaaaaggatctcagctcttcaatgtctaccaatccgcacggacatccgacggacaaaaaatggaccattggggagaaagtgttatgccgttatctgaactcggagcacatttattatgaggctaaagtgatgtttctgaaagacttgtctggcggagatgtcggctatggcattcattatccgggttggagcaaccgtcacgacgaagttgtaccacaacatgaagcactaattcgcttcaagaattactccgatgaagaggcaaccaaggcaaaggaagacgtgaaaagggctcagcagatgctaaatgccaaaaaaagaaagcgatcggaactgaagaaccgctcgcaagcgcatgatgaaagtagtcgctccagcacaccaggaagcgccgacaacgcatcaaaacgtaagatcgcccgtcggacgacaattgaaactagcgcagtggccaaaaaggacatgccccaagtcacattgaccgaccctttgcgacgcattctgatagacgac

SEQ ID NO: 48703 - DNA, 637 bp, Heterodera glycines
  SCN-specific regions: Sequence locations=1-637
catgatgatcgtgtgccagcatttacggaacttacgcttatcagacattcacccgactctgagaatattcaaatgcaattcgccgcgttttttatttacagcggccttggaagattgatgagaccagttaggaaccttttatttgatcaaatcgagcaaataggaatttttgaacaagtttacctttccattataattgaccccgaagaggcagaaccgggcgtaacaatgcaccaagaacttcatccctcgtctctgttctcattcgctggcaatttgattccttttcccgatcacaaccaatcgcctcgaaatgtgtatcaatgtcaaatgggaaaacagacaatgggggtcccagtccacgcttggcagacgcgtacggacaacaaaatgtacaaattgcaaactgcgcaaaaacctttactcaaattggaggcccatgacaaatacgaaatggacgaataccctctaggcacaaatgcgtgtgtggccgttatttcgtacactggatacgacatggaagatgcaatggtgatcaacaaggcttcgtatcagcgtggctttgcacatggaactgtcgttaaagtgcagaggatcagtttggttgatcgctccaccggtggttttggtcagaaca

SEQ ID NO: 48704 - DNA, 640 bp, Heterodera glycines
  SCN-specific regions: Sequence locations=1-145,167-640
cttccttggattgagttcaagaaatgtctttcctcaaagtgttcgcccgtcgtctctttttgcatgtcacttttcttcgggtaccaacgatgatgttttatttgaacgggtcaatcaaaaattggtcatcacgctgaacaggcccaaggcattgaatgctcttaactttccgatgattcgcaaaatttacccccagcttaggaattcttccttcgatttggcacttgtcaaaggtacgggtggtttagccttttgtgccggtggcgatgtcctcgctgtctcaaaatcctataaggcgaatgatccggaccgaatttttcagcaatttttcctacaagaataccaactcaatcatttaattggatcactcagccgaccctacgttgccttcatcgatggcattacaatgggcgggggatgtggcctctcattgcacggggcttttcgcgcggctactgaacgaacaatattggctatgccagaaacggcacttggcctttttccggatgttggcggaacgtactttctgccgcgactcagcggtcaactcggcatgtttttggcactgacaggttttcgtctccatggtgcggatgtgttccatgccgggctggcgacgcattatgtcgagtcagccaaa

SEQ ID NO: 48705 - DNA, 897 bp, Heterodera glycines
  SCN-specific regions: Sequence locations=1-66,92-183,225-641,663 -860,883-897
cacaatttgctgtcccattgtttcccgatgctgtgaagaagcaatgcttgaaggaattgaaacagcgatatgaaaataaagaaattaaaagtccgccggaaaattttgaagaatgggttctgcaccattttggaccccaaattttggatgtgttcttcaatccgtactccaaaaaagtgtggacagtgaaaccgtcgaaaatgtctccaatttgggttggcactcgggtggcaaaattgccacaagaaaagctggaggaactgtgctcaatggatgccaatgtgttgaaaaatgccgattttggatggggcccaaatgcacaatttaatttcccaaaatacggtggcaccggcgccgtgtggaaaaatatgacggagaaattgccatcggaatggttcaaatataattcaaaggtccttcgcgttgaccatcgccaaaagtgtgtgcattacgtccaactgaatgccaatggtcagccgacgggcccaacaaagtcactgaaatacgacgcactgatcaactccagtcccatcgacgcgttcgtggcggacaacaaaatttgcgagatgccgttgttggagcacaacaaagtttttgttattggcgtcggattgaaactgccaatgactgagttttgcgagaaatacacttggctctactttcctgaccctgacgtgccgttctatcgtgtcacatttttcacggtatggtgaagtaactccggacaacaccaaattttggtccgttttgtgcgaatgcgcacggcccagcgatgacacgatgaccgaggccgaaattcgccaatgggccatcgagggtctgatcaccaaatcgatcattaaacgtgagcaaatcatcaatgaatattccatctgtttgccctatggctatccgatt

SEQ ID NO: 48706 - DNA, 714 bp, Heterodera glycines
  SCN-specific regions: Sequence locations=1-714
aataccatcacggcccggctgattttaaaattccagtttcctcattatcaactgtgcttctattgatttacgtacctttttatgatggacgaggacatggaagaagtcgaaattgtttttgctcagcgattggccagcggtgaaccaacggcacgacaaagggccatgaaacacttgcgaacgcacataagagaaaggacgaaaactgatgcaaagggcttttcctctgtttcgttagcgcgactttgcaaagggttgcattatgcgctttggatgcaggacaaaatgactttgcaggaggaacttgcggatgaaatctgcgctctttgcaactattttcgcaccgacgagcaactgcttgaatttgtcgttgttctgttcactacgctttctaaggaatggccgtacatcgaccggtggcgaatggacaaatttctcatgttggtccgtcgtttggttcgcactttgttccgtcgattgtcctcccaccgctgggacccgccattgtgtgaccaatttttgcaaatgttttgctcttcgctgctcagtgccaattcgcctttatgcgagtctttgaaattccattgcgcgtccgtttggttggacgaattggacacagcggcaacagcgaaagtgacgccgagcgaagggaacgccggcaaaaattgcgaagcctttccattggatgcacagcgctcgttggactttgtttgg

SEQ ID NO: 48707 - DNA, 700 bp, Heterodera glycines
  SCN-specific regions: Sequence locations=1-105,128-700
atttggaccaaatgggcgagtcgacttgggccatcaggagttccaagccgtggtcgaccatttcgcggtacggccaataccaagcggagtcctttcgccattctctgaaagaggaaacggaaaaactgcgccaggccaaccccaaattgttccaacagcaaacgcccagcacttctgacacgccacccgtcgactgtgcttcgccagcaccgtcgaagaagcgcaaaacggccgcttcaatggccgcggggagcggaacgccgacgagcagaggccgcgtggaggagagcagcccgtacaaaatcatcaaattcggcaccaacattgacctgagtgacgagcgaaaattctatgtccaactgaaggaattgaacaaattgcccgccttttgtcgcctccattccgccagtaatatgctcagttatctcggccacaccgtttttgggatgaacactgtccaattgtatttgaaagtgcccggctgcagaacgccaggccacctcgaaaacaacagttttgccagtgtcaatgtgaacattgggcccggcgaatgcgaatggttcggcgttccttacgaatattggccggtgttggaaaatctgtgcaaagagcggaatatcgattttcttcgtggcgcgtggtggccgagtgtttcggacttggttaagtctgacgtgccattctatcggtttacgcaaaa

SEQ ID NO: 48708 - DNA, 1691 bp, Heterodera glycines
  SCN-specific regions: Sequence locations=1-54,76-112,134-306,330 -572,605-862,885-1398,1421-1691
gtttgtatatcaaattcaactcaaacaaactcgaaaaaaatacttgtttaaactgcagtgaaatggatttagggggattttaacctttaattaggaatttgatcacagttaaagaattaagacactttgttttatatttgaatgcattggcgttttttacgccaacaatttattggcgacttttcgttttttttaccgtccgtggaaaggggcacccattttgggccctttcctggcgaatgggctgggctgggggcgaccccgctattttgtatgttgttacttgaacagatttaagcattatttaattttctttttcaactgtcacagtttaaatgttggaaatgaacggtgttggaaattccaaagactatgacaccaaagtgaaggcaattctcgaacaatgccgaatatcacagaagctcttgaactatactgagcattttaactatccctatgtcagcgaagtgacatattacgagcagttgttgaagattggacaaggaacatttggcgaggttttcaaggcgcgttgcaagcgaactggcaaattggtggcactgaaaaaaattttgatggaaaatgaaaaggaagggtttccaataactgcacttcgcgaaataaaaatgctacaaaggcttcgacatcagcacataactgaactggtggaagtgtgcacaagcaaacaaaagagtgggaaggagaaattctgcttttacttggtgttcaccttttgcgagcacgatcttgccggtctgttgagtaacacccaagtgaaaattcgactggtggacatcaaaacgatgatgcagcacattctgcgcggattgcacaaaattcactccagtcaaatattgcatcgcgacatgaaagcggccaatgtgttgattactggtgacggggtgctcaaattggcagattttggtttggcacggataatgtataagcaaccagaacattgctacacaaatcgagttgtcactttgtggtatcgaccccccgagttgttattgggcacgcggaactacggcccggcgattgacatttggggcgcgggttgcatcatggccgagctttggatccgtgcaccaatccttcagggtaacaccgaacaatctcagctggagctcatttcgaaactgtgtgggtcgattaatccgcacagttggccaggtgtttgttggcgtttggcttttcctaaaaaaccaaatccgccaaagggtgtgacaagttgccttattacaacaatttgcaaggatcgttacagcaaaatttaccgagacgcgtgagagagcgtataaatccatttcttcagaacaatgagcaagccctttcgctcatcgattttatgctgacgcttaaccccgagaaacggccctctgcgtccgctgccttggaccacaacttctttttcgagacgcccatcccagcaataaacattcaggaattgctccaacagttaagagggaccaatttgttcgagtacacttcgggctgtggagctcatgctaaccgtcgtcggccggttgctcctgccgctcccatgcaccagcaacaaatacgcggaaaaatgccttctgttgggggagcgatgcatcgggcaacgggaggggcaccgcaaagggcacaacaccaaacggtgggcggtcctccaaacatccaccggtcaacgggcggagcaccgcaaaggg

SEQ ID NO: 48709 - DNA, 815 bp, Heterodera glycines
  SCN-specific regions: Sequence locations=1-80,102-620,642-815
attaatatgattggtgcgacttggataaagaatttaaaaatcactgcccagggacgtgagatttatgactctaactcactttatgcttataaagcatacttggatgccgaactttcttattccaaaaacgtaaaggagtcagacctacaggcgagcgggtattatgtggacagtgagaatcaggacggcacggatattactcagcagggttttgaactgagaagaaaattgttttcacaaagtcaaactgcacaatttattacaaaattggatgcagatatttttaatcaggacagatatatggtgaatggagttgagattgatatacaacttacccctaatgacaatgagtttatggtaatggcagcggccgacgataaatatagaatagaaattaccgcttgtaaattatatgttaaaactcttgaagttgttgatggtcttgcattagacatacagaaaaaacttgaaagcaaagaagcaaaatatgcccatagaaaaactttgatcaaatccacatttataagcgagaatcgaactgaatacaatggaacgctatttacgggtcaattacctaaacgagtcattctcggaatggtggagaacgctgcatacgtaggcaaccaaaagaaaagcccatttaattttaaaccatttgatattcgatccgtcacattgatagcaaacgggaaacaatggcccgcagcgccatttgagcttaatttcaacaaaaatttatataccagggcattccacgaaatgaatgaggcattaggtatggccagttcaacagacagtaacggaatttctcttga

SEQ ID NO: 48710 - DNA, 643 bp, Heterodera glycines
  SCN-specific regions: Sequence locations=1-314,348-578,601-643
ctcaaaatgattatcagcagcaaagccgtccaacttttgacttgctacagaaataggatcaccagaaaactacaatattcgactacggagaatgtgccggtgaatgtgcctgagccggtcatttcctcctccaacatggcacagttccgcaagggagcgggcggtcgttccagcttctcgggcaatgtcattacagtttttggcaacaccggatttaccggccgaagggtggtcaatcggttggccagacacgcaaatcagctaattttgccgtaccgctgcgattcgtattttctcagagaattgaaagtgccttgtgaccttggccaagttctgttttttcctttccaattggacgacgatgaaagcattcggaaggcagtcaaatacagcaacgttgtgatcaatatgatcggcacatatgtcgacacaccgaattattccatttatgacgccaatgtggagggtgcgtggagaattgcgcgcatttgtcgggaaatgggcgtggaacggctgatccatgtgagcgcattgaacgcggacccatcgtacaaaacgcaattcatcaaaaatggcgcctttctgaaaagcaaaggcatggccgagcaggcggtccgtgccgaattcccaagtgccaccatca

SEQ ID NO: 48711 - DNA, 1026 bp, Heterodera glycines
  SCN-specific regions: Sequence locations=1-506,532-694,716-1026
ttgtttggttcgtccatcggcacttcttcgccttttggcagcaagccgagtggtggtctctttggcgctgcgaacaccgcagttgtgcagcccagcacttcgaccacaacgcagcaggacatcgaggttccacaagctcccgatgacactgtgcaggcaatgaaattcaatccgctggtggccgggtctcccatttttttggctgctggttcctgggacaacacctgtcgcatttggcaggtcaatgaaaatggaatggttgaaccgaaggcaatgcaaaatgttggagcgcccattctttcgctggattggtcggaggacggctcaaaaatattcatcgctggtgcagacaaacaagcgttcgcctgggatttaggctcaaaccaaatggctgttgttggcacgcacaatgagccagtgcgaagttgccattggatagcgacaccccaatattcgtgtctaatgacgggaagttgggaccggacgctgcgtttttgggacatgcgccaattgcccacccaaaactccctggcaaccatccaactgcctgaacgcgtgtactgctccgacatggttttcccgctgatggtcgttgctttggccgacagacacatcaaaatgtataagttggacggaacaccctctgaaattcaagacgtggaatctcagttgaagtttcagagtcgttgcattgcgattttcaaagacaaaatgacgggacagcccaatggattcgctcttggctccaccgaaggacgagtggcgattcaatgtttgcagccaaaggacccgaaggacaatttcactttcaaatgccatcggtcagccgaactcatcaacaattaccaggagatttacccggtcaatgacgtcgcttttcatccgacccaccaaacattggccacagcgggcgcagacggaaaatattccttttgggacaaagacgcgcggacgaaattgaagggttccgatgccttgccaatgccaatcacaaaatgcgccattcattcgggtggaaacataatg

SEQ ID NO: 48712 - DNA, 779 bp, Heterodera glycines
  SCN-specific regions: Sequence locations=1-64,94-779
ccacggccaatttcctgacttgatgagaatcttcaactgcctcgggaccccgccggagaagaaatacctgttcctgggcgactacgtggaccgtggcgcgcaatccgtggagaccatcatgctgctgctttgctacaaggtcaaatatccgacatcgattgtgctgctgagagggaaccacgagacgagcaacatcaacgcaacgtacggcttcaaaaaggaactggaggaacgctatccggcccattcgcaagccctgttcgacagcttcaatgacaccttcgcgtggatgccgctgaccgggctaatcggccaaaaaattttatgcatgcatggaggcatcagcaacaaaattcgaagcattgaacagctcaaacaattggaacgcccgatgctgctaccgccgaccgatagtctgcacattgaccttatgtgggccgacccgatggaagcgcaaggacaacgaccgaatccacgaggcgcaggtgtcctgttcggcgaagatgtggttatcagaacttgccagctgctgaagatttcgtgcatcatccgagcgcaccaattcatccaatccggatttgagccaatgttcaaccaacgactcatcaccgttttctctgcacccgcctacacaggccaaacaaacacgggcgcggtactggaagtgaagacgtcgagccactttaccactcactttttcccgccccaatcccagtgattgattgtactttgtattgttgtcgttgttgtgtttataataaatgctcttttgtgcaaaa

SEQ ID NO: 48713 - DNA, 897 bp, Heterodera glycines
  SCN-specific regions: Sequence locations=1-289,311-670,692-897
aaaagtttcatcgattcggcaattgcatttgtgcgaaagcacggctttgatggcattgacatcgtaagagaatacccaaagggcggagagcagaagcgaaacttcagcagattttttaaggaactgaaagacgccgttcggaaagaagcgtcttcaagcggaaggccgcgtctgctgatcactgctgcggttgcggcggggacggaaaacattgacaacggatacgacattccgacagtcggaaagcttctcgactttgtgcttctgatgggctacgacttccatggctcgtgggagcagcagacggggatgaacgcgccattgtacggacggtccaaagatgtgccggagaagcgcttgtggaatgtggctggtgctgcgaattattgggctaagaagggcatgccgaaatcaaagattattatcggaatcccaacatatggccgtggatggacactgagcaacccgcaacaattccgtggcatcgaagcaccggcccaagtggcaaaagcgacaaaatttgtcaaattggcgggcatcggatcatactttgagttctgcgaaatgctggcaaacggtgcgcagcgttacgtggaccgggaaacgctggtgccctttttggtggcggacaacgaccagtggttcagctacgacgacgtggagagcatcagaaacaaactcagttggattcgccaaaactctttcggcggcgctttcgtgtggactttggactttgacgatttcaacggacaatgccccggcagccaactcggccgttacccgctgatccgcacaattgcccaagaattgggcggcatccaactctcacagacacccgtctcggcactttcgaattcgccttcgccgtctacgggcgcagctttgccggctgtcaca

SEQ ID NO: 48714 - DNA, 846 bp, Heterodera glycines
  SCN-specific regions: Sequence locations=1-147,174-308,330-714,737-846
tgagcgtaaaatatgcaagaaactcacattgttctcggcattgcctcgctgtgctctctgctggcgattatcgccaccgtagtcactctgccatcgctttactcggagatgaaccaactgaacaacaaagtgcgcgacggcgttgaagccttccgcgtcaacaccgactcggcttggactgacctgatggacgtgcaagtagtcgtggcaccaccgtcaaaggcccgtgacaacccattcaactccatcttccgtgccaagcgtcaattgcccggccattgccattgcggtcccccacaacggccaaactgccctcctggcccacctggtccgtccggaccgcctggccaacccggacagccgggaggcgcaggactgcccggacagccgggagcacctggacaacctgctcctccgtgcccgcctcagaacatcccgtgcccacgctgcccggctggcccacccggcagccccggaggacaaggaccgcccggacagcaaggagcccccggccagcctggtgcgcccgctccaggcggaggacaaggaccgcctggcgcgtccggaccccaaggacagcctggacagccaggacgcagcggaacacccggccaacccggacagcctggaaataacgctgttattttcaacaccattcctggcccgaggggagctcctggtgcgcctggccaaccgggaagtcccggcagtcaaggccaacccggacagcccggaggccaaggaccgcctgggccctctggtgcgcctgggctgcccggcctgtctggcaacagcggtcagcctggacagcccggggcacccggccaacccggcaaagacagcggc

SEQ ID NO: 48715 - DNA, 657 bp, Heterodera glycines
  SCN-specific regions: Sequence locations=1-195,217-657
gagaaaattcgtagatgggaaattactacagtccacctaaacgagtggggcagaaccctttcactcgttctggggcgccgccgcctaaattggtcattaggaaggacaaggatgtgccgatgcaccgagtcaatgacccgatgagtttgcagctgcatatggcggatgaacgcgttcggactgcgggactctcgaaggcggagagagagtggagagaaaaatgggttcatgaccagagtatgcatccggatgagcctatccatgtcgacgcggtccaccgccaactgaatccaatcagagtgctttatcgatggccaatggataagctttacaagcatttcttgcgaccaacttttgggaattactgggcaacgattatccgtgtctatgttcccaagttcttctggttctttatgacattcgaatttttctactacgtgtggaaatacgaatcgaagagttggcaaaaacgaattggcttttccactatcaatcgaccggatcgttatgtgcttgtcaaagaccacgatgaggagacgcttaagcttggcctgacagactacagccgatctgactattttgacaaggaattctaccagcgcattaaaacggccaacatcgacttcggccccccgaagaggccgtggtgatcgctgc

SEQ ID NO: 48716 - DNA, 560 bp, Heterodera glycines
  misc_feature (535)..(535): n is a, c, g, or t
  misc_feature (539)..(539): n is a, c, g, or t
  SCN-specific regions: Sequence locations=1-217,240-512,534-539
atttttaaagtaataattgatttaaaatgtctaagcgaggtcgtggaggcgcttctggggcgaaattccgggtttctcttgctcttcctgttggcgcagtaattaattgtgccgataacactggagcaaagaatctgttcgttattgctgtttatggcattcgcggtcgactgaatcggatgcccagtgccgccgttggagacatgttcgtctgttcagttaagaaagggaagcctgaactgcgtaaaaaagttttgcaagctgtcgtcgtccgtcaacggaaacaatatcgacgcaaggatgggaccttcatctatttcgaggacaacgccggagttatcgtcaataacaaaggcgagatgaaggggtccgccatcactgggcctgttgccaaagaatgtgccgacctttggccgagaattgcttctaacgccagttcgatcgcctaatttgtttgcgttattctgttgatttttgttacttggatgcaaaaattgttatttgtctaattttttcaattagtaaaaattctacngttnaaaaaaaaaaaaaaaaaaaaa

SEQ ID NO: 48717 - DNA, 728 bp, Heterodera glycines
  misc_feature (695)..(696): n is a, c, g, or t
  SCN-specific regions: Sequence locations=1-73,108-192,214-627,649-696
gtttgaggttttaaaatttttcgcagtcaattttccaacgtctcttctgtgaaaatgtcatctgacaagaacaaggaacgcactttcatcgccatcaaacccgacggtgtccagcgcggattggttgccaaaatcattaaacagttcgagcagcgtggttacaaattggttgccatgaaacttgccaaggcaactgtcccccatttggaggtccactaccaagacctcaaggacaaacctttctttgccgggctcgtcaaatacatggcatcaggcccgattgtcgctatggtttgggaaggtttggatgtggttaaacagggtcgcgttttgctcggcgctacgaatccgttggccagtgccccagggactattcgtggcaatttttgcattgagatgggacgtaacatttgccacggctccgattcggtgccttctgccgaccgtgaaattgcccattggttcaagccggaagaactcgtcgactgggaaagtgcgcagaatgcgtgggtttacgaatgatggaaagaggcaaatttgtgcagtgaaaggcctctgctttcgaatcgatgaccaatgacgaccatccaatttttgtttgacattcttccattctgttagttaggtttttcttttgttgttggctttgtttgtgttcttccttttcaattcgagcataaaattcctaattgttnnaaaaaaaaaaaaaaaaaaaaaaaaaaaaaaaa

SEQ ID NO: 48718 - DNA, 845 bp, Heterodera glycines
  misc_feature (823)..(824): n is a, c, g, or t
  SCN-specific regions: Sequence locations=1-62,84-343,366-485,507 -748,771-845
tcattctaccccgattcgtactaaattttcccaaacatgtaaaatgtgttgagtgttcatccaaatttttcaaccaaaattccccatttctcgcttctttacaattttatttctataccattattcgacttcaaacagagtttattaacgacatgccaggcaatgaaacaattcgaggccatttggaaaaacggaaggattggatccgacggacgagggaccatcaggaaaagtcggcggatatcaaaaagttgaagagaagcgcacgggaacggaaccccgacgaattccattttcatatgttgcggagtcaaatcggatttgatggaacacatcgcgacttagagacggaagaggaggagaaaagcgaagcgcaacgccttttgagcgatgtcagcgatattaatttcgtacaattcaaattgggcatggaacgaaaaaaaattgaaaaattgaaagcggtgctccacttttgtgatgagacggaaaaaccacagaacaaacacataatattcgcggaggacgaagaagaagcacgcaatttcgaccctcggcaatatttcaacacttccgaacaattcttggcacggactttcaatagaccaatcgaaggcgacgcgcggaaaagcctcagcgtaacggagaaacgaaaattaaaagaaacagagaaggagcgacgccgtccttacgccgaactttgcaaacgcatggaaagggaacgcgaactgacggtggtgttgcaaaaagtggaactgaagagagatttggcactgttcaaaaagtctgagttaaagccgaaactgatcaaaaaaagggacgcacnngaggcagccatttacaaatgg

SEQ ID NO: 48719 - DNA, 628 bp, Heterodera glycines
  SCN-specific regions: Sequence locations=1-276,298-418,441-628
gtatacaatacatataagctaaacaaagaaaaagctttcaatggaccaaaacaacgaccaacgccgtgctgttaacgaatatcggcttaatgaggacaatgaactgcgtttagaagtgggcaaagaagaagtcattctcgaattgctggagggttctgccgaaatattcggctcccaaatatccatgcacaaacgctactctctccccccagggtttcgcgccgccgttttcacatataaaggtgcccttattgaagtggtcggtcgaacagatagtgcttacattgcacaacaaacacctatgattatctatttgaatactcatgccgctctcgagagtatgcgaaaaagtgccgagacacaattggtggccgaccgaacatcttccgcccgtggtccacgtcttttggttgccggaccaactgatgttggaaaatcgactctttgtcgaatattatgcaattacgccgtccgggagggaaggacacctctttatgtggaccttgacattggacagggcagtgtttccattcccgggaccatcggatgcctttacattgaaaagcccgcagacattgtggacggattcgatcgaaaagccgcctatgttcacaacttcggtcacatt

SEQ ID NO: 48720 - DNA, 693 bp, Heterodera glycines
  SCN-specific regions: Sequence locations=1-693
caagtttgagatggcatcaaaaattgttccaattgccgtttcgccctctttcaactttttgcgtcgtccattgccttcgttggtctttcgtcgttctcttttcaaatcgccattggacgcgccgttctgtggcatttacaggacaaatggcgggatttgccggacggatgacattttggtgtgccaacgcaagatggactatcaccttggagcaaatgtccgtcatcaacggggtcggaaccagcacttgttgaaagctaattgtgacgggacggttgtgatcacacgcggcaaaacgttcgaagagttcaagcaggagtatgagcgtgagtcggtttcgaggcgtgcggcatttactcgcggcaccattttcactgttcttttttatccgggcatttttgttggcattttggcggtcatcagtgtcatgtctcatcgctggtacacttatcatggcactggccgtgaacttcgccccgtgtcgaacgccttcgtccgctttgtcgccgctttcttcggttgttacagctattttccctacaacactgaccccgaccctgaaccaatcgctgtcgttgaaaaggaatgagtggtgaagaggaaatacgatttaggcaagcaaccacaacactttggtctttttattgttatttccctggcacataaacacagaccaaatgcaaaaaaaaaaaa

SEQ ID NO: 48721 - DNA, 658 bp, Heterodera glycines
  SCN-specific regions: Sequence locations=1-658
ccttaagcctttgctaatggaggttgaccatcaatcacttgacagcatttgcgaaaatattttgtcaatttctcgtcatttggatcttccgctagctgataatctcgacaatgcccatttgtcactcttcaagactaagctgactgaatttgctaaagaaagcaaaaaacaaaaagccattccgagtttattgcttccgtcgaatttgtcgttgaatgacaacgaatgggccaaatttggacagtacgtcgacttaatgaatgccgattatgcggagagggcattattgctgaagagacgtgccgaagtgaccatcgattcttttctttggtcggatcgcgtcaaacaaattgaggacaaaattcgacaggttttggaagtcggcggattcacaaatgttcattttgaccctgtccatgccgacgatgttttggccgctaatttggaccttttatatgtgacgaaaacaagtgacgcgcaactgagaagggggaagcgcactttcgtaacggaccatcgcgtgaaggcggacattgtgccggacagagggggaaggacggagcaaatgcaaccgatgcagcgggagacattccaccagcaggagacacaacggcagcagcaacagcaattccggggaggaggcgcaggagctggacgt

SEQ ID NO: 48722 - DNA, 1129 bp, Heterodera glycines
  SCN-specific regions: Sequence locations=1-355,449-462,495-539,603 -906,931-1063,1098-1107
ggcgaattacaccaacaaaaacttctatacaaaattgaccttggcgctgtgtacaatcgtccgccgtgtgaccgcaagaatattggtgaattttttcccgtggaacgggaactcgtctttgacatcgatttgaatgactacgacacaatacgacaatgttgcaaggacaaaagtgtgtgcaaaaagtgttggcgttggatcataattgcggttgatgtgctggagcatcttttacgaactcattttggcttccaacatttgctctgggtcttttccggacggcgtggcattcactgttgggtggcggacaaaaaggcacgcgcattgagcagtcgcgggcgtgaggcgatcaccaaatatttgacatttaacaaagatggctctgcgatcaacaaatatcgggtgcacccatttgttacggaatcgtaccgaaaaatcatggaatccgacgattttgagcagttgatcatggaacagggatggttggactcggccgaccaatggaactctacaatccttgcccattgggccgacaaaaatttggctgaactgctcgacaaaagcttttcaaggcttcaaacgccaaaattgcgttgggaatcgatgaaactccgatttgatgatgcaacgcgaatcaatgcgcgagggatcaaattgccaccgacaccttccgatgaagcgagacgttttttcatttcattggtcatgaaatttgcttatccgcaactcgacgcaaaagtcactgctgggctcaaccatttgctgaaatcgcccttctctgttcatccagaaaatggaaatattgccgttccgttgagtgccaaagaaatccgtgcctttgatccgaatgtggtgccacgaattgataaattgttagcacaacttgcctcattgcgagaatccagccaagaaaacaaggagaatcaacgttcaattgtctatcgtcaaacttcattggctccacacattgctgtgtttgaacaatggaccgcacaaattctcaattctgaagcgcaaaaatgacagagcaataacaacaactcattccttcatcattgctatttttgaacactttttaactgtttaatttaacattttgattttgccaaaaaaaaaaaaaaaaaaaaaa

SEQ ID NO: 48723 - DNA, 1065 bp, Heterodera glycines
  SCN-specific regions: Sequence locations=1-67,89-92,114-1065
gtttgagtgcgtctgatgttgtgctttcttcgttctgcaaatggttgctcctccgtgggattctcttcgtctgtctgttctcgttttgcttttcctcgcctttgtgtgttggcttcgttgtccaatgagtcgggactgagcgagtgccttccccaatcggttgaaagtgtttcggcatcggctgctgcaattcgggagagagaacgccgtgagcgccttctgacgatatcggacgcaatgaagttttacctggagaggaagcaggacgaaatggcgattctggagaaggagaagttgctgtacgcgcaaggaaagcgccacttggccaacataatgggcttcgaccccgactcgatcagcggggaccaaatatcgcagtccatccgttatttgttccccagcggcctattcgacaaaaaagcgctacccgtgatgaaacccccggaggaagtgttcccgaaaatcgtgaagattgacgtggacgcctccggctctccgaagcattcgctgtttttcactgccaaacccaaattctattctttgctttcggacataaacaaacgcacacaaaaactggtgaatgcattcgacggacatcagacaaaagtgaacgaagttgaaaagatgcaaacgatggaattggcacttctcggagaaaaaccggccgagaaaggacagatcaatttgatgggcacccaatgggtgacgaaggatcagctgcagcagcaaatgcaggagatcctttccgatgacgaatatgcaaattttataattgcgctcgaatacatttcgcaattgccaaattccgcggaggaggaggactttatcatgtcattgcgtcgtgggattggagcaagtgaaaaaaatagacttttccgcgcaaaagtaccggaggtgacgataaacgaagatggcaggagagaatgctggagaatttgcaagacgagggcttccgccgtgaaaattgtggtcagagacggaggcaccggccttttcacagtcaatgggcaacactattgcacgttccgttcgctcctcgcgagagaatgtctcttggctccaatg

SEQ ID NO: 48724 - DNA, 1066 bp, Heterodera glycines
  misc_feature (1042)..(1042): n is a, c, g, or t
  SCN-specific regions: Sequence locations=1-85,107-794,816-1066
gtccaccaactttggtgcagacacaggtagaaggtggctctacccttttctccctgaatttcttcggcgagtccgctttcctcactcagtcttctcagctttacctcgaaacgtgcattgcctcgttgggcgattgttattgcatttcgcagtcttaccgcgctgaaaagtcgcgcacgcggcgccatttggccgaatattcgcacgtggaggctgagtttccatttatcaccttcgaaggtcattttcaaagtgtagagaaccagcgaagctgtgtgttcagatttgatggtgcgcattgaggaaatgacatgtgacacagtcaacagagtgatggccgacccggaaatacgcgaacttatccagcagcagtggcaaaaggattcccaatatgagttcgtcgctcccaaacggccttttcttcggatgacttatgcggaggcaattgaatggcttcaaaacaatgaagtgatgaacgaagaggggaaacccttccaattcggcgaggatattcccgaaggccctgagcgatttatgaccgacacaattggacaaccaattcttctcaatcgctttccgcatggaattaaggctttttatatgtcacgttgtgcagatcaaccggaattgaccgaatctgtggatttgctaatgccgggcgttgtctagatagtcggaggatcgatgaggatttggaaggaggacgaactgcttggggccttccaaaaagccgacatcgatcccaagccatactactggtacgtggaccagcggaaatacggaggttgcccccacggaggttttggacttggtctggagcggttcgtatgctggttggccaatcagcatcatatccgtgatgtgtgtctcttccctcggaacatcgggcggtgtgcgccgtagcttttttccgtctctgaaaaggaccaaaaacgaacccatacgaatatgggtattgttcatttttggcgttaaaacaaatgtatcttctaaattgtgcatttttttttgttgttgttattgcataaagggataaaacgcntaaaaagaaaaaaacaaaaaaaaa

SEQ ID NO: 48725 - DNA, 396 bp, Heterodera glycines
  SCN-specific regions: Sequence locations=1-281,303-371
ttgagaccaaaattaatttgctccctctctaaatgccgaaggaagaagtgcccgaaggagttgaccagctgacttattttcgtgagcaatgcgagcataaggttgcccatttgaagtccattttggaggaatgcaacgagcgcgtgcggtccaagccgaagaccactgaaatttgtcacatggagatgatcgactacgtggagggcctcgatcattgtgccaaaccgaaggcattcaaagcactgaaatgatgcccttcaccgccggatgattactttaggttttttgtctgttaatgtttttcggatttatgacgacgatatcagcaagcttttcaaatggatattaatcaactggtaaaatatgtaattaaaaaaaaaaaaaaaaaaaaaaaaa

SEQ ID NO: 48726 - DNA, 495 bp, Heterodera glycines
  SCN-specific regions: Sequence locations=1-17,39-252,274-495
gtgacgcaaaagattgtgaagaaaaaacagaagaaaggggcgcaggcgggcaaatacgtcaccaaaacggtgaccaacgaaagcttcttcaactttttcgatccgaaagtgacgaccatcacagaggaaatggacgacatcgaggaacagaaaaccaatgatgacttcgaggttggacagatcattcgtgaacagctgattccccgtgcggtgcttttcttcactggtgaggcggcagaggaagacgaatatgacgagttcgatgacgaggaggaaatgggggacgaacagtcggaagaggaggacaatgccatgcactgaaggaccattggacgctgttaatgacaattgtttagtgacgctgatgatgttctctatttaaaagttgttttgttgacacttatctttatcacacacattctgttaatgcgcgtacacacaaacaaaagatttattctgttaaaaaaaaagagaagcggactctagaattaaaat

SEQ ID NO: 48727 - DNA, 1104 bp, Heterodera glycines
  SCN-specific regions: Sequence locations=1-100,134-158,193-200,247 -298,321-323,351-368,391-536,561-1077
ctgactttgacaaacacgctgcccagcgcgaggcggagtcgctccgcactttggccttcttcggcgtgtgcctgtccaccgtggccacggttatcgctgtgctttccgtgccgttcgcctaccagcacttccagcagatcggcgcccaaatgcagaacgaagtggacttctgcaaaatgcgctccggcaacatgtggcgtgaggtcacccgcacccaggcctactccaaggtgtcgcacgacagccgtcacaagcgtcaggcaggcggttgctgtggctgcggagtgtcgcccccgggcccgcccggaccccctggcccatcgggacaacccggcggagacggacaacccggaggctcaggacagcccggagcaccaggccaggcagctcctcgcccgtacccgccaagcggcggatgcgtgccgcaatgtgaggccgcccagcccggactccccggcccgcccggaccccccggacccgagggacagaacggccaacccggacagtcggcaccacccgcgtctcctggccgccccgggccccagggacctcctggacccgatggacagcccggcaaccccggagagtctggccaacccggccagcccggcaaactcacccagggcccgcccgtcgttggaccgcctggcccatcaggaccccctggccagcccggacagcccggcgagaacggacagcccggccagcctggaaaccccggcccgcaaggataccctggcgacggcggaagccccggccaacccggcaaccccggaggcagcggcgagcccggacagcccggagcacagggatccagcggccaatgctaccactgcccaccgccccgcaccgcccccggctactgagtgtgatcagtcgaccatcgacaattggagaagaacccccactgatgatccacgaggctgctgtcctttcgtctctcaccattttcccgatcattttggcatttccaaaacgctgatcggacaattctcaatgttatttttgtatttgtgcaaaatttcgttggattgttctgtcgcacaaaaaaatcaaagaataaattgatcggagctcaaaaaaaaaaaaaaaaaaaaaaaaaaa

SEQ ID NO: 48728 - DNA, 647 bp, Heterodera glycines
  SCN-specific regions: Sequence locations=1-114,136-468,490-647
caaatgttgagttggttggaggacaaaaacgagaagttcttgaacattgtcacggacattatgcagaaagtgatcacgaagaattccgaacaaatgacatttttcatcggaatgaacggacaccaaaaactggtcggactaattgccaattgtcgtcaggaggcactgttatggagagttaccaaactgatggacaaaattgtgcagatggacgcggaaagaatggtcggcgcgggactattggaagcattgcaacgccatttggaccatccgagccaaagactgcttcgtcaagtgctgtcgtgcgttcgaagtgtcagtcacgtgccaaccgccgaccgaacagttcagccacttctgcagaaactgctccaacttcttggaacgagtgacattcgcctaaaagaaaattgtgtggacattttggccaatttgtgcgccaacaattcccaaaataaatccttccttgttgagaacggcgcggtgccatcgatgtttcagttgctctacgagttggactccgttaggagcggaggaggagaacagccgacgggagacgaccccttccaacggcaattggagggcattcaggagacggcgctgaccttactgaagtccctgtgcagtggacagaacgacgatgcgag

SEQ ID NO: 48729 - DNA, 631 bp, Heterodera glycines
  SCN-specific regions: Sequence locations=1-295,318-589,611-631
cttttttttcttttttaccgtccatgcgtcgttttgataaccgtagcagtggcggcagattcgccaagatttcggcgaacaaaagagggtgcgcgctcaaccgagtcgacatatcgaagctgaacatcaatttcgaaagcccaaaatggcaggaaaggaaagaggcattggacgcactgcaacaattgttgttgcaatcgccgcgacttgctgatttgccaaattaccgggagctaatcggacgcttaacaaagattatggcaaatgatgcaaatatctttgtcgccgcaagtgccaccaaatgtgtgatgctgttcgccaaaggattgcgtgccgaattcacgcctcacgtgtcgttggttgtcccggtgatcttcgacaagttcaaagtggagaaacggttgctcagagatgctctcgtcgagtgcatcgatgtcatcgcagcatataccagtttcgaccacctaagcaaggccttgctcgaggctatgacctccaaacagaatccgagtcagaaatcacagacggatttgttcatctaccgcctgttccgttctcttccggccaaagacgttcccaagggtttgctgaaggatttggtggccattctgagcaaacatggctttgatgc

SEQ ID NO: 48730 - DNA, 612 bp, Heterodera glycines
  SCN-specific regions: Sequence locations=1-92,116-328,350-612
gtccaataaggtgcctatttttcgatttttgtgcctaaaaaaggaagccctactcattgccaaatgctctgttctctacgtggagttttgccaaatttcttcaaaagacatttatctgttgccattcaaaaaaatataccggaggagcatgacgagggttttgtggacgttgcgaatacggagatactgtgcaaatatgttttcatcaattaccagtttggagcagaaggaccgggcccgaaaatacaacacaactctgagtatcccgcatggcttttcacattggaccttgaaccgtcaaaggagctcgaagacttggatccggaaaacagtggatggaaatattgggagaaatgggaggagcgaagacagcagcaaatgttgcgccatgacgaactaaaatacaaatatttttggcttcaaaattcgcctgccgttcagacgcacatgcgcttcaccactgaaaaatacaaaacacacaagttcctcactattcccgtgacgacgccgggcgtttatttgaagcatacgcgtcgactgcgtctcaaacagcgggtgtggaagtcgttggaagagtcggagcaaatgatgaaggaaaatgatggttgggga

SEQ ID NO: 48731 - DNA, 650 bp, Heterodera glycines
  SCN-specific regions: Sequence locations=1-56,78-432,454-650
gcaacccggagcagtacctggccaatttacatgagctttacctaaagacgcacaaattgctgggccttctgcaggagaaattccgcacgaattcattggacccccaatttttgccaacgctcactcagtcggtgttcggcccctatttggtcacatatgcaaaaattgagcacaaattcatcgccgacaaatgcacttttacgctccgaaagttctacgagtccaaagggcaccaaaaacggagtattctctcgagcggacttcaagaactcaagtcgcgtctgctgacagcggaggattttggtggcgaaacttttctttccgaaatcatagcgataaacattctgcaggagtttaagaatgccttcgcccgctgttcatcgctttgcaaaaaaacggagtctcttgaactgaacacagtgctttttgacatgcttctcaaatttctgtacaccgaacacgtggaatacgccattgagcttggcctcgcatgcattcccctttccgagccacggattgagccgtctccaaatttcttcaaagtgatccaacagaagtccgccatcactcatttgttcgccaaattatttgatgacacaattcaccccggaaaaagggacacacaaatagagggacgcattgcttcgaaa

SEQ ID NO: 48732 - DNA, 620 bp, Heterodera glycines
  SCN-specific regions: Sequence locations=1-620
taagctcccattgtattattactatgaccaaaacggataatgggaagttcaccgaaaaaaataacacgttgatggcaaatggaaggacaaaaccctcagagaaaacatctctgtccacatgtatatacaacaaacaggacgggactttcttagggcgttctgcaaagtcttgggcacagatcatcggattctacatcgtcttttacatatttctagctctcttttggttgggatgtctgtggacctttcttaatacgaacgatgattttattccgagataccacggggaaaacacaattattggcgcaaacccaggtgttggttatcagccttggctggccagcaatcccgagtccacgctgatcaaattttacgaaaacgacacctcaagttacaaggattatctcaatgccatcgatacgtttctggagaagtatcacaacacagaaaacactcgcttctgcgacgagaacggcatagattccaattctcaacacgtgaaggacggcaaagtgtcgtcgttaaacgacgtaaaggcgtgccgcttcgagctcggctttctcgacgacaatggctgtggtaagaaagacgactacgggttcaacaaaggacagccgtgt

SEQ ID NO: 48733 - DNA, 627 bp, Heterodera glycines
  SCN-specific regions: Sequence locations=1-10,58-627
cctcgtgccgcttttcctcccgcttctctcctctctccctccctctcctccctttccgccatttctctcgataattgactcattacgctttctttgacctcccgccgtgtcggtgccaattcagcagatgccctcgccgtccctcgtgcccatttcggcaactgctgacacagcgaatgcatcgcccgccgctgacgacaattgttgcgccgtttgcgccgacgacgcccacggggtgcacttcggcgtacaggtatgccgtgcttgtgccgccttcttccgacgctccaccatcgcggcacgcgtctatcggtgccgttacgacggaaactgtgacatcgcccaaagggaagtgcgttgtgtgtgccgcgcgtgtcgattagccaaatgtttggcgcttggcatggacccggacgctgtccaacgacaccgtgaccaaattgggccccgacaaaataaaacgaaattggaaaatgaaaagcgacggacggaggacggcggacgaaagtgccaacgccattcgccaccaacaacagattcaatgtgccaacaacattttgaatcgacaaatgcggaggggacgaggccgaataattttatgagagaaactgagcagcagcaaaatat

SEQ ID NO: 48734 - DNA, 905 bp, Heterodera glycines
  SCN-specific regions: Sequence locations=1-905
gctccaccaagcctttttggaaagcggcaggcagcactggatcggggttacagaagatatgaacgggtacagacaggagggactcgggaagatggacatgacgattaaagacgggagacggtggagcgcatccagcgcatatctgactaatattttggaccggccaaatctgttcactaccgccggtgtcacttgcacctctgttttgttcaacaatcatagagcaatcggaatcgaatttatacgatatcatcgtttcatgctcaccgaagaagtggatgcctactcacgggagaaaatttactgcgaagactctgtgattctttgtgccggtgccattaatacgcctcaattgctaatgctcagtggggtcggaccggcatctcacttgaaagttcatcaaatccctgtcgtgcaggacatgccgggcgtgggccaaaaatctacaggaccatcttgaactttatgtacaacagaaatgcaccaagccgatcacattgtacaacaaatccacgtggcgacacccccaccgcatggtcatcaacggtcttcagtggttcctcaccaaaaagggcttggctgcgacaagtcatctcgagtctggcggctttgcccggtccagcacagaaattgatcaccccgacttgcaattccatttccttccgtcgacggttcacgaggacggcaggcaaagtccgaattgccatgcctttcaagttcacgtgggcccaatgcggacgaagtcggcaggggaaatcactttacagagcaaggacccgcgcacatcgccgcttatgaaccccaattatttgtcacatgagaatgactttgttgagttccgaaaagctgtccgtctgtcgcgtgaactttttgcacaaaaggcatttgacgagtttcgaggggaa

SEQ ID NO: 48735 - DNA, 546 bp, Heterodera glycines
  SCN-specific regions: Sequence locations=1-61,83-240,266-465,496-505
gtttgagattaaaagaattgatttgtgaaaaatgacccgcgtgaagacccatgaacttcgggccaagaagaaggaggagttgatgaaaatgttggaagaacagaaaacggagctggccagtctgcaggtgtccaaggtgacgaacggggcggtgtccaaactgtccaacatccacgtggtgcgcaagaacattgcccgcattctcaccgtgatcaaccaggcgcagaagatgaacttgctcaagttctacaagggcaagaagtatcgtccgattgaccttcgcttcaagaaaacgcgtgccatgcgcagagagttgaccaagcatgagctttcattgaagacacacaaacagaaggtcaaagaacgccgttgtccaacgcgtatttatgcgcttaaggcgtgaagcggccacagcctaggcgatgtgtttcgacagagagggaaatgtgacgaggattttgatggatcaaattttttgttgttgttgaccaacttttaaatgattaaaaaaaacaaaaaaaaaaaaaaaaaaaaaaaaaaaaaaaa

SEQ ID NO: 48736 - DNA, 622 bp, Heterodera glycines
  SCN-specific regions: Sequence locations=1-60,82-249,289-622
tggcaatcattgccacggtgtgcacaattccgtcgctgtactcgcagatgaacgagatcagcaacaaagtgcacgacggcgttgaagttttccgcgtgaacaccgactcggcatggaccgatctgatggacgtgcaagtggccgtcgcgccgccgtccaagccgcgtgagaacccgttcggctctatcttccgtgccaagcgtcagctgcccggctactgccagtgcggtccgattgctcaaccgtcgtgcccgccggggccgcccggcccacccggacccgcggggcatccaggacagccaggacatcccggcgggcccggacagcccggagcacccggtcaaccatctgcgccatgtcctgtgcaacatgttgcgtgcccgaaatgccctgccggaccccccggacaccccggaggccaaggcccgcccggaccggctggaggcccgggccagcccggtgcgccagctcacggcggtggacaaggcccgcctggaccacccggcccgcaaggatcgcctggacagcccggacaccccggaggaaagggacagccgggcaacccgggtgcacccggaacatcatcgaaatccatccccggaccgaaaggaccgcccggaca

SEQ ID NO: 48737 - DNA, 716 bp, Heterodera glycines
  SCN-specific regions: Sequence locations=1-83,105-282,304-368,390-716
gtgaaatatttaatggcacaacctgctaagcgtgttgctgtcagctcagttaactgggctaagttggccgaacggctgacgccacaacaggaggaggagcttaatcgtttgaaagcacaaaactcttcatatcatgcagaggttgtacaacaccaggctgatctgcctaaagttgactgggctacactgaagaagcaaatgccggaaaattcgactgttcttgactcattgcagaagcaatgggaagcgttgagcattccatacggaacgatacctgacaatctgaagaaacaaattgaccagtgggtgaaattcaatgaggcccgagtcaagtttcacgagcttaagacggcggatggacttgtggaaatgaagaagattgaagacaaatgggcgaaaatgccgccagtcgagcagctttggcgtgaccaactcgtccagtatttcccacataagtatcaggaccttcgctatctcaacgagtattatgacccatggggcattggtgttaatgacaccaattggcgcgagcgtttcaaggacttccagagtcgtcctcgagagggtgcaacgcttcactgatcgcatgattttacaatttaggaaattcaacgtgattttatttggaagaagttattcgatagagatgttattaaatggacattctcttttgcacaaattggtttagatgataaaaatttgttgctctcaaaaaa

SEQ ID NO: 48738 - DNA, 626 bp, Heterodera glycines
  SCN-specific regions: Sequence locations=1-587,614-626
agactgtggaacctttggttggccatgtttagcattgccggctgtctggtgaccagctacgcgctgctcagagagattggcacctacgggctggtcagctcgtacacgaactgtcgcgacttcttcgagggattcaccggcttgtggacctggtggttctgcatgtcgaaatttgccgagttgggcgacacttacttcatcgtcctgcgcaagaagcccctgatgttcctgcattggtaccaccacgtggccacgctcaactacggtctgatgtcctacgtggacaacaccgcgttcaacacatggattgtgtggctgaacttcagtgtgcacgccgtcatgtacacctattactttttggccgcctgccgcatccgtctgcccgcttggttcgcccagtgtttgaccacctctcagatcacccagtttctgatcactttggccatccttgcccacgtcggtgtgcgactgttggtcgggtcccacgtggacaccacaccgatgacctatggggactgcttgctgatggagatcagctaccggggtttggttggcaactttttctaccattcgtacatcggccggagggggcaaaaaattccaaaaggaaaagcaaatgaaacagc

SEQ ID NO: 48739 - DNA, 669 bp, Heterodera glycines
  SCN-specific regions: Sequence locations=1-669
ccaattaaggggtattcattttttgtgcaatgtctcatagtcagtccgagaaatcgctcgaccagcagttcgattgttgtgagtgcgtcgtcgatgatttgctgaagggccgacttggcgattcgcaatttgcgcaaaggaataacgtcttgagagattgtatccaatctctccaatccgtggccaaaacaatcgatggcctttcgttgttcagtgccaatgattccgtcgaagaacttccgacgaactctctccgttttttgctcgtcccagcttatttggccaccgcactgcaagaaatcggcgtggagatggacaaacggggcgcatatttgagagcttcgaagacatattatcgcgaattcctgcagaacatgtcaatttttgggctggtaaacttccgacttccttggcttaatgaagatgagcgcaattccgacgaccagcaaaaagagaatgggcgcaaccgatcgaaactgatcagcagttttgacgatgcaaaagcacgtcgacagcacaccatttcccgtcttcaacaattggaacagctcgaaaagactgtcgaacagctgaaaaacgaaaaacgacgcaatgatgacgaggcggcgcagcgtgaactgattttcgcacttttgcgtttttggtccattcgatctgtgaaggaactgg

SEQ ID NO: 48740 - DNA, 715 bp, Heterodera glycines
  SCN-specific regions: Sequence locations=1-79,103-216,239-715
aattaaggcgtattgttagtcaaaaatggtgaattggccttggagtgcgaaacagcgcgacgaaccggcgcaagacaagcaaaaagttgtgaccactcatcccgaacccactcaaggcattcacggaatccgaaccattctgatgggtccacccggtgcaggaaaaggcactcaggctaccaaactggcgaaaaagtacgagtcgtgccacctgtccactggcgatctgctcagagccgagataaaagcaggcactccacttggccaaaaaatcaaagggctcgttgaagggggcgacttggtgtcggatgacattgtgtgtgagatgatcgacaagcatttgtccaccgccgagtgtcgcaacggattcattctcgacggttttccgcgcaacaccgcacaggcggagaagttggacgctctgttggagaaacgccagcgccctttgcaggcggcgcttgaattggcgttggatgactctttgctggtcaaacgcatcactggacgtctgttccacgtgccgtccgggcgcagttaccacgagcagttcaacccgccgaaaaaggcgatgactgacgattttacgggcgaaccgttggtgcaccgtgaagatgacaatgagaaagtgttgcgcaaacgcttggccgactatcattccgtgacaatgccgctgatcgactactactcaaaacggcgcattcaccacagaatcgat

SEQ ID NO: 48741 - DNA, 970 bp, Heterodera glycines
  SCN-specific regions: Sequence locations=1-127,149-657,681-683,706-970
gtttcgaacggatgactgaaatccaagccaaaagcatcccgccccttctggagggaaaggatgtgctcggatccgcaaagacggggagtggcaaaactttggcatttctcattccgtcgattgaattgttgctgagaaatgggtggaaacagcaacaaggcaccggtgttcttattgtgtcgccaacacgcgaattgtcaatgcaaacgtacggagttctctatgaattgatggagaaacacccgaacatttcccacgggctcgtgatgggcggcgcaaatcgccaaaatgaggagaaacgactcgctggaggcgttgccattctcgttgcaactcctggccgactgctcgatcatttgcagaatacatccaattttgtcgtgcgcaatttgaagtgtttaattgtcgacgaggcggaccgaattttcgacattggatttgagcaggaaatgcaccaaatcgtcaaattgttgccaaagaaacggcagagcatgcttttctccgccacatgttcgcccaaagttgacgagttggtaaagactgcgctgaaaacggacccactgaaaatcggagtgatggagcagcaaagggacccaaatgacatggccacggttgaggggttggagcagggttacgtcgtttgtccttccgaaaaacgttttcttctgcttttcacttttttgaagaaaaaccggaacaaaaagattatggtctttttttcatcttgtgcctccgtcagattccatagcgacttgctcaacttcatcgaccttcccgtcatgaacattcatgggaagttgaaacagcagcaacggacgcggacattcttccaattttgtcaggcttccgctggcactttgctgtgtactgatgtcgccgctcgtggtttggacattccccgtgtcgattggattgtgcaatatgatccgccagatgagcctcgtgagtacattcaccgggtgggaaggac

SEQ ID NO: 48742 - DNA, 662 bp, Heterodera glycines
  SCN-specific regions: Sequence locations=1-17,40-81,103-485,507-662
gtccaattaaggtcaataatttcgctttctttgtttgagcttactatttccgcataatggacgaggaacaacttttggattatgaggaagaacaagaagagactcaggaacaacaatcaaaaaatgatgcagcaacaaacggagatgcaacaaagaaaattaaaggtaattatgcgagcattcacagcagcggattccgagatttgatgctccgtccggagttacttcgtgcgataattgattgtggatttgagcacccttctgaagtgcagcatgagtgtattccacaagctattcttggaatggacattgtctgtcaggcgaaatcgggaatgggtaaaactgcagtgtttgtgcttgccactttgcaacaactgacaccgactgatggcacggtctctgttctcgtcatgtgtcacactcgtgaactcgcctttcaaatttcgaaagaatatgagcggttcagcaagtacatgccaggagtgaaggtttctgtgttttttggtggtatgccgattaagaaagatgaggaggtcctggccaaaaacactccgcacattgttgttgggacgccgggtcgccttttagcactgggacgcactggacatctgaagcttaaaggaggcaaattcttcgtgctggatgagtgtgacaaaatgatt

SEQ ID NO: 48743 - DNA, 1157 bp, Heterodera glycines
  SCN-specific regions: Sequence locations=1-2,32-32,55-55,118-127,153 -163,185-243,272-544,592-592,632-670,711-817,839-1157
attggccgctgataattttgacgctcaacgtgttttgaacattttggccgagagagacaatttccaaagtaatgaactcgccgatcagttgtccattgaccaccagcgactgatcggaggcctcaaaagtctgcaggtcaaagaagggttgggttgcgcttcagaagtcaaaatcaaacgcatccaattgaccgcggaaggggaggaaattattcaaaagggttcccacgagtttaatgtgtgcaaaatcgtcggagaaaagggcatttccaaatcagaaattgaaaaaacttcctttggtcgcatcggattgggcaaggccatgcaatgcgggtgggtgggcatggacacgcgcgaacgagtgcctttggtggtgcggaaggtggctaatggcgaggacggggacaaggagcgattgaaattggtgaagaacggaaagggcgaccaattgacggcccaatgcgtggcacaactgaggaagcgctaatggataatggacagcgcaattaaagccctttccgttgccaaaggggcgaacttcgccacgactgtgcagaagcaggaattggatttgacttcggagatgattgcctcgggttcgtggcgtggcaagcagttcaaacagtacaatatctccgcgatgggcgtgccgcccccctccggccatctccaccctttgctcaaagtgcgtgccgaatttcgcgacattttcttccaaatgggtttctctgaaatgccaacaaatcgtttcgtggagagttccttctggaactttgacgctctgttccaaccccaacaacacccggcacgcgactcacatgacaccttttttctttcaagaccggcactttcaacagaattcccggaagattaccttgaaagtgtcagaaaagtgcattctgagggcggtttcggttctattggctatcgctacgattggaagttggaagaagcgcagaagaatttgctgaggacgcacaccaccgccgtttctgcccgtcagctttaccttctcgcacaaaaacctttccaaccgtccaaaatgttcagcatcgaccgcgtgttccgcaacgaaacattggatgccactcacttggccgaattcaccaagttgaaggtgttgtggcagaacgaaacctctcactagcgcatgtcat

SEQ ID NO: 48744 - DNA, 1130 bp, Heterodera glycines
  SCN-specific regions: Sequence locations=1-494,518-1130
ttttgttttatttgtgctttttccacgctcaaagtcccattcattcctttgcttttgccgatcgattgatccgaacaaaacaaaatataatcgaagtccaagagaagacgacgtaaaggaatgccttcgggaggcgacgatgaacaacagtttgaggaggcggtcaaaccggcattggagtcccttttggcggatttgcaaaagaccaccgaagttcttcggcaaggcaaacatggcaaaggccgacggcaacagaaggaggacgaatccgccgctttgttggacttgaagaagcttcggaactctccccgccagcgaaaccaatcgccggcagcggtcgccaatttgcgaaacggaagaagcgaagagctgcagcctcgccgtgacccgatgcttgagggcgacaaattgggcatccacacgataccgaagggggactgtgcttcgtgcaaccaagcagtgattgggcccgtggtgatagcccttgggaagatgtggcatcctgaacatttttgctgcgctcattgcggagattccattgaaaatcggaattttttcgagcggcaaggaaaggcgtactgtgaaagcgattaccacgatttattttcacctcgttgttcctactgtaacgggcccatcaaagaacgttgtgtaacagcacttggcggaaagaattttcacgtggagcattttgtttgcgccgaatgcggcaaaagcttcggagacggcggattccatgagaaatccaattccgcgtactgtcgcgattgtttctaccgtacttacgcgcccaagtgtcagtcctgcaaacagccgatcactcacaaattcatcacggcactcaacacacattggcaccccgaatgcttttgctgtcaggagtgtggccaacccttccattgtgtctctctgttcgaccatttgggccgtcttctctgtgagatgtgtctccacacgcgcgtcggctccatctgcgcgcgttgtcggctgcccatcagcggccgttgtgtgtccgcgatgagtcaaaaattccatccggaacatttcacttgctcctactgcactgaccaacttgacaagggcaccttcaaagagagtgccgggcgacccttttgcctccgctgctatca

SEQ ID NO: 48745 - DNA, 860 bp, Heterodera glycines
  SCN-specific regions: Sequence locations=1-3,32-85,108-476,498-860
cactttttctttctttcgtccttttcttctccattaatttctctccttccgtcgttgcccaacgcacccaatgggacgcgttcaatttccccaacccaacggcgcccggcgatttccatcgctgcaaaatgcgatcgacggcacttttgtgtgacccggacgaggtattaagcgaacaggagcggtaccgactgaactacgaattgggactgatcgaatcggcaacgagacaggaaaacggaagggaattctgtgagcggaaaggaattaacgcggccgtagcaattgcacgccaagtgaagggcgggcaggagcaggatgtgcggaatatggccaatgaccttttgcgacgctggacgttggacaaacaatgcgaaaaggcacttgttattgtgctgtcgctggaggaccgccgcttttgggtggcgcggatgccgcgagtgccggtttatgcgcaggaattcacggaactcttcaaaagagagcaaggcactttcaaaaccggtcgcaattcggagggccttcaaaatgtaatccgcgccatccgcgaccgcgctctctccaagcagtttccctccgcacgccctgacgacgacggccgttctaaaggcactccgtttgtgccgatgccaaaaccaacgcctcacccggagggaaagcacaagcagaggggcggcggaggagtgcttagttggctgttcatccttctggtcatcgtcttcgtggtcatccccttggcatgctgctgctgctgtctttatttctgctttttccgcaaaaaggacagcggcagcaacaaccgcacaccacacaatgcggaaaacggtggctctggcgcggaaagacggggcggcaccgga

SEQ ID NO: 48746 - DNA, 633 bp, Heterodera glycines
  SCN-specific regions: Sequence locations=1-280,302-633
ggaagctgacgcgggtctgctcatggctgggttcagagctgaactatgatcccgcaaagatcatgctttataagaatgtgttacatggtgacaagcccggcatgtggataccgcaccaacaattgttggaactgcaggttagccagatgctcaacctgaacacaggcagttacgacccacgttttcaacgcatcttcaaatttttctatgccaaattgccacttccaatggtcgactttgataatcatgcacatgtattgctgcacttgatgaatgaaaaattccagctaacggaaatgagtatttttgtggataaaaacgcaagcgtgcaaacactcctggatgaggcgagaaaagagttcaggttctcgtcgatggggaccaaaactcttagacttgtgcaagcctcggccgacgggacttttagagtctatcaggtcctcaagaacgacattctttacaaggatatccaactccgaccatctttaatgctgcgtgtggaagaaatcccgaaggatcagctcgaagttggcaccgacgaatatttgctgccagtggcccatttcgacagagagccgaatcggacattcggagtgccattcttcattaaaatttgcaacggggagaaagtga

SEQ ID NO: 48747 - DNA, 561 bp, Heterodera glycines
  SCN-specific regions: Sequence locations=1-318,341-515,543-561
gtgtgctcagagtgagcgatttaaccaaagccaacgaaagagtacccttccgtttgctgaacctttccctcgcttctttggatgtgaatatgcgccccttttgcgactctgagggccattcggccgtccgattgcccggctttttgctcattttgtccggccaaatggtcctttcgcgccctttgcctccactgaatgcgtcgtcccttcgtttgtctctcactttggagcaaaactccgtttgggtgggccgaatttgtgacaaagggcgaagtcaaagtgcctttttatccgacgattttagtaccttttctctgtgctcccttctgccggacgcgtgcaattcgctggaggctttggcttccaaatatgctgagagtgatttccccctgcttttgccactgtccgatctgttcccgactgatcagccaattgctctcgtgccaatggccaatttcccattgctcgagggctattggaaggcgcaagcgcaaatccaagcggacgacggaaacgcaatggaggaggaggaggacgaacagaatgagcagcatattctga

SEQ ID NO: 48748 - DNA, 662 bp, Heterodera glycines
  SCN-specific regions: Sequence locations=1-557,581-662
ctgcgaccattaatcatatatctgcaagcaacggaaatgatcaaaaacggcgacatttggcaagtggaaatgagccgttgcaacgcttcggagaggcaaaaaaatggatgactgatatctatgggcaattggatggacatgttggagagttactcgaattctatttgggtttggttaaaaacggacaaaaatttgttcctcccgctcaaattgatgaaattggacattttcgcgactcagtaagggcaattcgtgaagtaatcgggcgggacaagatgaaggtcgtcttcttcgggagaacaagcaacggtaagagcagtgtgatcaatgcgatgttgtcatgccgagtgttgccccaggggatggggcacaccacttgctgtttcttacaagtggaaggggggtcggagcaggacaagtacttcatgatggaagacggggcgaagcactttccaattgctgaattggattcggttgggcatgcgttgggctcggaaggcatgggctccctgggacgcgactcgctcattcacattttctatccaaaatcggcgtccaaattgcttcaaaatgatgttttgatcgtggacagccccggcgttgacctcagtcccgagtttgacagttggattgacaagcactgtttggatgcggatgtgttt

SEQ ID NO: 48749 - DNA, 639 bp, Heterodera glycines
  SCN-specific regions: Sequence locations=1-201,224-639
gtttcttttgctcaaatggccacactatcaaacacagacagtgaagaaatcccacagaagcggccacgggaaaatgacaaaaaggatttaacgacgtcagcagaaaaaaataacagcgcgaatggtggaagttcagagagtgccaaaaccacggctgtttcgcacagggctccctttgacgcgacccatcgcataaatcgccttggtggaaaataccatgttttattagcggtgacgggctccgtggcctcaataaaagtgaatgaactgatcgccgaattgtacaagcaatcacccgagaaccgtttagcaattaaagtggttgcaacccaaagtgctctgaacttctttgacgcggctgacacacaagaaattgtttacgatgacagagatgaatggaatatgtggaagaagcgcggagacccagtgctccatattgaactccgaaaatgggctgattcgatgctggtcgcacctttggatgcgaattctctcgctaagatagcaaacggaatttgtgacaatttggtgacgagtgtcgtacgagcgtgggatcagcgaaaaccgctttattttgctcctgcgatgaacacagcgatgtgggagaacccattgacatatcaacacttgaaaacgctg

SEQ ID NO: 48750 - DNA, 867 bp, Heterodera glycines
  SCN-specific regions: Sequence locations=1-867
gcccatttgaatgcggcggaaagggggcgcccttacctttttattgttgcgcattacgacacttacggaataatcccgtcccttggcattgggtccgactcaaacggcagcggaactgcggtactgctcgaactactcgccattctaagccaaatttattcattaccgtcacacaaagcacgctacaatttggtttttgttctttcggcaggagggaaattcagttaccagggaagtcgcagtttcatcgacgacttcaatgaacgccattcggatgagcgtattgcccttgcaatttgtttggacagtttggctcgcggcgattctctttttgtccacgcctcaaaaattccatcggatgagacgaaggcttttcgcttcattcaaactttgaggcattttgccaatcgaccagtcgagcttatctcgaaaaaaatcagtttggcttctgataggttggcttgggaacacgaaatttacaacatccgacgtattcacgccgttaccatttcccacttcagcaaccattccaaccctttcagaaattcgttgctggacattccgacttcgttagatttctccatgttagaggacaatgccaaattaattgccaatgctttggtttcctttgtgttcgacttggactcgcgactttgcaacaacgccaaagagaacaatttggcctgttcactgcttaatgatgcagttgaagttgacccaaaaaggctcaaggcgtgggtgtcgatgttcgggtcaaagtcgcgcccaattgtcgtgtctcagcaccaattggtcgccaatctgttcgaagttgtcaaacgacttgctcacagtgcacacgtttcagagattgtggtcaatgattat

SEQ ID NO: 48751 - DNA, 843 bp, Heterodera glycines
  SCN-specific regions: Sequence locations=1-13,45-843
agatattttaagcaaatattttttattttttctaattttaaaatgaccaacgaagcaggaaattggtgtttgattgaaagtgaccctggccttttcacagaattgataagtgggttgggtgtcaaaggaacacaagttgaggagctgtactccattgacgatgagcagcatctgtccagcttaagacccatttacggtctcattttcctcttcaaatggcgtcccggcgaagaattggagggcactccgatgcccgacgcccccgtgtactttgcccagcaggtgatcacaaatgcgtgtgcctcccaagcactgatcaaccttttgctgaacatttcgtcgtccgatgttcaactgggccccatcctcgaccatttcaaaagtttcaccgtcggctttgacccggcaacgcgtggccttacgctgagcaacagcgaagatattcggaagttgcacaactcgttcacccgggaacactttgtggagttggacgtcccaaaagccaaggcggaggacaatttccactttatcacttacgtgccggtggacggaaagatttacgaattggacggaatgcgcgaggcgcccatttgcctggcggacattgagccgggaaaagaaagttgggtggacaccctgcgcccattcatccaacggcgcattcaaaagtacacagagggcgaaattcacttcaatttgatggcgctggtgccgaatttgaagaccaaatacgagcagcgggttgccgagctgagcgcggttgggatggactcggacgaagtgacaaaggaactgaatgaactgcacatgttgatcagtggcgaggaggaaaagttcaggaac

SEQ ID NO: 48752 - DNA, 626 bp, Heterodera glycines
  SCN-specific regions: Sequence locations=1-626
caatgactgaaccttccgcctcaattgttcgtccaactttcttcgattcggttgaaagatgggccgaccgcgactttggagaagatctcagaaattttttggaagagattagttactccgatttggcaagttacgcgcagttgatccatcacaaagatatcattatccaatgtctcctccgtcacttggccgatcggtctctctctttgcccgctttttgcgatttttgttcggctattgcgacggatttgcgtgacgattttcacacgcatttttggcagatttttgatgcaatttcaaatttggttttggcatcgaaaggtaaagagcaatgcagtgataacgaattggagtgcacatttcgcgcgatggaacaaattgtgcgaattaattttcgattcgtttcagcgcggctaaaacaattgtttagccgtcttttaccgctctttgcttttccttctgatgggcgcctccgttttatctccgcccgaactttttcctttgtttttctaaaatcgcctttcccccacaaattggccaaatttcttctcgtcaaatgtttttctgattgtggccatttgcgcgacggactttcgctggttttcttcgacccttttttgggagtt

SEQ ID NO: 48753 - DNA, 704 bp, Heterodera glycines
  SCN-specific regions: Sequence locations=1-389,411-680
ccacgtacggattgacatttgccaacccgtcggtgagtgccaacaattgccagggcactttggttgcgcaaatgttgcggcgtgccaccaaaaatctcgaccttggtgccgaatacatttaccatagggacgaacggtttcctggcaaacagtcgaacactctcagctacgccttgcgctacattcagcccacttggatattttcgggaactcttgcgccaaccgaactccatttgtgttactaccacaaacagagtgaacacttgcagttcggcgttgaatttgaggcgaatttcaagcttcaggaggtgaacacgaccttcgcctatcaaattgaagtgcccgactctctgactctgagggcctgctgcgacacaaattggaaggtcggtgctgtgctggagaagaagctgtccaagcagttgcccttctcgctggcgatcagtggcgtgctcgatcacgtcaaagcgcagggaaagttcggcatcggactgctcattggctgattggcgactgatgaggggagaagcggcgaatgttcgcaattgttagcttctgccaatttacattttacaccattttttgctggccgaccattttctgttgtgtcgccgttgtttgttatcattttacattagattgattcatgcgattcaaaacggataaaaattgacattttcaaaaaaaaaaaaaaaaaaaaaaaa

SEQ ID NO: 48754 - DNA, 1527 bp, Heterodera glycines
  SCN-specific regions: Sequence locations=1-239,268-320,342-1527
gcaacactgaaacttcaggattttcttcgacaaagacttttttccatcagtcaaccaaaagttgtcagtgtccaagctcgtcagtttccagttacaatttattttgaacgacgcactccaacaaattatttggaagcaacattcaaaaaagtgtgtaaaatccacgaggaataccctgcgggtggcatccttgcgttcgtcaccggtcaacgtgaagtcacacatttggtcaaattgctagaaaacaaatacacaaaaatatctgcatcaaaattactgagaaaagagaaaatgaaaaagtgtcggaaaaaagagacaaaagaggaggaggaagagggactactgcttgacaacgacgaattcggaacttcggatatggaccttgaagacgaggcgtggcaaaataccttttttgggtctgacgatgaatcacttaatgcttcgcaatcgttcaaaaagtaccctcctctgctggccatccctctctattctctcctaccagtgaatttgcagaagaaaattttcaacgaaccgccagatgacgggtctagggtgtgtgtagtttctacaaatgttgcagaaacttcgttgacgattccaaatgtccgttacgtcatcgattctgggcgggaaaagaagagggaatatgacccgattacgggagtttctcggtttgtggtcggatggtgttcaaaggcgtctgcagaccaaagatccggtcgtgccggacgagttcagtccggatacgcattcagattgtattcttcggctgtttacgaagatatgcgcgatcattctactcctgagatccttaataaaccgatcgaccaattgattcttatgttgaaagcaatgaatttcacgaaaatcgacaattttcctttcccgactcctccaagattggaccaaatcaaatcttctgagctgagactttctcacataggggcgcttagagttcaagaagggctttataccatcacacaacttggacaatcacttgcgcagctgcctctcactccttcttttgcgaaggtcgtcatcagttcaattcgtggcggacttcttccttttgccgtcactttggtgtcggctctctccgttcgtgaaccattattgttcatttcaagcacaaaagaggacggaacggaagagagacgaaaaagaatgtccgaagtgattaagcaaagatttctttggtgtgctgttggggaggctcgactctttggtgatttgacagtaattctgaacactgttggtgctgctgactatgaggaagagaacgctcgcgcaatcgaagccctaggacttcgccctaaggccctaaaggaaatcaacaaacagagacatcagctgacgcttcttctgaacaaatccgattctgtggagaagttgcccgagaagttcagaatggatgcaccctcccaagaacaactgaggagattaaggcatataatggtgaaatgccatccggataaattggcaaagaaagttcagtcattggatgcaccaaagggcgcatataaaaca

SEQ ID NO: 48755 - DNA, 1521 bp, Heterodera glycines
  SCN-specific regions: Sequence locations=1-127,156-309,336-348,381 -477,507-507,549-549,597-639,690-812,834-871,907-972,997-1101,1128 -1236,1260-1278,1305-1317,1361-1442,1464-1521
ccacaaactaaaccagacctatttaatcaagtcaaatcttagtgagagaaaacatcaaaaatgcgtgaagtgatctctattcatgtgggacaagcgggcgtgcaaattggaaatgcttgttgggaattgtactgcttggaacatggcattcagcccgatggaaaaatgccatccgaccaaaacaaccaagacgattcgttcagcaccttcttctcggaaacaggcaatgggcgtcatgttccgcgtgcggttatggtcgacttggagccaacagtgatcgacgagatccgcactgggacttacaagcatctcttccaccctgaacagctcatcactggaaaagaagacgcggccaacaactacgctagaggacactacacagtcggcaaagaaatcatcgaccccgtcttggatcggattcgtcgcatcgcggataactgcaccggacttcaaggctttctcatcttccattcgttcggtggtggcactggctctgggttcacatcgctgcttatggaacgtctctctgttgactatgggaagaagtctaagctcgagttctccatctaccctgctcctcaagtgtccaccgctgtcgttgagccgtacaattcggtgcttactacgcacacgactctcgaacactctgactgtgcatttatggttgacaatgaggccatctacgatatttgtcgtcgaaatttggacgtggaacgaccttcttacaccaatttgaaccgtttgatttctcaagttgtctcttcgataaccgcttcacttcgatttgatggtgctttgaatgtcgatctcactgaattccagaccaatcttgttccttatcctcgaattcactttcctcttgcgacttattctccagttatctcagctgagaaggcctaccacgaatcattgtcggtttccgaaatcaccaacatgtgctttgagccgtccaaccaaatggtcaaatgcgatccacgtcacggcaaatacatggccgtgtgccttctctaccgaggtgacgtcgtcccgaaggatgtaaatgcggccattgcttcgatcaaaacgaaccgttcaattcaattcgtggactggtgcccgaccggcttcaaggttggtatcaattatcaacctccgactgttgttcccggcggtgacgttgccaaagtcccacgtgccgtgtgcatgttgtccaatactaccgcaattgctgacgcttggtctcgtttggaccataaatttgatttgatgtacgccaaaagggcatttgtgcattggtacgttggggagggcatggaggagggcgaattctccgaagcacgtgaggatttggctgccctggagaaggactacgaggaagtggccattgacactgtggagggagatggcgctggagacgacgactattgattgaaaacattgttcgattaaattatattttggtttggaaatgttcttattgtattgctttattgagacgtaactgctttgatgctttttatataaatatgcttatcttttaac

SEQ ID NO: 48756 - DNA, 2375 bp, Heterodera glycines
  SCN-specific regions: Sequence locations=1-227,250-266,288-690,712 -1433,1456-2375
gtttccttacctcattgacaatttttttcttcattttgagctgttttcatcatgagtgacgacaactgctgcggctctgttggtgcccgttctccgactggctccatctcatcaagcggttccgctgactataacgttgccctttcgccaacccaattgcttgcaatggcaatcaagaaacgtcgtcacttgctcgaggacaagcagcgcgactaccaacgggagctgctccactcgcacctcatccagaacttgtagcgatgccaattttggtggtgatggtggaggccggggcccacggtggctcaacaaacgctcttctcactctgacgacggtggacctccgatgaaacgaaaccgggcggactcttccgaggatgggctcacattcattgatctcaaccataccttgtgaggttgggaagttcgatggagaatttgcagatggtggacggatattctgatcggaatggcatggtcgtcatgatatgattacagtttctttatttttttctacgtgtattttttttttaccgcagataaataatttatagatcacagcgagcaaaataatcactggaaggtcttttgtgtgtagagcatttatgcgttctttcatactggcaagttgaacgtataattcaaacgatcaatggtgatttgtcatttatccaacgttactttttctagttttaattgcagaaaatcgcaactttgcgcggagttttaaaaatgctcaaacattgcacccaaattcgttcatttgccacccaccaaagcaccttctacgacgtggtcattgtcggtggtgggttggtcgggagtgcgatggcttgctccatcggcacaaattcggctttgggtccatccacgagggtgctcctgttggagagtggacgactgcacagcgtcaagcagtcaaaagaagccgaaaccaaacacacttataacaaccgcgtttccgcggtcagcccatcctccgttgaaatgttcataagtaatcctgagtctctcaaccaagtgctttatccgagaatatccaaattcttacctatgttgctgattctgccaatccaattccatcctcttcccttaaaattagccattccttttttattcacaattcggtgtttgggatgagatttgctcgaagcgagttcatccaatttctgcgctttacgttcgtattatttttctggttcaacccattaaaattagtgaagaaaagaaacgaaaaatcaggttgaggatggctgtgccaaatccaaaatccatttcaaacaattggataagcgttcaccgattgctcacatcgtcgagaatgagctcatcgtcgccgcactgcagcaatgcattcgggaccgatgtgccaatgtggaagtgcgccaaggcgcggttgttgaccagaatttgagtgttcctgacaatctcggccaaaatgtcaccattcagttcgaagatggcacaattgaagcttcattgatgattgccgccgatgggtccaaaagtacggcacggaaaagggccggcattgattttgaagaaacggcctatgagcagcgtgccgttgtgggcacattggccctccagcacaattcggagtccgatgaatccttcgcttggcaacgctttgtgccgtcgggccccgtcgcgcttctgccgcttggccgtgaactgtgctcgttggtttggaccgtgtcaactgccgacgcggcacggcttctccaactgtcgcccgaacactttgtggaagagctgaatgggacacttcaatttgacaactcttcggctaattccctcgtcaacaattcgttggattgtcttggcaaggcactgaactttttgccgtccaaagaatcgcctgccaaatgcacaattccccgcgttttgtcgctgccttacgatgaccgtgccgtgtttcctctgtcccttggctacgcttacgactacattcggccgcgggttgcgcttattggagatgctgcgcatcgtgtccatccgctggcggggcaaggcgtcaatttgggctggtccgatgttcgcttcctcaccgctgcgcttcagcgggctttcgacgagggaggcgatttgggttcgttgacatatttgcgcgactttgacagtgcgagccaaaggcgaaatgggccgattatattcgcaattgactgtctgaaccgactttactcgaccgaccaccccttttgcacgttgttccgttccgttgggctcaacattttggaccggattcttccggccaaggatttgattgttcatctggcctcatgatttgatttggtctttactcgatttatgacgaatttcgttgatttgtactgccttttttattttgagtaaatttttttatttcaaaaaaa

SEQ ID NO: 48757 - DNA, 638 bp, Heterodera glycines
  SCN-specific regions: Sequence locations=1-638
cgcgagtttatgtcggcagttaaaggacgacgtgagcaggacagaaaggaatgggcagcctattggaatattcgatggaaggaggtggagaattcattcgtcggcaaatactcttattacacaaaccgttttttggattggccggtcacttggttccgtgagaacattgtggaacggctgcacgacaagcacaagatgccgtattaccatcgcaaaatcagcagagtgcccgaaatcgacgaatgcggcgtcaacgaccgaatttgtctcttcgaagctgaagaacaattccgactggacaaattggtggaccattacattcgcgatattttgtaccaacgcttcactcagtgcgttcgcgccgaagggtacgaccatttgtacaaatgcgcaaagcacgttgacgactacgaaaatgccgagttgaacttctttatcaagtatggcgaattgggcagtgagcagactgtggtggcgtgttacatgaagcaaaagcatcggctgatttgggagcgtcgtcaccccgaaataatggaggagcgaaagcgagcgcatgaagaacacacagagaacatgaacaaggacaaattcaacatgcacttttggatcaaggacaacatttaccgaaagaagcagga

SEQ ID NO: 48758 - DNA, 548 bp, Heterodera glycines
  SCN-specific regions: Sequence locations=1-482,523-527
gcatggaagactctgagcagaatattaccgaacaatcggtatcggctcccaccactgatcacgacgaatatgaagaactttgcaaattggtcaacccaatctcaaaaccgcttgcaaacagaaaattggcaaagaaagtctacaaattggtgaaaaaagcggcaaaagagaagggctttttgagacatggattggctgatgtgatgaaagccttccgaaagaatgaaaaaggaattatcgtcttggcaggaaacgtttcaccgattgacgtgtacagtcatattcctgccatttgtgaagaaaagggtcttccttatgttttcactccgtcccgtgaacaccttggtctttgtgctggctataaacgtcctgcaattgtccttttggtgaagcgacacgattcgttcgcggagcttttcgatcaaacgcacgagtcaacttatgcgctggtggtggaaccggaataagcttttaattccaaaattgttgtttgttcgttttgtttcactcaataaacaaattgtcttaaaaaaaaaaaaaaaaaaaaa

SEQ ID NO: 48759 - DNA, 898 bp, Heterodera glycines
  SCN-specific regions: Sequence locations=1-13,41-142,167-532,554-875
caaaataaaaatgtttgtgcttgacgaggctgatgaaatgttgtctcgcgggttcaaagaccaaatttatgaagtttttaaaagcttgccgaacgatgtccaggttgttttgttgtccgcaacgatgcctaatgaagtgctcgacgtgaccaagaagttcatgcgcaaccccatccaaattctgattaagaaggaggaattgacgctcgaaggcattcgtcaattctacattttcgtcgacaaagaggaatggaagttcgagaccctttgcgacctctacgacaccgtaaacatcactcaggcggttattttcgctaacacgcgaagaaaagttgaggatttggcgcgaaatatgacgcagaagaaattcactgtgtctctcattcacggcgaaatggagcagcaggaccgcgacgtgattatgcgcgagttccgttccggctcttcccgcgtcctcatcaccaccgacctgctcgcccgtggcatcgatgttcagcaggtgtcagtcgtgataaactacgatttgccgggcaaccgtgagaattacatccatcgaatcggtcggtccggacgattcggtcgtaagggagtggccatcaactttgtgacgaaacaggaccagcaaatgttgaaggaaatcgagacatattattccacccaaatcgaagaaatgcctgccaacatcggggacatgatttgagcgttgacagggcaggatcgataaatgggaaagtgatttgggagttattatgtttggattaccacccacccgccctttcaaatcattcggtattaccattattatgttggtcccatttcggctcctggttataaatcgattgttgttttggagggatatgaataatatttgttataaaaaaaaaaaaaaaaaaaaaaa

SEQ ID NO: 48760 - DNA, 734 bp, Heterodera glycines
  SCN-specific regions: Sequence locations=1-141,163-415,449-734
ccaattaagaccaaactacaatttttttaccgacggtcgctctgccaacaaatttacaatttcttttatttgtcatagcaaaaatgaacaactcaaaccacacacagtcggtggaagtgaaattgttaaaggatgacgattggaaacgcattcagcagaacactttcacgcgttgggtcaatcagcaccttaagaaggcgcctggaagtcctaaaattgaaaatttggcgactgatttccatgacggcattttgctgattcaattagccgaagtgttggcccagcggaatttggtccgattcaaccgaaagccgacgatgcggactcagaaattggacaacatttcgacggtgctcaacttcttccagaaggaagaacacatcaaaattgtcaacattgacagttcgcacatcgccgaccacaacctgaagctgatcctgggcctcatgtggacactcattctgcactattccctctctcagtccatcgcatcgacggagagtgtcaacggcgacgaagacggccttggtaacggcaccgaccaccagcggcacccatcgccgcggaagagtacgtcgtcgtccgcatcggaacagcaaagcccgaagaaacgtctgttggcgtggattcaggaacgggtgccgcacctggtggtcaccaatttcacgtcggattggaccaatggaattgtgctgggcgcactggttgatgcgtgcctcgggtcgggtgctttc

SEQ ID NO: 48761 - DNA, 964 bp, Heterodera glycines
  SCN-specific regions: Sequence locations=1-964
gttgaatttactcttcaattctccaatttctgtgcattatttatttcggcgacattttgctcactttcctttgatgaaagccgccgttgtgggcgaaggcgccgttggggcgagcgttgcattggccatccgtcgagcacatcccaatgccaatatcactgttttctcggaccgggactttgaaaagaccaccagttacggaccggaaggcatttttcgggttgatgtgccgggaacggagcgattggccaaagagtcattcgaattttgggcgaaaaccgaaagggacgagttggcccacaaaactggcgttcgcctcatttcgggctattgccaatccaacgacagaaaatggatcgaagcgcaagaaagttcaatgtccgacattgtgtacaattggaagtggctcagtgagcgcgaattgcgcacacttttcgtccgtccgtattgttatggcgcccattacaccacttacgcggcggagggtcggctgtatgtgccgtggctccgtgcccaattggtggccgaaagtggccaagggcttttgcatttccaacgccaacgaattgaatctttggagcagttgatcgactcagatcagttcactttggtggtgaattgtgccggattggaagggggacgattggccggtgacgatggcacttccgtttacccaaaccgcggcgttggactcgaagttgaggctcccggacacgtccatttcacttattggggcagagacatcttttgcattccgatggtgtccaacaatcgtctaatgattggcactcttcgacaagacaattgttgggagttggaagtgactgagcaggaccgaagcgcaatttggacgcgtttcatcgaattgcaaccgaactttagagatgccaaaattgtctccgcgtggtgtgggctgaggccgaatagacacggcggggtcagaattgagcatcaattacgcacc

SEQ ID NO: 48762 - DNA, 642 bp, Heterodera glycines
  SCN-specific regions: Sequence locations=1-136,158-366,390-413,447 -471,495-559,581-642
caattaaggcaagctaaatatttccctaaattgcaaatgtcagcgtcaaaattttttctgaagtcgaacgacgatgaggtgtttgaggttgaccgcaatgtgatccgtctctccaccacactcaacacgatgtttcaagaccttggaatggaccaggccgaggcgggtgaaaagatgtacaccgacccaattccattggcaaacgtcaacggtgcaattctccgtaaggtgattgcatggtgcaatcaccacaaggacgatgctccaactggcgaagatgcggagtcgaaagagcgtcgcactgatgacataccgagttgggatgtggagtttttgaaggtcgaccagggaacgctgtttgagctaattttggcagccaactatttggacgtgcgcgggttgctcgacgttgcgtgcaagacggtggccaacatgatcaaaggcaagtcgccggatgagattcgtcgcacattcaacatcaaaaacgatttcacgcccgaagaagaggagcagattcgtcgcgagaatgcctggtgtgaggactgattggattcgattgtttgttttttgtgctgtgtgtacctatcgccgacagtaaaatcggctatgatcatattcatttactgcttgtctatttcatta

SEQ ID NO: 48763 - DNA, 2092 bp, Heterodera glycines
gtacagttaagtattgtcaaattgctttttcaaaaatgccagctaaagctaatgcaattggtattgacctcggcacgacgtattcgtgtgttggagtcttccagcacggaaaggtggagatcatcgcgaacgaccaaggcaaccgcaccacgccgtcctatgtcgcgttcaccgacaccgaacgtttgatcggcgatgcggccaagaaccaggtggcgatgaacccatccaacaccgtgttcgacgccaaacgtctcatcggacgcaagttcgacgacccggcggtgcagtcggacatgaagcactggccgttcaaagtggtgcagggagagggtgctcgtccgaaagtgatggtggaagtcaaaggcgaggacaaagcgttcttccctgaggaggtttcgtccatggtgcttatcaagatgaaggagacggccgaggccttccttggccagactgtcacggatgcggtggtcacagtgcccgcttacttcaacgactcgcagcgtcaggccaccaaggacgcggggaccatcgccgggctgaacgtgttgcgcatcatcaacgagccgacagccgccgcgattgcctacggcttggacaagaaggggcagggtgagcgccatgtgctcattttcgacttgggcggtggcactttcgacgtgtccatccttaccatcgaggacggcatcttcgaggtgaaatcgaccgccggtgacactcatctcggtggcgaggacttcgacaatcgaatggtcaaccactttgtcgcggagttcaagcgcaagcacaagaaggacctcagttcgaaccctcgtgcgttgcgtcgtttgcgtacggcctgcgagcgcgccaagcgcactctgtccggttccacccaggccagcatcgaaattgactctctcttcgacggcatcgacttctacaccaacatcacgcgcgcccgcttcgaggagctttgcgccgaccttttccgcaacaccatggaccctgtggagaaggctttgcgcgacgcgaagatggacaagtcccagatccacgacattgtgttggtcggcggctcgactcgaattccgaaggtgcagaagcttctctccgactttttctccggcaaggagctgaacaaaagcatcaacccggacgaggcggtggcctacggagcggctgtccaggcggccattctttccggcgacaagtcggaaactgttcaggacttgctgctgcttgacgttgcccctctctccctgggcattgaaacggccggcggcgtgatgacttcactcatcaagcgcaacacgaccattccgacaaagacgtcgcagacattcaccacctattcggacaatcagcctggtgtgctgattcaggtctacgaaggcgagcgcgcgatgaccaaggacaacaacctgctgggcaagttcgagctcagcggcattccgccggcgccacgaggagtgcctcaaatcgaagtcactttcgacatcgacgccaacggcattctgaacgtgtcggcccaggacaagtctaccgggaagcagaacaagatcaccatcaccaacgacaaaggccgcctttccaaggaggaaattgagcgcatggtgcaggaggcggagaagttttccaaggaggacgaggtgcagcgtgaccgtgtgtctgccaagaacgccttggagtcctactgcttcaacatcaagcagacaatggaggactcaaatctgaaggacaagatcagcgaggacgacaagaagaaggtgctggagaagtgcggtgaggtgctggcatggctcgacgccaaccaggcggcagagaaggaggaatttgagcaccagcagaaggaactcgaagggatctgtaatcccatcatcaccaagctctaccaagccggcggcgcaatgcccggcggtccaatgcctggcggagggatgcccggaggtggcggcgctgctggtgcgggaggagccggtggaccgaccatcgaggaagtggactaagcgagtcgatctcttcgcgatcattttttgtttgatcgattatttaattttatttttttctcgcgtaaattgtttgacatataaattcattggttgcttaaaaa

SEQ ID NO: 48764 - DNA, 730 bp, Heterodera glycines
  SCN-specific regions: Sequence locations=1-11,33-34,56-137,166-730
aaattcttctgcaaaattaagtgaaaaatcctcaaaaattattttttagatttaattcttaaatatgagtagtcagcaacaacagttggatgtgcttattgtcatagatggtaccaacattgataagccttgtgtattttttgatcttttcaaatttcaacatttaacttatttaatttaaaggttgatattttttcgagttctggctttgttgcttcttgtctcaattgggtttcaaagcttcattctcctaatgtaattgttgcgttacccaatcaaccgaatgatgtagcagccgaacttttaaaaaaatgggcttctaaattcaagcagcttcaggcatttggtgtttcaaattgccaatctttaaacgatgttcttcgtgaagttgattttcgacaaattcttagaaatgatttcatgctcatacaaaatttagccactttttgtttttcctatctgacgcgacaaatcgaaaaatttcgaaacgataggcggcaaaacaacaaaaatgtgctcacattgctttattactcaaaacgaaattatggaaggaaattcgaggaagatcggtctctgattggatacattgaacaaactcaaaaattaacacattatgagaacattggcaaacatagaacttttactgttccaaagagtgaatttttacatgacacggttttccgggttgacctgttctcctgtgggattgcgctttgtggaatcgaat

SEQ ID NO: 48765 - DNA, 709 bp, Heterodera glycines
  SCN-specific regions: Sequence locations=1-709
aagagaatcgtacgtatttttgctgaaaatgggaatagacataaaccacaaatatgaccgcaaggttagacgtacggcacccaaaagtgaggatccgtacctgcgcgttttggttaaactgtaccgcttcttggccaaacgtgtggacaccagcaaacgctttaatgctgttgtgctcaagcgtttgttcatgtcgaagcgcaaccgtccaccactttcaattgcgcgcattgtgcgctatgtgaaaaagccaggtaatgagaagaaactcgtcgtctgtgttggctccgtgacggacgacaagcgcatttacaccgttccggcgatgactgtctgtgcgttgcgcttcaccgacgcggctcgcgcgcgaatcatcgctgcgggcggcgagtgcatcactttcgatcagttggcattgcgtgcaccaaagggcgagaacacgctgctgttacagggacgacgaaaggcgcgcgaggcggagaagcacttcggaccgccgccgggagtgcctggcagtcacgcgaaaccgttggttcgcgcgaagggaaggaaattcgaacgtgcacgcggtcgccgaaagtctcgcggttacaagaactgaggaattcctgtttcgctttgttgagatatattcccttgtcatgttacctttttgttatggaaatgaaatctttcttatccataatcaaagaaaaaattgttgattttc

SEQ ID NO: 48766 - DNA, 964 bp, Heterodera glycines
  SCN-specific regions: Sequence locations=1-912,934-964
ccctcaatacggcgtttctcagcccatatgtacgaaggaaccaacagaaaaggatttgagactaacgaaagaactcgagagttatctaagaagctctggcattttcgagtcggacttggacatacagaagagatttgatgtcttgaggaggataaattcgttggtcaaaagttgggtcaaacaagccttttttttataggtaccgcccgaacagttggacactgtcggtggcaaactgttcaccttcggttcctaccgtctcggcgttcatacgcccggggctgacatcgattctctgtgcgtcgtcccccgtcacatcgaacgcatcgatttctttacttcattttaccaaatgcttaaagaggatgaaaaaacggcggacctccacaaagttgaggacgccttcgtacctctgatcaaactgcgctacgatggcattgaactcgacattttattcgctcggttggcgttgaaagaaataaaggaagaccaggaactctcagacgacaatttgcttaagaacttggacgagaagagcattcgctctctgaatggttgtcgtgtggccgatgaaattttgcgattggtcccaaatcgactgaatttcattttggttcttagagccggtaagctttgggctaaaaaccatggcatttattccaatgtgttgggctttcttggcggcatttcttgggcaattctcgtcgcccggacctgtcaattgtatccaaatgcaacaccttctgttttattgcagaaatttttcctcgatttttctgcatgggattggccacatcccgtcattctgaaggatgtcgacgctaccccgcggattgacataccctatttcattgacatgatttgggatccgagaacacgcgcatcggaccgctaccatttgatgccaatcattacgccagccttcccagaacagaattccacatttaatgtgacaaggtcaacg

SEQ ID NO: 48767 - DNA, 801 bp, Heterodera glycines
  SCN-specific regions: Sequence locations=1-189,214-525,552-708,730-801
gagcatttaattttaagccttcaagccgaataaaatcttttttcttcgatggatcaacaggagaaaagttccggatggtttgcaaatgttgaaatgggtccaccggatgtgattttgggcgtaactgaagcatttaaacgcgatgacaacccgaaaaaggttaaccttggagtaggcgcatacagagatgaccagggaatgccttttgttctgccgagcgtaaaacaagccgaaaaagaattactcgaagcaaacctcgacaaagaatatgctggcattgccggtttgccggacttcaccgccaaggccattgaattggcgctcggaagagattctgaagttttgaaagcgaaacgaaacgcgacggttcagtcggtgtccggcacgggagcattgagaacgggcgccgaatttctctccaaatggtttccgcacaacaaagttgtttatcagccgacgcccacttggggcaaccatgtgcccgtgttcaagtttgctggctttgaaatccaaaagtaccgctattacgacccgaagacttgtggctttgatgagaatggctgcttggaagacattctgaacatcccggcgaagtccgtcattttgttccacgcgtgcgcccacaatccgacgggcgttgacccgacaccagagcaatggacaaaaatttcggatgcatgcaaaagccgcgacttgtacgtctttttcgacatggcctaccaagggtttgccactggcgacgtcgatggggacgcacatgcattgcgctatttcgttcaacaaggggacaacatttgtcta

SEQ ID NO: 48768 - DNA, 956 bp, Heterodera glycines
  SCN-specific regions: Sequence locations=1-372,395-665,687-956
gtttgagtgatagtatccttattttataaactcaaatttgctgaagtatcatgggagttccagcctttttccgttggctttcacgaaagtatgtgtcgatcattgttgacgcggtggaacagcgcagaagagaaattgacggagtaaaaatcccaatagatgcaactcaaccaaatgagaattaccaagagtttgacaatctttacttggacatgaacggcattatccatccgtgcacacatccggaagaccgacccgcaccgaagaccgaggaagaaatgttcattttgatcttcgagtatattgaccgcctcttttccatcgttcggccaagaaaacttctctacatggcagttgatggggtcgcccccagagcaaagatgaaccaacagcgaagtcgtcgatttcgagcagcacaagaagcggcggagaagcgcgagctcatcgaaaatgtgcgtaagcggttggagtcggaaggaattccgttgccgccaccgcgaaaggaagaggaacactttgactccaattgcataacacccggcacgccgtttatggcccgtctttctgttgcccttcgctattacgtgcacaaacggatcacctacgacccggcatggcaaaagatccaggttattctttccgatgcgaatgtgccgggtgagggcgaacataaaatcatggactacgtccgacgtcagcgcgcttcgccggcgcatgacccgaacaccgttcactgtctttgtggcgccgatgccgaccttatcatgcttggattggccacccacgagtccaatttcaacataattcgagaagagtttttgccgaatcaaccgagggcgtgcgaactttgcggtcaatacgggcacgaggtcgaacattgtgaagggttggcacgtgccgagaccggggcggaccaaagggacccgttgaagaaggagaaaaacttctccttcata

SEQ ID NO: 48769 - DNA, 981 bp, Heterodera glycines
  SCN-specific regions: Sequence locations=1-691,713-981
tattgatgaaaatcgacgatggagtgacttacgctgtttaacagatagggcgtctacatttgccaattcaggattcgtccctggaatcaagaatttgaaagaagttcataaaatgccggtgctagttgttggtgctggtgggcttggctgtgaaatccttaaagacttggctttatctggtttccatgacattcatattattgatatggacacaatcgatctctcaaatttaaaccgacaatttctctttcgtgaaaatgacattggacgctcaaaagctgaggtggcggctgcctttatcgagaaaagggtgtttggctgtaaagttactccccataattgcaaaatccaggacaaatctctcgaattttatcgtaaatttttcattattatttgcggacttgactccattgaagctcgccgttggcttaatgcgactgtgtgttctttggttgaatttgatgacggaaataacccaaaatccaacaccatagtgccgttgatcgatggtggaacagagggattcaaaggaaattcacgtgtgattattcctttcatgacgccgtgtattcagtgcacgatagatctttacactccccaggtcaactttccggtgtgtacaattgctcacacacctcggcttcctgagcattgtgtggaatatgtaaaagttgtgctttgggaaaaggagaagccttttgggcaaggtgaaaatggtaaataactccatcaccattttccatttccatagacgttaaattggatgctgatgaccctgctcatgtcgaatgggctttccgtgctgctcaacaacgcgcgaatgagtatgaaataaaggatgtcgatttgcgactcacccaaggcgtgctcaaacgtataatcccggcagtggcttcaaccaatgccatcatagcgggaagctgtgctcttgaggcattgaaactggcatcaaagtaagcattcagtggcagcaatttcaca

SEQ ID NO: 48770 - DNA, 1443 bp, Heterodera glycines
  SCN-specific regions: Sequence locations=1-89,112-121,146-206,229 -1235,1262-1443
gagattgattggaagaaccggctgcccttcgtcggtcgctgctgcgactcattccttcgcattttccgctgtttgtgcgttttccgtgccttttctgtttccccccttttcgactgccgcaaaaacaacaaattaataaataattaaaacgaaacgaattttaatgggacaactgctggtcgcttttcggggagcagccaatggcaacagaaacaacgacaaccaaaatgcagcaacaaatccatcggcagggcttagacgactgttcgttctgctcagtgcttttttgccgttcggacagcaaacagcgaataatttggagcaacggaacgacaataatcagcagggagagtcagcagaaatgggccaattccgtgccgggttcggcaggcgccgccggcgccatgcgccggctcctcccgatttgtcgggcagcggcgaggcgggcggtcacggcagtccgtgcggtgccaacggcggcggctcatttttcggctcgcactttctgatgggcggtgagctgtacgactcatcaaagccggaagtctttttgtttggcgaccagcaggacttggagctgttgggcagcaaatcagtgaagttccctttctcggccaaaggcgtcaccgattcgatcggtgttctgaacgcgttggtcaatgtgcgcaaggactccgtcaaattcacaaaagttggccgtgccggcggcggttattcctccggcttttaccgtttggaattcgtcttcgactgcgacgtgtcctgctttgtccaaattcacttctgtgcccgggaacaaattgacgaacagcagccacaacttctccagattgtctctcgtcagccccaatttgaacactccgaacgtttccatttccccgtgggcgccaaccaacacttcagccatttcaccttcaaaccgcaccgatacgacatgaaaatgatgcattgggacggcggcccagttttcccggtggtcatcgaaattcgatcggtgtccgaccaattccctgaacaggtccaaaccacgctttgcagcatcgaacggtccaatgatcagtcggcggtgctaattctgaagccaatgaagcagaaactgttctcggacggtgtcctatttttgctgcaagaaattttcggcattgagaacaaagagatggagacggcgccgccggcgttggcggatgaaaacggcgccgaatgcatcatttgcatggccaactcgagggacacaatgattttgccgtgccgtcatttgtgcatttgcaatggttgtgccgaaacactgcgatataagctgaataattgcccaatttgccgttcgccgtttaaagcactgctaaaaatcaaagcgatgcgcaattcactggtgggcaaaggggtcggctctgacgggagtatgaccacggcacggattcgtcatgagccggtgactctgattga

SEQ ID NO: 48771 - DNA, 399 bp, Heterodera glycines
  SCN-specific regions: Sequence locations=1-344,367-399
ggcaccgattcgactaattacttgggtgttcgccttttgtgggtgacgggtcaatcgggcgcaacgctgcaggccaaactctctaaggatttgatgttggtgcatatgtcggtgcctcgtacaatgtctcccgttgccatctccgttctcggcgagttcgttcagccggcactgaagtcctgggacgtgttgagcgttcaggaagaaatggcgtacgacctgagccaacagagtccatacgacttgaccatcgaagggttgtaccgggcggcgttcaggaacggatcattgtccaacgcactgttgtctccccattatcaaattgggaacatcaccaacaagcgcactcaacaatttgtcaactcgcgctggttgaccaaggagacggcactgatcggg

SEQ ID NO: 48772 - DNA, 750 bp, Heterodera glycines
  SCN-specific regions: Sequence locations=1-27,53-750
gagatttataaaatgctttataacggcaaatttttaaataagaaaaattatacaattacctttgaattagcaggaagttttgtggagaatcatcgtggcactgtttattccgtgtctttcaatccttttactcactcggaagcgcccatttattttgccactgtagggaaaaatagggtgtctgtgtacctttgtccacccgaaaagggctttcaattggtgcggcaattcgaagaccaagacgcgaaggacgagttttattacacggtcacttgggcttataaccttgaaaaagcacaacatgtgttggtcgtcggcggatttcgcggaatcatccgtgtgattagcccactcaatgggcgacttcattgcgcattaatcggtcacggcgactccatcaacgaattgtgcacttcgcccgtctctccgatgattgtcgcttcagcgagtaaggatctgacagtgcgaatttggaacgtcacttactcgcaatgtttggccatcctcggggggaccaacggacaccgtgaccaagtgatttctctggatttcgattcgtccggcgcttttttggccactgcgagtatggaccacgcggttaaactatggcacattggcaaaggcaccgaagtgcacgaaaacatcaccgcttcgctgaggggccaattgaattctgtccaaagtgtcgaaatgcattttccgatatgccattcaaaggaccagcacacgaattacctcgactgcgttcga

SEQ ID NO: 48773 - DNA, 587 bp, Heterodera glycines
  SCN-specific regions: Sequence locations=1-587
ggtgagcgctcagagtgattctcctgttcctaattggctgcttaacatcggaccaatttcttgccatgcgtggaacaaggacaaaactcaattggctgtttcgccttccaacaacgaaattcacatattcgctcgtttggagactgtttggaacccgttgcacgtgctaagagaacacgacttgctgatcaccggattggattgggctccgaatactaatcggattgtttcatgttcgcacgacaaaaatgcgtttgtgtggacatgggaggctgaaaagaacagttggaaaccggagatggtggtcgttcggataaacagagctgccacctgtgtcaaatggtcgcccaacgaaaacaaattcgccgttgggacggcgtgaaaatgactggtgggtagcgaagcaaatcaaaaagctgattcgttccactgtcacctcattgaattggcatcccaacaacattttgttggctgttggcgcctgcgacttcaaaacgcgtgtttttttctgcttatgtgaaagagattgacgaaaaaccaacgccaaacccttgggggaccaaaatgccattgggagaattgctcaa

SEQ ID NO: 48774 - DNA, 865 bp, Heterodera glycines
  SCN-specific regions: Sequence locations=1-61,83-385,407-865
ggacggggaccacgttgtgttcaccgactttgagcacgccgaactgaacgaacttccaccagtgccagtcactttgaagggaagtgagtgccaccactgaacatttgttggttcatctacagtcctcccatttttaggcaaagtcttcaacattggaaatgctctcgcggccttttctggcgcagttcaaggccccgtttcgcgtggacgtgttcagcaagtcaaagtgcccaagaaaatgtccttctattcattgtctctcgcactcgccgagcccgactttatgatttgggactttgccaagttcgacgaacctgcgcaacttcacgccctttggcaggctttgtacagttttgaggagatggttcgtcatcttgcgactttccatttgtttgggttttcctttcagaaaaactacagccctttgccccgttccgatgccgacgcaaaattgttaaaggaaatgctgccaaaagatgcgcccgaaatgccggactcactgctcttaaacttctcttaccaggtcccttttgtgccattttcaacttcgaattcctcccccgtcttaaggcgtgcggaaatctccaacccatcgcttcgctcatcggcgggttggtggcccaagaggcgatgaaggcagtgacgcaccacacgactcccctcaagcagtttctgtacaccgattctcttgaggcgttgccgggcgcagattcgacctttgacgccgccaagttggagaagaacgattgtgcaccggtgagtttttggacggacaactaattgctgttggagtattcaaaaactgtccatttgcagcgcaacaatcgctacgatggacaggcggccgttttcgggtgggcctttc

SEQ ID NO: 48775 - DNA, 614 bp, Heterodera glycines
  SCN-specific regions: Sequence locations=1-10,32-614
catacctaactatttttaaataaaaaaattacaaccagcctgttgaatggggaattcgtcaactactgctcgatcggatgatccccagtcgacactaacagccggtgaaacgctttctgattacgatgagaacattatcaacagggggcgagtggcaccacgaaaagagtcgttttgcaagggtcttgcattcagcaaccgacccataagcatcaatgagatcgtatgcattcgattgagtgagatcggcactaattggagcggagttatgagattcggtgtcactaatgttgatccggccagttttcgcgacattgaattgccaaagttcgcgtgtcctgacctcacctctaagggcggctattgggcaaagtctcttgctgaacgatattccgtggaaggctcaattttgcattttttcaccaatgccaatggcgaaatgtattacggcgttaatggggtgcacaaagggctcttcttgagcggaattaatgtgcttagtccactgtggatcattgtggacatttacgggaattcgattgccgttgaatttatcgatccaagtgaggtgcaacttcaatcgaaacgaacttcgtccaaaaatagggctggat

SEQ ID NO: 48776 - DNA, 622 bp, Heterodera glycines
  misc_feature (513)..(513): n is a, c, g, or t
  SCN-specific regions: Sequence locations=1-485,507-622
gttgagctttatgttttcatgaatcaacgaagcgaaatgccagcgcaactccgtttccaaccgtccaatgctattggaacgcaccagcgctcaattataactgcacaacaatttcaacagcagcctttttgtgtaaaacgcgcccgttatgattatgatttatacgaagggcaatcgcatcataatttccaaagacagcgttttaatcaaacaccgccctccgctattcatccaatgcgcactttccaaattcgtcatcgttcaacggataaaacgcgcgggttgcgtcattttgctcaaaaagtttgtgagaaagtgaagcaaaaagttcaaactaattacaacgaagttgcggaagaattggtcaatgaatattttgacaatattgctgaagtcccatctgacccggaaaaattacaatatgatacaagaaacattcgccgtcgtgtttatgatgcgcttaatgttttaatggcgatgaacataattgaaaaagaaaagaaagagattcgntgggtgggcttgcccacttcgtcgttggccgagtgccgacggctcgaagaagaaaaggacaacgtcaggaacgaatccgtcaaaaaaccgaacaacttcaggaactgat

SEQ ID NO: 48777 - DNA, 872 bp, Heterodera glycines
  misc_feature (815)..(815): n is a, c, g, or t
  SCN-specific regions: Sequence locations=1-326,348-781,804-872
gatatttaaattttctaacatgacacagcagagaaatcccaatgggatgaaaaagaccaacaaagaattgacggaactcaacgactgcttatccaaatttgcttatcttcggggttttcttccgtctcaagatgatcagcgcctattcgaaagtttttcctcggctcctccacagaaagaatatctgaatatcgctcgttggtacaaccatgttcaaacttacgaagatgttgaacgtcccacacagaccagataaatcgtctaacattggcaaggaagagacagcaccaaagaaagacagagttggggaagattccacgaaagtgacaacccaaaaacgatttgccgagatgtttggtcatttgcacttccacgaggtgggcaaaaacgacacaaccgaaggttatgtgcggacagagaacacagaacgacttctaagagagcacgtcaaagcggggggaggaaaggttgtcacgcgttttcctcctgaacccaatgggattttgcatatcggacacgcaaaagccatcaacattgatttcggattggcaaaggcacgtgggggtatttgctatcttcgcttggatgacacaaatcccgaaaaggaggaggagagatttgtgcaggaaattgaggacatggtcaattggataggctattcgccctacaaaatcacacatgcttcggattaatgtgaccaactttacagctgggcattgacccttattcggaagaatttgggctacgtttggccgccgagtacggatgaaaagcgggggtttaacccctctccttccccctggcgggaccggccnctggaagaatgcctagggttaattcaggcgaagaaagacggagcattggacggaggg

SEQ ID NO: 48778 - DNA, 847 bp, Heterodera glycines
  SCN-specific regions: Sequence locations=1-66,88-397,419-704,727-847
tcttctcaaaatgccttctgtttcttttgtggatgtccccgttaattcgccgtttacctttgagaatctcccgttcggcgtcttctcaacaaatgaaaatagcaaaaaacgcattggagtagcgattggagcccaaatcttggacctttcggtcgtgaaacatctcttcaccggtccgctgctttccgagagacaaaatgtttttagtcaagaaacgctgaaccaattcatgggactgagtcggcagtgttggctcgaggcgcgtctcaccctccaatcgttgctgtccaatgccaacccaatgcttcgcgatgacagcgaattgcgcgaaagggcttttgttgcgcagtcggaggccaagatgcatttgcccgccctaattggcgattacactgacttttattcatctatttatcatgccacgaatgttggcacaatgtttcgtggcaaagacaacgcacttatggagaattggaaatggctgcccgttgcttaccatggcagggcgtcaagcattgttgtctccggcacggcagtcaatcgcccgtggggccaagtcaaggcggaagatgatacccagccgaactttgtgacaagtcggttaatggactttgagttggaaatggcatttttcgtgggagggcccgaaaacgctttgggcacgccaattccaattgagaagacggaggaacacatcttcggaatggttctgatgaatgattggagtgcaagggacatccaaaaatgggagtatgttccgctgggcccattcctcggcaaaagtttcgccaccaccatttccccgtgggtcgtcacaatggaagcactccgtccgttcgtcgtcgac

SEQ ID NO: 48779 - DNA, 836 bp, Heterodera glycines
  SCN-specific regions: Sequence locations=1-815
cctctactctgtttgctgctgatcgtccgcttttcctccccttcagcttaaacactcaaacccctctcccccccccccccgcctccattctccgctgactgatctgtccgcccccgcacttcttttgcccgtttcttccgccgttacacactcatctcacatagtcccacaaaacatttcaccaacaaaagcagcagaagaattaccaaacggaagagcagagaaatgccgtcccaaggagaactcaaagaaatcttcaacctttacgatgaggaattggagggcaaaatcgacgccacgcaaattggcgacgtggcacgcgcgtgtgggctgaagccgaccaatgcgatggtttggaaagcggcgggcgaagaatacaaacgcaagggcgagaagaaattggcattcgaagaatggctgcccatcttcgaacagttgcagaaggagaaggaagtgggcacttacgccgacttcgtcgagggtctgaaagtgttcgacaaagacgagagtggcaaaatcatggcagccgagctcaggcacgtgctgctggcgctgggcgaacggctgagcgcggaggaagcggacgaacttttgctgggcgcccaggacggcgagggaatgatcaattacgaccagttcatcaaaaaggtgttggccgggccctaccccgaggattgaaagacgcaacgcaaattagacaaaacacaaaatgagagatgggaaaagtccacccgaatgacgaaagagatgatacaactgttttctcgccccatttccaaattggcaattgctccaataaaaggcgttcaattttcaaaaaaaaaaaaaaaaaaaaa

SEQ ID NO: 48780 - DNA, 1127 bp, Heterodera glycines
  SCN-specific regions: Sequence locations=1-13,35-39,64-132,155-1127
attaagatgcttctttttggcagcaaaaatctttctacccttaaaataattttaagaaaaaatgccacagctgcggttcaggcagaaagtccaaaacaacaaaaggtcgaagttacgattgatgacaaaaaagtgttggtggatcctggcatgacaattcttcaagcctgtgctttggttggtgtggacattccgcgcttctgttaccacgaccgattgtcaatcgcagggaattgtcggatgtgtctggtcgaagtggaaaaatctgtgaagccggtcgcttcttgtgctatgcccgtgatgaacggaatgcgagtcaagacgaattcagcagcgaccaaaaaagctcgcgaaggcgtgatggagtttctgttggtcaaccatcccctcgactgtccgatttgcgaccagggaggcgagtgcgaccttcaagaccaatcgatggcttttggctctgatcgaagtcgacaccaaaatgaatatgacgggaaaagagccgtggaagacaaagacattgggccattggtgaagacaatcatgacccgttgcattcattgcacgcgttgcattcggttcgccaacgaaattgccggggtgcccgacttgggctcgaccggcagagggtccgacatgcaaatcgggacgtacgttgagaagctgttcgcctctgagctttccggaaatgtcatcgacttgtgccccgtgggtgcactgaccagcaaacagtacagtttcgttgcccggccatgggaaactcggaaaacggaaagtgttgacgttatggatgcattgggctcaaacattgtaattgcacacagaacaggagagattttgaggataattccacgaatgaacgatgaagtgaacgaagaatggttgtcggacaaagcccggttcatttgcgacgggctgaagcggcagcgactgttacagccgatgctcaaaaatgagtcggacgttctgagtccctgcaattgggaagaagccctcttcacagcggcacaaaaacttcgtcagatcactccaaatgcaattgccgggttggccggcggcctcgtcgatgcagaatctctaatcgcattgaaggatctgctgaatcaaatcaactcggaaaatgttttcagtga

SEQ ID NO: 48781 - DNA, 1041 bp, Heterodera glycines
  SCN-specific regions: Sequence locations=1-173,195-703,725-972,1008 -1041
gctttgttgaatttctttcactcaaaaatgtccagcgatattgtcgagaaaaaggagacaaaccccaatgagacggatgacaaaaccaaagaaataaaatcgcttgacgaggatgaaattgccgcacttagtaattacaacatgggaccgtacgcggatcagttgaagcaggcggagaaggacattgatgaaattcagaagcgcataaacactctttgcggagtgaaagagagcgacacggggctggcgccgcccattctttgggacattgcggccgacaaaatggccatgtcccatgagcagccgctgcaggtggctcgctgcacaaaaatcatcaaagaagagggcaaagaaacgcgttacatgatcaatgtgaagcagttcgccaagttcgtcgtggacttgcacgaaaatgtggcgcccactgacattgaggagggaatgcgagtgggggtggaccgcaacaaataccagattcatttgcctttgccggcaaagattgacgcgtccgttacgatgatgcaagtggaggacaagccggacgttacctacgcggacattggcgggtgcgaagaacagatcaaaaagttgcgtgaagtggtcgagtttccgttgcttcagcctgagcgtttcacgagtttgggcattgagcctccgaagggcgttttgttttttggtccgccgggcaccggcaaaactttgtgtgcccgcgcggtcgccaatcggacggacgcgtgtttcatccgcgtcatcggttccgaattagtcaaaaaatacgttggcgaaggcgcgcgcatggtgcgcgagctgttttcgctggctaaaacgaaaaaggcgtgcattctcttcttcgacgaagtcgacgccatcggcggagcgcgatttgacgacggaaaagggggcgacaacgaagtgcaacggacgatgctcgagttggtcaaccaactggacggattcgactcacgcggggccatcaaggttttgatggccaccaacagaccggacacactcgacccggcgctcattcgtcccggtcgcatt

SEQ ID NO: 48782 - DNA, 1030 bp, Heterodera glycines
  SCN-specific regions: Sequence locations=1-362,401-685,707-962,984 -1030
aaaagcatccagaaatgctagatgaaacctcagcctccagagcaattggttccaatgaaactgctgtgatgatcaactcggatgaacacgaattggacaccgatcccggcgttcagggcagtgacaatggcgcctcctcttccatgcaaaggcagctgtccgccgctatgcaggcggtcgtggaggagccgaccttcaatttgcgtttaattgacgcggtcaggcaaagccattgtctctacgacgcttcggacaaacaatacagaagcgcggactacaaaataaaggtttggaatcggcttgtacacgttctcgggttccaaggtgacgcgcggacattgtacaaccggtggaagcaattgagagacaaatacggaaaagagaaaaagaaactgaaatacagcggggagcagcactcgcaatggcaatattttaagcatctcgaatttctcgatccgcacatggtggacaggacacaacaacgttttgagcgcaacaaagaaggcaaaactgaacaacgccaaattgtcattaccgacccaaactttgctcttcacctgatcaaccaagttcggacgcagccttgcttatacgatatcaaggacacgaagtatcgtcacacggagtacagaaatcaggcatgggctgagattgcaaaaaacctggcatttcctggcgatgtgagtgccctttacaaacagtggaagaaaataagggatcgatatgtgcgcgaaaaaaggaaactgcgcatgaccaatggtacggagaatgaggagcccaattgggagttgtaccgggaattggtttggatcgaccgatatttggacgaacgcgcagcgcaggtaaagcggaagcaagagagcagcgacttgtccggagaggaattcatagaggatgcttactccacccaaaatgcttccggccttagtaattcgttgcccggaaattccgccaccccattggactctgcccatccccaccaccacccgcagcaacatcactacgccaatgtgctcatgccaaactctgg

SEQ ID NO: 48783 - DNA, 612 bp, Heterodera glycines
  SCN-specific regions: Sequence locations=1-7,30-32,59-84,108-150,172 -241,273-387,409-612
gtttgagcacttttgaaaagtttataattgaattttgctcatatttttgcataaatgaaccaagaacaagacaatatcccaactttcaagcttgtgttggttggtgacggtggtaccggaaagaccacttttgtgaaacgccatttgactggagaattcgagaagaaatatatcgctacgcttggtgttgaggtccatcccctcacttttcacacttcgcgaggtcaaatccgattcaacgtttgggacacagccggccaggagaagtttggtggacttcgtgatgggtattacatccaaggccaatgtgctattgtcatgttcgacgtgaccgccagagtcacatacaaaaatgtgccgaattggcaccgcgatttggtccgagtttgtgagaacatcccaattgtgctgggtggggaacaaagtggatgtcaaagatagggaaagtcaaggcgaaaaagcatcacttttaaccgcaagaaaaatctccagtattaacacatttccgcaaagaacaactacaatttcaagaagcccttcctttatctggcaagaaaactgatcggcgaccccaaactccgaattctggggaaagccggccctccctccccc

SEQ ID NO: 48784 - DNA, 745 bp, Heterodera glycines
  SCN-specific regions: Sequence locations=1-476,498-745
ccaaagtggaggaaatccgacgcactgtttatgtgggcaatttgccaaagggatgcgacggcgaggaggtgctcaacttctttaacgcgtgcattggcgaggtgatgtatttgcgaatggcggccggcaacgactatttgccctgtgactacgcttacgtcgagttcagtcagcagtcgtcggtgccattggcactgcaaaacagcgactcattggagtttcagggacgtccattaagaatccaacattccaaagttgcgatcataaaaccgcaacgcaaaacggctgaccaggcacttgaggaggtggaggaagcgatcaaaagcggcagcgacggacgcacaacgacggacactggccgtggctattcgccgttccgtcccggggtcagcgccccgcgcgttgtgccgacctcaccgcgtccatccgtcaaacgctccacccgctcacgttcaacgtcctccagtcacagtcgtcgttcccgctctcgttctcgccgacgtcgttcccgttctcgctccacccggtcgccgtcccgttcgcgtcgccgccgttcgcggtcacgcgatcgcaaacgctcgcggtcgcgtcgccgttctcgctcgcgcgataaagaccgcaaaaaggccagcaaacgctctcgttcacgcgaccgttccaccagagaaagcggcagcaaagcatcgaaacgggacaaagacaggagcagcagagagcgcgacaaggagaagagcagcaaaaaaga

SEQ ID NO: 48785 - DNA, 658 bp, Heterodera glycines
  SCN-specific regions: Sequence locations=1-658
ctttccatggcttcagaatgttgtatacaggttttttgtcgggttcgcgcctttgaacgagagcgagaagaagaacagttccaccaatgtcgtcaagtttcagtccaaagacaccatcgtcgttgggggaaaaccgtacgcctatgaccatgtgtttgagccaagttccaaccaagaggccgtgtacagcactgccgcccgacacattgtgcaggacgtactcaccgggtacaacgggacaatttttgtctatggacagacttcgtcgggaaaaacgcacactatggagggtgttattggcgactccgagaaacagggcataattccacgcatagtcaacgacatattcactcacatctacaattttgttgacacggaaatggaatttctgatcaaagtgtcttacttcgagatttacaacgaacgaattcgcgaccttttggatgttaccaaaacaaatttggcaattcacgaggacaaaaaccgaattccgtttgtgaagaatatcaccgaagtgtttgtgacaaacccggacgaagtgttggcttacatcgaagaaggaaagacgaaccgacaagtggcggtgacgaacatgaacgagcattcttcacgatcgcacagcgtattccaaatacaggtgcagcaagacaacaaaacg

SEQ ID NO: 48786 - DNA, 615 bp, Heterodera glycines
  SCN-specific regions: Sequence locations=1-209,236-615
gacggtcggcacggcgtcttcttccgcaacgatctcttcccgtacagctccggctcatccccggtcgcctccttccgcttggccgtccaccattcgcgcgctccctccacttgcggcaaattcaacgagtcgcttctcggtgaattggccaattcggccacgttgcagtcgtcgctgtgcgtttgcacgtccattcgacggacggccgcggtggtggaggaggaagaagaagcgacggagggccggaagctgaagcttaaggagcacccggtgaccgacgaatacaaagtgtcacatgagatcgtcggcattggcgaaagcggtaaagttatggcgtgtttccataaacgacgcggcgaaaagtgcgcgctcaaagtgttgcgtgacaatgcgcgcagtcggcgcgagttggcgctgcatttgtcggtgtttgggcatccgcacgtggtgtccattgaagacatgttcgagaacagcttcgacggattcaaatgtttgctagtgggggtcgaattcatgggaggaagagaagtgctgaccatctttgagcagaacggacgattgggctactcggaaaaatgtgtgggccgaattgtgagccaaattggaagtggt

SEQ ID NO: 48787 - DNA, 374 bp, Heterodera glycines
  misc_feature (353)..(354): n is a, c, g, or t
  SCN-specific regions: Sequence locations=1-322,352-354
cttttctggcgaatattgtgctctttgagtgtcctttcattggcccattgtgcttacagtgccgcacagcatcgttcctaccttcgcctcgttggccaacctttcactcatttgcctgcggaccttactacacaaacgttgctcagtcttttgttcgccattgtttctgccagtttcgttgttggcgacttccaaccgattcgcaccgaccttttgatttcaaaaaagtcgtgggatgtgctcggcaattgtccctccttttacgtgtacaatcatcgtgccaaatgtttgatgccaaaatttgatgacattgattaattttttggcacttttttcaataaatgtttttattnnaaaaaaaaaaaaaaaaaaaa

SEQ ID NO: 48788 - DNA, 627 bp, Heterodera glycines
  SCN-specific regions: Sequence locations=1-154,190-267,338-509,532-627
cattttgtgtgttataaggcggggagacgttcgatatttattgtgtgtgttagaagaggaagagaagaagcaggaagagtggaagatgagcgcgaatacggaatgctatcgttgccacgaattcgggcacatttcgcgtgactgtcccaatgccggtcgtagtggtggtggtggtggtggcggtggcggctcgcgcggcggtggaggcgaaaccaagtgttataactgtggacgttctggacattttgcccgtgaatgccgtgatgccggagaccgcgaccgtgggcgcggtggtggtggcgggggcggcggacgaggtggcgatgaccgcggcagcaaatgttacaactgcggtggttacgggcactttgcacgcgaatgtcgcgatgagagaagcgccagcggcggtggacgtggcggcagagacgacagggatgaccgaggcaacaaatgctacaattgtgggaaaagcggtcatttttcgcgcgagtgtccggagggaagcgaccgccgcggtggtggcggcggtgggcgcgaccgtgacgaccgtcgctgctacaactgcaatgagccagggcacatgagccgcgactgtcctaaggaagcgcgatagatcacgtcgctctg

SEQ ID NO: 48789 - DNA, 823 bp, Heterodera glycines
  SCN-specific regions: Sequence locations=1-8,31-287,332-677,701-823
ggtgagataaaatttgaagcaattaaaaaatggctgatcgtgcggggttccaaagtggatttggtggtgctgctccaccgtcggcgcgtgggcgtggtgggcctcgcggtcgtggccgtggcgctgccagagggcgaggacgtggaaaggacgccgagaaggaatgggtcccggttactaagcttggccgtcttgtcaaggatcgcaaagtccttacgattgaggagatttatctccactcgcttccgattaaggagtttgaaattatcgaccttttgctttctggactgaaggacgaggtgctgaaaattatgccagtgcaaaaacagacgcgagcaggacagcgaactcgcttcaaggcttttgttgcaattggtgaccacaacggccacgtcggactcggagttaaatgctcaaaggaagttgccactgcaattcgcggagcgattatcgccgctaaattagccatcattccagtgcgtcgtggctactggggcaacaaaatcggaaaaccgcatacggttccatgcaaggtcactggcaaatgtgcatctgttctcgttcgactcattcccgctcctcgtggtaccggcattgttggtgcgcctgtgcccaaaaaattgctccaaatggctggcattgacgattgctacacttccgccgttggccagacggcaactctgggcaactttgccaaggcgacttactacgccatccaacggacatattcctacttgacgcccgatctttggaaagagaacgaattgccgagaaatcctctggatcacattggcggtggcggggcgcaataagcgcagcgagg

SEQ ID NO: 48790 - DNA, 567 bp, Heterodera glycines
  SCN-specific regions: Sequence locations=1-18,47-85,107-250,272 -329,351-498,538-567
tagacactacccgtaccctaaaattttttaataacttttaaaaattccattttttcaaaaaagagatcctaccatcggcagtattacaatttttgtctttaatttttctggttcaaatggctgttggcaaacagaaaaaatccgcggagaatatcaatgcgaggctggccatggtgacaaaatcgggcaaatactgcctgggctacaaacaagcgcttaaaacacttcgttcgggcaaagcaaaattggtgatcatctccagcaacacgccgacactcagacgcagtgaagttgaatactacgccatgctgtcaaagacgggcgtgcacgagtaccatggcaacaacatcgagctgggcaccgcttgcggcaaactgttccgagtgtccatgctgtccatcactgacccgggcgactcggacatcattcgcacaatgccaaccgaggcctgacaaatctctgtgagctgttgtgatcacacactgtgctcatcgccgttgttttcttatgttgttgttgttgtttttaacttgaaaatttaaaaaaaaaatttcactcggtttaaaa

SEQ ID NO: 48791 - DNA, 658 bp, Heterodera glycines
  SCN-specific regions: Sequence locations=1-7,45-401,425-479,501-658
gaagaatttgcttttttaattttgtctttggattcttagttcttacaatttgagaaatgtctgcgagaccaaaggtttttttcgatgttatggttggcggaaaatcgacaggtcgaattgtgatggaattgtttagtgacatcgttccgaagactgccgaaaattttagggctctgtgtactggcgagaaagggatgggcaaaagtggcaaaccgttgcactacaaagggtcgaagttccaccgcgtcattccgagtttcatgcttcagggtggcgattttactcgaggcaatgggaccggcggcgagtcgatctatggcgagaaattccccgacgagaatttcaaagagaagcataccgtcccgggactattgtcgatggccaatgccggccccaacactaacggctcgcagtttttcatcaccacagtgaaaacggagtggcttgacggcaaacacgtggtgtttgggcgagtcgttgagggcatggacgtggtgaagcaagtcgaagcccagggcaatcagagcggaaagacagcgaacgaaattaccatcgccgattgtggccagctttcgtgaaagcgacaaatttgtgcatcgttacagctcagttttagataattaattattgttttgtaagtttttgcactttgttgctc

SEQ ID NO: 48792 - DNA, 619 bp, Heterodera glycines
  SCN-specific regions: Sequence locations=1-94,123-155,177-365,388-619
agcaattaatgatttgttcttgagtacaaaaaacttaatttattggcttttgacgcccttctcaaaaggcatcacttctcaaaatgatgaagcatacaacgagcagcagcagcagtaacagtggggatgccaagccacagttcatgccatcgaaaccagcgttccatgtcattgggtggaccagcacatgagtcactgttgtccaagcaacattcctcctcccctccacagacggtggagctgagccgggccgacaacggcgactgtgttgtgttggttgtggaaaacacgcggttcattgtgaacccggctttgctggtcgtcaaaccggacacaatgctgggacgaatgttctcgttgagggcacgcacgggcggcgggacaaacactctgtccgtgccctcgtcgtcgtcgtcggccaatgaccccggcgccgaccgtggctcccccagtgatttggtgcgtcccaacgagcgcaatgagtacgacgtggcggagggactttccgccgcttgtttccgtgttgtcatggacttttaccaccgtggctttatgcacgtgccccagtccatttctgtggccgaacttcgcgaggcatgtgactatctgttggtgccgt

SEQ ID NO: 48793 - DNA, 981 bp, Heterodera glycines
  SCN-specific regions: Sequence locations=1-145,167-422,459-614,644 -795,822-981
gtccaattgagatttgtttatctttactcaacaatttgcggtttaataattaaagacgctaaaaaatggcacaacagcaagcgataacgaagaagcgtaaagctgtgcaagacggaattttcaaggccgaattaaacaactttctcatgaaggagttggccgaggacggttattccggtgtcgaagtgcgtcgtgcaccttcccgtactgaagtgatcatcatggcgacgcgcacccaaagtgtgctcggcgagcgcggcaagcgcatccgcgaactgaccgcactcgtgcagaagcggtttggctattccgctggacaaattgagctctatgccgagaaagtgtccagccgtgggctttgcgcggtggcccaatgcgagtcattgcgttacaaattggtcggtgggctcgccgtgcgtcgtgcgtgctacggtgtgctgcgcttcatcatggaaagtaatgcccgtgggtgcgaaattgtggtcagcggcaagttgcgcggtcagcgtgccaaggcgatgaagtttgtggacggagtgatgatccattcgggtaacccggtcaccgagtacatccaagaggcggttcgccacgtgcaaatgcgacagggcgttttgggcatcaaagtgaagatcatgttgccgcacgaccccaagggacagatgggaccgcgcaatccgttgcccgaccacatccaggtcaaagagccaccgattgacgtcgcgccgaccacgccgtactcggagcaccgcgaaccgatgaccactggcatgccgccccagacacaaatgccgcccgcccatcagcagcagcagctgccgatggttggccaagtgccgcccccggcacagttttaattgtgaggaagaaccgctgctgatggtcctgatggatgagtgggagatgttcaattaaaatttgttatttgtgtgtcatcggcacagaccacccatttttgttccgttaaaaattctttgttgt

SEQ ID NO: 48794 - DNA, 477 bp, Heterodera glycines
  SCN-specific regions: Sequence locations=1-25,58-409,431-431
ctatgatattgcgcgtggtgtgcaaaaaattctgcaggactacaaatcactgcaggacatcattgcaattcttggaatggacgagttatctgaagacgacaaactgacagtctctcgcgctcgtaaaatccagcgttatctctcgcagccgttccaagtcgctgaggttttcaccggacacaaaggaaaatttgtgactctcgagcagaccattgacggatttgaatccattcttaaaggtgagatggaccacatccccgaagtggcgttttacatgcagggagcgatcgacgatgtgcacaagaaagcggacgagttggccaaacagagttaaatagagaaataataatcggcacatagacctgattgtttaaatttcgttataggctgtttttttgtttaaatgcgtgtctttttggtaaattgttttcaaaaaaaaaaaaaaaaaaaaaaaacccaaaaaaaaaaaaaaaaaaa

SEQ ID NO: 48795 - DNA, 626 bp, Heterodera glycines
  SCN-specific regions: Sequence locations=1-188,215-626
gaatgaagcggttggagtgtgccgtccaacactacgcctggggcaagagcggcaaggacagttttgtcgcccatttgttgccggctgagcgagttgatttggacaagcgatatgccgagctctggatgggcacccatccgaatgggccgtcccgtgtgatcgacggcggcgcagaggcgtcaacgaatttgaaggactttttggcccaaaatccgcaactgttgggccaccacgagaagggcgagctgagctttctgttcattattttgtcggtggacaaagcgttgtccatccaatcgcacccgacaaaagaacaggccaaggtgttgcatgccaaagacccggccaactacccggatgacaaccacaaaccggaaatggcgattgctctcaccgactttgagctgttgtgcggctttcaaaccccgcatggcatcatttccaacgtgaaggcccaccgggaactgctccaactcgtcggcgagccgttactagacgaattggcacaggcggaacaccacgagccggactggggcgagcgtgcactgcgccgcatgttctgccaagtgtggacgagcccggcggagcaaattgcgcacgttgttgcacaaattgtggaccgaatt

SEQ ID NO: 48796 - DNA, 594 bp, Heterodera glycines
  SCN-specific regions: Sequence locations=1-594
caagtttgagaaatcagctctaataatcttttcacgtcgtcatgggtcgcatgcacaacccgggaaaaggcatttcgcgctcggcgttgccttaccgtcgctctgtgcccacctggcagaagctgaccaaccaagaggtggaggagcaaattgtgaagttggcccgcaaagggttgcgtccgtctcaaattggcgtgattttgcgtgattctcatggcgttgcgcaagtgcgtcgtataaccggcaacaaaattgtgcgcattcttcgatcaaaggggatggcaccagaaattccggaggatctttaccatctgatcaagaaggcggttagcatccgcaagcatttggagcgtttccgcaaggacattgactcaaagtaccgtctaattttggtggagagtcgaatccaccgtctcgcccgttacttcaaaaccaaacggatgctcccgcccacttggaagtacgaatcggcgaccgcctccgcactcgtctcttaatttggcgatgaaggctgctgctaacgcacatttttatttgttgatgattgaattaaactgttgatctttaaaaaaaaattttgcgccgcaacaaaac

SEQ ID NO: 48797 - DNA, 571 bp, Heterodera glycines
  SCN-specific regions: Sequence locations=1-571
gtcaaatttcgtcaacatgggtatcgacatcaagaaccaccacgtcaagaagacgcagcgccgcgaggccgcttcccgcaacccttacttgttgctcctcgtcaagctctacaagttccttgcccgccgtaccgatgccggcttcaacaaggtcgtgctgcagcgtcttgtcaagtccaagatctacaagccgcccgtgtccttgtccaagctctccgtatccatgaagggccgcgaggacaagattgccgttgttgttggtcccatcaccgacgacaaccggttccacgaggtgcccaagttgaccgtggctgccctccgcttcaccgagtctgcccgtgcccgcattgtcaaggccggcggtgagtgcctcacgctcgaccagctcgccctccgtgccccgactggcgccaacaccgtgctcctccgcggctcgcgccagcgcgttgccctcaagcacttcggcaaggcccccggtacccccggctccactgccagcccctacatccgctccaaaggccgcaagttccagcgcgctcgtggtcgtcgtgcttcccgcgggtaccgcaac

SEQ ID NO: 48798 - DNA, 666 bp, Heterodera glycines
  SCN-specific regions: Sequence locations=1-280,302-494,522-607,630-666
aaaacacagaaatggctgatgacaaaagctgtgacggtgcttcttctgcgttgcctccgtgtttaattgtgcttggaatggccggttctggaaaaagctcatttgtccaaaggttggcgagtcatctccactccaagaaggtgttcccctacttggtcaatctcgacccggcggcagcaaccgttccattcccagcaaacattgacatcagagacactgtaaattacaaaaaggtcatgcaggaatacggcctcggtccaaacggtgctattctgaccagtctgaatttgttttgcactcgcttcaaccaagtgttggacttgttggacagacaaaaggggtccatgccatacgccattttcgacaccccgggccaaattgaggtgttcacgtggtccgccagcggcactgtcatcaccgattcattggccgcctcttttccgaccgttgtcgcttatgtgatggatagtgcccgttcgaccaacccgacgactttcatgtccaacatgctctacgcctgctccattctttaccagaccaaattgccatttttcgtcgttttgaacaagtccgacgtggtggaccctgcttttgccgtcgaatggatgaaagattttgagcagtttcaaactgcgcttgaccaaaattcgtccagtttcatgaacg

SEQ ID NO: 48799 - DNA, 699 bp, Heterodera glycines
  SCN-specific regions: Sequence locations=1-678
gtttgagggcctaattctgactacctagttttgcgaaatggttgtgctctcaaaacttggctcgccgcttcgtccgttttccaatgactatctcctttgccgcttccaggccttccgtaattatgcaatcaaaaaagaaaggccgccaccagcgaagattcaagtgccgccacccgcaaacgaaactggccattggaaatatgagcgtgactactcctatgacctgcgttattcaaacccgatcaacaaatactccagttttaccaggttcattacgctcaccgcaacaggccacaaagaattgtgggcacttttcgcccttctgatgctttcgtcatctctggcgataggaattgtgttctatagccttggcaagatcgaagtttgggttgaccgaagcacctcaactccgccgtgggattgggcgcgagtacgtgacaaatattggaaatttccgacggttctctatgacccgaccggcattactcatgttcgactcagcccgatggagaaacttcaggacgaaatgctggaagctgctaaagaacgtggaacccgcgatgctaagggctattgggttggaaagcaataggaaaatggatgtaatttgatgtgttaactgttctttagcttgcgttctcatataatgtatacgtggagcaaataaaagcagattttaaaaaaaaaaaaaaaaaaaaa

SEQ ID NO: 48800 - DNA, 531 bp, Heterodera glycines
  SCN-specific regions: Sequence locations=1-333,355-531
gccgaaagcgaaggggcgaaaggcgacggaacggaggccgagggaagcgatcggtcgccgctgctcacttcggtggatgtctctcgattccgttttctgaacgagcggttgtgcagccaaacatcggcttcttccgcaaagctctttgaggaggaccccgactcgttcaggctgtaccatcgcgggtaccggcaccaagtgtccaaatggccggtgaatcctctcgagaaaatcgtgctggacctcggctcccttccgcccggaagtgtcgtcgccgacttgggctgtggcgacgcggaaattgctaagcgattgggcgaacggctccgagttcattcctttgacctggtggcttcaaatgagcgggttttggcagcggacatggccgatttgccgttggaagcggagtctgtggacgtttgcgtttactgtctgtccgtgatgggcaacaatttggcccaattcttccgagaagctcatcgagtgctcaaaactcacgggaagatccaaattggccagataacgaagcgt

SEQ ID NO: 48801 - DNA, 511 bp, Heterodera glycines
  SCN-specific regions: Sequence locations=1-484
cgaaataccaacttatctcacaaatggctaaacaaaagggtgaaaagaaaggaaaaagtgcgctcaacaaagtggtcactcgggaatataccatccatttgcacaaacgcatccacggaataggcttcaaaaatcgagctccgcgagcgatcaaagaagtgaaaaagttcgctgagcagcagatgggcacacccgacgtacgcgttgacacgcgtctgaataaatttctctggtctcgaggcgttcgtaatgttccattccgcgttcgcgtccgactttcacgcagacgcaatgacgacgaagactctccgcacaaattatacactttggtgacgcatgtgcctgttacttcgttcaaaaggttgacaacggtcaatgtggagagtgaggactgatagatggagaaaggatccggactgagtaaatggctgttttttgttgcgttatattgttgcggattttttgaaataaaagaatcgttgacaaaaaaaaaaaaaaaaaaaaaaaaaaa

SEQ ID NO: 48802 - DNA, 777 bp, Heterodera glycines
  SCN-specific regions: Sequence locations=1-12,36-472,495-777
atttcgtcctcctcccccttttttcttccctttgtctctttgccgatcgtttgtcgtcctttgaagacgaatgagtaagcgttgatgagctttgattccccacaataattaccaattttgctgctcctactgctgaatattttcaaaaaactgaacggagaaatgcattctaaggacataaaggaaaagggtggacaacaaattgggggacaaggcgaagttggcgagggagggacggcggagaatgggcagcagcggcagaacagagggcaaagcgctgatgccggggcactgccgcaaaggacaatgggagcattgtacgagatgactcccgagctggagaacaaccaagatgagatacgaaaattggactcccaattggaccacctcaatgattacatggaccgggtggaagagaggctgaagacgcacaatgacaaattgatggaaacacttcgacaacagagagaggaccgagagaaacggcgacggagttttcacgagcgtctcgaacaaagccggcaagaagacgatgacttccagcaacagctgagttcggtgctcagccgagtagattctgtgaggagcaaaaaaacggaaccgaaagtgaaattggagggcgatcagctttcatccaattgagtgatacgccttaaaaatgaatgcattccaatgccaaaatgtcacttttcttagcacacatcggtcacttctatctgcgtattgtacctttttaatcgttttcgtggttctgattaaaaattcaagttttcgaaa

SEQ ID NO: 48803 - DNA, 420 bp, Heterodera glycines
  misc_feature (397)..(405): n is a, c, g, or t
  misc_feature (408)..(410): n is a, c, g, or t
  SCN-specific regions: Sequence locations=37-176,200-420
cctcgtgccgaattcggcacgaggatttttctcatacaaacgaaatgcctttggctgaagatttgttgtatcctgatccgcaaaaggaacgtcaaaagcacaagctcaaaagactcgtgcaacatccaaattctttctttatggacgtcaaatgccctggctgctataagattactacagtgttcagccatgctcaaactgttgtggtctgtgttggttgcagtacagttttgtgtcagccgaccggcgggaaggcgcgacttgtcgaagggtgttcgttccgaaagaaaggacactaagacaatgagacaattataacggaaggcgatgctatcatttatttgttctgatttacaatatttgttgttgttggaaaaaaaaaaaaatcaatttgctnnnnnnnnnaannnaaaaaaaaaa

SEQ ID NO: 48804 - DNA, 667 bp, Heterodera glycines
  SCN-specific regions: Sequence locations=1-13,36-155,177-352,376-667
caattaaggaattctatttgttttttattcaatttcgacctgaatgtcagctgcggtttcttcttcgcgtccgatggaagattggaaatctgagttagctatgccagacaaggaccttcgatacaaaacatctgatgtgactgcgactaagggcgttgaatttgaggaatttgggctcactcgcgaccttcttaaaggcatttttgagaagggttgggagcatccaagtccggttcaggaagcgtcgattggaattgcacttacaggccaagacattctcgctcgcgccaaaaatggaactggcaaaactggcgcatattgcattccctgcattgagaaaattgacccatcaaaagaatacatccaagcaatgataatcgttccaactcgggagcttgccttacaaacatctcagatttgcgtagaactcagcaaacacttgaagattaagattatggtgacgactggcggaacagatcttcgtgacgatattttgcgtctcaatggtattgtacatcttgttgtggcaactcctggccgaattttggatcttatggagaagggagttgcgaatgttgcgtattgcaagacgatcgttctcgatgaagcggacaaactcctttcccaggacttccaaggtgtgcttgaccgtcttgttcagtttcta

SEQ ID NO: 48805 - DNA, 649 bp, Heterodera glycines
  SCN-specific regions: Sequence locations=1-580,602-649
gagcttttagcccaattaaaatgcgatatgaattttctgagttctgagattaaaaccgactccccctgcaatgttaatccaggaaaattttcgacttcaattttatgagccgatcagaagagaacattcgctgattgtcaccaacactgacgtggactcactttgtgcaacaaatattctcactcacattttctcttgtgacgatgcctcatacactctcagtccggtggactccttcccgacgttggagaaggcaatcaatgaccatgtcagacaggccaagaacattgtgctggtcaattgcatcggctcgcggtctgtcagcgaattgagcattgcccgactgacggacgaagtgacattttgggtgttggagtcgcggagaccgctcaatttggaggacatttacaacgcgaactctgtgcgcgtgttggccccagcagcggaagttgcggaatggacactgcccgaagcgagtgccatttttgaaacaatggtggagcaggaggacgaagacgacgacgacgaagcgagcgacggggacgaggaaaaccgaccgccgtcggacgaccgcgaagaagcggaggacggagaagcggcgatggcgggcgattccgatcgcgaatccgatgaagaggactcaaatggt

SEQ ID NO: 48806 - DNA, 1596 bp, Heterodera glycines
  SCN-specific regions: Sequence locations=1-133,156-191,213-940,962 -1014,1036-1401,1423-1596
tgaagataaaagtaattaatggacccttttcaccggaacgaggctaaagttgaggtcgccgttgagccaccaacggcgatagaccaacgcgtggacgacataatgcaaacgggcagatttggagacggccgattggtgaagatggaagtggactatagcgctcaagtggacagtcagttgatagtggcagacaatttggccaaggaggggaagactgccgaggcaattgagtccttggaaaagctggaaaaggacagacgcataaattgcgacatgcgttccaaccagcgcctgttgtgccacatggtcaaattggcatttgacgcgaataattggcaattgctctgcgaaactgcgaagacattgtgcaagaagcgtctgctgatcaagtcgagcatcaagaaaatggtccaagaatgctgcgaaatggtgccaaaagcgccagacgcgtcgtccaaatcgacgctcatcgacacactccgcgcagtgactgcgggaaagatttacctagaggtcgaaagagcgcggctgaccaaacaagtggccgaaaagttggaagccgagggaaaattggacgaagcgcgcgaaatgatgatggaactgcaagtggagacgtacggcacgatggaagtggaggaaaaggtcaattatttgctgcatcaaatgcgcctttccattgccaataatcattttacgcgtgcttcaattatttcacgtaaaatcagcacaaaatttttcgaacgcgaaggcactcaagtgcaattgatgaaattggaattttacaaatatatggtgcaaatcggactgagcgaaaacaactatttggatgtgtgcaaacactttctggcaattcttaacactccgcagatccaagaaaacaacgtcaagaaaattgagattctcaagtgtgtcgtgttttacttgctgctttcggctcatgacaacgaaaaatgggaacttttgcatcgagtgaatgcgatgagagaattggaacaaatacccaaacacaaagaactgctggaactgttcatccaccaggaattgatcttttggagcaaaaccattgagtccgaattcgccccaattttattcgctgctcaaccgccggtcgaagtcatttcggattcgtttctcccgtccacccacgtgtttccgatgaccaaagaggatggtcaaaagcgcagagaacgccttcatgactgtgtgggggaacataatgtgcgatatggtggccaaatattactcgcggatcactttccaacgaatggccaaacttctcgaattcggaattgagcaaatggaagcctttgtgtgcaaaatgattgtcgacggagtaatccccgaagtgaaaattcaccgcccttcgcaaattatttatttgagcccgaaaaagaacggcgcagaagtgctggacgaatgggtttttaacgttcgcaaattgaccgacacaatgaacaaagtcagtcagctgatcgcaaaggaggaaatggttcacggattgcaaatttctcagcggatttgaccgatgatatcgatacaaagaatcaattgattgttttattattgttttcccaaaaaaataaacgaattaaaaaa

SEQ ID NO: 48807 - DNA, 692 bp, Heterodera glycines
  SCN-specific regions: Sequence locations=1-692
attcaacagcagcgccaacttaccccacagagcgacagcgacacatggcggatgagcttgtggcgcttgcaccaggaacgcgtgtctcaggccgatggaccatcctaaagaagcttggcgccggagcatttggagccgtctatttgtgcaaagatggcaagggaacagtggcagcactgaaaacggagccaatcgacacacgtcaaccgcttcttgttatggaggccaccgttttggacaccctgggcaaaaaacttaagaatgctgatggtcaacacttctgccgtctgttggaccttggacgtagtgaacaacggaatgctacgtctggagatacggtgttcaactacgttgtcatgactgtggttggcactccgttggacaaacttattcgaaacgcgggcgatcgcttcagtccgggaaccgcaatcggcatgtcaatccaattgctgagtgccatcaaggctcttcacaatgtcggttttcttcatcgcgacatcaaaccagcaaacacagcgattggacgggcggagaccaacgaacatcgacttctctaccttatcgacttcgggatggcccgtcaatttcttcggcccgatggtacgcagcgacgtccgcgagcctccgcgaatttccgagggacgccaatttacgcaccgatctctgcacatatcaagcgtgactacagccgc

SEQ ID NO: 48808 - DNA, 1065 bp, Heterodera glycines
  SCN-specific regions: Sequence locations=1-56,79-309,336-531,555-1065
gtccaattaagcgttaatacacttagaagtgaaatggcttctcgacccttggtctctatttataatgagaaaaatgagccaaccggcaagcaaatcaagcttccggccgttttccgggctccaattcggcctgacattgtgagcttcatccatgaccaaattcgcaaaaacaagcgacaagcgtatgctgtgtcaaccgctgccggtcatcaaacttccgccgaatcgtggggcactggtcgcgcagtggcgcgtattccgcgcgtccgtggcggtggcacccaccgctctggccaaggagcgttcggcaacatgtgtcgtggtggccgtatgttcgcaccgaccaaagtgtaccgtcgttggcaccgccgggttaatgtggcgcaacgtcgttacgccattgtgtccgcaattgccgcttcggcggttcccgcactggtccaagcgcgtggccatgtgattgaccagctcaacgaaattccgctcgtcatttcggacaaaattgagtcgttcacgaagaccaaggaagcggttggctttctccagcgagcgcatttgtgggacgatgttgagaaggtttacaaatcgaaacgcttccgcgccgggaaaaggaaagcgacgcaaccgtcgctacaaacagaaattgggcccgctggtcatctacaacaacgacggtggcattgtgcgcgcatttcgcaacgtccccggcgtcacattgctctccgtcagccacctcaacttgttgaagattgcgcccggtggtcacttgggtcgtcttgttgtgtggacagagtccgccttccgccagttggacccactttttggcacatggactcggcagagcaatgtcaagaagggctttacgttgcctcgtgccaagatgaccaattcggactttgcgcgaatcattcgctcggaggaaatcaccaaagtgttgcgaccgacgatggcgcgaaaagtgcgccgggtggccaagattcatggcaacccgctgaagaaaccctcgctgatggccaagctgaacccgtacgccgctgttctgcgccgtgccgcggtgttggcatc

SEQ ID NO: 48809 - DNA, 600 bp, Heterodera glycines
  SCN-specific regions: Sequence locations=1-22,70-92,114-135,181 -456,478-600
gcacaaacactggaagtcgtcaaccatcaccaccgaccacttccaccaccaccaccagcagcacaaccagcggaagggccacgtcggtccatcagacggcggccacggcggcaaatccatcgacaaacgccacgggcagaagcagtaccagcaatagcagcagcggctgcggcggcagcaaattccatttgcccgaattgaaagttggccgagcgcaacagcagcaaagcgcggccggcgcatcggccggcggcgatgattgaggatgccatagcgtcggcgatcaatggcggcggaagtgcaacggtggcggacattgcgctgttgcgcaacgggcgactgagcggcgcgtcgtccgtcgtcgccgcgggcgccaacgacgactttgtgcggcgactggtggacgtcgtccgacgcgagccggcactgtacgacccgagccacgagcactacgggaacagacacgccagcacacactttcgaaccgcaatttggcaacggttgtgcaaagagttggactacccagatgatccgcaggcactgcaaaagcaatggaaaagcattagggacaaatacatcaaagagaagaagcggagaaaa

SEQ ID NO: 48810 - DNA, 832 bp, Heterodera glycines
  SCN-specific regions: Sequence locations=1-832
gtccttaagagcaataaatgcttcgcaatttgtccaaatttggcaccattttgaacggtgttgccgacccgttgtccgccctcgtggtgccttccgccgccgcgggtgacgcatcctccctgctgttgccgtgcagtgccggcgctgtgcagcggcagagtcggcgttggggtttcccccgtgggcacaaacatccgccacgtctgtttttcgactttgcacatctcaagcagatcactggcggcgaatacaccaccaaaccgttacaaatcaatcggttgggcggacggtgtccaattacgaggaaaaagctgtgcatacacatcggtggcggtgtaaagtttgactatttcatgctcaatttgcacccgcgcggtccaaccgttgcggacgaaacgtacgatgagcgcgtgatcgaagtgcgccgtgaccccaaccgaacgccgtacattgcgctagttgcgggtgtcaagggaaagcgttggatatacgccacgcagaacatgcaggccggccaaatcatacaaacgacgtgtcacattccggaacggccggtcattggctgtgagggcaactcatacccattgggcgctttggtcgaagggacaatggtgaattcgattgagcttcatcggaacaaccctaactcgcacgtggtcatcaccgaagcaggcggttgtgccgaaattattcgacacatggacgaattcactgttgtccggatgccgaacaaatatgaatacgcggtgcgcaaggaatgcatggcggttgttggaaaactgtcacacgtggactgggataaaaagcattggggctctgcccaaatgcatcg

SEQ ID NO: 48811 - DNA, 603 bp, Heterodera glycines
  SCN-specific regions: Sequence locations=1-448,473-603
ggaacttccgccaagcgccaaagacggcgatccaacgcggaacggttcccccctgacaatcaatggaaatcccttcgttcctctaaacgaacgcgcgtatggacgtaaaaaggaagctgttgaggcggatggaatccgctggcaattggccaaaaaggacgaggaattgctcaatttgcagaaagcgctcaaagagcgcgacagtgaaattggcacaatgaaacttcgggtggaaatggcaaagactcagttggcagaaacgacggggaaaggcggcatttccgtggagatggaattgcttcggcagcgatgcaccggcttagagaacgacttgaagagacagaaggatgaatacgaacaacagttggaccaactgcgacaacaattggccgaagaacacaacagaacccgcgagttctccaagaaggcgctttttgcgaatatgcaaaatcaacagcagcaggcggctgcgtcagcactgacaatgaatgcatctcccggcagcgtttccgcctcgcccctctctcgcgtggggtcctcctccggggccagcacaatgggcgccaccgatacgacgcatggcgccgctagcgatgtttcggt

SEQ ID NO: 48812 - DNA, 608 bp, Heterodera glycines
  SCN-specific regions: Sequence locations=1-10,32-215,237-528,550-608
ttaagatcaaaaaattttcccaatctttatatattatttttttcaaaatgcggcagtcgcccaaccaaacgccggtcactcgcacaacgacgacgacaatcactgaacaacagagggaaggcggaggagaccaacagaccaattctgaacaatttgtgcttaggctggaagcaccgcccgacacgcggccgagggtccaatggagcaccggaacagtggacaatgaaaacatgggcaaaaagaagtcgaaatgttgttgtatttacaagaaaaagcgcagttgggacgacccaaacgcatcgagcgaagacgacgacggagaatgtgaaagttcgcattgccgtggccacgtggagaaacagcgaaagccgccgccgtcggacgatggaaatggcggcggtgggcccggcccttcgtccatttcaacctgatcaattttgccaatcatttgcctatccatttactattatttatcgatttcctttatttaaacattgatacaatgtattagaaattgaatgtataatttccatccattcttttgtgatttgtgcgttaaaattgggacaatccgtcgaatggattaaaagaaattcaaatttgaaaaa

SEQ ID NO: 48813 - DNA, 640 bp, Heterodera glycines
  SCN-specific regions: Sequence locations=1-478,500-640
gaaataaataaatttaaaagcctcaatgctgataaaacgcgcattttcattctcttctcgtgcattgcaacagcacagtgtcgtcaggcctcccgtccaagtgacaggcattgagggaaaatacgcgtctgctctgtactcgtccgggataaaggagaaaaagctggaaaacatcgagaaagagttgcgtcaagtgaaggagttgtacgacaccaacaaagagtttaagtctttcattgacaacccaattctgaataagcaaaagaaaaaggaggccgttgaggatgtgctgaagaagcagggcgtctcacaacaagttcagaacttcttcggccttttggcggagaatgggcgaatcaacaaattgaccggtgtcgtgagctccttcgaaacaataatgcgagcgcatcgcggagaacttcacgtggaagtcgcaagtgccgagcccctcgacaaaaaacacgaacaatcgctgaacgacgccctgcaaaagtttgccacgcgtggacagaagctgaacttgaccttcactgtgaagccggacttggttggtggactggtggtgaacatcggcgataaatatatcgatttgtcaatggcaacacgccttaagaaaatggacgcggtggtaaagggatcg

SEQ ID NO: 48814 - DNA, 933 bp, Heterodera glycines
  SCN-specific regions: Sequence locations=1-933
atttggtagaggagttggcctttttcaatgaggtcgaagatggttccgttctgagaaaagaagaaattccgcaagaataccgcgaagaggcaaagatactccgccaagaacttctcgaaaacctcgcaaattgtgacgatgttattgccgagtgttaccttaacgaagtgacgccgtccgtcaaagagataaaagaggcaattcggagggcaaccatcaaacggtcctttgtccccgtgctcgtgggcagtgctctgaagaacaagggggtccaacaaatgatcgatgctattgtacattatttgccaaacccttctgaagttgacaattttgtgaatttatatgacaaaaatgacaatgcagaacgcgtgctgatggaccctttgaggaccgcaaactccgaaaaacaaaagccatttataggacttgcgtttaaattggaagcaggaaattttggacaattgacgtattttcggatttatcaaggacgactggtcaaaggcgacactatttatgcgacaagggacggacgcaaagtaagaattcagcgtttggtccgaatgcatgcgaatacaatggaagacgttgacgttgcctatgcgggagacatttgcgcgacctttggcgtcgattgtttcagtggggagaccttttgttcggatgagcaattacgagtccattgcgaatcaatgcacattcccgaccctgtcatttcaatgtccataaaaccgatcggaaaaagggacatggaaaactatctcagggcattgaagcgatttgcaaaagaggacccgacgtttaaactttgttacagcaaagagcacaaagaaacggtggtgagcggaatgcgcgaattgcatttggaaatttatgcgcagcgaatgggaaatgaatacaattgtccggttgagttgggaaggcccaccgtttcgt

SEQ ID NO: 48815 - DNA, 652 bp, Heterodera glycines
  SCN-specific regions: Sequence locations=1-59,87-117,139-140,170 -182,206-233,270-350,374-652
attttataaaacttggcaaaactcttattaattgccgttaaagattgatttgaagaatggctgccatgaatcctgaatatgactatctcttcaaattgctgttgatcggcgattctggtgttggcaagtcgtgtctgttgcttaggtttgcggatgacacctacacagagtcgtacatttcgaccatcggcgttgatttcaaaattcgcaccattgagcttgaggggaagacgattaaacttcagatttgggacaccgccggacaggaacgcttccgcacgattacgtccagttattatcgcggagcacacggaatcattgttgtttacgacattacagaccaggactccttcaacaacgtcaagcaatggctccaggaaatcgaccgatacgcatcggagagtgtgaataaacttcttgtcgggaataaatgcgatttgaccaccaaacgtgcgatagagacgaatgttgccaaggagtatgccgaccaattgaacattccattccttgagacttctgccaaaaactccactaatgttgaacaggcgttcatcacaatggccactgaaatcaaaaatcgcatgggccctcttcaacaggccggtggcaatgcgtccgccgtgcgcattggtccgtctcagccggtgcagga

SEQ ID NO: 48816 - DNA, 886 bp, Heterodera glycines
  SCN-specific regions: Sequence locations=1-557,579-886
gtgacaaggtgatatgttgtcaaagtgtctccgctcgtcaatttttggctgctttaattgtgcgctccaaaatgtgtcttctgctgccgttttaatgaattcggttcgccatgcggggaccgcagagcattggagacgcgcctatctgaaggatttgtacaacagacggcaaatggtcgggcccgaaccgctgagaggcagggcatccgaggacaattggaattatccctccgaaatttccgcgctttctcatcgtcttcacatccccgacatggacaacgcactgattgtgcaagcgctgaccgacaaaagttattttacgcgcaatgatttggacgacgaagcgatgggagacgacggaccattgacgacggaagttgcgagagacaaatccaacgaccaattagtggagaaaggaatgcccctctttcgtcatatcgtactcacttatttgcgcgcccattggcctttggctcccgaggaattcatcattgccgtggccacccgaatcgcccccacttcggcgctggccgagttggccacccaattaggcctccaccacgtggtcagaaccgcggagtttcctcccactcagcaaacgctccagtcgacactgttggcccttgtcggtgccatggacgtggcaaaagcgcgcgacttcgtccgccgttttgtgctgccgcgactgtacgaagtgccgttggaggatgtgctgccgttccggcatcccttcgccgtgttgggcgattatttgcgcacatggcaaggggcaactgacatccaaccgcgtacaattgggtcgggtgctgttatgaaagcaacgcctttttaccaaggcgccgattacgtggacaaacagcaaattgttggaccatcgggcggtgaa

SEQ ID NO: 48817 - DNA, 536 bp, Heterodera glycines
  SCN-specific regions: Sequence locations=1-116,145-352,374-460,482-512
gcatattttaatcaattaaacatattcttgcgagtaataatggtgggacgagtgcgaaccaaaacggtgaagaaagcatcccgtgtaatcatgtgagaaatattacacaaaattgacaaacgacttccacaccaacaagcgcatttgtgaggaggtggccatcgtcccgagcaaaaagatgcgcaatcgaattgccgggtttatcacccatttgatgaagcggattgagcgaggccctgttcgcggcatttccatcaaattgcaggaggaggagcgggaacgtcgggacaattacatgccggaaatttcctaccttgacgcacagaatcaccagacgatcagcacagaccaagagacgaaggacatgatcgagtatttgggacttggtctcaacttggaggtgaaggggcctgtgccgactggcgcaggacgtcgttgaatcacgaaaaaccattaagcgatttggtggtgttattgttatctttttaagcgctgataaaacaattttgttgaaaaaaaaaaaagaaaaaaaaaaa

SEQ ID NO: 48818 - DNA, 552 bp, Heterodera glycines
  misc_feature (25)..(25): n is a, c, g, or t
  SCN-specific regions: Sequence locations=33-552
ttttttttttttttttttttttttntttatttcaacaatttattcatttcactttcaatgacaatgaaccgacttttgcccggccgttctctgctccccaaaatcatgcgaaatttttcacacagcaatcgcctcgccgcctccgaggcggacccggaacattacggctatttcccggacccaaccgaacagacgtggggcctggagagggaaatgcttgctgcccgcctgaagggcgaagatcgctactcacccaaaatttattaccgcgctgaacattcgaccaaggatgtcccaaatgtggtgcgtgtccatttggaggacaaagtcgtcggatgcctttgcgaacacgacggagaccatgtgaattattggcacatcagaaaaggcgacacaaagcgatgcgagtgcggacattggttcaaaggcgtgcaagcagacaccgacagtttcgactgaatgcggtggacaccgatttctcgctttgaagaggataggaaattgttttggttgattaaatctttattttttgttttgttttttcgttttcaa

SEQ ID NO: 48819 - DNA, 919 bp, Heterodera glycines
  SCN-specific regions: Sequence locations=1-919
ccaagtttgagttattgataataaataacctacaacgcctaaatggaattttcttcaactgattatctcaatgagcatcaacgttttgactatcagattttgccgaaagtagaatacactggtacaactttggtgggcatggaatgctttggcggaattgtcgttgctactgattctcgttcttccagtggaacttatatatcgaatcgcacaaccgacaaaattaccatgcttaacgaccgtattgtgatcctgcgagcgggcactcaagcagacacacaggccttggccgatatcgtcatgtattatgcggaagcgcatgcgatcatggacgaagaggatgagattaccgtgcgcaacgttgccaattacgcccgcaaaatgcactacaattatcgcggacaactcaacagcacttttcttgtggctggttacgactccctcaacatgggtcaactgtatgtcatcccaggcggaggatacaccacgcgacacccttattatacgtctggcagtgggtcgtcatacatccgagaatatctccaaaaccaatggaaggaagatttggacggagaagttgttcgtcagattttgaaaaaagctgtttttgaagcgcagagaagggacggtgcttcgggtggtttgattcacacggcaataattaatgcgaaaggaatctcgcgaaagacttatcgccccgacaaagaagattttccaattgtttcgcccgaaaaattctacccaaatttgcctgagcatattctacagcccggcttggttaccattgaacgcatggaaacttgaatcactctgatgctgatgattgaaaaataaatgattttggacacttatgtatcaattgttctatcgattgttaattattctgcaatgtgcttatgttggataaaatcatcagaat

SEQ ID NO: 48820 - DNA, 896 bp, Heterodera glycines
  SCN-specific regions: Sequence locations=1-13,35-123,150-152,178 -228,262-763,785-896
gagatttgaaaattttgaattcgcttttctcattccaaggcaaataattgtaaaatgagtagcccacgaaagaaaatccttctcaaagtcatcattctcggtgactcgggcgtcggaaagacatcgctgatgaaccaatatgtgaacaaacggttcagcaatcagtacaaagccacgattggtgctgattttcttacaaaagacgtgatgatcgatgaccgacttgtcaccatgcagatttgggacactgccggccaagagcgtttccaatcgctcggcgtcgccttttaccgtggtgctgactgttgtgtgctggtttacgatgtcactcacgcgccgtccttcaaatcgttggagagttggcgcgacgaattccttgtgcaggcgagtcctcgtgatcccgaacactttccgttcgttttgctcggcaacaaaattgacaatgacgcggcgcgtgcagtgaatgcgaagagagcgcagagttggtgccagtccaagaatgggatgccgtactttgaggtctctgcccgggacggagtgaacgtcgaagaagctttccaagcgattgcccgtgctgcgcttgcacgagactcgcaggaaacgcacgacttcccggaatttccggaccaaattcgacttgatcagagccgcaatggcagacagcagaattcctcctgttgctgaccgtccgggggcatttcgcgatgagtgaaatggaagaaatggtcgatcactctgtcgagatcaaatgatttgtaatttcaaaaagaaagaattcggatttcaaattcacatcttctaacacagacaagctcattccctcactttgactacccttttaaccaattcaaatagaaacgatgtttagcacttttattatgaggccatttgccccc

SEQ ID NO: 48821 - DNA, 616 bp, Heterodera glycines
  SCN-specific regions: Sequence locations=1-616
attaagccaattaattcatccgtaaattattcaaatcattccgccgatggcatcaattgtggacagcgcaaaagtgaacaattttggaattggcactgttgttgagccgattctcgtcaataaaaatggatccaccggcggtggcggacggaggaaaaataaaactctgttcggcatttcacaagcagtgcatgccgaacatcctcaacagcaattgtccgaattcgctggtggcatttcgcctgtcgacgccgtgccaatgccaaccgcggccaatgactgcaacaataattccatcgaagacattcaatcggaccgccgaaggggcccaattgatccgacaaacttcgaccatttggtccgtctgagtgagctcatccgttccatggccgaccttggcactttgcagcccgagttcggcataatctgtggctccggattgggcgcaattgccgaccaaatggagggggcgcggattttgcctttctccgaggtgcccggctttccacagccgagtgttattgggcacaaagggaatttggtgttcggtcggattggtggtcacttttgcatgtgtcttcaggggcgtttccacccctacgaacacaaaatggac

SEQ ID NO: 48822 - DNA, 690 bp, Heterodera glycines
  SCN-specific regions: Sequence locations=1-100,122-188,210-378,413-690
attaagagatcgcttgactattcgcaagaatgactaaagccgaacaagctgcggaaaaaaaggagaagaagttgggaaaccccatgagagatttaaagattcaaaaactctgtctcaacatttgcgtcggtgagtctggtgaccgtctcactcgtgctgcaaaggtcttagaacaattgactggtcaaactccggttctttcaaaggctcgttacactgtgcgctcgttcggaattcgtcgtaatgaaaaaatcgctgtccattgcacagttcgtggaccaaaagctgaggaaatcattgatcgtgggctcaaagtcaaggaatatgagctttaccgcgagaatttttcggacactggcaattttgggttcggcattcaggagcacatcgatttgggcataaagtacgacccgtcgattggtatctacggaatggacttttatgtggtgctcggtcgtgctggtttgcgggtggcaaaacgtcgacgaatccaaggacgaattggcgcatcgcatcgtgtgcaaaaggaggaagcggtcaaatggttccaacaaaagtatgacggtgttattttgccacccaaaccgaaggaatcccgtaagggtggtcaccgcggacgtaagcgctaattttggatcgttttgttgaatgctattttcccttgttgataaattactatttgttgaaaaa

SEQ ID NO: 48823 - DNA, 1997 bp, Heterodera glycines
  misc_feature (1973)..(1978): n is a, c, g, or t
  misc_feature (1980)..(1992): n is a, c, g, or t
  SCN-specific regions: Sequence locations=1-29,51-807,830-869,891 -991,1013-1387,1409-1997
cctcgtgccgctgtcattaaacctaaattgtaatggcttcgaaaagtaaacgaacgactcgatcacagcgcgaagcggccattcacattgatgcaagtgcggatgagaccatcgaaagcagcagtaatggctcaacaattaacagttcatcagggcatctgtcgtcgcgtcaggacgagaagaaccacctgtgcaatcttaacgaccgtcttgctggctacattgagcgcgtgcgcagtctcgagacggagaatgcgcgtctacagatccaagtgcgcgaggttgaggttgtggagcgcaaggagaaggaaaatttgtcggcccgctacgagatcaaaatcgacgaactgcgcaagcagttggagttcttcacgcgtgaaaaggccaaattgcaaattgagagtgacaaggcgcagagcggctttgaggagttgaaggcgcgggtcggcaaattggagaaggatttgcgcaaggcggagaaggagcgcaccgcggcgcaggcggacgttcaggaactcacggcacgcttcaacaacacggacaccgcacttggcaacgcggagcgcgagatcgagcaacttcgaaacgagttcaacaactcggaaaatatggtggacatgttgcgtcgtcagttggaggacgaggtgctgctgcgcactgagctggagaatcgtctgcacaccgccaaagacgacttggattttgcgcgtcgcagtcacagcaaccaaattgaggagatacggcgcaagcgccaagtggaaatgacatcgttcagcgacgaagtggagcaccgttaccaggccaagctgcaggaacagctgcaggccatgcgggacgactttgacaatcgcattgcgcagaaccgtgccgaggtcgatgagctgtaccgcaacaagctgggcgaggcggctgaaaacgcgaacagaaaccgtgacttggcggccaaggcgcgcgaggaagcggcaatgtggcgcgtccgtgttcaggacttggagaactccagcaaagaccatcagggcatcgtcgagtcgctgaaccgtcgtgttaaggacttggaggcggcgttgcgccgcgcgcacgaggacgccgacattcgcattcaacagcgcgacgaacagattgagcaactgcagaaggaaattgcgttgatgatcagtgactaccaggacttgttggatgtcaaagtgcagttggacaccgaattgcaggcgtaccagaagatgttggagcaggaggagaccagattgcacattacgccgtcgaccagtccgaacacgtcggttgtcgggcagaacatcagcacgcctaacatggtcatttccacgccacgtccggtcagcccgcgtttggcgacgccggttactcagagcgaaagtctgaccaccgtccgccgtggggtgaagcgccgccgtctcaaccaggatgacattgtctccttcgacaaaacgtccagctcgtggaagagcaatggccattccaacggcaatttggtgatcggcgaggtggacaaggagggacagtacgtgagcgtgatcaacaagggcaaggaggacgtggcggtgggcaattggactctgaagtcgagtgccggcggcagggaggtgcagtacaaattccactcacgacagacggtgaaggcgggcaaaacgctgatggtttggtccaccaactcgggccaggagcatcagccgcccaacaatttggtgttcaagaaccagcaatggccacacgacgacgccatccgcacggagctgttgaacgcggaccgtgaggtggaggcgtggaacgaggcgtttctgcagcacagcttcagcagccgcgtggaggagggcaccgacattgataagaattgtcgcattatgtagatgagtgacaaagtgatggaaggatgatgattggagtaattgagttcgttaaatcaattgtttttttgttctgtttgcttttgaacgataaagtccatccctcgtaannnnnnannnnnnnnnnnnnaaaaa

SEQ ID NO: 48824 - DNA, 641 bp, Heterodera glycines
  SCN-specific regions: Sequence locations=1-641
aaaaaagatgcgagatctgttcatcgaagacaacagcccgatcactccggcccggcttgccgaactgatcagacatttctacgcgttgggatggatgcgcgataacggcggaggaatggcggtcctttgcaacggcgccgtgttcggttcgcccacttcggtgcagaaggagaaagtgtccgaaaatgatctgtttgtaattgatgctacgaccggcacagtactgaaacggccgcaaaacgcggcgagtgttccgagtgccacctgcggactgttaatgaacacaggtctgaactgcgtaattcacacccactccaaatacgcaaatcttgtctctcagttggtcacgggcaacgaattcgccatccaaaaccaggagatgattcagggggtcgagaatcgtagcagcggactccgtctcgacaacgtcgaccgcctcgttgtgcctatcgttgattctgagttaaacgaacaaatgctcagtcctgttttgctccgaactttggacaaatacacagaagcatcggccattttggtgcgtggccacggcttttttgtgttcggctctcactgctggcagtctaccaaaatgatgttggagtgttacgagtacctctttgagttagcctgcgaaatgatca

SEQ ID NO: 48825 - DNA, 594 bp, Heterodera glycines
  SCN-specific regions: Sequence locations=1-594
attaagctcgctttggtcggccaagaaccgattctttttgcccgatcggtggcggaaaacatcgcttacggattggagaggtgcacaattgtggacgtggtcgaagcggccaaaatggccaacgcacacacatttattcaacagactcgggaccaatacgagacaaatgtgggcgagaagggcagtcaaatgagcggcggccaaaaacagagaattgcgattgctcgtgccttggtgcgtcggcctgcaattttgctgttagatgaagcgacttctgctctcgacacggaatctgaacatcttgttcaagaagccatctataagaatctgaaggggcgttctgtcattttgatagctcatcgtttgtcgacggtggaaaaggccgataaaattgtggtgatcagccgaggacgacttgaacagatcggcacacatgagcaactgttggctcaggaaggaatgtatcgctctttggtccaacgccaaatgatttcggtgggggacaatggcagcgaattggaaatggcgggggaagtgccgactgagggccaggaagagactctgagtggagatggcaccgacggtgccgcacga

SEQ ID NO: 48826 - DNA, 682 bp, Heterodera glycines
  SCN-specific regions: Sequence locations=1-81,103-682
tctgcttatcagttcatttcttcacattctcccatctcaattacgtggaatgcgtcattcagcttattttgtggaaagaaaattccgactcatttcctttcattttttacgtcgtgttctgtcaacttcggcaatgccaactaaacccagcagacattcgccatcaaaaatcgtccatggagcgggaaaaagcatttgggttgaatttactgctttggctgtcgaatgcaatgcggtcaatttgggacagggttttactgattctccaatgccggattttctcacgcgacatttggccgatatcggaaaaagtcccgaaaggaccgatttccaccagtacactcgtggctatggccacccgcgtttggtctcagtgttggcaaaactttattcacgtctcctcagcgtttccgtggatgcccagtcagaagtgttgatcaccgtcggtgcctatttgtccctctattacgcttttatgggttggctcaacgcgggcgacgaggcaatcatttttgaacctgcttatgacagttacgtctctcagattaaaatggccggcggaattcccgtcccggtcgttttggagttggacccggaggctcgtgggagttcgggttaccgactcgacatggaagtggtgcgaagcaaagtcactgaccggacaaaaatgattgtgataaac

SEQ ID NO: 48827 - DNA, 557 bp, Heterodera glycines
  SCN-specific regions: Sequence locations=1-10,32-174,197-229,251 -253,275-406,428-557
ataagattttgtagttcttgttgtttattttcttggtaatatggctgttggaaagcagaaaaaatccgcggagaatatcaatgccaggttgggcatggtaaccaagtcgggcaaatactgcctgggctacaaacaatcgctgaaaacgcttcgttcgggcaaggcaaagctggtgatcatctccagcaacacgccatctctcagacgcagtgaaattgagtactacgcgatgttgtcaaagacgggcgtgcacgagtaccatggcaacaacatcgagctgggcaccgcgtgtggcaaactgttccgcgtttccatgctgtccatcactgacccgggcgactcggacatcattcgcagtatgccgacggaggcatgagcaatcaaatgaaatgaacggatggacgtgatcagtgatcattcattcattgatcggatcatttgtcatcctttttttcaaatattttgttgttgtttcacccggaagtgtttcatgttttcggtgaaacgaaagacattctcgttgttaaaaggcggttggtttttcaaaaaaaaaaaaa

SEQ ID NO: 48828 - DNA, 430 bp, Heterodera glycines
  SCN-specific regions: Sequence locations=1-324,346-365,387-394
gtccaattaagcttaaattatatttgctacttacaaaaatggctccaccgacaaacaaagtgcaaaaggtgatggtccagccgatcaacctcatctttcgctgtctccaaagtcgttcgcgcattcaaatttggctttatgaaaacgcttcttcgcgcattgagggttatattatcgggtttgacgagtatatgaacgtggtcattgacgaggcggaggaggtccaactcaaatcgttgaaccgtcacaagttgggccgcattttactcaagggcgataacattacgctgatccaaacaatccaatgacgaggacgggcgaagatctctctgttgttgtgtgctggagcatgaaattaattcgttttcatttgcattttattaaaacgatggtcaaaaaaaaaaaaaaaaaaaacaacgaaaaaaaaaaa

SEQ ID NO: 48829 - DNA, 645 bp, Heterodera glycines
  SCN-specific regions: Sequence locations=1-645
gtccaattaagcaattacaatgcttcaacgtctatttgttggcaagaatttcacctgtctgccgttgttcacttctcatcgcaattatccgggctcaaatttcactttccccatagattggtatgaaaataagtatgtgttactgcaccaacgcgcccgtgaaaaagtttcgcccgattttcacaagcagaccaccggccttaacggcctttacgtgaatgaaaatccgcacaaagaccttcgcttgctttaccaccgcattttgcgcgtgattggaatgatcccggacagcagtcagtaccggatggccgtcgaagaaattgtcaagcatcgcctttcgcttgttgaagcggaacccgacattcaacaattggagcagaaaatcggcatgggtcagattgaagaagtagttcaacaggccgagtatgaattggagtgtattcgtctgtttgttgcacataaatgttgggaaccgctggtggaaaaagcggatgaggcgcaatggcggtggccaattggaccaggcccataagggaatcaaatgaccgtgaaaatttgacgccttagaacgctgtattttttctcgttacaattattttaacgaattcacgtggagaatataaacagtataattaaaaaaaaaaa

SEQ ID NO: 48830 - DNA, 734 bp, Heterodera glycines
  SCN-specific regions: Sequence locations=1-41,64-321,343-686,708-734
gaggaaattactataagtaataattgtcctaaaaaatggtccaatacaaattatattattttgatgggcgcggtttgggtgaatccatccgtctgttgcttcactatgttggccaaccgtttgaggacatccgaattaaagacatggaagaatgggagaaaacgtacaagccgaaatttttttacggaaaggtcccagttttggaggttgacgggaagccattgggacaaagtgctacgattttgcgctaccttgccgaaaaatttggcttggccggcaaagatgaatgcgaaaaggcgaaggctaacgaaatcatcgactttcaaaaggatgctaacactgatttggccccctatttatacgtcaaaatgggattccgccaaggcgatttggacaaattgcgtgccgaagtgttcgagccgggagtcaagcacattttgccactgtttgagaaacttttgaaggagtccgggtcagggtacatgctcaagtccggcctctcaatggtggactttcaagtggccaactttctgtacacgtttaccaagttggagccggagactatcaatgcgttcccggagctgatcaaatacgttgaccgtgtccatgcgctgccccaactgcagcagtatttgaagcagcgcccgcaggaccgctgatcagtgatcagaaaagtcgagattgaatgagaaaagaaaatcaatcattgagattaattcgataagttatgataa

SEQ ID NO: 48831 - DNA, 972 bp, Heterodera glycines
  SCN-specific regions: Sequence locations=1-329,351-762,784-881,903 -904,927-972
acccgccgtacgtccactacattaacacgcacacaacctcggaaccccagcggggatttgcctttatgccgaaacggggaatgaattcgttggaaaacgaaatcaatcgcatttacaaagtgaccacaaaaggagtcgttgacatccttcaattctttgtgcctcggaaatccgatctgtggcaagccgacctttacccggacacgcgcagcttaatacccgctttgacagcagaagaattcgttggcggcaaaaacgcaccgccgaatttaattccggtgaaccccgaggcagcaaaggcggggccaaaagtgcaagtggcaaaaaaggcaaacattttggcacaaatgccaccccaacaagaacatccgcccgaaccgccgatgcaaaggccggcgccccctcagcagcagcgagccgcgccggtacgccacgacgaggaaatgggcatcgtacgaagccaacgaagagagccatcgccgccggaacagcaaacgccggccccgagacagcaagtccaattgcggtcgagggaggccagggacgaaacgggcggctctcaaacggcaggtcaacgccgcgccgccgcggaattggacagaattcgaagggaacagaacagaagcggggccggagaagcggacggacaaagcaccgccgcaacgacaccgaacgcatcgcgaaggccgagcaattcatccgctgccgcggtcagtggaagcgttgaagacgaattggccaaaatcaaagtggtcttacgacagcacgagaggaggatccgattgcttgaggaccaattggcggatgccaacatggccaatgcttatggaatatgaaaattaatacggacagaaatattgtgattgaagaaatgacgaaaggaaaatatttgaaaatttatagcaaacaaatgcaatttgttcatcacaaaaaatggaatatccgccagctttttgtaaatgagcttcaaat

SEQ ID NO: 48832 - DNA, 586 bp, Heterodera glycines
  SCN-specific regions: Sequence locations=1-136,158-564
attcagacggtgccccctttctttaccgtaaagcgacttcgagaaacgatgtctcgtttcgatgggcttggccgtgtttatcttcagtcggagaagaggggcgcacagcgaaaaaagcgctatacggagggatgggttgagtttaaaaacaaaaaggtggccaaggaagtggtgagacttatgaacggccgagtggtgggcggaagacggcggagtgcggcgtacgacagcgtttggacgatgaaatatttgcacggtttcaaatgggaacatttgatggaacagctcaactacgaacagcgcattgagcagcagagactacgcacggaaattgtacaggaaaaacgcaaggccgatttttttgcgcaacaggtagagaagggcgaaagtttaaaaaaattggaggaaaaaatactgaaaaagtgcggactttgggagcagtaccaacgccagcacaaacagctaaaaaattgtggggaggggaggagcagaaattggaggaggacgaatcattgctgcttcaaatatttggaggaaacgaccgaaggaaaaacacttacaatcagaggaaagggaaaccaaacga

SEQ ID NO: 48833 - DNA, 652 bp, Heterodera glycines
  SCN-specific regions: Sequence locations=1-269,291-594,617-652
attcatacaatgtctaccttttattcgttaaatgtttcttcgaattggctgaaatatttatctcttgggacggctttggtcgttggctatgcagtttacattgaccgtaaacgtcgccttgacccggaatacaaacaaaaaattcgtcaaaacaggaaacagaaacaagccaactttttctacgcaaaaatgagcggaggagttgattttcccgacccaagtgatccacaggcgaatgagatcttcttcttcagtcagatcactcccggagaggagaaaatgaagactggccacattgaggaggggattacgcatctgtcgaatgcaattgtgacttgctcgaagcctgacgaattgctcagaattttccaacagaccatcccaccggagtgtttcagtttgcttgtgcaggcaattcctggcgccaaaatgcgtcggaatgcctcttcatcgtatcgccatgggcgagagccgattgatttagactgtgcaaagattgacgatattggtgacaatgcggtcgacaagaaaatgtttgttttgcaagatgacgagcttgaatgaaatggaatacgacaggaaagcaggccactccaaattatattttgatttgtttcgaataaatttgaaattttcaaaaaaaaaaaaaaaa

SEQ ID NO: 48834 - DNA, 799 bp, Heterodera glycines
  SCN-specific regions: Sequence locations=1-232,254-799
ccaagtttgagtttttttaatggccaacaattttctctccgttcgtcgctttttgcattgctgccctccactacgaaatgttgtcaatggcagatggacgacaacgcattacacacagaggccgagagaaaaggacggaaggtggaaatgcgtggacatggctcgtgtggaggacgagttcgacgtggtcattgtgggcggtggccccgctggactgtccgccgccattcgcctcaaacaattggcggcggagaaggcaaaagaattgcgcgtttgcttggttgaaaaagcacccgaaatcggtgcccatacgctctccggtgccatcattgagaccggcggattggaccgtctttttcccaattggcgagaactcgactcgcccatcaaacagccggtgaagaaagacgcattcgcaattctcaccaaaaatggacgaattccggtcccattggtccccggcgtcccgctgaacaaccatggcaattacattgtccgccttggtcatttggtgcggtggttgggcgaacgtgcggaggagcacggggtcgagctgtactcgggcattgctgcgcaggaagtgctttttgacgaggctgggaaaacggtgtgcggagttgcgacgggcgatgttggaattcacaaggacggaagcccaaaggagagctttgaacgcggcatggaactcaaagcaaaatgcacaatttttgctgagggctgtcctggccatctgacaaagtcagtcattggaaaattcgggctcagggagggcagagacccgatgacttttggaaatggg

SEQ ID NO: 48835 - DNA, 725 bp, Heterodera glycines
  SCN-specific regions: Sequence locations=1-211,233-357,379-725
gtccaattaagatgtttatggccgcggatgatagcaatagcgagaaggaatcaaactctttgagcattcgaactgacaaattgctttcggtccctttcaacggagaagagacttccgagaacacatcccaacagcaacaacagcaaacgcccgttgcccttccgacttcatcttctaaaattttatctaaacagcacccactcaagacgaaatggaatttctggtttttgaacaacaaaaagaaggacatggactggttggaaaggttgtcgaaagtttgcacagtttcgaccgtcgaggaattttgggctttttttgacaacattcatcctccatctggcatgtacggctgcgattacaactttttcagagatggaattgaacctttgtgggaggtggcacagaacaaagatggtggtcgactggtcatccaagttgacaagcagcgaaatgagctccttgatggttggtggatggagtttttgttggcatgcattggtgaacaatttggagacgattctgatcaagtttgtggcgccgtttgcaacatccgtaacaaagggtcgaagatcagcatatggacgacaaatgcgtcggaagaagacaaaaacagacggatcgggcacgtcttaaaagatcgtcttcaagcttccggtggattaaagcctattaagataaatttcgaagaccatgaagtggtgcagcagaagacttcgagtgccatc

SEQ ID NO: 48836 - DNA, 908 bp, Heterodera glycines
  SCN-specific regions: Sequence locations=1-49,73-459,483-865
caagtttgagatggcccgtcgctatgatactcgtacgacaatcttctctccagaaggccgtctctaccaagttgaatatgcaatggaagcaattggtcaggctgggacttgtcttggaattcgagctcccgatggcattttcattgctgcacaaaaactaacggccaacaaattgcttgatgatcgaatcatgagcgagaaaatctacaaggtgtcggcgaacatcttctgcacggtggcggggatcaccagcgacgcgaatgtgctggtcgacaaattgcgcgaaatggcggtgatgaacactttggatttcggagagaacattccggtggaacagctcgtgatcagactgtgcaacaccaaacagcactacacacaagttggaggtaaacgaccctatggagtgtcacttctctatgccggttgggacacgcaccacggctttcagctctaccaatctgaccccagtggaaattacggtggttggaaggcgacttgcatcggaaagggccaccaaaatgcactttcaattctcaaacaagagtacaaggacgaggacatgacgctggaaaaggccaaggatttggcgatgaaggtgctctccaaaacaatcgaagccaaaatgttgcccgagcagttggagatggctcagctcacccttgacgaaaagggcagacccgagttgcgcatactcgaggaggcggaaaggaagcaactgaccgataaatgggaagccagcgaagaggccaaacagccgtgacgggaaaaattgtgttgtgctttggggcacctttggtcggactttggctcggttaatctatatgttttgtttatttgcgccttgatttgataaaaaatgaattctaaaaaaaaaaaaaaaaaaaaacaaaaaaaaaaaaaaaaaaaaa

SEQ ID NO: 48837 - DNA, 846 bp, Heterodera glycines
  SCN-specific regions: Sequence locations=1-770,794-846
gaaagaacaaaacagcggcgacgaggaggcggaagaagcggacgaacaccggacaaagaaaaggggcatcctcagcttggaagacggcatcatcgtcgatgccgaaccgcttgccaagcgggagaagaagcagttggtcatccccgtcctccaagtgtccagcagagcacaaatttctcgcattcagaagctggtggacgagggaacagccacagaaacagacttagcacgactgtcgctgttaatcgacagtttggacgacgagcaaaggaaaactaccacattgccattggacgcgcgccaccaaaccgtgccgaccgttgcggtggcggacgacgacgacccggactacgcgagtgtgccggtgggcgagttcggactggcttttttgcgaggctgtggctggaaggacgagaagtcgtgcatcggcaagtcaaatccgcaggtggtgccactgcgcgtcatcgaaccaaggccaaagggactcggacttggcgctgtccttccgacaacggcaccgccgacggccaacgcgctaaaggcggcagaaaacggtgacgaagaagcgacaacacttggcaaacactcctacgtcagatgcttatccggtctgaacaaaggctcttatggccaagtgatgtcaatggacgaggagaatgccagcattttcgtcgagttggcatggccccccgccaacgttggcaaaacggtgcgtgtcagccaatgggcgggggaagtggtgagacggaaagagtatcgcgagtgcgtaaagggcggcagcggaggaggaggaacagcggagaacggacggaggctcgaaagggtccgagtctgatggaattggca

SEQ ID NO: 48838 - DNA, 558 bp, Heterodera glycines
  SCN-specific regions: Sequence locations=1-81,151-192,239-311,338-533
gtttgagtgaatacgtaactgaagatgcaaattttcgtcaaaactttgaccggaaaaacaattactttggaagtcgaggcgagtgacactatcgaaaatgtcaaagccaaaatccaggacaaagaaggaatccctccggaccagcaacgtttgatttttgccgggaaacaattggaggatggacgcactttggctgattacaacattcagaaagagtccactcttcacttggttcttcgccttcgtggtggaaaggtccacggatcattggcgcgtgcagggaaagttcgtgctcaaacacctaaagtggagaaacaggagaaaaagaagaagaagcgtggccgtgccttccgtcgcattcagtacaaacgtcgttacgtcaacgtcgctgcagcgggaccgggccgccgtcgtgggccaaactcgaatgctgcataaatttctggatatgcaaaatgatacggatgctaaacaatgttgcgtcttttgatatgttgttgttttttttatgaattgaaaaaagtaaattgttgaaaaaaaaaaaaaaaaaaaaaaaaa

SEQ ID NO: 48839 - DNA, 626 bp, Heterodera glycines
  SCN-specific regions: Sequence locations=33-88,110-626
cctcgtgccgaattcggcacgaggcaacatcattgcctccgttgctacttgagcgcctgaagaagcgtgggattgttgcgtcaaagaatgaggacgaggaagtttttgctgagagttatgatcaagatgacgattcgaaattggaaatttcccgtgagaaatatcgcggcggtgcccccggatgtcctaacaagcacaatccgttccacgtctgcacagacttttgctttgaccattggcaggagggctatccggagagtcgactatccgataaatacttggagcagcggaacaaaatgttgcggaattacccactgccgaaggattgggtcgaaatttacgacccagggatgcaccgccattactattggaaccaaatgaccgacgaagtcagttggctctccccaaaacacccaaaggccgtcatttcggaagcggcagcaaaatcggcaaaagaagcatggaacatgagcaaaatcgagcgcagtgaaggcgaaagaggcgggcgaagaggggggcgagagggcgacgaaagagagggcactgagcggaggggcaaagagcggtacaaaggcaaacggacaaaggattatgaaattgctttgccggacagtgatgaggaggag

SEQ ID NO: 48840 - DNA, 517 bp, Heterodera glycines
  SCN-specific regions: Sequence locations=1-474,496-517
gggttcactttcgctgactgttacagctgcactgatggttaatcacaaggtcaatccaaaggacattggctttctcgcggatggcaccgaaacattggtcgacaaaagcaaaagtgtgaagtcagtgttaatggatttgtttgccgattcgggcaacatggacttggagggcgccgactagaaaaacgcgtgtttcggtgggactcaggcgttgttccatgccgacgattggatgtacgctttttacgcaacacaaaaacgccttgccatcgatgtctgtgctgatgtggcactttattcggctgggcccgcccgatgtacgggcggtgccggtgcaatggcctttctgattggaccaaatgcaccgattgcacttgaacgtggccttagggcatgccattctcaaaatgtttacgacttttacaagccaattggaggcgttagcacgcaattcccacgagtggacgggccaaacagtgtggacacctatttgaacgccgttgacatgtgtctacgg

SEQ ID NO: 48841 - DNA, 609 bp, Heterodera glycines
  SCN-specific regions: Sequence locations=1-609
ttgtcaaatgaacgccattcgccaaaaaaagtgaagagcaaagagaagcagaggaaaagaaacgcgctgaaaagctgcaacaatttgttgattcaagaaatttgggctttcacaagagaaaatccggtgaatacgacgacgaaatgttgacggtttgcggagaacttctgaagaataacccggacatttacacactttggaatgtgcgacgggaggccattgaaaagcgagcgacgaaatgtgaggacgaaagtgacgaggaattggccaaacgaatctccgagctgatcaatggcgagttgaagttgacgcaaagttgtttgttgcgaaacccaaagtcatattcaacgtggcaccaccgctattggtcctgtcttcgccaccccacgccaccgttgcgacaagaattggcactttgcgaaaaggcgttgggccaagactgtcgcaattttcactgctgggaccacagacggtccattgcacggacggcccaactaagtgccgaggaggaactcagattttcggacactttggtgggccgtaacccgagcaattactcagcttggcattatcggggcactttgttgccactgatgaagccgaacaccg

SEQ ID NO: 48842 - DNA, 478 bp, Heterodera glycines
  misc_feature (455)..(459): n is a, c, g, or t
  misc_feature (462)..(464): n is a, c, g, or t
  SCN-specific regions: Sequence locations=1-478
tgtaagacaaattttacaaccaaaaaaaaaatggttcgtcttattcaaaaccaattttggcggggaacgttgacgcagccgtggggtgtcaagatgttcaagtacatttggcgcaagcacagtcgttttttggtgaaaacggttatggtccaagaaaacgacatcgacagcgcatttcatctgctgaacagactcatggaacgtgaagggcttttgaagatcatccgcaacacccagcgctatcagaaaccgtttatgcagcgttcccaactgtccatcgaggcgtcgaaggcaattctggaggaggaccgggaccgcaaactcaaatttttggtgcgcaaacaccgcgcggacgcgtacccggggcaactgacgatgtgacggggcgggcggaagatttgtcattgtttttttcactcaaatttttttttattggtaaatattcatgtcttccnnnnnaannnaaaaaaaaaaaaaa

SEQ ID NO: 48843 - DNA, 1194 bp, Heterodera glycines
  SCN-specific regions: Sequence locations=1-95,117-117,147-859,916 -1081,1104-1194
gttcatctacaaccacgaaattacggcgatggctcggaatgcgtccaaatcaccacagctgttggtcctctactgtgatcagcttttgcgcaaaagtgcacgcaacatggaggacgagaagatggatgagaacctggagcaagtgatgaccgtcttcaaatacatcgacgacaaggacatgttccaagcgtttttccacaagtttttgtgcaagcgcctcgactacgacacgtcagccagcgaggagcaggagcgatgcatgatcgcaaagctgaagcacatgtgcgggttcgagtacacctccaagttggagcgattgctgactgatgtcccgctcagcagggaccactccgagcaattcaagcagcagccgaggacatccaacgttgacttctccgtcattgacgtcatgtcaaacgtgtggccactgcagcagccggtcaaattagaaatcccgcgtcctctcctcgacggcattgactcctacactcagtactacaccaaccgtttcaatggccgtaaactgacctggacgttgcaaatgtaccacggtgaattggtctcgacgagcaacactttcccgtcgaaatactcatttttgtgcaacacgcaacaaattgccgtcctcatgcagtacaacgaacgcaacacgtacacacttggcgaactgcacgtcgctcttggcaccgactttcccggcgatcagctgtgcgctgttgttcaatccttggtcaagacgaatctcctgaagctcaccagcgccgatgggaaagctttgaccgagacgaaactcaatgacaacgagcagaaattcacctttaacccaggattccacagccgcaagctgaaagtcgacttggtccgtgccatgtcctctgccagggagacaaagaaggagagtgaggacgtgcagaagacggtggacgaggacaggaagttggtcatccaggctgccattgtccgtattatgaaaatgcgcaaatcgttgaagcatcagctgctggttgccgaggtgctcaaccaattgacaactcgtttccagccaaaggtgccgatcatcaagaagtgcatcgactcgctgattgagaaagaatatttgaagaggtcggaagaggatcgcgatatgtatgaatatttggcatgacagcattaaatgtattggatgtttgtccgcgttataattgtattgttttg

SEQ ID NO: 48844 - DNA, 705 bp, Heterodera glycines
  SCN-specific regions: Sequence locations=1-35,61-138,161-511,533-705
atggagataatttacgcaattctaagcttttttgggttgctttttcttctttgtttgctattcaaatttcttcgcgcaatttggcgttgtgtttacccctattttattgcacgtccaaaagatttgcgccgtttggtcggtgccaaatgggccgtggtcaccggcgccagcgatggaattggcaaagaatatgcaaaacagttggccaacaaaggatttaacttaatgctaatttcgcgctccgctgacaaattaaaagcagtgaaagaagaaattcagccaaaacaatttttgcagcccgaagtcaaatggatttcattcgatttgaccaacgcaaacattgaggactatgaaaaatggcttttccccgagctttcaaaaatggacattggcatgctggttaataatgtcggaagttttccgccattaatgcgttttcacgagctccccggtggacatcgaagtattgcgaaagatttgattttgaacacaatgccacacaccattcttaccgcttttgttttaaaacaaatgactgaacgcaataaaggcattattgtcaatattgcttcggtggctgctgttttcccactttttcatacagctctgtattcttcagttaaaaaatatctcacttggttctcggcaatcttgcgcaaagattatgctgatactggcattatcattcagagtattcttccgggg

SEQ ID NO: 48845 - DNA, 535 bp, Heterodera glycines
  SCN-specific regions: Sequence locations=1-317,341-446,468-535
gtccaattaagcgcgcgttaaaatgagtgcaccaacggcattggcgaccaacagcagacgacaaacgcccagcgaatttttgaagaaaattgtcggcaaaccggtggtggtgaagctcaattcgggtgccgattatcggggcattctctcctgcctggacggcttcatgaacattgcgctggaacagacggaggagtaccatggcggacagctgaaggccaagtacggggacgcgttcatccggggcaacaacgtgctgtacatcagcacgcagaagcaatgacggatgcccccggaggggaagtgatcgatcatcaaccaatcaaatcaatcaatcaatgcgtcatttcattatttatcggattcccatttttgacacttaaaaaaattttaatcgctttttaaattgttgagcactgtctgactgactcattctctttctgttaaaaccagcaacagatcttattaccgtaccgtctgctggtaattgatgtacagtacaaacgaccgtattcactaaaataaatctgccaac

SEQ ID NO: 48846 - DNA, 524 bp, Heterodera glycines
  SCN-specific regions: Sequence locations=1-524
ctcaagacaatacgaacacaattcaaagtaaatccaagtcaggatatcctacgaaaatggttattgtctatcgaccttacgtcagtcgttggcgccgagcatggacagttatcaaggcaaagcctcgtttctggctcaaatattatccagaattttctgcgggctggtatatgctggttccatcggtcattatttgtctcggaacaaggttctattttggcgggtatccaaacaacttcggcatgggctggaacgaaaaacccttctatcgtcagtttttcgaggtgcgtcgtcccgatgatccattggttctcaaatggcgtcttcctgaggaatatcccgctcgtttccaaaccaaccgtcagtccgactactaccctactaccgctcacaacaaacactacgcctgggacgtgaaataactgcgtgtcgagcgaacagcgaacgacaagaaaaaaacatgcacatttattttatgttacgtttaggaatgacactgtaaaatgttctgccaaaaaaaaaaa

SEQ ID NO: 48847 - DNA, 596 bp, Heterodera glycines
  SCN-specific regions: Sequence locations=1-11,34-70,93-254,276-596
agatgctttcctcggtcactttccgtttttcctatgccatctcttcttccgtcgcttttccgtcgtcggcattttgcccatttttccacaattttcggcatatttcgctgcttcccaaagatggaatgacattgcatgactttttgccaccgggcagcacaaaagcgattagtttcgcggacgatggacaaaaaactgagacggcacagcgacggacggcggacggacgccttcggttgccggaatggctgaagagggacgtggtggccaagcagagcgatgtgaatttgatcagaatgaagaagcagctgaggggactgaagttggccaccgtttgtgaggaggcacggtgccctaacattggcgaatgtttgggcggtgggcccggcaggccgtcaaccgcggccattatgctaatgggcgacacgtgcaccagaggatgccggttctgctcggtgaaaacggcccgccgacctccgccaccggacccggaagaaccgctgaacacggcgaaggccgtcgcgagttggggcgtcgattacattgtgctgacctccgttgaccgcgacgattttggtcggacggcggcgcggcac

SEQ ID NO: 48848 - DNA, 563 bp, Heterodera glycines
  misc_feature (553)..(553): n is a, c, g, or t
  SCN-specific regions: Sequence locations=1-452,507-518,540-563
aacgtggacatgctaatgagtataatcgtccccgaaaggcgtagcattgccagcgccattcagattctcttttcccatttgttcggcgatgcctccggcccctatttggtcggtgccatctccgacttcgtccgcggctcttccgatttgccagccgatcgtttccattcactgatcgtcgctttttatctgcccaatgctttgctttttctcagcggcgcggcatttctcggcgccgcttattcacttcccgcggatttgaaacgaatggaagcggaaaaagctgcggcagagagcccaaaacccacaacttcggccaccattggcccttcgtccgctaacattggtccgcaagggcggcaaaacgaagcttttgaatgagagggaaaagcagctgataatgatcatcatcatctctgcgtttcataatcattctgttatcgaattctcacattttacttttttttaaattctatttattttatttttttctattttttatttatggcattggcatttttctatataaattttattgtacctttaaaaaaanaaaaaaaaaa

SEQ ID NO: 48849 - DNA, 687 bp, Heterodera glycines
  SCN-specific regions: Sequence locations=1-86,109-663,685-687
gttcattttgagggtgccgatgttgacgcgtctggttctcgttacggtgcatcaattccatttgaaaaagcaatgcgaccggaagtaattattgcatatgaaatgaacggagatgtcctcacgagggaccatggctttccaatccgtttggttgtgcctggtcatgtcggagcccgacaagtcaaatggctgaacgccattcgccttagtgacgaggagagtcccagcacttggcagcaaagggactacaaagcatttccaagttccgtccaaattggcgatccactgccctttgacacaactccagcaattcaggaatacccagtccaaagtgtcatctgtgaaccaaactcaaacactaaaattgcaccgggtgccaaaactatcacagttcgtggatatgcatggagcggtggtggaagaggaattattcgtgtcgaagtttctccagacaatgggaccacatggaaatgtgctgaattggagcagtgtccggaacagaacatagaacaaatgtggggttggactttgtggagcgtggaactgcccatttccgaggcaacaattcggaatggtcggatggaattggtgtgcaaggcgacggaccgttcttataacacacagcccgagacggggatcgcactttggaatgtccgtgggctgctgcacaatgcatggcacagagtt

SEQ ID NO: 48850 - DNA, 637 bp, Heterodera glycines
  SCN-specific regions: Sequence locations=1-229,251-637
gtccaattaagattacactcacaatcttatctacctagttattttttcatttgatcaactacacgattaaaagcgtcaatcatgggcaagggattccaaaattttatgtccaagaaggacttccatccaagtgcatggtggaacttaaaaaggaaatgggaagctgagcaaaagaatgacttggagaaaagaagacaggatgaattgcgtgtccaatatgagaaggagcaagaaattctcaacaataaggcacttcttggtgacgaaaaagcgaggttgggcctttctttcatgtacgatgcgcccgctggcattaacaaaaagaaggaggaagggccggaaccgaaattcgaatggcaaaggaaatacaatgcaccgcgtgaagaatgggcgaaaggaaatgaactcatccaggaccaacctttcggaattcaggtgcgaaacgttcgctgtgtcaaatgtcgcgcgtggggtcatttgaacacggaccgcgaatgcccactgtatggtatgagtggaaatgctgaagaccatggctatgcaaataatccctccgatatcattcgtgatttaaatgtcgaaaagaaaacaaagactgtctctgatgtcacgaccaatgagcagattgatataaaac

SEQ ID NO: 48851 - DNA, 641 bp, Heterodera glycines
  SCN-specific regions: Sequence locations=1-303,328-641
gtccaattaagcatcgtttgctcttcgattgttggccatattttgtttgatgagattcgatttctcgagtgttttcacccattttaacccatagtttcactgtcatgaaaattggacatcggaccccgccgaggcagaaaagagccactgaccctcccccacagttcgattcttccgatttgggctctccgcaaaaggtttggtcactgttatgcgagaaggacgagaaattgcgccgagatccgcacgtattttcgcgccagaagaaaataaacgccaaaatgcgtgccatgctgctcgactggctgatggacgtctgtgccgacaaacagctccaccgcgaaaccttccatctttgcatcgattacatcgaccgtttcatcgcattgagtgaccaccaaatgcagccccagcgattgcaactgttcggctccaccgccctggtaattgcgagcaaagtcgaggaaatttatcctccgaaaattgcggagattgccgaatacacggacggctgttgttctgaggctgacattcgaggcatcgaagagattatgctggagaagttggattggacgtgttatccggtgaccgctgtccattggctcgcacttttcatgcagctgatgaacacggacgaagtg

SEQ ID NO: 48852 - DNA, 1296 bp, Heterodera glycines
  SCN-specific regions: Sequence locations=1-13,38-795,817-1266
aaggaaacgaaattttgtatttaaatgtttttactaattggcaaatatccatttttaacttcgacatccatacgtgcattttcgactattaaggaagccttcattttggaagcatgtcgaactccaattggctctttccgttctcaattggcttcggtgtcagcgccggcattggcctccgaatgcattaaagaattgttgaagagaactaaagtgccggcaaaggaagttcaagaggtatttctaggccaagtttgccaggctaatgttggccaggcaccggcaagacaagccgcacttggcgccggtttggacgtggcagtggcggtcactaccgtcaacaaagtgtgcagttctggcctcaagtccagcatgctggccgcccaacaaattcaactgaatcatcagcaattggtcatcggcggagggatggaatcgatgagtcatgtgcctttctatttggagcgcggcgaattgccttatggcggtgccaaactaattgatggcattgtgaaagatggactgaccgatgcttacgattcggtgcatatgggcaattgtgcggagaaaacggcgaaggaatgccaaataggacgggaggagcaggacaattacgccattcaaagttacaaaagggctgctcaagcatggcagaatgggcaaattggacccgaaattgtaccagtggagataaaaacgcgcaaagggactttcaaaatggagcgggacgaggagtacagcaaagtggactttgacaaactgaaggcattgcgcacagtcttccagaaagagaatggcacagtgactgcgggaaatgcctccacgttaaacgatggcgcagccgccgtcttaatggccagcgaggaaaaagcggacgcacttggggtgaagccaatggccaaagtaatcgcctacggagacgcagccacacacccaatggactttccaatcgccccggcgcttgtcatccccaagattttatcagccgcttctttgagcattggcgacatttcacttttcgaactgaatgaggctttatccgtggttccgcttgctgtgattaaaaagcttggcattgacccggccaaagtgaatgctcacggcggtgccgttagcattggccatccgattggaatgtccggtgcacgaattcttgcccatttggtccatgccctcaaaccgggtcagtttggattggctgcgatttgcaacggaggcgggggagccagtggaatggtcattaaaaaactgtgatatgattttgtgaaatattttttatatttacaaatatattta

SEQ ID NO: 48853 - DNA, 1246 bp, Heterodera glycines
  SCN-specific regions: Sequence locations=1-1012,1034-1246
gtcaaacttggctcagcagtgatcactcgtgacgacgagtgcggactcgcacttggccgtctcgcgtcgattgtggaacaggtgtccgaattgcaacagactggccgtcaaatgctgatggtttcatcgggtgccgttgcgtttggccgtcaaaagttgcgccaggagttggtcatgtccatgtccatgcggcagactttgcgcgggcccgccggcatgcagacggacaaaagggcgtgtgcctccagcggaatgccgggactgatgagtctgtacgaacagctgttccaacagtacggtatcaccgtagcccaggttctgctcaccaaaccggacattgacgacccgcagcgacgcaaaaatctgcaggcgaccattgaaagtctgctgcgtctgaacattattccaattgtgaatgccaatgacgcagttgcacccgacccgaagcttaacatgcacatttcggacaacgattcgttggccggtcgattggccagcgaaatcagcgccgatctgatgatcattctgtccaatgtcaacggcgtgtacaccggtccccccgagcaggagggcacgcgcctgctgcactcgtattgcccggcagaagcaagctccgtctcattcggctccaattcgaagtttggcaccggcggaatggaagcgaaagtgcaagcatgtgtgactgcattgcaccacggagtgtccacagtaattaccaacggaatgcaaaacaacgtaattaccgatgtggtttatggtcgaaaagttggcacaatgttctgtaacacttcgcgctacgaagggcctccgatcgccgaaacggcggcgaaagtgaaagagagcggccgattgttgcaaagtctgagcaacgaagaaagggcacaaatggtgcgccacatggccgatttactgatggcacgcgagtcggacattctcgaagcaaatcgcctggatttgcacaatgccaaaggcgcaaagttggaagcggcaatgaatcgaccgactgaagctgaccaaaggcaagcttttggacctgcactcgggactgaatatgatcgccgactcggcaaacacattgatcggccgggtgttgaaacggacaaaagtggcggagaatctgatcctggaacagacgacagtgcccatcggcactttgcttgtcatcttcgagtcgcgtcccgactgtttgccccaagtgggcggactttccattgcctcgggcaattcgctgctgctgaaggggggc

SEQ ID NO: 48854 - DNA, 729 bp, Heterodera glycines
  SCN-specific regions: Sequence locations=1-15,37-351,373-729
gagaatttgaagttcaaaagagagagacgagaaaagttcagtcagtcggcggcgattccttcgaatttgcccccttcgacaagcaatggacaaatgggttcgcttcttctgcacgatgaaatggcgtccgcttccagcggttcttcgacctttgcgttggacatggataaattggagcaacagcgggtgcaggaacagaccactctactgctcgacgataccgaacagttccaccaatcccggttcaacgccatggaaagcattgaaagcagcatctctgagctgggcacgattttccgccagttggccactctcgtctcggaacaaggcgaaatgatcacgagaattgactcaaatgtggaggagagcagcctcaacgtggaggcagcacaccacgagttgctcaagtatttcaacaacatttcccgcaaccgttggctgattatcaaagtgttcggcgttctgatggcattctttgtgttctttgtgattttcctcacctgatcggctgataaactcagttctgcggggattccttcacattgtcatcataatcactcacagaattttattctcttaaacagcagtcaaatcattgaccaaatattcctaacttattacccattctttattgtgttaattgttggtcatcattaggtctttctgaaaatcgctttgtgacggttccattcgcccgttccttcttctgtttaaactctcccactcctc

SEQ ID NO: 48855 - DNA, 740 bp, Heterodera glycines
  SCN-specific regions: Sequence locations=1-3,25-40,62-601,623-718
tcatttgatggtggcaatggcaactgttagttcatctagcaataatacatgtaaaccaagtgaaagttattccgcctcaaaaatacctcaatgtgtcggaaacaatcaaaaaaatgttccacgaattgggaatcaaagagtacgaaccgcaattagtcttacaattgtgtgatatttcttactcattgaccaaggagattctcgtcgatgctcgttctgtttccgagtttagtggcaagaaacaggtggacagaagcgacgttgaccttgcgatcaaaacatttgatgaaaagcacactaatgatcgcccaccaaaagcttttgtgtcggaattagccgcagaaaaaaatgcactgcctttacatccgatacgtcaaaattatggactccgtttaccgaatgaccgtttctgtcaactgcagcccaattacatatacatcggagatgatccgaacaacgaagaccaagcagtccatatggaagagcggcccagacaaaatggatcgtcgaaattcaatgcaataaacaattttgatcctgaatctgtgtccaatctcttgatgacggacaaaaatgctactcaaagaaagaggccatatacaaacggagaaatgcagaaacatacgcaagaagaagattacgacgatgaatatgattgatttttgtcgataattctgtttaaaattagctcattttttaaacagtaaattattcctgtaaaaaaaaaaaaaaaaaaaaaa

SEQ ID NO: 48856 - DNA, 635 bp, Heterodera glycines
  SCN-specific regions: Sequence locations=1-577,600-604
atggcttctccgttgcaacgtctgatcacgtgtaattccccccaaattggctttgttgcgggtcgaattcgttttgtgccacattttgaaaaattagcggtgagttggtcagcgaattcgccaaaaagtgagggcgcggaacgttttgtgaaggaattctggccgattatcagagagaacaacccgaacatcgaatacctactcacccgttcgcacaccgaatgcgaccctttcgtcgtgggcacattccgttgggatcgtactcgaaaacagagactttgttggaaacacccgcaccaaattttggcaataattgaacaatggtccatcggtggcgattatcggcccggacgaaagcgcaaagtggcgacgataatcccacggggaatgcaaatcatagacaacgaaacgaagggacacgaagtgttcaaagtgttcagtcggtggaagggcgaacccacggggaacgccatggacccgaagaaacacccgaattacttgtaccatctgattaacgaagctcggaaatgaggaaaaaagtagagcaacatcatttgtttattcgaatttcaaatggattttggaattttaaaatttttcgatgaaataaatataaaaaataaaaaaaaaaaaaa

SEQ ID NO: 48857 - DNA, 1148 bp, Heterodera glycines
  misc_feature (1126)..(1128): n is a, c, g, or t
  misc_feature (1130)..(1130): n is a, c, g, or t
  SCN-specific regions: Sequence locations=1-395,431-578,601-959,983 -1063,1097-1148
caagtttgagcgcaaattgtctggaaatagccaattagccatttaataattgaaggatgggcgaacaaatgaaattggagggttcactccgtggccacaacggatgggtcacgcaaattgccaccaacccattgtataagaatatgttggtgtcggcctcaagagacaaaaccatcatcgtttggatgcttgatgagagtgggtcggtgctaaacggcaaaccgatcaaatcattgcacggacatggacactttgtttccgatgttgtcatgtcctcggatggacagtacgcactgtccggctcctgggacaaaacattacgactgtgggacttgaacacaggacaaacgactcgtcagttcgtctcccacacccaggatgtgctgtccgttgctttctccgccgacaaccgtcagattgtgtctggctcgcgcgacaagaagatcaaactgtggaatacacttgcccagtgcaaacacacaatcgtggaggagtgccattccgattgggtgtccaccgtgcgcttttcgccttctcatgcgaacccagtgattgtgtccgccggctgggacaaaattgtcaaggtgtggaacttggccacttgccgactgaagaccaaccacttcggacacaccggctacatcaactcggtcaccgtatcacccgacggctcactttgcgcttccggaggaaaggacggctcggcaatgttgtgggacttaaacgacggcaaacacttgtacacattgggcggcaatgacgtgatcaacgctttggcgttttcgcctaatcgctattggctgtgcgccgcggttggcccggtggtgaaaatttgggacttggagaacaagacggtggtggacgagctgaagttggacattgccagcaccagcgccgcaaatccgatgcgtgtatccaaaaaatcgtgtccccaatgcatttcattggcatggtccacggacggacagacgctgtttgccggttacaccgacaacatcatccgagtgtggcgcatagcttaagcgaaatgttatggacagagaaatcggcactgatcgtccttttgatcagtttttgttgttgttgttgtacttcttttctgccgatttataaaagtttggttttnnnanaaaaaaaaaaaaaaaaaa

SEQ ID NO: 48858 - DNA, 720 bp, Heterodera glycines
  SCN-specific regions: Sequence locations=1-386,408-720
cgcagattcgcatttgattggattctcggtacgcagcataaattggacgtggacgtgcatgtttcggacgaattggacattaacgcgttcttttcaactggagaattacagccgaacgaaaagagtttgcctgttgacgacacttcagccgtcataaaggagcgcttatggcaagagccgaaccatgaaattgtggccaagttgctttcgatgggtttcactgaaaacgcagctaaaaaagcggcgcttttcacaaagaacgaatcagcggaatcggccattaattggattcttcagcattctgacgacactgatgtaaacgatccgcatccgatgttaacgaaacaaagcactccgccactgacatccaaccaaggccagaacgcgtctcagaaagttcgtcacggcaaaggtcattaccgactgcgcgccttcatttcgcacattgggtcgacgccaaattctggccattatgtcgcacacgtaaaggcagacaatggccagtggcacatttttaatgacgaaaaagtggccaaatctcaacatcctccgaagactcttggctatctttacctgttccaacgggccacctgaacagtcaaataaatgctcttttgatatgcttttttgttgttattgaattttatttggcatcgttttattgactcaatttttgttttaattggacttgttttctcaaaatgttaaaaaaggtgtgac

SEQ ID NO: 48859 - DNA, 711 bp, Heterodera glycines
  SCN-specific regions: Sequence locations=23-39,61-169,193-301,324 -338,362-661,683-711
attaagaagaaaactgaaaaatgtcgagacctaaagtcttttttgatataaccattggtggaaaagcagctgggcgtatcgtgatggagctttattcggacattgttccaaaaacggcagaaaattttcgttcgctttgtaccggcgaaaaggggatgggaaagagtggcaaacctctccattacaaagggtctaaattccaccgtgtgattccaaatttcatgttgcagggtggcgacttcactcgcggtaatggtaccggaggggaatcgatctatggcgagaagttcgtggatgagaatttcaaagagaaacacacccagcccgggattctctcgatggccaacgccgggcccaacacaaacgggtcacaattctttgttacgactgtgaagaccgaatggttggacggtaaacacgtcgtattcggtcgcgtcactgatggaatggatgtggtgaaagctgttgaagctcaggggtctcagtccgggcgcgcttcgaaagacattatgatcgctgactgtggacaattgtcgtgagaatagggccaagaaaaaccggattttccaatgttatgaatggtattgaaacaagttaaggcaatctctaattttaattattgagggcgatgataaatttgtgatttattaatggccaatttttctatttttgttggtgcggtacaacaaaataaatacatgttcatgaaaa

SEQ ID NO: 48860 - DNA, 675 bp, Heterodera glycines
  SCN-specific regions: Sequence locations=1-75,97-116,139-277,316 -424,451-472,506-675
caagtttgagtacgattattatcttgcacgaatccaattgtttcctatcttagacacttaaatggcactgaaacgtatacaaaaggagctgcaggacctcggccgtgacccacccgcccagtgcagtgctggccctgtcggcgatgaccttttccattggcaagccaccattatggggccaccagaatcgccttaccagggcggcgtcttctttctgaccatccacttcccgacagactatccgtttaagccaccgaaggtggcgttcaccactcgtatttatcatccgaacatcaacagcaacgggagcatttgccttgatattctgagatctcaatggtctcctgcactgactatctccaaagtcttgctttcgatttgctctcttctctgtgatccgaatcccgatgatccattggttccggagatagcacgcatctacaagacggatcgtgaaagatacaatacgttggcgcgggaatggactcagaaatatgcgatgtgatcgacggacattggcacccgggaagaataccctcacgaccatcccttacatccaccactgaattttcttttggagtcttctctattgtgaaagcgaactttttggaaaatcggcctctcctttattatgtcgcccaagacaaatgtttttcggtaacaagtaaataaatg

SEQ ID NO: 48861 - DNA, 668 bp, Heterodera glycines
  SCN-specific regions: Sequence locations=1-317,341-517,539-668
gtttgctaaataaaactccaatttcattgcagctgccaatgacttccgcttcatccgaccaacaggaccgtgtggacggagtgctgctttcgttagccacttccttgggcggcggagtgcccgaactgttcgaccacattttttcgttcctttcacgaaaaaccgacttttacaccggcgcttccgttgacgaggcgcgcaaaattgttctcgacgcttttgaaaagcacgcctcgggggccaaaaaggaggcggaacaaaaacgaatgcgcaaagagacggaggagcgaaagttagccgagcgaagggccgcccaaaaggccaaggaggaggcggagttcacgcgggtgcgcgaactcaccgacgcggaagcggccgaattgcagcggaaattggacgcggaaaaattggccgaacaaaaaacgacaaacgccgacgaatcaatgccaattaacagcagcgcaaaaacaagcgaaagtggggcagatggtccaacttcaacggaagaggagaaaagcagcaacaaaacgaaaccgaacgcgggcaatggctgtgacctcgagcgttaccaatggacgcagacactcggcgaattggaagtgcgcgttcccttcccttcgcttggctttccgctcaaagcaaaagatgtgattgtggaggtcaagcgt

SEQ ID NO: 48862 - DNA, 788 bp, Heterodera glycines
  SCN-specific regions: Sequence locations=1-25,47-788
ccaagtttgagattatacgacttattttctgcctccaacatgtcaagcagtcttgacgtcttcaaactgacggacgatgacgcaatgaaatttttggtgtgcgaatcgcacatcggcaccaaaaagatggactaccaaatggagcattatgtgtggaagcgtcgatcagacggcattcacatcatcaacattcgcaaaacgtgggagaaactgttgttcgccgcccgtgccatcgcggccattgaaaatccgtccgatgttgtggttgtctctgctcagccgtacgcccaacgcgctgtgctcaagttcgccgctcacatcggtgccactccaatcgttggccgttttacgcccggctctttgaccaaccaaattcaaaagaatttcaaggaaccgcgtctgctcgtggtgtccgacccgcagttggaccaccaggcggtccgtgaggcgtcctacgtgaacacgccggtgattgcggtggccaacacggactcgccgctgaaatttgtggacattgccatcccggcaaacaacaagcaaaagcactccgtcggactgatttggtggctgttggcccgtgaagttttgctgttgcgcggcaaaatcagtcgccagacgggctttatggtggacgacaagctgatcatgcccgacctgtacttcttccgtgacccgcaagagcaggagaaggagggcaccgagggtgaggccgaggcggacatcaccgtcaaggagggcggctggggtgccaccggaggcatggacactatgggcggcgacttccccgg

SEQ ID NO: 48863 - DNA, 1142 bp, Heterodera glycines
  SCN-specific regions: Sequence locations=1-134,160-166,190-253,275 -286,308-374,409-484,506-509,532-543,565-586,656-658,682-733,800-1142
gcgtgaaatcttccatattcaagctggccaatgcggaaaccaaattgggtcaaagttctgggaggttatttctgaccaacatggaattcaaccagacggaacttacaaaggcgaatccgaccttcaactcgagcgaatcaatgtctattacaatgaagcacatggtggcaaatacgtgccccgtgctgttcttgtcgatcttgagcctggcactatggattcaatccgagctggagcgtacggacaactctttcggccggacaatttcgtttttggacagagtggcgcgggaaacaattgggcaaaaggccattacacggacggtgctgagttggtggacaatgtgctggatgttgtgcggaaagaagcggaaggctgtgactgtctgcagggctttcaactcactcattcactcggaggaggcacccgctcaagaatgggcactctactgatttcgaagatccgcgaggaatatccggaccgaattatgtcctctttctcagtggttccatctcctaaggtctctgacaccgttgttgagccatacaatgccactctttccgtccaccaacttgtagaaaacaccgatgagaccttttgcattgacaatgaggccctctacgacatttgcttccgcacattgaaacttcagaatccgacttatggcgatctcaaccatctcgtgtctgtgacaatgtctggcgttacaacttgcctccgtttcccggggcaactcaatgccgacctccgaaagttggccgtcaacatggttccgttcccgcggctccactttttcatgccaggatttgcgccgctttctgccaagggggcagctgcgtaccaagccttgtctgtgtcagaacttaccaagcaaatgttcgatgctaaaaatatgatggcagcgtgtgacccgcgtcatggccgttatttaacagtcgcggcgatgttccgcgggcgaatgtcaatgcgcgaagtggacgatcaaatgatgtcggtgcagaacaaaaattcgtcttacttcgtcgaatggataccaaataatgtgaagactgccgtatgtgacattccgccgcgcggtctcaaaatgtctgcaacttttgtcggaaattccaccgccatccaagaattattcaaacgaattt

SEQ ID NO: 48864 - DNA, 639 bp, Heterodera glycines
  SCN-specific regions: Sequence locations=1-198,222-374,396-607,630-639
gaaacattcaaactttggcgcgtacgtaagactgttatgcagatgtgccacgaccgagggtatttggttacgcaagacgagttggaccaaacgctggaccaattcaaggaccaattcggcgatagacccagcgaacggaggcccggcaggggcgagctgaccattttggtggcacataatgacgaccctactgaccaaatgtacgtgttcttcccagatgacccgaaaataggcatcaaaactatcaaacagatctgtcaacaaatgcaagaacagaacatcactcgagcgatcattgtggttcaaagtgggatgacaccgagcgcaaaacaggcgattgtggacatggcgcccaaatacattctcgagcactttttggaggcggaactgatgataaacatcactgaacatgagcttgttccggaacacgtggtgatgagcagcgaagaaaaagcggaactgttggcgcgatacaagctcagagataatcaactgccgcgcattcaagtcagtgacccagttgctcgttacttcgggttgaaacgcgggcaagtggtcaaaatcattcgtgcatcagaaacggcgggccgttacattacttaccgactttgcaattgatgtttaattcagaggatttgt

SEQ ID NO: 48865 - DNA, 484 bp, Heterodera glycines
  SCN-specific regions: Sequence locations=1-484
tctctcgtcgaccgccgccaaaacgccggtccaggagttcggctctgagtatctgaagcggcagatgaacctgggcaggccgttgtcgccgcacttgcaaatttacaagccccagttgacctgggtgatgtccggcgtgcatcggatcctcgcctgcatcatgtccggagcgctgttggtcggcgttttcggttttggcatttgctcaatcgatttcacttcattcgcggaacggcttaactcgtggaatttgtggcgaccggcttttgacatggccaaaggcaccgaattggcgtccgtttaccgctccggctatttggtgatcggcttgtccacgctcatttccctgctcattgtggccaattcgaagcatttgacgaaggaacagttccaacagaagtacaagaaggaagcgaacaaatagagagaggagacaaaaacataatgaaattgggacacaccgcctcaatgtttatgtattgct

SEQ ID NO: 48866 - DNA, 630 bp, Heterodera glycines
  misc_feature (380)..(380): n is a, c, g, or t
  misc_feature (391)..(391): n is a, c, g, or t
  SCN-specific regions: Sequence locations=1-597,620-630
cattaattcttaaaatgaacaaaactgacgatcaattagctgaatgtcgcgaaatcttttgctacttcgattccaaaggcgacgagaaaatcaatgtgaaacaggttggcgatgttttgcgggcactcggccaaagtccgacggagtccgaagtgcgaaaatgttgtgagcactggaccgaaccagatacgcgcatttcatttgaggaatttgtgccaattttccaaacggttagcaaatcgcgcgctcagtacacaaaggaccaatttgtggagggattgtctcatttcgaccgcgagggcaatggcacaattgccgttgcggaactcaaacatttgctgaccaatttgggtgaacgtctctccgaggaagaggtggangcaactgctcngccggccacgacgtggccaatggttttgtcagcatcgattcgttcattgaaacagtgcttcgttttcctttgacccctccggacaatgaaaaatgccggcggttccgtcgcccctcagccaaaagagcgaaaaactgcccattttcaatagacaacgtttcaatttgagtggacaaggaaatcattccgatcgctgagttattccatatttatttatttaattttgttccctcccctaa

SEQ ID NO: 48867 - DNA, 1257 bp, Heterodera glycines
  SCN-specific regions: Sequence locations=1-872,899-1119,1143-1257
cacatttttacgggcgaatttggccgaattggggcctacgagaaacagaggccgccatttgagccgaagaatccgttcctggccacacttacgctcaatcgcgagttgcactcagtggccagcgatcgttcgtgtcggcacattgagttggcggtggacaaggcgttgatccgctacgagaccggcgatcacattgccattttcccgaccaatgacaccgaaaaggtggacaaattgggcaatctgttggtggttgagttggacacggtgttcaagctggtcaacacagacgaggagagtaccaagaaacatcccttcccctgcccgtgcacttttcgaacggccctcacccattacgtggacatttgctctccggtcaaatcgcatgttttgaaagcgctcgtcgaagtttcggcggacgaagagacaaaggcaaaacttacgctgctgagcacggcgtcggaggagggattgcgcgagtacgcccaattcatcgtgaaggagcggcgcagcattgtggacgtgttgcagcacttccccgcatgcaaaccgcatttagacctgctgcttgaactgctcccgcgtctccaggcccgctattacagcatttcgtcgtcgccccgcgtggacgcgtcactcgtcgcggtcactgccgttgtgctgcgctacaacacaagcgacgggcgactggtcaaaggcgtgtgcaccaacttcttggcggaccgtgccccgggcgtgtccaccgcgccggtgttcgtccgcaagtccacgctgcgcttgccccaccgggtgcagcagccggtgatcatggtcgggcccggcaccggcttcgcccccttccgcggcttcctccacgaccgattgtggcacaaacagcagggcaaggaggtgggcgagatgcacttgttcttcggctgtcgtcacccagaccatgaccacatttacaaggaggagatggaggaatttgttcgggtcggtctgctcacccaattgcacgtcgcttactcgcggttgggaagcgaaaaagtttatgtgcagcacaaactgtgggaggcgcgacaacaaatttgggagctgatccaagcgggcgcttctgtgtacatttgcggagacgcgagaaacatggcccgggacgtgcagaatatgttttacaaaatttttgccgaagttggaggactcagcgaccaggaatcgcagaagatgatgaaagacatggagagacagcgacggtaccaagccgacgtgtggtcatgagag

SEQ ID NO: 48868 - DNA, 929 bp, Heterodera glycines
  SCN-specific regions: Sequence locations=1-28,56-157,179-929
aaacatattcatatcaaacaattataataaacgaaaaagcaaaaacaacagcaaacccctgaaatatgttgaatgacgacgattttccggctttgccaaattcagtgctccaaagcaaccaatcccagcaaatatcggcgcaacagaggttaccatcacagcacacacaccaaaacaattcattgctcgtgaacgatgacgctaccaacgcaaggctaagtcggatgaagcagcaaatggcactggaaaactcggacaaagtcggcattcagacgcatccagacggccgtgtcaccaacattccttccgggatgctcaatgatcagtgtgtaacgaatgagacaaacattcgtcttcagataaacagttttcctctcagattcgccatggacggccttctgacctttttgcggaccattgaaagtgcgccgtccatcgtcggacttgcgctgggccacgacttgaccaatttgggtctcaatttgaattcttcgaagcgaaatctcttccaaacgtttggtggtccctgggccgactttccgtgcagaattcaagatttggacgcgaaagtgccggacgaatatttgaccaatgcgaccattcgagacaaattgccgaacatcaaaatgaacaaattgcacgaggacgtccttttctatttgttctacaactgtccgggcgaagtttaccaagtggcggcggcgaccgaactgtattcgcgggattggcgcttccataaagtggaacgcgtttggctcatgcgggcgcccttttcggcgcctccgcgagaaattggcggcacttacgagcggcgttcgtatttggtgttcgaccccatacagtggagacggattccgcgcgaaatggtgttggagcacaaagatttggaggggaagccgagcgtgcccgggacaggacagtcctccgct

SEQ ID NO: 48869 - DNA, 822 bp, Heterodera glycines
  SCN-specific regions: Sequence locations=1-822
ccaagtttgagtgatcttttgcttctgatcaccgactgatcgatcaatcgatcacttcgttattttctcggcaataaaatgccgagtacagccattcaaaaacttttgttggccgtttccatttttctgatcgtcgccggcatcgttttgacagtcgccggtgttttttcgcccgcttggcaagttgttgacattcgcgaattccgagctgaacatcagcacggcctttggtgggattgcattcgtgccgaaaagcatgtggtggcggtgggcgacttttacgaggaagcgccgctccattgcatgtacaaattcgacgagtccgcggcattagtcatcgaaagagcgctgaaccatgtcgacgaggacggggcagctggagaagctgagcaccaccgattctggggatggcataaggtcgtcctttcgctgatccttctctcccaattggctgcgtttgtcgccgtttgcaccggcgtttgtgcgccttattttgccccgtccaccttctgtttcgccatttctctgttcatcgccatgcttttgtcggtgctcgccgatggcattttcttcttctccgctaatcgcgtcgacattcgcttcgtcaccggaatggtcggcacttatgagcaagtgatcggctacgccttttacctccatttgggcggtactctctgctgggcgttcgcttttgtctgtgccattgcaaccacttacaaatttctcacttccaatggacagcaaagaaaactgttcgatgacggcccacggctccactcggccaacctcgcctcggtctaccgacgacccgtggtcgaatgg

SEQ ID NO: 48870 - DNA, 776 bp, Heterodera glycines
  SCN-specific regions: Sequence locations=1-54,76-123,145-776
gcgaaataaaaaaaagaaattatccaatatttaaaaacagcgaacaaaaaggtcaggaggcaaagaagaaaaagatgtttgaagggccaatcaaaatttggtcatggaatgtcgccggtctgagggcgtgtgttaaaaaaggagggcacaaacatattcgagagtcgggtgctgacattgtatcactgcaagaaacgaaatgttccgaatttccagctgaaatcaacgcattggacgaatatccatacaaaaaactgctgatgactaatgagaaaaaagggtatgcgggcgtggcactcctttccaaggagaaaccaattaaggttgaggaaggcatgggcgacgtggactttgacgaccacgcgcgttacatccaagcggaattcgctgcctttttcttaatcgctgtctatgtgccaaatgctggtcaaaaattggtgaacctacagaagagaggacgctttgatgaacttctgctcaacaaactctccgccctgaatgagagaaaggcggtgataattgctggggatatgaacgtggcgcatcaggagattgatcttcgaaatcccgaaacgaacagaaacaaaaccgccggattcacagaccaagaacgtaacgcattcactcgccttttggacgttggttttgtcgacgtttggaggacccgtaacccggagaccactggcgcatacacttactggtcgtacattggcaaacgatttgccgataacattggctggcggttggactatttcgttgtcagtcagcgactgttt

SEQ ID NO: 48871 - DNA, 711 bp, Heterodera glycines
  SCN-specific regions: Sequence locations=24-239,261-672
cctcgtgccgaattcggcgtttgaggtaaattttttgtcgcacacaaacttgagtaaaaatggcatttcgcgcactttctttcgcccgtcgtccgtttacaacttcgtccatttgccgtaaagaaattgacctggtcgccggtgtttatctgaacaaagttcgggaagtggttggcaaacaaagtgagattctcaattcgcctcagttgaagaaggagttgaacgaccaactgaaccgtttggcccaaaaattccatttgccggatgccgacgcggttgccaagttgggccttcagtttaagggagcaagtgttgtcagttcggtggaccaattggttgatgggggacagtcggtggatgcccagcttaatgcgcttaatgacagtcgtgccaaatatgaagcggagcagaaggggaagagacaggctgaacaggagcggatcggcgcaatttctggtgatgcggactatgcaaaagagtttttcccaattccgccgcctcatatcgaagcccagcaattggccgccgccgccaaagctgcgcaatgatattagaagtgatcagcggaatgagtgaccaaaatgacaaaaaacaaatagcgattttctttgcctctttttttgtgtgaaaatttttgtagaatccgtctccgtataaaaatgtgttgttactaaaaaaaaaaaaaaaaaaaaaaaaaaaaaaaaaaaaaaa

SEQ ID NO: 48872 - DNA, 668 bp, Heterodera glycines
  SCN-specific regions: Sequence locations=1-373,395-668
gtccaataagctggatttctcagatgactgaagtattcaaacgacctgcactcccactcgttcctgcgagtggcaaacggcagcgtctttcttccgaggacgtctctttggtttcgctcggggattctacgcgcacgggggagcaacgagcgtccggtctacaatgtccgattatgcttttgactggccatgagggcgaaatctacgccgcccaattcagtcccgatggcacatgtctcgcttctgtcggctacgaccagcgaattttcttttggaatgtttatggcgagtgtgagaacttctccactctctccggtcacaaaggcgccattatggacgtacatttcagcaccgatggaagtttccttttcacctgttcaaccgacaaaacagtgcgcgtgtgggacatggaaagtgggaaatgcgtacgccgtttccgtacacacaccgatttcgtcaacggctgtcaccccgcccggcgtggtccatcgcttgtcgtctccggctgtgacggcggcaaaattattgtgcacgatgttcgtcgtcggggccctgtggccacttttgaaagtgtgaacaattaccaagtgacctctgtgacattcaacgacacagccgaacaaattatcagtgggggcattgacaatgtgcttaagatttgggatatc

SEQ ID NO: 48873 - DNA, 497 bp, Heterodera glycines
  SCN-specific regions: Sequence locations=1-445,467-497
ggcatttctccgaatacttcgctttttcaaatccatcaattaattcacgccaaactgtgcaatgtccggacgccaaggaggaaaattgaaaccgctgaaacaggcgaaaaaggacgacaaagtgctcactgaggaggacgtcgaattcaaaaagaagcaaatggaagagcaaaagaaactgaaagaggcggcacagaaagcggcggaaaagggcggcaaacttggcggtggcatcaaaaaatcgggcaaaaaatgagtcggtggagaaaaacgccggagggaatgaatttttggacgcaaaaatggctcagaacaaaaagagaatttatatgaacggagtgattgcgactgttctgttttgattcccatccaattttgttgttccatttttgctgtgtatttttatgacggatattttcgccagttattcggcactttttcgtcccaaaaaacacaatcatcatcaaacgcctctgccaagtcaccatcaaagacat

SEQ ID NO: 48874 - DNA, 655 bp, Heterodera glycines
  SCN-specific regions: Sequence locations=1-159,181-213,235-655
tatggattttcaaaaccgagctggtggcaaaactggaggtggtggcgttgcatcggcgaccgatgcaaacgtcgatcgccgagaacgacttcgtcagcttgcattggagacgatcgatttacaaaaagacccttattttatgcgcaatcacttgggcggctatgaatgcaaactttgccttacattacataacaatgaaggatcatatttggcacacacccaaggcaagaaacaccaagccaacctcgccagacgtgctgctaaggaagcttctgatgtgccggatatgccggtgccgcagcaagcaaaaattgagccgaaaaaatttgttaaaattggtcgtcccggctacaaggtgacgaaagaacgtgaccatgcgtccggtcaacaagcactgctctttcaaatagactatcctgaaattgctgatggcgttgtgccgcgtcaccgatttatgtcttcatacgaacaaaagatccaaccaccggacaagcgttggcaatatcttttgtttgctgcagaaccatacgaaacgatcgcgttcaaaatcccggcacgagagattgatcgatccgaggataaattatggacattgtggaacagggagagccgtcagtatggtatgcaatatgcgttgagacacatgcatgatgat

SEQ ID NO: 48875 - DNA, 631 bp, Heterodera glycines
  SCN-specific regions: Sequence locations=1-223,245-374,397-631
attaagatgaaattattgagattgcgctcttatcttcatttttcatgtaatttgcatgttcgcaatttgacgaatttatccaaatttggtacctacaatgagaaagccattcagcttatccagcagcactatgatgaagcgacgtcatcttcacatcaatttgtcgattctccatcccaagaagtcttccgaatggttttgccacctccgaatgtgacaggcaacttgcacattggccatgccatcactgtcgccctcgaagacgcaatatgtcgctaccagcgattactcgggaaaaaagttcgttggaccccaggctttgaccacgccggcatggccactgaacaagtggtgcaaaggcaactcgcgcaacgctttggaaaacaaacggacgaaatgtcgcaatcggagtttgtcgcacactgtgaagaatggaaagaggcaagaattcgggacatttctggtcaactccgctccatggcctgttctctggattggcccgatttgttctacacaatggaccaaaatttttcccgcgctgtccgtgtcgccttttgccgtgtgcagtcgcttggactgatcgttcgcgagacgcgtcccgtgttcactgctctctccgcggacgaggaga

SEQ ID NO: 48876 - DNA, 1293 bp, Heterodera glycines
  SCN-specific regions: Sequence locations=1-584,606-1225,1248-1293
gtccaattaagatgggcccaaaaaaagcgccgccggcaagacgaaaggccgagccaagtgaaggcgaagaggaagtgaagagaaagaaggcgaagagaattgtcattgaggatgaaccggaagaagaagcgaatgggacaggaagtcaattgcaacaaaatgggcatgaagaagcaatggcaccggtagtgaagggaggggacgaagaagacgaagtcgtttctgaagtcggcatctatctgttgccgttggctccgtccgatgctggtggcattgcaaagatggcaaactctgctggtgctgcttcgtcggtgtccatcaatcgacttcaattcccccagcagcatccgaatgtgctccgacgtcgcttcaatggcgcgctgtccggacgcggaaatgcacaggacggagaggaggaggaggaagaccaggaggaacagcgaaccgaccgaactggacggaaattatttgcacagtacaaggcccaggtcaaacatttgcggcttgggttcggctcggactgcgatgaggaggcgatggcatcggccgtcatgcccactttcgccggtggagggggaattgccgaactgctgacaaagaatcacactccgtcttcgtccgcccttttctcgccgcccccttcggcgtcggcctcttcctctgcaatcaaaagggggagtgatttgacctccgacgaaatgttcaccggggaaggcttttcccagcaaggcttgcttaattacgctgtcggattcttcaaaaaaggtcgtctttttttgttaccggtggacaaaaccttcgaaatgcgaaagcccttgcgggggaccattgagcgcgagtcgacggcgcgtaccaccgcattaaagccgtcttcgtccgtcttctccacttcgacacgttccgttgccgctgattctgctccttccggcactgcgtccgcttcgtcgtcttccgtcgctgttgccgcgccgttgcgcattcgctttgcacgtgccgaaaatgacttgcaacgacgccgccgagagcagtcgtccttctacaagcagaagctggtggagcaggaccagtggattccgctcaaagtggagcatagagatttgttggaaatgtacgaaaaggacatcaacaaggtgctgctgtcttcagaatgtccgcccaagtagcaaaaaggcacaatgaatgcttatagacattatattgaaagtcaaaacaacttctcgaacgcttaaactgttctaataacttgcaattgttggttttcccatctggaaattaccaaattatttctgttga

SEQ ID NO: 48877 - DNA, 861 bp, Heterodera glycines
  SCN-specific regions: Sequence locations=1-137,164-212,235-268,301 -334,370-419,445-861
ctttcttttattgctttacacctaaactcatcaaaatgttcaccaaattaatgccatttttatctcttagacaaccgctggcagtggcctcctattctctcatacaacaggctcggaaattttcaacggcagttatgaccaattacgaaatgatcaaagtggagagagtgggcgccgacgacgtcgtcgcactgatcactctgaaccgaccgaaggcactgaacgcattgtgcagccaattgatggacgagctcgcccattccctcacttatttggacaaagacgacggagtccatgccatcgttctcaccggcagtgaaagggctttcgcagccggcgccgacattaaggaaatggtgccgaagaaatttgccgaggttttcggtggcggctttttggagaattggtcccaagttgcgactgtacgaaagccgacaattgcggcggtcaacggacacgctctcgggggtggatgtgagttggctatgatgtgcgatatcatttacgcgggagagaaggccatgtttggacagccggaaatcaaaatcgggacaatccctggagccggtgggactcaacgtcttgcgagaattgttggcaagtcgctggccatgaaaatgtgtttgactggcgaaccgatcaacgcgagcaaagcactcgaaagcggacttgtcgcggaggtgtttccgcctgatcagttggtgtcggaggcgatcaaattgggcgaaaaaattgcagcaaattcaccactgatggtcggaatggcgaaacaggcggtgaaccgttcatacgaaacgacgctccaagaaggccttttgttcgagcgacgacttttccacgcttcttttgcaacgaatgacc

SEQ ID NO: 48878 - DNA, 618 bp, Heterodera glycines
  SCN-specific regions: Sequence locations=1-87,110-186,238-241,271 -295,324-618
caataaagaaaatcaatcatttgcttctctcaacaaatcttctctcttctttcattcaaataaaatgccaccaaagccatcgggaaaaggggcgaaaaaggcagtgaagtccaccaagacggtgcgcacggctgacaagaagcgtaagaagtctcgcaaggagtcgtactcagtctacatttaccgtgtgctgaagcaggtccaccctgacaccggcatctcgtccaaggccatgtctattatgaactcgtttgttaatgatgtgttcgaacgcattgctgccgaagcatcgcgtctggcccattacaacaagcgctcgacaatctcttctcgtgaaattcagacggcggtgcgtctcatccttccgggcgagttggcaaagcatgccgtttctgaggggaccaaagccgtgaccaaatacacctcgtcgaaatgagaccatcgaaaggacgtgaccaaaacacacacaccatcccaaacagttctctatataactataagaaaaaagaaaaaccgttttctctgtattatgactctttgattttttcttttgtctgtcgtttattttgttttttctttttcgttcgataaacttggatggaaaactcgcttttatga

SEQ ID NO: 48879 - DNA, 634 bp, Heterodera glycines
  SCN-specific regions: Sequence locations=1-335,357-463,494-610
gtccaattaagctcaattaatgctgaaaaataacttattaatccgtggcaaatccgtccttttctcgttgccgttgagggctttttccctgtccgctcagtgcgccaacggtgagcccattcgtcgcgtcgttctgatccccggcgatggcattgggcccgaaatttcttccgcggtgcaaaagattttcgaggcggccaaaaccccgattgactgggatcccgtcgatgtcacaccggtgcagggccgggacggcattttccgcattccgaacaaatgcattgagctgatgcacaagaacaaagtgggactgaaggggccgctggagacgccgattggaaaggggcaccgttcactgaatttggcggtccgaaaggagtttaatttgtacgccaatgttcggccgtgccgttcgttggagggccacaaaacgctgtacgacaatgtggacggggtgaccattcgggagaataccgaaggagaatattcaggcattgaacacgaaattggctctggtggtgtgcagagcatcaaactgatcactgaacaggcgtcccgacgcgtcgcccgttttgcgtttgaatacgcacgacaaaacggacgaaaagaggtcaccgctgtgcacaaagccaac

SEQ ID NO: 48880 - DNA, 638 bp, Heterodera glycines
  SCN-specific regions: Sequence locations=1-314,337-586,615-638
cacttttccaatttcttaaaatggcagctcatagccctggcagttccggcgacacttcaacgccgtcgctgcgcaaatttctcaccgacgccctcgtcggtggcacagcggcgggcattgccaagacgggaatggcgcccattgaaagggtcaaattgatattacagtcccaagatgcttcttcacaaatcactgcggacaaacgctacaaaggcatcgtcgacgtcctcgtccgtgtgcccaaagagcaaggctttttggcgttgtggcgtggcaatttgccaaacgttcttcgctactttcccacccaagcgctgaacttcgccttcaaagacacttaccagagaatgttcatggagggagtggacaaggacaagcaattctggaagtccttcgtcatgagtttggcctcgggcggtgccgctggcgccacttcgctgtgttttgtgtaccctttggactttgcgcgaacacgattggctgtcgatgtcggaaaggccgatacccgtgagttcaaaggtttggcggactgcatcatgaaaatcctcaagtcggacggtcccatcggtctctaccgcggcttcttcgtctccgtccagggcatcatcatttaccgcggccgctacttcggctgcttc

SEQ ID NO: 48881 - DNA, 668 bp, Heterodera glycines
  SCN-specific regions: Sequence locations=1-668
agaaggggaggtgaaacatcggcagtactaccattatttctttagtatgaatcgaattctaagcaaaaatttattcaatcggttctttgtcggttatgaaaatctcccgtcttgtcggcactacccaactctccgttcctctgctaatgcgccaaaaccagatgatttgtatgaaccgagattcgagagtgaccgcaaatatcctgacgttccccttctcaatgtgttgctacaggcgtatgattttcaacccgtcgagaaatttcaagcgtacgtacattgggccgccaaacattttgggatacaaatcgtagaaagttatgctcttgcacacacttctgagcttgtcaaggagtacaaggctggctcgaccattcccgtttcgcaatctgttttgaaaacgtacagcagagttgtgcgggttggacccgtccccggcatccaactccccctcttcattgcccttttgcaagcgcacgcacccgttgggatgaaaattgttgtgaagaaacattccccgcgcgacgaacgctgcagatatattcctgacccacaattggaagattttaaagaaacgttgcgtaatttggatgaccctgtcgtcaggaaacttttgggttgggaggcgtaacaaccgagtcaatggaaatgtacagtaattaatgctt

SEQ ID NO: 48882 - DNA, 636 bp, Heterodera glycines
  SCN-specific regions: Sequence locations=1-98,123-322,355-356,378 -388,417-426,476-636
ttcctttttattttctggtccaaatgtcttctaagccggcatacaaagttgctgacatttctttggccgactttgggcggaaagaaattacaattgcggagaatgaaatgcccggactgatggccatgcgggcaaagttcggtgcgcaaaagccattgaaaggtgcgcggattgccggctgtttgcacatgactgtccaaacggcggtgcttatcgaaacgctgttggaactcggcgccgaagtccaatggtcgtcctgcaacattttctccacccaagaccacgccgccgctgcgattgccaagcgtggcgtgcccgtctacgcgtggaagggcgagacggacgaggagtacgaatggtgcattgagcagaccctgattttcccggacggaaagccgctgaatatgattttggaccaccgaggcaacctgaccaaccttgtgcaccaccaacacgccgaacttctgcccggcatcatcagactgtccgaagagaccacgacgggggtgcacaatttgcccaaaatgttggcggccggactgctgaaaacggcggccatcaacgtgaatgactcggtgaccaagtccaagtttgacaatatgtacggcatccgcgaatcgttgccggacggaatca

SEQ ID NO: 48883 - DNA, 663 bp, Heterodera glycines
  SCN-specific regions: Sequence locations=1-558,580-663
agtttaaattccaataaatcacgttaaattcattcggtccattctttcatcgtttaaagcgcaaacggtaaattgaccatattttctcctccatcgtcaacaattatgtccaaattcgaaggagggttctcttctcatgattcctatggctatggtcaaatgccttccgctttcccttccattggtggcgctgcgcccagtgcgcctccttttggcttttctggagcaccgatcggctcgcatgcattcggaggcgatattccgagcccacttgacgcggaaatccaaattgttctgagggaaattcagtcggaagtgcatcagctagagaacagtggcgaatacggggaacaattgaaaaatgcgcgtcgactgttggccaccgaagcaaccaagctcgagaataacatcgacccagaatggctcgaagtggacatcaacaaaccgatcaaagtctccaagaaggtgctcatccccagtttccgtcatccaaagtttaattttgtgggcaaagttcttggaccaaaaggcacgactttgcaaaatatcgccaaatcatacaaatgtcacgtgtacattttggggcggggcagcactcgcgaccgaaccaaggagcaggaaatgctcagcagcggcgacccacagtacgctcactactgtggg

SEQ ID NO: 48884 - DNA, 518 bp, Heterodera glycines
  SCN-specific regions: Sequence locations=1-36,58-281,304-354,376 -381,403-467,490-518
gtccaattaagattaaatttactttcctatccattcttttctaaattgaaaatggccgacgaaagtggcacgaacgcaggaggagccggtgccgctggtggcgctcagcccgccgagtacatcaaactgaaggttgtgggccaggactcaaatgaagtgcatttccgggtcaaatacgggacatccatgggcaagctgaagaaggcgtacgctgagcggactggcgtccaggtgacttctttgcgctttttgttcgatggccgccgcgtcaatgacgacgacacccccaaatcacttgaaatggaggaggacgacgtcattgaagtgtaccaagaacagctcggaggctacattgtggaggaataatgaagattgtgaacatttctccgtgtttctttctctgacgatgatcttttgcggatgttatatttatacttcgatttgtttctttttttgtttctttgaaagaattggattccaaacttttgttgtttaatttatcacacttgtaaaaaaaa

SEQ ID NO: 48885 - DNA, 647 bp, Heterodera glycines
  SCN-specific regions: Sequence locations=1-11,34-441,468-553,577-647
aaataagggtgtaaatttaaattaaatttaaatcgaaatggcttcaacaacaattcgcttttgctcattgttcaagcgacttccagcaaagacatttgttagttgcaggactttgtcaacgagccggccgatgtttgcagatattctctacacggataaacacgagtggctttcgttggacgaggcgagaagtgtcggcaccgtcggcatcacaaaccatgctcaagaatctctgggcgacgttgtttacgtggaattgcccgaaattggcaaaaaattggacagtggcgacacagcgggtgccatcgaaagtgtgaaggccgcctcggacctttacgcgccggttgccggcgaagtggtggaacggaacgcggaagtggaggacaaaccggcgctggtcaacaaggactgctacggaaagggttggctgtacaagatgaaggtgagcaacctgaaggagttggacgagctgatgagcgagcaaagctataagaactttttggctgaggagagtaacaaagatgacgagacgcaacacttttagtcaatttgaggggaggaaagaatcattttgtttgcatgatttttgaggaatcaaatcatatttttaatttattctctacattatgttcacatattattcaagc

SEQ ID NO: 48886 - DNA, 3309 bp, Heterodera glycines
  SCN-specific regions: Sequence locations=1-11,63-63,97-163,191 -208,240-1043,1065-1182,1208-1662,1685-1879,1901-2020,2042-2062,2085 -2174,2197-2504,2526-2538,2561-2892,2917-3139,3174-3228,3250-3261
ctgaacatggccattttgcagaatctgaacgaaaaggaggccaaaatcccaacttcggtcggtgtgcagttgcgcattctcaactcaatgccgattttggccaacatcgaaggccaaatgaagatcaaagcggagtcggcaagtcttatgtctccactcggcatccaattcgacgtcaacacattggcatccgcccgcctttcgcaaatccagaaaatggaactatggactccgttcgcgtccagcggtgtggaaagtgtgcgctcggcccaagtcaatctgccgcttcaggccgaactgaacgccaactcggaccagggcatcagcctaaaggcgaacctgcccaagcagaagacgcagttggccagtgtccattccctacccatcaccttcactgcaaaagtggaccaaaacaccaaattggtgcgcgagccgcgccaaatcgtcaccatccacgaccctaagctggagagacagcagtacgagctgaactcggtccagggacagaagaacttggccatgccattacacttccgcggacattaccattggccagccgagccgaccagctaccagcagttcgcgcagctccttttggccactgaaaacgcggtgaacattcactaccagccgagccgggaaagtccacgcgaggccatcttccgcgtcaccggccaacacttcgaacagttggcacagagtgaacagccggacgcacagctgcgcaacttcttctccgagaaattcgccaatgcgtacagctgcgacgacgagcagtgccaacagaggggcgattgcgaacaatgcgagcaaatcgagcagcaacaacgagaggacgcgcaggagttggaggaccaacagatgcgacagcagtcgctgcacagcttcatcagtgcgtacaagccgcgccagcaatacaaacactcgctgaaaatggtcgcgcagacgaacggcggggcgaaagacgcgaaagcccagggcgacatccaagccatatgcgacgagcagaccgcgtactgcaaagtgctggtgaaggtggagcgaccaccaatcggcaatgagaaccaaaaatggatgctgaacgcacaagcgcacgttttgatgccggagaccgccgcatcagtggagcagctgcagacacagcccaagcagttgaagcagttcatcgcccaggcgaaagcccagtggggacagcagggacagcagacgcagcaggtaaacatccgcgtgcacggcgcccaggcgcacacgcagcaggtgcgggcggtgctacagcaacaacagggcagccaactgatcagcgcgcagcatttgcgcaacatgcaacgccgcagcgccttcctgaacaaattccaaatcgaggcaatttactcgctgaaagccaacgcccaaaatgcgatcaaccgcgtgttggagctgttcaaatcggcctacttctggaacaccaaatcccaactgatgagcggacagagtgcacagaaagacggaaagatcgccgccacaattctaatcgacccggtgactcagaagagtgccaacattaccatccgaacgccggcgcaacagttgcgcatggagcagatcgaagtgccgtacaaagtgcgccctttcgctttgattcgccagcggagtgcgcaacagacgcattcgctggctcagctgttccaccaattcagcatcaaataccgcccccaatgcaccgttgacgggcgcaaagtgaacactttcgacgacttgatctacacggcccccctctcctccaattgttactccgtcgtggccaaagactgcggctcagaccaaccccaatttgtggtgctgatgaagaaggtcgcgcagcagcagcagcagcagacgaacaaaagggcccaaaacgcggctaaggtgctgaaagtgatcacaccagagcagcaaatcgaatgccatccgaagacaaacgccgctggcattccaacgcaattgatttgcaaagtgaacggacaacaggtcaccggagatgagcagtgccaggacagttcttcatgtgtgcagttcaacaacaaacaacaggatgacgtgaccattcagacggaggcaatcgcagtgcgtttcaacggacgcaaggcgtggctgaaggtgtcccaggcatacaaaaacacccaatgcggactttgcggacactacgacgactcggacgaccagggggaggagctgcgcatggccaacggccagagagcttccgacttggccgagttccaccgctcctacgctttggaagacgcggaagaatgcccacaacaggtgatgaacaacttctacagcgaacagcagcagcagaacagcgagcaggacacattctacgggcagttcaaccaatttgaggacgaagacgaagcggacgatgagcagcaacaacagtctgaaaaggacgaatggcagaatgagcaattcaatggccaattcgaggagcaaaacgatggccaagtcactgacggaggcaatccgttcgaaggaattttcaacgaccaacaacagcagcagaagtgttgctgctgctgtgacgacgacgaggacgaagagggcaccaacgaacagagccaatgccgacaaaactgccaaaacggcggggaatgcccagagaagtgcaacaaaaacgaccaaaagcaatgccgaaagtcatcgccaccacagccgcaacaacaacaaaattgcaaaggcagcgacgacgagcagtgcaaagggatttgcaacgacggagacgaagcatgtgccgagcagcagcagcagtggaaagcagtttggccgattttgagaaccaaaacccacgagcagaaccacgcggtgtgcttttccactcgcccggtcaaacactgcccgccggatgcctacccgtacaatccgatgaacggttatgagcagcagcagcagccgaagaccaagaaggtcagcttcgtgtgcatggagcgggcggagccggagacgcgtcggctgttgcgctcgttgcgacgcggacagcgcgtggtggacgtaaacgcacgcggcgcctccttcacggagaatgtgagcgagccgcatcagtgctggcgcagacgctactgatggatgaacggacgatttggtggatgacagaggagtgaccccccaacggagtagaaaagcacaaagcgtagaccaacccaaaaacaaaacaataatcaccctctgctgatcaatgccattactcaaatgatcagcaccacaactccgccatttcctataacaaattgtatttttgtgatagtttagaataaaaaatttattaataaaaaaaaaaaaaaaaaaaaaaaaaaa

SEQ ID NO: 48887 - DNA, 783 bp, Heterodera glycines
  SCN-specific regions: Sequence locations=1-24,59-783
gtaattcttactttttcattgtacaaagaatgagattgtgattgactctgtgccatctttttcttctgtttgtatttttggtgggcttttaaggaaatatggcatagaaaaatcagtgcagaatctttgtgtcgaatggatgacaaaagtcccgccgcaatttttgctcgagaatttgagcatcgtcaagcgcgcgatgtcgacgagttgcgcaggatattccacaggcacattgaagaggaaagtcgaaatgacgagcagcaaaggcacgagaaaacggcggcgccgatgctaacgacggcaccagcgatggcggcggcacttcccagtgcgcgcattgttcggacgccacacattggcacaaatgcccgcgagaatggcaccgcctcattgtccgccatcactccaatcgctgccgcctttcgatggtgcactccgctggccaacacaccaactgtaagtcgtctcactttgcccttccgtacgccatgttttgtccatatttctgtccatgtcaatcctggtcatttcttcgtccaattgccctcccatccgacattttcgtcgcttgcgctgctcaaccaatatatgctcaccgtatacacgcacaatcagccgggcgttggggcaccaggcttggccaagccgtacgacgtcggcgtgctttgcgctgccccggcgtacaacggatggtgccgcgccattactgtggcatacgaccaggaccaggatgggatggtgggccgtttcgtcgattacgggggctttgcccgtttggcccgg

SEQ ID NO: 48888 - DNA, 782 bp, Heterodera glycines
  misc_feature (774)..(774): n is a, c, g, or t
  misc_feature (778)..(778): n is a, c, g, or t
  SCN-specific regions: Sequence locations=1-24,57-600,622-732,755-782
ccaagtttgagatgtttcagaaagttttcttggttcttttgtttttacttgcctttacagtctcaaatttgcggtccgatgaaggaattggggagatggatgcgaatcaaaaacctttgaattcggctcgaatactcgcttccaaattcactctttctcagtatgccgttgagagtatggaccttgtgatggagtacaatttgtttaatgttggcgaccgcactgcttttcgtgtcgtgctggacgatcgtaactcatttcccacccattcatttgacattgtgcgtggaatgcttcacatccgatgggaaaaaatctcaccgggagaaaatgtgactcattcggtggtggtacgaccgcgcagttacggcattttcaattacacttccgccatggtcacttattatgtgaccgaagatgccaaacaagcgaccgtcgggtacagcacagcgccaggcgaagggaacatttaccggctaaaggattatgagcgccgattcagttccaaaatcggtatttggctcgtctttttgctgttagctttacccacgaccttgttgcctttcttcctctggtacaaattccaacagaaatatgcgacaaaaagcgggacatccggtcaacaaaattctaaaaaggctcaatgaaaactaaaggcaattatggagtgcgcaaatccatgccacctttatatttattaccattttgtttccatgcaaacttgtatttgttgtgttaaaccatttcattccttatgctgttggcgtaaacgtntggnaaac

SEQ ID NO: 48889 - DNA, 618 bp, Heterodera glycines
  SCN-specific regions: Sequence locations=1-38,73-124,151-154,191 -316,338-579,602-618
gtcgtcttacgctcgacaaaaaaccgccataaaccgcgccatgcctcccaagttcgaccccaacgagaccaagatcatcaccctccgtgtgacgggtggtgaagtggctggtggttcggcccttgcccccaagatcggtcccctcggtctgtcgcccaagaaggttggtgatgacatcgccaaggccacccaggcctacaagggtctccgcgtgactgtgcagcttaccgtgcagaaccgtcaagccgccatctcggttgtgcccacggcctcgtcgctcgtcatcggcgccctcaaggagccgcccagggaccgcaagaaggagaagaacatcaagcactctggcaacctcaccttggacgccatcatcgatgttgcccgccaaatgcgccccaagtccatggctcgcaccttgaccggctccgtcaaggagattctcggcactgccttctctgtgggttgcaccgtcgacggcatgtcgcccaaggaggtccaggagaagattgacgccggtgagattgagatccccgaggaataattcttcttcatcactcgttgattcaatacattcggcttttgccttgtttgtctgtgtgtgttgacgctgtcgctcattcc

SEQ ID NO: 48890 - DNA, 1021 bp, Heterodera glycines
  SCN-specific regions: Sequence locations=1-498,520-1021
gtgatacatcgccaaccagtggagccggcttcttgcaacaactgcttgacttcttaagtgccgaaaactatggcgaattggcaaccattgttggtcgttattatgccatggaccgtgacaaccgatgggagcgaattaaggttgcctacgaggcattggttgccggagagggcgaaaagtgcgaaccggcgaatgctgtacaattggtgaacgagcgctacgcaaaccaacagactgacgaattcctgacgcccatcgtgttttcggacgaagcgcgtgtgaaagacaatgacacattggtctttttcaattatcgtgctgatcggatgcgtgagattaacaagtgcatgggtgatctgcaaaacctgcaggatttgggcaccaatgttgcattgccgaacggactgcacatcaaaacgatgacacagtacaacgcagagtttccattccccattctgttccctcccgtgacgcataaaaatgtgctcgctgaatggctcagtgttcagcaagtgtctcaattccattgcgcagagtccgaaaagtatgcccatgtgactttctttttcaacggtggacgagaagtgcaatttgagggtgaagaacgcgagttggtcccatcgccgagggttgccacttatgacctgcagccggagatgaattgtgaaggcattgcggacaaagtacgaaacgggtcgataatgttcagggacagtcttcggagttgattctttgaagaaaaaaccgaaaatcggttaaaccaacacttccaatcggggtatccccccaagcttcgaaaatcctaaattctctcaaatcatagtgcatttttttggggggggagggggagagcaccacgatttttagagtaaataaaacggaaaaatgtttttggcattcaatttccctctatttttaggtggtcaagcaagttgaattaggcaagcacccgttcatcatgtgcaattttgcatcacccgacatggttggtcacactggtcaatatcagccgacggtggag

SEQ ID NO: 48891 - DNA, 641 bp, Heterodera glycines
  SCN-specific regions: Sequence locations=1-367,389-641
gtccatttaagattacctacatagtatttattcgaaaaatgtcatctaatgggaccgtgtctaatcaaattgggaatttaagcaatgtgggcgctattggcaattgggtggaagctgttgaccaggaaacagcacaaaaacggattgaatttctgaaggatggcatcaaaactgtcatcgattacgtcgatgaaccggatgggagcaaaagcaaagttatcgccacttacaaagtgataaacaaaaaagtgccacgtgtagttgccgaacggaaaaaatggaagaaattcggcacgtcaaaggacgacgggcccggcccgaacattatcacgacttatgtggcggacgaagtggaggtccaattcaccaaccgaggcggagagcaggacgatcgggacgacaaattggcggaagcgctgctcaagggacagtcgtcgaaggcgcactgtcgcttttgcaaatcggacgaccattggagcgtcacctgcccttacaaagacatgttcaaagagacgtctgaggaagagcaacaggaagcggacaaaggcggcgccaagcaaacgcccggccgttacattccgccgtcacagcgcggcggacccgcgggggaacggacgatgatgacgggaggcgaacaacgc

SEQ ID NO: 48892 - DNA, 884 bp, Heterodera glycines
  misc_feature (862)..(862): n is a, c, g, or t
  SCN-specific regions: Sequence locations=1-143,165-290,323-551,573-884
cattttgttcccaatcagcaaaccataatattccttgattctctacattttcctacacaaaatgggccgggagcatcgttctgaccgcaaacgagactatgagaaagagcacagtccgttggcggacgaatcgtcgagtggcagcagaaagaggacaaaaagggagaagaaccgaagtgtgagcccggcgcgttctcgttcccacacttacagtccgtcaccacgccgagaaatttcgccaaagcgccgcgctcgaagtcgttctcgctcgcgtgatttgccctcctcacgcggtggtggtggcggcggcggcggttactacggctcgcgtcgtttccatgacggacgcgacaacccaaatccgaacccatgcttgggcgtgtttggcatgagtttgcataccacggagcgcgacctgaagcatttgtttggccgttatggcgaggttgattcggtgcaaattgtgtacgaccgtctctcgggacgctcgcggggctttggctttgtctacttcacacacaccaaagacgctgcgagggctaaggaaaatttggtggatgcagtgattgatgggatgaaagttcgtgtggattattcggtgacgcgcggcggtggaacacatagccgtcatgtgcgcaaaagcttctcgcgcagtccggtgcgcaacaaccgtagccgcacgcgcagccgttcccggtccgagtcgcggtcggtgtcgcgttagaaaggtgaaaagtgctaatggtttggagaaatgaatgaatgatggatgaggatgaattgattgattgacaatgattttgatccgctttttgtggtttagtattattgggctgtcgaatcataaagaacacataacgtnaagaataaaacaccggagatat

SEQ ID NO: 48893 - DNA, 683 bp, Heterodera glycines
  misc_feature (45)..(45): n is a, c, g, or t
  SCN-specific regions: Sequence locations=1-88,111-683
acgtagtggagctgctgccgaacgacggggacttcctggtgcgcntgacagaagaaatttcgggcacggagcgtgtgtatgcactgtcggtgaacgtcggcggcttcctgaaccacgtcatcttccgccgacacaagggaatgttttccgtggacctcaactccgacaagggcttccgaacaatcgaacgattcgtcgacaattatctgcgcaccggagtttccgtcaccactcaacaatacgtcgctctcatcagggccgtgccccgcgcgcactgggagctgtcgcacacttcaatcatactgggcaatgaacttggccgcggcacgttcggggtcgtcaagagtggcgtctacgtggatcagcaggggactcgagcggcggtggccatcaaagaggtgtctcagacgagcaccaaagagcaaatcaaggagttcatgaatgaggcgcgagtcatgcggcagctcccacaccccaatgtcatccagttctacggcgtcgcggttggccaggagcccctgatgatcgtcatggagctggcgacggaaggcagcctcaccaactacttgaagcatcagcggcggagcgcgcgggtcaaactctacatgtgcctcggcgcatctggcggactggaccacatccactcgaaaggcatcatccattgcgaactcgcttgcaggaaa

SEQ ID NO: 48894 - DNA, 639 bp, Heterodera glycines
  SCN-specific regions: Sequence locations=1-225,247-639
ctcaacccgtgggagaagcagcaaccgaacaacaacaacaggcaaaacaagggcaaggagaacggcacacgccaaccccaggctatgcctgtcggctgggtgctcggcgttcgttccaaaaccacgtccataaatgaagatgccggaccaagccatccgtcgacctccgacgctctctcaacaacggtcaagccaccggcatcgacgtcgtcgattgccagcgttcttcctcctcatccctctttctcattgattcaagaaaacgggttcgaacagcgggtgtacactgattggaggagtcagtgcaaaaaacagcgtgaggcacttggctacgacattcccgagatgcatacgctctatcggatttggtctctgtttttgcgggacaatttcaacaggtcaatgtacaacgagttccgtaaatttgcactggaagacgctgaccatggccttcggtatggcattgaatcgcttttccgtttctacagctatgggcttgagaagaagttgcgcccgaagctgtacaacgatttccaagaagccactttgcaggacgttaagcgcggacacacttttggtctcgagaaattcctcgcctctttgaaatattgtaagcacagcactcaaattggaggtgat

SEQ ID NO: 48895 - DNA, 857 bp, Heterodera glycines
  SCN-specific regions: Sequence locations=1-13,35-56,133-134,193 -380,402-594,616-833
ctaaaatgcaagagactcacattgttctcgggattgcctcggtgtgctctctgttggctatcatcgccacagtcgtcactctgccatctctgtactcggagatgagccaaatgaacagcaaagtgcgcgacggagttgaggccttccgcgtcaacaccgactcggcctggactgacttgatggacgtgcaagtggtcgtgacgccgccgtcgaagccccgtgataaccccttcaactccatcttccgtgccaaacgtcaactgcccggacactgccagtgcgctggcctccaacagccaagctgtccccctggtccgcccggcccgtccggaccgcctggacagcccggacagcctggaggcgcaggacagcccggacagcctggacagcctggacagcctggagcgaacggagttgtctcacgcccaattcctggcccgaagggaccgcctggagcgcctggccagaacggaaaccccggaagccaaggtcagccaggacagccaggaggccaaggaccgcccggacctcctggcgcgcccggtcagcccggccagcctggaaactctggccagcctggacagcccggagcaccgggacagcccggcaaggacagcggctactgtccgtgcccgccccgctcttccgtgttggcagtcaaaaagaagatggcggcagccaagaaagcataagcgacaagcgcagggagaagagaaccgaaagacaaaggaccgacgcgaaagcgaagctgaagatgatcataattgggtggaagttgttgtcggaatttgtgttcaccagcgcatttcccacacgaataaagggcattcactaaaaaaaaaaaaaaaaaaaaaaaa

SEQ ID NO: 48896 - DNA, 1016 bp, Heterodera glycines
  SCN-specific regions: Sequence locations=1-791,813-1016
gttccggaagtctcccaaagcgaagaaggccaaaagcaaaaatggcgcataattgtggacgcattgaaccgaacgcttcacgagggaggcggaggacagagcataaatcagccggggggacagccaaaatggacagcggaaatgatccacgcgaaggcgagacggggaaggaatgagaacgactgatcagaaccaattaatgatcagaggaacgctgatcaaacaattagtttatcagataggagggacgggagattaatcagagggacgacggctcatccaattgtttagagtgattaatggattttatcgccagagagtggttgctcaatgatggttattgaccaaagtttaggacattgtggccatccttcaccttctgatcactctcgcccttcattaccgggcaccgattcgcttcccgaacaatgtcaatgtgcaagtaattaggggaagggcaaggaaaaggcaatgacagccgaagggcgcaggttctgatctacactcggcacggcaaacaaatcagcaaaagcatcgtcactgaacagctgaccaccaaacagacggaattggcaccgaaaggcgaacgtgacgcatttgatactctttttgactatgggccggacaaattgcaacacgtgaaaaattcgctagtcgccttctgcaacaagcacttgaacaagatcaacttggaggtgaccgacttggagacgcaattccaagacggcgttttcctcatccttttgatgggtcttctcgagggttatttcgtgcccctctacaaattccatctccaagtgaacaacaacgacgagaagctgaagaatgtgcaattcgcttattttctgatggaggaggcgggcatggccaagccaaagtgccgtccggcggacattgtcaacggcgacctgaagagcacgctgagagtgctgcacgcactgttcaccaagtacaaacacgtttaggaggaggggagaacagacggagcagcgaaattagggacaaaagagcgacgt

SEQ ID NO: 48897 - DNA, 853 bp, Heterodera glycines
  SCN-specific regions: Sequence locations=1-85,107-335,357-853
gggtttaattgtgtgattggtttaagtaaatttctcctcgtccgtcatgttttatcacgacttgcacgacaacgaaaatagtcatgataaagagttaaaacagttggtacaaatggacgaccttgcaattcccaaatttgtaatgcctccgctcggcattaagccaaaaaaatttgtgcgcaaacattttgggccgaacagtcggcttccaatggcgcagtttctgaagggcactaccacactgtcctttgtgtacaagccgaagacaccgcaagacaaaggcggcgttattgtggcggtcgattcgcgtgcaacgggcggaacttacatcagctccaaaacggtagaaaaaatcattccgatcaacgaccaattggtcgcgacgatggcaggcggtgcagcggactgtcagtattggacgcgggtggtgagcaaatattgcaatcttttcgaacttcgcgagggtacgcaaatttcggtggctgcggccagtaaatattttgccaatgttatgtacgactatcgtggccaagagctgggcgttcactcgatggtttgcggggttgacaagttcggcccttccatttacatggtcgaagctgaagggactcgcgtgaagattgacaccatttgttcactcgggtcgggcatgttacacgccatgtccattttggacaccaaatacaaggaggcgatgactgacgcggaagcgttggagttgggcagaaaaaccattgtgtacgcgacattccgcgacgcggcttcccgtggccattgcaatttgggtcatatcacttccgaaggaaagaccatatacccgccattcgatgtcaatgataagtattatgaattc

SEQ ID NO: 48898 - DNA, 654 bp, Heterodera glycines
  SCN-specific regions: Sequence locations=1-94,116-254,289-289,319 -352,381-425,449-654
gtttgagcaagaacattatggtaaacaagtttttaccgctgatcattttcgtttttctgctgattgacaccgccatatgtcgccatcaccatcggcactcccatcaccaccatcaacaaaatgagcagccggagatgatcagcgttccgcttcgccgcatggacaccgtccgcgcccgtctggcgctcaccggatcgcttgaacagttccgcaagcatcgcacggagtcgttgcgccgtaccgtggagcgaatgaacaacaactacaacaacaatgaagagtacagcagcgcggaatcggaccaggaacagatggaaatggcacaaaacggggccagagttggcacggaaattgacgaactgttgcgcaactacatggacgcccaatattacggtgacatttccatcggttcaccggcgcaaaatttcaccgtcatcttcgacaccggttcatcaaacctatgggtgccgtccaaaaaatgtcccatttatgacatcgcttgcagccttcaccacaaatatgatggcgccaaatcaacctcctatcagcccgatgggcgaaaggtggcaatacagtacggcactggctcaatgaaaggatttgtttccaaagacattgtttgtatggcaaacatttgtgtacaaaaacaggaat

SEQ ID NO: 48899 - DNA, 652 bp, Heterodera glycines
  SCN-specific regions: Sequence locations=1-632
gtccaattaagagattaatatataaaatggccgtggtaagccgaatgtggtatattggaaaggagacttgcaaattcttccacggtgctgtgaaagtcttttttgacccaaattggcaaatcccaaagaccaagcttgatccaagaatgcccgcctatccaacccaacttcatgaatggcttcgcatgttcccctggcgtcattactgggcttactacccaattctgcgcaatttttgctacgtcttcgcctcagcttttgtcgttacgagcattactcaaccgacaagcgttaaaatcaccaaagaacacgtgatcaaccacgaattgcatcacatcgaagcgaaaatgctccacgcgtacacccaacggaaggaggacctgaagtacttcaaggagaacgacgtcatggccaaactgcgcccgaaaaactttgccagggatttgtcaatgggcgacttcaattacttcccctgggggtattccttcggagcgcactgatttctgcggagtacagaaaacgaaggtggacaacgcatttgcgatgccaagcacagattaggacaatgtttgttgaaatgtaccattgctattatattttgtgggaagtaagagaaataaaaggctagccttaaaaaaaaaaaaaaaaaaaa

SEQ ID NO: 48900 - DNA, 696 bp, Heterodera glycines
  misc_feature (675)..(675): n is a, c, g, or t
  misc_feature (677)..(679): n is a, c, g, or t
  SCN-specific regions: Sequence locations=1-593,615-696
gtttgagttattttactgccatgcacaacatactcaaaaggttctttgcgcatgtttcgccttcgcttttaaagaagcccctcaacgacccatttccgattgctgcgtggcgctcgcacccggccaacatggccaaaggtgtgaagttcgatcacgacaacgcgttcgtgcgattctgccgctactatctatggcattactgttggagtgggcgtcagtacggtcttcaattctacgaccaggcattcgaaccgcatcccgtagtccaagaggcactgcgccggctccgtcttaaggacccctaccagtacgaccttcgtctgcagcgtattcttttggccagtcaattgggctcaaagaatgagcgactgccgaagaacatgtggacaaaatgggacgacgagacattctatctgaacccgtattttaacgaaattgaggaggaaaagctggagcgtgaagccagcacgggcatgaagccgggataccaactcaaagagcagatttaggggacagacattgtgttgtgaacgattaggcgcggaggaaaagcacattgcgtttgttgatactgttgccggagagaaattgatttgatgagtgattgttcacaacttttaggacgacatgtgttatgttcatttaacgtgaagtaataaaaccattttcttttcnannnaaaaaaaaaaaaaaaaa

SEQ ID NO: 48901 - DNA, 719 bp, Heterodera glycines
  SCN-specific regions: Sequence locations=1-636,659-719
cagatgttgaaacagggcgactcaaattgtcacagcaaaaaagcgtcagggagccgttacagtgaattatttgaatgcattcgggacaatttgctgactttcatcaaggccaacatgcgccaaatgctcttcgacaagatttccgctgtccttgttcttgacactttggaagtcccgtcaccttcggatcccttccttcgtgaaattggcgacagcgatttggatgactgtttccgggcaattgctgagattgccactgacgaattcgtcccccactcgcccgatgggccgtcccatattgtgcagggcggttgcgctcgcttcgtgttccgcaaactgttgcaggcggacccgggacggtgtgacggacaccgcctcagcgacttcctggccgaccttcccgccgacaatttgtcctcctggaccagcatggactgcggatgttacaccctggtggaggtgttcaagagcgggtcggacaaggcccgcaaggtgctcagacgggcgctcagtgtggccatgttgcagaattcgcatttgtccggcgccaagtctttgttggatttgctattgggcaaaggcaaagagcaaccgacgcgggaacattcggtggctaatggcggcggcgctggtcgaaaaaatccaagaaaggcagcagcaccctttcagaaaagaagagagcggaaaaccaatcaagcttgagccgtttgttgttattg

SEQ ID NO: 48902 - DNA, 563 bp, Heterodera glycines
  misc_feature (546)..(546): n is a, c, g, or t
  SCN-specific regions: Sequence locations=1-478,522-563
gtccaataagcaatactccctttttcccaaatcttacaaatgaacatgaatcaacttttggttggccgttcgctgttcccaaaaatcatccgccctttctcgcacaccaaaccccttgccaagtctgaggctgacccggatgattacggctacttcccggacccaattgaacactcgtggggtttggagaggaaaatgctcatcgctcgtctgaagggtgacgaccgctatgagccgaaggtgtatttccgcgctgaacataccacccgggactatccgaatttggtgccggtccatttgcaggacaaagtcgtcgggtgcctttgcgagccggacgcggagtacgtgaactattggcatattaggaaaggccagatgaagcgatgcgagtgcggacattggtttaagggcgtgcaagccgaccctgacagtttcgcctgaatgcgatggatacgaattggctttgaagtgataggagatcatataaaatgatcagttattttaattgtatttctaagttggttggataaatgtaaagcatatacnagaaaaataaaaaaaaa

SEQ ID NO: 48903 - DNA, 1011 bp, Heterodera glycines
  misc_feature (900)..(900): n is a, c, g, or t
  SCN-specific regions: Sequence locations=1-25,50-480,520-1011
agagaaattcgctgagtgttttgctccaaattttcgtttcattcaaaaattgctgtctgtgctgcgaaaagttgcaggaaaatgtcatctgagtcaaatatggagaatttccccgtcaaattggacatggattatatcaaacggttggcacgcatcgaacggaccggccctaacacttttaatgccaattttcttgtggcaggctatcgcaaggcggtgaataaggacgttttcgggggacaaatgttcgcgcaggcaattgccgcggcagaagcaacggtggacggcgacgaatttgcaccgaacgcggcccattcgatgttcattagaaaagcattcattgaccatcccatcgaatatattgtcaccagaacgcgcgacgggcgttcattttgcactcggacagtcgaagcgcgacagaacggcgaaaccgttttctgtgcgcagatttcactttgcgttaaggaacgctcttccattgaacaccaaacagaaatgccagcggaagtgccggagcccgaggagttggtgccgttcttcaagacggtccgtcgagtggtcaccgaacacgacgagggcaggacggagcgtaacggacggaccatcgctaaccttcgcgcggtgctcgaggacgagcagcaaccgtccgtcttcgagttccgacccattcattccgacatttttcttggcattcgaccccattcgcccacgccgattcgttactggttgaaatgcgccgttcctttgggtagcgaacggacaaataaggcactgaaccgcttcctgctggcatttataaccgatgcaacaatggcttccactgccaaccgtgcccatgccagccacaattatcatccgtcaatggttgtctctctcgaccacatcgtccactttcattcngacaactttttcgcagatgaatggctgttgtgtgagaatacgagtccaatcgcgaggaatggacgagcgcttacagacggtcgcatttggaaccgaaagggacagcttttg

SEQ ID NO: 48904 - DNA, 770 bp, Heterodera glycines
  SCN-specific regions: Sequence locations=1-770
atttttgccaaattttcgcaaatcaatctacaattacgatacctatttttaacttgcactaaaatttacgcaatatgtcgttgaacacggcgaatacgccggacggacgtggggttatcatttacagtggtgaaatgattttgcttttcgttcgcgaggttaatctttcttttgacaaattcactaacgccgcgttcaaaggcacaaagaagggcaacctttacctaaccacgcacagaatcattttcaataacactgaaacttcgtctcgcggcaatttcaagtcgttgtcaatgcctttcggatgcattcgaaatgtgaagttggaacagcccatctttggcgccaattatttggctggcgaattggtcgcacagccggacggaaattgggaaggagaagtgaattggaaattgacgttcaatcggggcggatgcatcgaattcggccaagctttgctgaaaaccagcgaaatggccaataacttttgtcctcggcccgcaaatgcgccgccgccgtacgctccgccgcctggcgcttattactcaccaccacccgcttattattggagcggaggccaattcaacggataccaggcgccggtccacgcgtttccagaacaaccgccgccggaaagtgtgttcatgtacgagcaaccacctccatatgcggggattgggccaattcgtggtcaaaatccggtcccatacccgtcgaatacgcccctgtatccgccgcaacaacaacctctaccaaccaacactccttcc

SEQ ID NO: 48905 - DNA, 686 bp, Heterodera glycines
  SCN-specific regions: Sequence locations=1-397,429-686
ccaagtttgagatgaatctccgcgatcaattttccaccaacaaatatgttgcgcatcgcttcatgcagttgccaacgcacaacaaagtgcaggtggaatatgtgtggattgacgggtcgggcgaaaatgtgcgctccaaaacgcgaacagtggactttgtgccgtccaaagtcgacgatttaccggtgtggaacttcgacgggtcctccactggacaagcatcgggtgccgattcggatgtgttcatcaagccggttgccatgtacaatgacccgttccgtatgggcaaccataaaattgtaatgtgtgaggcattcgacaacaaaatgcagccccatgtgaccaacaaccgtgcgcgatgtaagcagacaatggacgcggctgccaaagagcacgcgtggtttggcatggagcaggagtacacactgctggacgttgaccagcatccgttcggatggcctaaggcgccgttcggcttccccgggccccaagggccttattattgcggtgctggagctaacaaagcttatggtcgtgatattgtggactcacactatcgcgcttgtctttacgcgggtattctgatttcgggtacaaatgccgaagtgatgccgggccaatgggaatttcaggtcggcccatgtgaaggaatccaaatgggagatcaacttttcatggcccgcttt

SEQ ID NO: 48906 - DNA, 492 bp, Heterodera glycines
  SCN-specific regions: Sequence locations=1-100,143-151,200-214,241 -382,409-492
ctgctttccattcaactaaactgtgctaaatatgtccggacgaggaaagggaggcaaaggactcgggaagggaggcgcaaagcgccaccgaaaagtgctccgtgacaacatccagggcatcaccaagccggccatccgccgtttggctcgtcgtgggggcgtcaagcgcatttccggcctgatctacgaggagactcgctcagtgctgaaggtgttcttggagaatgtcatccgtgacgcggttacttactgcgagcacgcgaagcggaagacagtcactgcgatggatgtcgtttacgcgctgaaacgtcagggccgaactttgtacggttttggtggctgagcagaacggtgacggaagagaacttcaaccaaaaacaatcccaaacggccctctttagggccacaaacatccaaatggacggatatgcttttcgaaaaacttgcttttgcattttcttttgtttgaataaatttggaaattaaaaaaaa

SEQ ID NO: 48907 - DNA, 1046 bp, Heterodera glycines
  SCN-specific regions: Sequence locations=1-372,395-568,591-780,802 -862,884-960,983-1046
gtccaataagacatttttctattttcttttttttcaccctttgacgacaaacagaagcagcaatgagtggttgggatgcgtacattcagtcattgacttccagttgtgcggagattactcgcgtggccataattggcaattcggacgcgagtgtttgggccaggactgaaggggagaacgaattcaaggcgagtgaacctgagctcaagaaacttgtcggccaattcgatgatctttcgcaagttccgtccgtcggtgccgacctcgagggaattcattacattgtgccgcgaacggatgaaaatcttatctttgggaagagggacaaaacgggctttttcgctgtgaagaccaagtccgccattctgatcgccatttacaaggacgaggaaagtgtcgtcggcgccgacgtgcgaggggcggtggagaaaatggccaaataccttgaggacgccggttactgagccgttgctcggtttcctaaacgacttttgtgttgccaaacgaaaagtgctgagaatggctttgacttattcttccaaatgcattccttttccatcccaaatgatcacttattattttattattacacattctgtgaagtgcgcgtgccgatttcttttttattatttggcctttggatgtgaataataaaaaggtgtaacgctgagaaccaaaaactgcttttgcttttcgaaaaccttttccatcaatccgttggcgggcaaatgtctccgccaatccaattctgtaattgatacgggcagtccctttaattaatctgacccacaggtgccatgctttttgtttggcttggccttgcgtttgtaattcgagctcacctcgggggggggggaggaatgtccgttcccttttgccttggcaacattcgccttatttcgcgatgctttttgtctcctttttcgtcttggcattactttttccccttggtgactccgttctgtccgtcgttgcccctcctccgtctccgttgtctatcagtgcgtttcctccgtcactttccgccgatttcgtcacttttcagc

SEQ ID NO: 48908 - DNA, 548 bp, Heterodera glycines
  SCN-specific regions: Sequence locations=1-518,546-548
gtgcatattcgatattcagttattgcaaattgttactcaaaatggcctcttttctccgttttttggcctgccgtcacttttctatgtcgtccgttttgcgcaaagaggcggaacaacttaccaatgaacacatcgacaaaattcggcagaggacccgtttcagtgagacgagcgcttttcacgggcgcggcagcggcggacggacgaacggcgaaagtggcgaggacgcatttaccaacccattttacattgccagctactacgacagtaaacgattcgaagcaatccgaggcgtttcaatcttcgcaagcatttcgcttctgttgatttatgtcgcatggttcaaagagccaaacgaagtggacgaactttgggattacgacatgcgtttggtgtactttgtggccaaaaaacgtgtgctaaaggaccaaattgaacaggcgaaaaagggcggccaaggaacagtcgatttggaaaccgatctcatcaacattgaggtgcaagagcaaaaaatccgcgaagaagaagagaagaaggcaaagaaaata

SEQ ID NO: 48909 - DNA, 667 bp, Heterodera glycines
  SCN-specific regions: Sequence locations=1-667
aatggccgtttttgttaaagaccaaaattttgtgccggaaaaacgagtcgacgaagctgggcatattttaaatgatccgagtaaaagtttggccgatcgtttccgtgcgcttttccttctcagaagcgtaaaaagcgacagggctgtccattggatttgcaaatgcttctccgacccatcggctcttcttaagcacgaacttgcgtattgtcttggtcagatgcaaaaccccgcggcgattcaaaaattaatcttcgttttgcaagacactgaacaagaaccaatggtccgtcatgaagcggccgaagcgctcggagccatcggcgacccgtcgaatgagcacggactcagcaaactgttcgagcagtacagcggtgacgcagtccgagaagtggcggagacatgccttttggcactgcgacggacgcaatgggtcaaagagaagggaaaggacgacacggaaagtcggagcatttacgattccattgaccccgcgccagcagcggacggagggaaaggagcagccgaagtcgaacaacttggccaaatgttggtcgatcacaacatggctctgtgggacagatatcgagcaatgtttgcgcttagaaatttgaacaacgaccgagcaacaaaggcattggcggacggtttgctttgtgatgacagc

SEQ ID NO: 48910 - DNA, 901 bp, Heterodera glycines
  SCN-specific regions: Sequence locations=1-165,197-360,384-675,702-877
gtccaataaggcattgattaagacattgcagaataaaacaaattaaagtgaaacatggcaaccgaagttgatgaaaatacagcagttgctgatccttggagcactgttgaagatgtgagcggtggagagtcaatgcaccaattggtcaccctggacgttcccgagattaaactgttcgggaagtggtctcttaatgacgtggacgtgtccgacatttcactcgtggattatgttgcggtgaaagaaaaggcggccaaatatttgccgcacagcgccggtcgttaccagcagaagcgcttccgtaaggcgacctgtccggtggtggaacggttggtctcgtcaatgatgatgcacgggcggaacaacggcaagaaactgatggcggtgcgcattgtgaagcatgccttcgaaatcattcatctgctcaccggagagaaccccgtccaagtgttagtcaatgctgtgatcaacagtggacctcgcgaggattccacgcgtattggccgtgcgggcacagttcgtcgacaggcagtcgatgtgtcgcctttgcgtcgtgtcaatcaggcaatttggttgctttgtaccggttcccgcgaggccgctttcagaaacatcaaaacgatcgcggaatgtcttgcggatgagctgatgaatgccgctaaggggtccagcaattcctacgcaatcaaaaagaaagacgaattggaacgggtggccaaatcgaaccgttgaggaaaaaaagcacagaatgcaaaagaggataaaggacacaaagggatcaatttgttcaattgttgttgaattttatgttattttgttcctcataaaacaaagagacaaattctaatcggattgtctgaataagatttgttttgttaaaaaaaaaaaaaaaaaaaaaaaa

SEQ ID NO: 48911 - DNA, 621 bp, Heterodera glycines
  SCN-specific regions: Sequence locations=1-161,204-229,267-498,524 -533,590-621
gtttgcccaacatgtctcttcccgtcgagatcgtcaaccacgaccagagcgaggcgcccaagctcttcggcaagtggtccttcgaggaggtccgctgcaacgaccttgccctcgttgactacatccaaatctcgtcgcccatctacctcccccacactgccggtcgctatgccgccaagcgtttccgcaaggcccagtgccccgtggttgagcgcttgaccaactcgctcatgatgcacggccgcaacaacggcaagaagcttatggccacgcgcattgtcaagcacgcgttcgagatcattcacttgctcacggatgccaacccgctccagatcctcgtggacgccattgtgaacacgggtccccgtgaagactcgacccgcattggttcccagggtaccgtccgtcgtcaagccgtcgatgtgtcgccgctccgtcgcgtcaaccaggccatcgctctcttgaccaccggcacccgcgaggccgcgttccgcaacgtcaagaccattgccgagtgcctggccgacgaattgatcaacgccgccaagggttcctcgaactcctatgccatcaagaagaaggacgagctcgagagggttgctaagtctaaccgctaaaaat

SEQ ID NO: 48912 - DNA, 672 bp, Heterodera glycines
  SCN-specific regions: Sequence locations=1-672
gtttgagacaaagactcaaaaatgactagcaaaacttcgcctaaaatgccgcgcaattaccaaattgcatccgggctccagcgtttctccaaggcccgtatgtttcacgccaaagggatgtgggtcaagctgaagaagccattcgagaagaaagcaaagcatgcccaaaaagcagaaaaatttgttgtcaagaaaattggcggagagaaaaacggaggcgagaggaaagtgctcaagaagaaggagccgaagcttttgccacaagtgcccagtgttcaaatcaagaacaaaaacaggccgaagaaagttccattgcgcaaatcgatttcgcccggaaccgttctgatcattttggctggccgtcaccgtgggaagcgcgttatctttataaagcaattgccaaaatcgggtcttcttcttgtcacaggcccactgaagttgaacgcgacgccgttgcgtcgcatcgcacaggcttttgtcatagcgaccaaaacaaaactggacatttcgacgatgaatgtgccggagcatttggacgacaaatattttaaacgacaaagtggcaaagtggcggacagatcgaagggtgggatttttgcggagggagcgaaccagcagtacgctgtgaccgaccagcgcaaggaggaccagaaaactgttgactcgcaggtt

SEQ ID NO: 48913 - DNA, 495 bp, Heterodera glycines
  SCN-specific regions: Sequence locations=1-301,341-344,378-495
caattaagagccagtttatttactcatttcaacaaacagcaatgaaatacgtcgccgcgtacatgttggcatcgctgggcggaaatggcgacccatcgccaaaggatttggaaaaaattctcgcagcaggcggactcgaggtggacatggacaatgtgaaggccgtcctcaacgcagtgaaaggcaagtccattgaggaggttattgcggcgggccagaagaaattggccaccatgcccactggtggaggcgctgcagcaccaactgcagcagcagcggccactgctgcacccgctgctgcggagaagaaggaggaaaagaagaaggaagaagtgaaggaagaatcggacgacgacatgggcttcggactgttcgactgatcaccgaccgattgatcgatcggacggaatattgtttttgcttcttaccatttcatcaaattaaaacgacgaacggaaaaacggagataaatttgttttttggtaaaaaaaaaaa

SEQ ID NO: 48914 - DNA, 650 bp, Heterodera glycines
  SCN-specific regions: Sequence locations=1-602,625-650
tgagatttcaccatgaaaccaacaatcgatttgaagcaggacatttccaagtacaaggaacgcttccaaaaacttcatcataaaagagaagagtcaagaaaaataaaccacgaacacgtcgtggaggaggatcgacgtctgaagttgcccaacaattttgaggcaaagcgaaaacgacaagaatgggagttggaggagcttgtggcaagaaaggaagcggaggagcgtggcgaagattatgacagaataaaggcactgggaacgcaagcggacatcgccgacaaaatggaagcggcaaaacgaagaaaagcaaaccccgacacgggatttgcgagttatgaagcgatgtcaattcggcaatacgaaagaatgaccaatgggataaagccggacatggaatcttaccaaaagatgaaaggagtcgtcggagaagatcaattctacgcaagtgcaaatacgttgatccaaggctcgcattatcccaccgacaaggcactcgataaactttcggaggatgttcataaccagatgaagaaacgtgaccagtaccaccgccgtcggatgttcgaccctgatgccccgattgacttcatcaacgaacgcaacagaaaattcaaccacaaattggagcgctattacggcaaatatac

SEQ ID NO: 48915 - DNA, 1163 bp, Heterodera glycines
  SCN-specific regions: Sequence locations=1-330,353-556,590-729,751 -1163
ttggctgcttttcccagaaccgccgttgcctttatgcagcaatgttctcgcttaatgagtgtcaggatgaaaagcagttctattaaggtaactttaatcggcgcaagtggaggcatcggccaaccgctcggattacttttgaagaagaacccttccattgcacacttggcactttacgatcttgtcggcactcccggagttgcggccgacctttcccatataaacaccccggcaaaagtgactggccatttgggaccagaccaacttgttgcagcgttggaaggtgctgacgttgtcattattcctgccggtgtgccacggaagcccggtatgactcgtgacgaccttttcaccacaaatgccggcattgtgcgggacatggccgaagcagccgcaaaaacttgtccgaaagctttcatgggcattataaccaatccggtgaactcgacccttcccatcgcctgcgaagtctacaaaaacaatgactgtttcgacccgcgacgcattttcggcgtcactcttattgacattgttcgagcacaggcattcgtttcaaaactaaaagggatggattgtttcccaaacaaaagtgtcggtggtcggtggccattccggagtgaccattgtcccacttctgtccagatgtacgcccaaagtcagtctgagtgacagtgagacgaaggcactcaccgaacgcatccaagaagcagggacagaagttgtgaaagccaaggctggcgcggggtcggccactctttcgatggcacttgcagctgaatactttgtttcggctttgatcaacgcgctgaagggccagaagagtgtgcagtgtgcgtatgtcaaatccgacgtggtggaaggccttgattactttgctggaccattggagctgggacccaacggcgtggagaaaatactgccattgggtgacctgaccgcttacgaaaaggagctgatcagcaaagcggtgcccgaactgaagaaggaaattgcgaagggtgtcaactttatcaagcaagggtagaagccagccggtagtaattagccaatcatttttgtgtcgagaaatgcattggcactgttactgtttgtcaaccgatgattttcatattatatgtagttttggttcttaatatcccaatcatgttttgtcctgctaccat

SEQ ID NO: 48916 - DNA, 1261 bp, Heterodera glycines
  SCN-specific regions: Sequence locations=1-283,323-338,360-505,532 -665,688-835,859-1189,1213-1261
gaggtgtggaatttgaatggttgagacagcggaacaacctgctaaaaaggaagacgagaagatggaaactgccgaagatgagatcgatgctgaaattttgcaaatgtctacggaccaaattcgggagcggtcgctgttgctcgacaacgaaattcgcataatgcgcagtgaaattcagcgcattagtcacagtatgcaaacactcaaagagaagacaaaggaaaacaacgaaaggatcaaaatcaacaaaactcttccctatttggtctcaaatgtcattgaacttttggatcttgaagagcaacaggaagaggaaggagcaaacattgaccttgatgcccacaaaacaaagtgtgccgtcatcaaaacatccacgcgtgccacttactttctgcccgttgttggtcttgtggacccggaagaaatgaaaccgtccgatttggttggcgttaacaaggactcttatctcatcctggaaaaactgccacccgagtacgactcacgcgtgaaggccatggaagtggacgagcgtccgaaagaaacgtactcagacattggcggatgcgatagtcaaatcagagaattggttgaagcaattgttcttccgatgactaaaaaagatctcttcataaacattggcattcagccgcctaagggcgttcttatgtatggaccaccaggtacgggtaaaacgatgttggcacgtgccgttgccgctcaaaccaagtccacttttctgaagctggctggtccgcaacttgtccaaatgttcatcggagacggcgccaaattggttcgagatgcttttgcactggccaaagagaaagcaccgtccattattttcattgacgaattggacgcaattgggacaaaacgattcagttcggagaaggccggcgatagggaagtgcagcgaacgatgttggaattgcttaaccaactcgacggcttccagccaaatgacgacataaaagttattgctgcgacaaaccgtgtcgatgtgctcgacccggctctgctccgttccggcagattggaccgcaaaattgaactgccagcgccaaacgagaaggcccgggcgcacatcgtccgcattcactcccggaatatgaacgttgataaagatgttaatttcgatgagttggcacgttgtaccgacgattttaatggtgctcaatgcaaagctgtttgtgtggaagcgggtatgatcgcgcttcgtcgtgaatctcacatcattctgcacgaagattttatggacgct

SEQ ID NO: 48917 - DNA, 665 bp, Heterodera glycines
  SCN-specific regions: Sequence locations=1-77,99-522,545-665
gtttgagattatacattgaaattgcgatggacactttgtttgacgtgcgaaacaacttttatttgggcgcttttcaacagtgcatcaacgaggcacagaaggtcaaatgcaagtcggaagaggagaaggagctcaaggacgcgttcatgtaccgcgcttacattggcctgaacaaatgttccgtgccgttgggcgaaattgacgccaccgatggcaatgggtcggccgcccttatggcaatccgacggttcgccacgtttatgagcggtgcgccggagaagaggtcagagattgttgaccaggtggccaaagaatttgaaacgaaaaagtacgctgacaacgaaatttgcctgctgatcagcacactcattttcatgcacggagaaaaaactgaggaggcattgcgcgtgctgaaccgcacggcgtccgattcgttggagtgcgccgcgttgcgcgtccaatgtttgctgaagctgaacaggggcgacctggcggccaaggaggtgaagcgaatgcaggagatggacgaggatgccaccatcacgcagttggcccaggcgtggctgaacatggccatgggtcgtgacaagctgaaggacgccttctacatttaacaggaaatggtggacaaatacggggccaccccactgctgctcacttcgcaa

SEQ ID NO: 48918 - DNA, 476 bp, Heterodera glycines
  misc_feature (460)..(462): n is a, c, g, or t
  SCN-specific regions: Sequence locations=1-396,418-442
atgttgcgacagcttgactctgtccgtgaatacatccaacaattgcatgcgcgactcctttcactgaccgacaggtttgcccaaatttcaccgctttggcaacgtggcgaacccatttcaaaaccgctgccggtgatggcactttgcgagtacaagagcaaggacaaaattcacatcagacaaggggacaagtacactctgttggacaaccatgaccaaattcagtggcgcgtgcgcggcatggacgacgttgaggtggtgtcaactccgggaacaagcggcgccacgggtgccaccgctgtgtcacaactcattgaagaagacgaggaaaaatgtgcccgttgtgccacagcatcagccactgtacgaaagattgcaacaagcgttgaatcggaagaattatttttattatcatttgtgcgtttgttttgatgtgttaagcataaaaatttttcaattnnnaaaaaaaaaaaaaa

SEQ ID NO: 48919 - DNA, 769 bp, Heterodera glycines
  SCN-specific regions: Sequence locations=1-769
attaagtttgatttctgtaaccttttttttttggtgttaatgatgtcgtcaaatgaagaagaagaatccggcggttcaaatgatgaccaattttcctctccgatcagtccggtcagccccattcaaccgatgagcaccgattggagtaacgcaattgatgcgcaggaaatgggcgccggaggtgttggaggagggatcagcagcggaagcctgcatgagagcctgcacgaactttcgccaatttgggccgacagcgatttgattggtgacacactttcggccgtaccggactcgcccagcgatgaagacccatatgccagcacaatttatcgcccagtttccatggtcacgcctgtcgctgcactgccgaatcccaatccaccgtcctgctcatttggtggaccgatggaaagcattgaggcgaaagggccgttggaattgcccaccaaaacgcggcttaaggtgcgtatcaaacggttggacattgtcggctcgtggcgttgggtggacggcaaagaggacgcgtgcggcatttgccgtactccgttcgagacctgttgcatggactgcaaattcccgggcgacgaatgtccattggtgttgggccagtgcaaacatccgttccacatgcattgcattgtgaagtggacgaacacgcaaagcgggcagaagcccgcctgtccgctgtgccgtcaggagtggaaatttgcgaccagctgattttttgcggggaaggcgaagaagactaataatgacttaatgtttttgt

SEQ ID NO: 48920 - DNA, 636 bp, Heterodera glycines
  SCN-specific regions: Sequence locations=1-32,76-636
tggttttacaaatgggtcaaaaccaaccgcagggaggtgggcgaaagccaggcgatgacaaaggacaggaccctgaaaaaaaaacggaaataccatggaccgccggttccaacgcgaattggaaaacgcaagaagggctctcgtggtcccgacacagcaaacaaaatgcccaccgtgactccgatcactcgttgtaaactcaagctcctcaagtatgaccggattaaggactatcttttaatggaggaagaattcataaagaacatggagcgtttgaagcctcaggacgaacgtcaggaggaagagcgtgttaaagttgacgaccttcgtgggactccaatgtctgtcggatcattggaagaagtcattgacgatcaacacgcaattgtttccacgaatgtcggcagtgaacattacgtcaacattttgtcatttgtggacaaagaacagcttgagccgggctgtgccgttctgctgaatcacaaaacccactcaatcgtcggcgttcttgcggaggacgccgatccgatggtgtcggtgatgaaattggagaaagcaccgaccgagacttacgctgacgttggtggcctcgagcagcaaattcaggagatcaaagaggcggtggagttgccgttg

SEQ ID NO: 48921 - DNA, 1015 bp, Heterodera glycines
  misc_feature (993)..(994): n is a, c, g, or t
  SCN-specific regions: Sequence locations=1-26,50-132,154-941,963-994
ttctgaatctataagtactacttccctattttaaaataataattattaagtgaattttcgacttacctataaatgtttctgacccgcagcgaatacgacaggggagtgaacactttttccccggagggccgtctgttccaagtggaatatgccatcgaaactgtcaagcttggttccacaagcatcggaattcacaccaaagaaggcgttcttttggctgcggaaaggcgttcaatgagcaaattggtggtggacgactcaatgagcaaaatttcggaagttgagaagcacattgccgtcgcctcggccggtctcatcgcagattcacgcacttgggtcgaacacgcgcgggtggaggctcaacacttttggtttacttacggtggcaaaattcgggtggaagacattactcaaaaggtctcaagattggcactgcattttggagacgacgactcaactatcagtctcggccgtccgtttggagtttctatgctttttgccggcattgatcacacgggtgcgcatctcttccatttggacccgtccgggacgtacattaaatgtttggccaaggccatcggtgccggctccgatgcagcggaacaaacgctgcaagagcactgtaaaaactgcgacaaaaaaatggaaatggccgaggcaaaacaagtcgcactgaacacactcaaacagctgatggaagagaaaatcaattccaaaaatgtggaaattgttatgattaagccgcagacggacaaggaaggcaaaacgttgggcaaaattgtgtggttagaggaatcggagttgcaagaaatcatttcgcgattgtagtcgaaggggacggattagagaaggaaaatgggctttgcactgccccttttatgattggatgaccttttgttattctctgcctttttgtgacttttcagtgtataaggcaaatgaaagcaattaattgagaaattggctaatatccaataaatgtttcaattctcnnaaaaaaaaaaaaaaaaaaaaa

SEQ ID NO: 48922 - DNA, 699 bp, Heterodera glycines
  SCN-specific regions: Sequence locations=1-198,228-699
aagcaaaaaaaaaagccaatggaattcaaaggcgaagaatggtcggacaatccgataagcgaatgccgaatggccgagttggtccggcactttttcgccttgggttggatgtgcgacaacggcagcggaatggcggtccgagtgaaagacgaacggacgggcgaacatttgattctgaactcataaaattcgttggagaaggaaattttttcggaaaacgatttatttgtgatgaaaatgaacggcgaaattttgaaaagcccgtcaaaatcggaccgatctccgacagcgccgttttatttactgcgcgacaatccggatttggcctgtgtcattcacactcactcaaaatgggcaaatctgatcacccaactgatcagaggagacgagttcaaaatttcaaaccaggaaatgattcagggttgtgaaaatcgtctcacaaaaagccgtctggataacattgacgtgctagtggtgccaattgtgcagacagagatcaatgagcatctgctttatccaattctgctgaggacgctgaagcaaaacgcgggggcaagtggcattttagtgcgtgggcacggctttttctgcttcggcagcaacagttggcaaagcaccaaaatgatgttggagtgctacgagtatttgttcgaattggcatgcgaaatgcttaattacgatttgccattggtcaaaagt

SEQ ID NO: 48923 - DNA, 631 bp, Heterodera glycines
  SCN-specific regions: Sequence locations=1-64,87-631
gtccaattaagaataatctgaatcagatttgtagttctcactattcaatcctacaattagccttattttgcaaaacatccatttttgaacttcaacaaatgtctacgtggattcattgcaaccattgcttcatcgtgccaacaaatgactgcaacaaaacgcgattttggttcacttcgtgcggtcatttgatgtgcgcaaagtgtctgaaggcgaagcgatccaacaacaacaacgggcagcactttgagtgtttgctgtgccatcaacagaatgtgcaactcgtggagctcaaccgccatctgaggcccgagctgctggcgctgtttcgtccggcgaaggatttgatagacgaattcaacgccaagttgaagcaagtcctcacatttcagcagtcgcatcagaagcgacttgtcgaccatttgacggacaaggcacaaagggccacaaaatgggcacagtcagttcagaaggacatgcaaaaagtgtcggcagaacgtgacaaactgaaactcgacttggagcagtccaatgagaagagcagaaagacggaggaaatgcttgcgaatacacgccatgagctgcagcgtctcgccaacaaattccaccagcaacaccaccgtggaaacaa

SEQ ID NO: 48924 - DNA, 1214 bp, Heterodera glycines
  SCN-specific regions: Sequence locations=1-11,33-51,73-83,120-405,428- 801,830-886,908-974,996-1214
gttgagcgctgctccctctttttctttctcccttttcccgctgcttttgctccttcccctgggatgtgcccttcgaattgcttttcgttgcttttcctcctcttctgtctgttttttgtgccttcctccgttttttcttcattttgcggcaaatccggcgtcccttatagttttgaggttctttcgaatggggcgcccgttttgggctgtgcccagccgagctgtgtgatctccgccaccgattcagagggcgacttccacgaggacagccaattcttcaccaacgcggatggccaaccggacggcttcttcagagacggggacagagccctcaaacgttacagacacagcacagcgccaaaactgattgcgaactgttcgggacaattcggcgagctttcctgtccccgcaaaaaccaatgggtcggtggcattgagtacatcgaccatccccggcaaccattgattctgcaatgctgcaccttcgagggccttcgcttctcccaggaagtcggctcaacgacggtcggacccggcgaagcaatcaccggtggtgaagtggtgcgagggggacggcaaatctcgtttgatgtgatcgcaaatgtgcggaaggtatccaaatcagcggaaggcgaaacggcaggaaaagtgcgatatgaggtgaccgttcggagaatgaactgcttgccggacccacctgaggtcgaagtcgaatttgacggagaagtgccaatggaagtgagcaaactgctgggaaatgccaaaaacaaagaagtgacggataaagtgaacagagcagggggaacgcagcagcagcagcagaacggaagccgaaagaaagtgccgatgagacagaaaagccgaaaggacggacaaccaaacgcaaaacagcagcagcaacagactgcttccatgggacaaagaaagcaacttcagtcattgcaacagcagcaacaagtcgaattgcaagaagtaacaggaggagagggagaacggcagccatttggtcgtaataacgaagtggccatacaaccaaacaatggacaaatgccacggaaaaataaccaccggccgcaaaaacaacaacaacaacaaaatgaagccgtacaaggagatcaacaacaaatattcaatgggggagaagggcaacacgcgattaaattcatcgagcaaaaccaacacaatttgggcacacactttgcggagcagcagca

SEQ ID NO: 48925 - DNA, 639 bp, Heterodera glycines
  SCN-specific regions: Sequence locations=1-639
cttggacgcgatgaacaaccggatgccgattctggacagacgatggagttcaactacgttgtcatgtcgttggttggccgtccaatggacaaactccttcacgaatccggtgaccgcttcagccccggaactgcgatcggcacttcaattcaacttctcaaagcgcttaaggcgttgcacagcgttggatacctccatcgtgacattaaaccagcaaactcggccatcggcacgcctgagacgaacgaacagcgccttctctacctcctcgactttggaatggcgcgcaaatatgtcagagaggacggcacacaccggcgccaaagggacaccgcccgcttcagagggacgccaatctacgcaccaatctctgcgcacatcaaacgcgactacagccgccgggatgacattgagtcgtggttctacatgctgattaaattctacaaaggctctgtcccttggaatagccttcgcgacaaaaatgagattggcctgtacaaatgtcgccggatggaggaccagccacccgaagtgcgacgccaagccatcgacgaactgactgctggatgtcctcccgaatttaccgagatcctatcctacattgaccgactgcagcccgaaagccgaccagactacgag

SEQ ID NO: 48926 - DNA, 701 bp, Heterodera glycines
  SCN-specific regions: Sequence locations=1-150,172-191,213-616,638-701
ccaagtttgaggtattattaaaataaaattccataatggacgtggcaacggttgtcgatgagtacattgattcatcggatttagagcgttttcgaaagacatacgaagaacagagtcgacgcggatttccaagtgccatggccgtatttaattatgcgcacgctttaataaaatcgacgaaagacgatgtgagcactggcatttttcttcttgagagtttattgaaacgatcggaagaagacattcctaaacgcgactacgtttattatttggccatcgctcacacgcgaatcaaagagtacgaccgtgcgctcgaatacatcaatttgcttctttctgcagaatcggataaccaccaagcattggacctgaaggaattgatcgaaaagaggatgaaacgggatggattgctcggcttggcactgaccgttggctttggcggtgctgcggtcgttggcgttctcggggcggcgctgttggctcggaaaaaatgagtggtgaaaaatgtgatgcccctaatttttaacttatactgatgagttgactgtatttatccgcatcgattgggtatctttgacactgataaaaatcgcttttccgttaaactcattacccttacaaaaaattatttttaatttcgcgctcactaaatattcaccacttttgagcaaacttttgtattgagcgatcactgtgaactg

SEQ ID NO: 48927 - DNA, 949 bp, Heterodera glycines
  SCN-specific regions: Sequence locations=1-264,286-408,430-949
attttgttttatttattgcttctcaatttgttaaattttattcaacgcggttatcttatgtccgaaaaggacgtcccacttgccttttcgggaccggtcaaattcgtcagcaacgcgctcgccggaggcaccgcggcggttgtcacaaaaacggtgattgcacccattgagcgggtcaaattgctgttgcaggctcaggacgcgtcggcacatatcactgcggacaaacgctacaaaggcatcgtcgacgtcctcgtccgtgtgcccaaagagcagggcttcctggcattttggcgtggcaattttccgagcattgttcgctattttcctgcacaggcgttgaattttgcgttcaacgatttgtacaaaggcattttgagcaaaaattcctcctcaaaaaatggtcaatttttggggagttttgccagcggtgccgccgccggtgccacctcttcgctgttcacttattggctggactttgcgcggactcggctcgctttggacattggcaggtcccgtgaatcgcgcgagttcactggtctcgccgatcttttcgccaaaatttggcgttccgacggacttttcggcctctaccgcgggttcagcgtgtccatttgggcgtccatcatttaccgcgcctgttatttcgggtttttcgacaaggccaaggcgtacgcgtcgtcggacggcaaacggccgttgtcttttctcgagagatggctaattgcgcagggagtcacaatggcctccggaatgttggcctatccgttggacaccgtccgacggcgtctgatgatgcaatcgggccacaaggagcacattctgtacaaaaatggccgcgattgtgcgcgtaaaatctttgcgagtgagcacggcattgccggcttctacaagggcgggctcagcaatattcttcgcagcaccggcgggcgcttttggtgctcgtcct

SEQ ID NO: 48928 - DNA, 660 bp, Heterodera glycines
  SCN-specific regions: Sequence locations=1-601,624-660
ataagaccgatcgtttcgctgttatctcgttcaatctctcctcatccttctcttccttccgtttctttctcctccgcacttttgttcacttcatttcgtgacttctcctccgaatttcaacggcataccgaagcctgtcccaacaacccaaaaatgactgctagtcgaagattgactcgcgcggaagtggcggaacacaataacagtagcgatgcatggataattattggcaacaaagtttacgatgtgaccaaatttctggacgaacaccccggcggaatggaagttttaatggaaaaagcgggcgaagatcgaaccgaggcattcgaagacatcggccattctacggacgccaggcaaatgaaagaagattttctagtgggagaaattgtcgagtccgaacattggaagtacagttacgacaaaagagagacgggcgcagacaaaacgatggaccaatcggaaaaaaggaacagccccgtggaaatgctggtgtatgcgttgctctttgctgtcattgttgccatcatttattaccttttgttggcttaaactgatgaatcttcgcaaatttttaagttaatcccccaaatcgttgacctaaatttgatttttattaatttttgtgatgtcggaccatttgcttatcccttttcaatg

SEQ ID NO: 48929 - DNA, 532 bp, Heterodera glycines
  SCN-specific regions: Sequence locations=1-175,197-452,474-486,508-509
attccatggaaattgattcgcacccatccgcagcagttcagcccgaaccggcaccaattgagcaccaacagcaaaataacacgagaattttgccaaaatcgaaaaaatggtggaaaaaagcactgaacattaggccgatggccaacagcagcacaaagcccaggtcaagttgggagcgcaaaatgcagaagaagggcgagcgcgagcagtgccgtgcggtggaggccgaaatccggcaacggttggcagacgaacggaacgcgcgggcacaggcgttgaaggagcgcgagcagcgccgaaaaagcaatgagcggaaggcggaagttgtgcaagtgatccgaaacagtgcaaagctgaaacggatgaaacgcaagcagttgcggacgactgtgcagatgagagacaccaccgcgacaacttccgatggaaaacagaaataattggaggaaatcaaattttatttttttaattttgttgctgtttgatgaagaaataaaaaatttgtttccaaaaaaaaaaaaaaaaaaaaaaa

SEQ ID NO: 48930 - DNA, 1010 bp, Heterodera glycines
  SCN-specific regions: Sequence locations=1-1010
acgaggcaagtttgagctttgatcccgtattttcctctcttttcccatgccaatgttggcccatttcggctctttccaaggccaagatgttttcgagtgccaactccgctcagaaagcggagtggtcgtcaaagtgatcagcttcggtgcaattatccgcgattggctggtgccaacgcctcaggatcagctgcggtcggtggtcctcggatttgacagtttcgagaattacgtcgagcacagccctttcttcggtgccattgtgggaagagtggcgaatcgaatcggaagagcgagattcacggttgatggaaaggaatttttgctgacaccgaacgaagggaaaaaccaattgcacggggggacagagacatttgggagaaaagtgtggaagatggaaccgttgtgtgacaatgccgcggccaaatggccctcgggcgtccgtctctctttggaaagtgccgacggagagggcaccttccccggaaatttgcgagtgtccgtcacttatcggctgaccacaaataaattacgaatggacattgaggccacttcggatttgccctgtcctgtgaatatcgtccagcacaattatttcaatttgtctggccacggggacatccgcgaacattcgctgaaattggccgccgattggttcacgccgacttcttctgatcagattccaaccggagaaatactcaccgtttcaggcacagaattggactttcgggaagagaaaaaactccaaacgaaagacggaaaaccgattgaattggatcataattttgtacttaccaagggaaaaggaacggacgcacaaattgcagcagttttgagagctccggacaattcattggcacttactctgcgctccaatcagcccggtctccaagtgtacacgtccaagtcgctgtccgtgcccgtgcccggcctttacggccaacgctatgccaaatttggcggaatttgcctggaggatcagaactttccggacgcagtgaaccacgaaa

SEQ ID NO: 48931 - DNA, 765 bp, Heterodera glycines
  SCN-specific regions: Sequence locations=1-293,322-510,532-643,665-744
gagaacttaatttgaggattacattgaaaataattaattagacttcaaaatgggtatttcccaagacagatggcacaagcggcgaaagactggggggaagcgaaaccccattcacaaaaaacgaaagttcgaaatgggacggccggcagcaaatactaagattggtcctaaacgaattcatttggtgcgttgtcgtggcgggaacattaaacatcgcggacttcgtcttgataccggaaactttgcttgggcttctgaagggtgcactcgcaaaacgcgtatcatcgacactatgtacaacgcttccaacaacgaattggtgcgcaccaaaacattggtcaagggaatgatcgtctcaatcgatgccattccgttccgccaatggtatgaagcgcattacgcactgccattggcgcgcaaaaagggacaaaagttgaccgaagatgaggaggcgcggattggaggagcacagaaacgctcaaagtcgactctgaagaaatacacggaacgccaaaaaaccgccggggtggagccgcatcttctggaacagttccaggccggacgacttctcgcttgcataagctcacgaccaggccaaagcggacgctgcgatgggtacattttggagggcaaagaactcgagttctacaacaagaaactgaaggctaaaaaggcgaagtgatgccgcaccgaagcttggaattgcgtttccaattttgttgtccgttccttttgagtgaatgataaattttgttgttttaaaaa

SEQ ID NO: 48932 - DNA, 917 bp, Heterodera glycines
  SCN-specific regions: Sequence locations=1-653,675-917
gtccaattaagttgtttaaaatgcgaccgcttgcactcaaaggtcacgaaagagcgatcacccgagtccgactgaatcgcgagggcgacattctcttctccgcttccaaaggttccgccgtctgtgcatggtatacggagaatggggaaagaattggcacttatgaaggacattccggtgtcgtttgggacatcgacgtcagttgggacacacaaacgatggtatccgcatctggtgaccagaaagttatggtttgggacattgagacgggcgtttccaaggggttctctgagcctggttccgttgtccgttccatcggtctctcctacagcggcaatttggtggttttcacgctgaacaagccgaccacgggcggtctcccgggcattgtcgtggccgaccttcgcgacaaaatgacgcaacccatcctacgcgacactttcgacgaccaatgcaacgcatgtctcttctcacacttagacgatcacattgtagccggtgatcataccggacagctggcgatgtgggacctgcggcagccgggcgccgctagcaatttcacacacccgcacaaataccaaatcaacgaccttcagatcaccgccgatcagacatttatcatcacagcatcgaaggacaaaacggcacaactgcacagtgcacatgatctgcagcatttgaaaacgtacaagtccaatcgcccggtgaacaccgcctccgtctctcccagccgcgaccacatcgttttaggcggtggtgaagaacacatggaagtcactcagacggccacaacagcggagcaattcgtggcccgactgtaccatttgattttcgaagaggaatttgcccgattcaggggccatttcggacccatcaattccatcattttcgaccccacgggggacattgttgtctct

SEQ ID NO: 48933 - DNA, 704 bp, Heterodera glycines
  SCN-specific regions: Sequence locations=1-704
ctccttcgaacagtgtgttccgatgttgccagcaataaaacctgcaaattccgatgggattgttttagacgcgcttccatatattgacgatcaacaatataccgatgaacatcgtcaattggcactgcaactgattcaggccgaatgcaaaaagtttcctatgacaaagaattacctgagaaatctgcctgaacctgactatgataagtttacaaccccgagaataatggaacaccaagcgaagatggccaacaaacaagaaattgagaaaatcgatttgttgcgatacgaagtgccatccccagcaaatacgagtcgatcgggcaataagaaagcgtggcttggtgccatcgataattgcagggcccaactgtcaaatcaatcgttacgcaaaatgaacttggaacttttggacgaatttggcccggaggcgtttttacggtcgaatcagcacctaaaaaagcaagttgagaaagaggaagccgaattgtttaagcttcgctcccaactctatgaattgaatgctcgccgaaaaagatcgcaattggatgctggggaaaggctggctgcgttgggacaaacatgggttgaactagtgacgaagaatgccgcgatggttgtccccaatgacaaacttgaaaaccaaattcgaacattggcgaaattatgtaaaatggactctggcatttgcaaaaaataaattg

SEQ ID NO: 48934 - DNA, 886 bp, Heterodera glycines
  SCN-specific regions: Sequence locations=1-886
gatggtgcaataatgtgcggtcgcttttctcaattagctggcatcaaaggcaacggacacgcgaaggcacactttgagtcgacgggctttccattggtcgtcaaattggggaccattgagaacggagacggcgatatttacagctacaatgaggacgcgccggtctgcgacccatggcttggtcaacatctggcacgttttggtctcgacatcaaaaaattccgcaagaccgaaaaaacgactttggaaatagaacttgatgcgaatttaaagcacgaattctcggcaattcaagaagaaggattggagttggtcaatgtgagtgggcctggctacactgggctgatcaacctcggctcttcttgttacatcaattcggctctccaagttctgcttattgtccctgactttgtccgtgcgtttactgaagaactgttgctaagaaaacaaccacccgaaataaatgaggatttcgccgctcaattggctaaaattttcgtcgcgatgaaatcgggggattattcgcgagaagacaacaaacatggtgccgaaaaggagaagggcattcgaccgacgacattccgtcggattgtgggccgaaaccaccccgaattttcaactgcaaaacagcaagatgtggaggaatatgttcgctttctgtttgagaaggtcgacgcgtgctccgacctctcctcggaaaatcccgtcgctgcgttccgatttcgtctggtcactcgtttcctggacgaactttcagattgcgttcgctattctttccgtactgacaacattttatcggttgcaattccaatggacttgtgcaaggagtctgacactgttgtgaatggggtcagacgaaagagtgtcactttggagcagtgtttgg

SEQ ID NO: 48935 - DNA, 707 bp, Heterodera glycines
  SCN-specific regions: Sequence locations=1-159,186-424,450-522,546 -546,568-642,664-707
gtttgagcagtgcctttatttattgaatccgacaaaatgtcatccagctcgaaagctttcattggtaagccggcgccaaatttcatggcggacgccgttgtgaacggcgacttcaaaacaatttcgctggaacagttcaaagggcaatatgtggtgctgttcttctacccactcgatttcactttcgtttgcccaaccgaaataattgccttttcggacaaggcgggagagttcaaaaagatcggtgtccaactcatcgcgtgttctaccgactctaaattttgccatcttgaatggatcaacaagccgcgaaagcagggaggacttggcgagatgaacatcccggtgctggcggacaccagccacaaaatcagccgtgactacggcgtgctgatggaggaggcgggcattgcttatcgcggattgttcatcatcgatgacaagggcgttcttcgtcagatcaccatcaacgatttgcctgttggtcgctcggttgacgagacgcttcgtctcgtgcaagcgttccaatacacggacaagcatggcgaggtgtgcccggccaactggcagcccggcaccgacaccattaaaccggacccgaagggctcgcaggcgtactttgacaagaagggctgaacaattgagggggagagaagaaaggaggatgagacgtatggaattgctgatgctgactctgtgttgtgatc

SEQ ID NO: 48936 - DNA, 419 bp, Heterodera glycines
  misc_feature (398)..(399): n is a, c, g, or t
  SCN-specific regions: Sequence locations=1-97,119-342,364-399
aatcaaaatgacgctcgcggtcgatctccttaacccctcgctcgagtccgagaagcgcaagcacaagctgaagcgcttggtacagtcgcccaactcgtacttcatggacgtcaagtgcggtgcctctggctgctctgccatcaacaccgtcttctcacacgcccagaccgttgtcttgtgctcgtcgtgctcgtcggtgctcgccacccccaccggtggtaaggctcgtttgaccgagggctcgtccttccgccccaaggctcaataagcgcagctcaacgtttacttgtaatgtgggagtcgtcgtcgagtcgacacggacgtgtgtgtttgtcgtcacggttgtcaatcttttcgtcttgcctgcccgccaaatgcaacagtcgtttcccgaaccnnaaaaaaaaaaaaaaaaaaaa

SEQ ID NO: 48937 - DNA, 636 bp, Heterodera glycines
  SCN-specific regions: Sequence locations=1-319,346-636
gccatccagcggcactttacaacagtttcaaaacaaaatttattcgtctattaatatacaaaaatgaattttcttcaatccgattcattttcattcattcaaggaccattcaaggagagaaatgacgagcgaaatacgacatttgatcacaatcaattatcgaaggaagcggaaggatttaaagagaatattcggagccaaatcagcacaagggaagcgcggaaacaagccaaggatacgacattggcattggcagccgctaatttagagtccaacgggcgcattcagctgcggaaccgacgaattctcaggggacacatggccaaaatctacgccatgcattgggcgtccgactcgcggaatttagtttcggcttctcaggacggcaaattaattgtgtgggactcgtacaccacgaacaaagtacatgccattccgctgctgtcttcctgggtgatgacttgcgcgtacgcccccagcggatcgttcgtcgcatgcggcggattggacaacatttgtagcatttactcgctgaagacgcgcgagggaaatgtgcgagtgtcgcgcgagttgcctggtcacaccgggtatttgtcctgctgccgcttcttggatgacaaccaaatcgtcacctcc

SEQ ID NO: 48938 - DNA, 535 bp, Heterodera glycines
  misc_feature (532)..(532): n is a, c, g, or t
  SCN-specific regions: Sequence locations=1-281,303-433,462-497,525-535
aagtttgagtaatccaatgtctctcactacaaaattgcgaagattgcggaagaaacccccggagggatgggacttaattgaaccgacattggaggagttcgaggcgaaaatgcgagaggccgagactgaaccgcatgaggggaaacggaggactgagaccgtttggccgttgttccggatccatcaccagcgttcccgatacatttacgaccttttctataaggaagagaaaatttctcgcgaattataccaattttgcatcgatgcgagactaatcgacgcccaattggtggccaaatggaagaagccgggtttcgaaaatttgtgttgtttgcgttgtatccagacgagggacacaaactttggaactaattgcatttgtcgtgtgcccaagtcgaaactcgaggcgggccgtgtgatcgaatgtgttcattgtggatgcagaggatgttccggatgatttcctccaatttgtcatcctctgtcaatttctcgatttctttttaattattaaattgcattttcgattaanaaa

SEQ ID NO: 48939 - DNA, 517 bp, Heterodera glycines
  SCN-specific regions: Sequence locations=1-162,203-236,258-272,299 -365,395-517
actacggacgttcaaataaccccacaacgcccatcaccatgaagttctccaaggacgtgtcctcgtcgcgccgcaagtcccgcaaggcccacttcacggccccctcgcacgttcgccgtgtcatcatgtcggctcccctcgccaaggagctccgtgagaagcacaacgtccgctccatgcccatccgcaaggacgatgaggtgctcgttgtccgcggaaacttcaagtcgcagaccggcaaggttgtccaagtgtaccgcaagaagtatgtgatccacattgagcgcatcacccgcgacaaggtcaacggcacctctgtccccgttggcatccacccctccaacgtggtcatcaccaagctccacctcgacaaggaccgcaaggccctcctcgagcgcaaggctgctggaaaggctgtccaggccgagtaaattgtcttcacgcttgtgtggaactctgggactcgtgcgtgtgagttgttctcgtctatgaatgcaatttgcgtgtttgactcaaa

SEQ ID NO: 48940 - DNA, 728 bp, Heterodera glycines
  SCN-specific regions: Sequence locations=1-728
gtccaattaagatacaaaatgtccaattcttttcgaattctttccttattctgtccgctgtttctgcttctctttgttcctgagacttcacgagctctctattttcacatcgctgagactgagaaaaaatgtttcattgaggaaattccggacgagacaatggtgatggggcggtacaaagtgcaactgtacgacccgaacacgaaggcatatggggactatccaacaatcggaatgcatgtcgaagctaaggacccggaagaaaaggttattttgagcaaattgtacacgagcgaaggcatgttcacgttcacatcccattcccccggcgaacatctcatttgtctctattcaaattcgtccgcttggttcagtggcgcccaattgcgcgttcatttggacatccaagtcggagaacatgcccaggactacgagcaggtggcagccaaagacaaattgaacgaacttcaattgcgtgtgcggcaattgttggaccaagtggaacaaatcaccaaagagcagaattaccagcgctatcgcgaagagcgtttccgacagaccagcgaaagtaccaacagtcgcgtgctttggtggtccgtcggacaaacgattgtcctccttttgaccggtgcttggcaaatgcgccacttgaagggctttttcgaggccaaaaagcttgtctgaatcgatgcttttttcctggcagatatttatttgtctccgaattg

SEQ ID NO: 48941 - DNA, 1130 bp, Heterodera glycines
  SCN-specific regions: Sequence locations=1-56,78-463,486-703,725-1130
ccaagtttgagtcaccgcaatgggcgtacacaatgaattacaattggaaggatgcaattttcctgagacagcacattgttttttcactactaactggtaggacaatcacaattacaaagattcggtcttacgacgacaatcctggactgaaggaatttgagcgcatttttctttccatgatcaaaagattgacgaatggaactgagctcaaacttagtaaaaacggtacggaactcagttttcggcctggtctaattcatggaggagaattggagttcgactgtggggttcaacgttgtatcagttactttttggagcctctcattctcatggcgcctttttgcaaaaaacctttgaatgtgaatctgaccggtgttacaaattccgtcgatgaactcagcatcgacgccattcgggctacttggctcccggtcttttcccgctttgttcttgccgaccaatgcacagaaataaaaatcaaagccagaggtttcaagccgagtggcggtggttcagtgactttctccagtcccatcaaaaggaatttgcgtgctgtgcaatgcattaagccaggaaaagtttgcaagatcagaggtctcgcttacgtatgcaaagtgacgccatcaatcgcatctcgaatgattgacggagctaaaaagatgcttcacggaaacatttctgacatttacattacgattgaccagaggaagggcccccagggcggactatctcccggctttggaatcttcttgacggctgaaaccaccgaaggcgtatttttccatggagaagcgatgtcgcgccctaagggccaaaacgaagaccaaacagtgccggaagaaattggggaacaggcggcaagacgtttgctggatgaaattcatatgggaggctgtgcagattcgtcctgtcaatctttggccgccactttcatgactctctgcgacagagatgtttcgaaatttctccttggtccactcacaattaacagcgtacacacccttcggaatttgcaaatgtttttcgagcaaatgtttaaattggaggaatggtggaaggttatgaaagaaatcgtcggaaaaggcggaaatgcgatgaaaaacggaagtgaggacaaatgtttgatgacc

SEQ ID NO: 48942 - DNA, 530 bp, Heterodera glycines
  SCN-specific regions: Sequence locations=1-61,83-435,457-496,518-530
caaatctctgttataataagcgttttgagtgcaaaatggccggtatcgcagcaggaagactgacggaggagcggaaagcctggcgcaaagaccacccattcggtttcatcgcacgacagtgcaaaaaggaggacggcacattggacctgtacaattggatctgtgccattcccgggcccaagtcgaccatttgggagggtggcctgtacaaattgcgcatgatcttcaaggacgacttcccatccactccgccaaaatgccgctttgagccgcctctcttccatccaaatgtttatccgtccgggacggtctgcttgagtctgttagacgagaacaaagactggaaaccgtccatcaccgtgaagcagttgctgctcggtatccaggaactgctggtgtcgcccaacccggaggacccggcacaggcggaggcgtaccaaatttatgtgcaaaatcggcccgagtatgagcgtcgagtgcgcaaacaggcccaacagttctcagaggaccaggtgctgaagcagttgttg

SEQ ID NO: 48943 - DNA, 335 bp, Heterodera glycines
  SCN-specific regions: Sequence locations=1-256,278-305
gtccaattaagattgtgaaagaatggctgcgcacaaaacatttatcatcaaacgaaagttggccaaggctgccaaacaaaatcgtccgcttccccactgggctcgaatgaagacgggcaatcgcattcgctacaacgcaaagcgtcgtcactggcgcagaaccaaactgaagttgtgagcgatggaccccgagaaaacatcggaagacgccggacgggcgttgattttcgacttttttgtttgttcatggagttaattttcatacatttttgtgtggactattgttggtaaaattgttgaatttgaaaaaaaaaaaaaaaaaaaaaaaaaaaaaa

SEQ ID NO: 48944 - DNA, 627 bp, Heterodera glycines
  SCN-specific regions: Sequence locations=1-595,625-627
ccgccacaatgatgttgctgcccacaaaaatcattaccaaactttgggagtgtctcgtgatgcgagcgcaaaggatatcaaaaggcattttttgagctgaccaaaaaacaccatcctgacatgaaccctacggataaaacgaaagcagccgaggcgtttcaaaatataactgatgcatacgaagtgcttggttccgaagagaaaagacaaatttacgatacgctcactgctccgaaaccgcaagcccatttcggcagaacgccaaatttcagacggactcgttccaaccatataaacatgggacctgcaggagggcataaagattggaccgatttggacatcgatttcagagatttcgagcacttccaacgagaaaaccggagacggcagacgttcaaagactgggcccgggcgaatacaaaatccgaattttactggtcatctcaccaatcttcgaaatcatataaaagcccgctagcgttggaaagagagaacttggagaagaaaatgcacgacgaagtcatggagagacgaaggcgaagcgcgacaattcccatgtttgacgaactgcaaagagacaagcagaaaagggaacaggaagagaggaagaagagaatgaagaattac

SEQ ID NO: 48945 - DNA, 1045 bp, Heterodera glycines
  misc_feature (1025)..(1025): n is a, c, g, or t
  SCN-specific regions: Sequence locations=1-639,663-1025
tccaattaagctactattagatgagcctatgagcaaccaatcgaatagcaatagccaatcgaaacaacagcaaaggagcgaacattttatgtccagtgtttttgaggagtgcgacgccctaaaacaggaatacgacaagtgctttttgaatttcttcaaaacttttgtaaaggaagacgaacgacacgaaaggacagtcaatccgtgccaacaattgcaaaacatttatcacaagtgtttggaaaagaatttaaagacacataagccatacgacatcgatttggacgagttgaagaaggaagtgtccatcagcatcgaggagaacatcgactggaaacaacgcgggaattgatggaggaaattgtgcaaagtgcggcgaacggcggcataagttcgacagcgccggaccaatccagcgaaagtcgtttcaaccaattggaacggaatttggagctgttccaggaaaatgcgcgtcatatgggagtgatcgccagtgacttcacttccaaaagtcaggagccgttgaatcagaaaattcacactctcatctcgggccttcaggttcttgaccaactcaaaagccaattcaccgatgttcgtgttcccattgaattgttggactatttggaccgtggtcaaaaccctcagctgtacaccaaagaattgttggaacgcacgcggcagaggaacaaagaactgaacgggaagacggagatgtacaggaagttccaggcgtgtcttctgcaggaactccaccgcgaaatgccttcggacgtggaggaatacgtgcgcattcgaaaaccgagcggaatgaatggggcggcagcgggaaacgcaatggcaaattcggcgatggcagcggaggaaacacagcacgcgatggagtgacggactgcgtgcaaatgacggggtgggaacttttccggacaaatttgttcatttttctttttgcattgtcatccaatcgttccccatttcagttgtttctctttgaatttcttccaatgataaatattaaattgctnaaaaaaaaaaaaaaaaaaaa

SEQ ID NO: 48946 - DNA, 852 bp, Heterodera glycines
  SCN-specific regions: Sequence locations=1-27,51-852
caataaaggtgccaaatcttatatttttaaattattcacattctttcctccaaaattcgttctttcatgtcccttttgagctttgagggtcgcgttgccctcgtgaccggcgcaggcggaggaattgggcgtacttatgcacttgaatttgcacgcagaggtgccaaagtgatagtgaatgacttgggaggggaccgccacggaaaatccgcgtcgacttcggcagcagacaaagtcgtagcctaaatcctagcggcaggaggaaaagcggtgccaaactatgacagtgttgaaaatggagacaaaattgtgaggactgccatcgataattttggtcgaattgatatcgtgataaacaatgctggcattttgcgggatgtcagttttggcaaaatgtctgagttcgattgggattcggtaatgaaagtccacgtgaagggtgccttttcggtgactaaagcggcgtgggaacacatgcgggcgcaaaaatacggacgtttggtgtttacttcgtccaattcgggcatttatggaagtttcggccaggcgaattatgcagcagcgaaaatggcactgattggtctatccaacactttggcgttggaaggagcaaagtacaacatcgccagcaatgttttggtgccaactgctggttcgcgaatgactcaaacagtgatgcctgaagaattgctgacggcgatgaagccagaatttgttactccgcttactgttttcctggcacatgaaagttgcaacgccaccggaagagtgtttgaagccggagcggggtggtatggcacagttgagcacgtgcattctcgaggaaggaggatagcagaaccaaccgtggag

SEQ ID NO: 48947 - DNA, 676 bp, Heterodera glycines
  SCN-specific regions: Sequence locations=1-260,282-676
ccaagtttgagattctgctggattgttatcatggttgctacttttgagaaactcgtaaagactgatggcaaagcgcccgatgaccttgaaaaacaagttgcaacggctttgtctgaattggcacacaattcagagatcaaggctcagctcagcgaactttattttgttggagcacaggaatacgaatttggaaacaaaaagtgtattctggtatggattcctgttccgcaacttcgagactaccaaaaaattcacccaaaattagttcgtgagctggagaagaaaatgagcgggtgtcatgtcatcttcattgccaagcgtaggattttgccaaaacctcaacgaggtaaaaaccgtaagccattgggacagaagcgtcctcgttcgcgaacactcactgctgtgcatgactcaattctcgcagacgttgtattcccagctgaagtggttggcaagcgaactcgagtcaagcttgacgggaaacaaatcatcaaagttcacttggacaaggcacaacaaacgaccgtcgaacacaaggtggacaccttttcgcatctgtacaagcgactgactgggaaggatgtggtgttcgaatttccggagccgttattctgagaattgaaaataaagagcctctccgttatttcttttttgttgttacgctgttgagaagatg

SEQ ID NO: 48948 - DNA, 623 bp, Heterodera glycines
  SCN-specific regions: Sequence locations=1-623
ggcttttccaaactcaatgataaaacctgtgaatacattaaagagtttaatgaggacaatgactgattgtcgctggatggcgtcggtgccaatggcatttgagcagaaagtgtcgatggcacaaccacaacaatccatggcatatctcccggacatcgaaactctgacgaagggaaaagtcagtccgacgattctcaaaccttacattgacccgactctgtgctcttcccacccaaattcctttgagagagaagtgaccgtccgaagaatgctcgacgcgcgtgtccatttgggccataaggttggcactctcaacgataatatgaaatgggcattgtatggagaacgtcttggcatttgcgtctttgacttggaaatcactcggcattatctgctaaaggcgttggaatttgtccgatctgtggctttgtttgggcggccgctttctcttcgtctcgaccaataagtcctcaatgctaatggtggagacaatggccgacgaaatgggacagtacgcccacacgcgccattggcagcccggcacattcaccaactcaaagagcgtcttcagagggcccattcggctgcccaacactgtgattctgttgaacaccctgactagc

SEQ ID NO: 48949 - DNA, 2179 bp, Heterodera glycines
  misc_feature (2169)..(2169): n is a, c, g, or t
  SCN-specific regions: Sequence locations=1-5,27-260,291-372,396 -1092,1114-1649,1671-1739,1762-1915,1937-2179
aaagggcagttgctgctgttgctcccgcaccaaatgctaacgcagcctcggctcaaacaacccaaccgcaggttatggcaccatcttatccgttggcttctctctatgtcggcgatcttcatccggatgtcactgaggccatgctctttgagcggttcagcaatgctggacctgtgctctccattcgtgtttgtcgtgatgcaattactcgtcgttcgcttggctatgcctatgtgaattttcaacaaccggcggatgctgaacgtgctttggacaccatgaactttgacatgatcctgaacaagccaattcgcattatgtggtcgcaacgtgatccaagcattcgtcgctcgggtgctgggaacattttcatcaaaaacttgggcaaggaaatcgacacgaaggccatctacgacactttttccatgtttggaagcattctgagctgcaagattgccactgacattgagggaggaagcaaagggtatgggttcatccattttgagactgaggaagcggcgaacagtgcaattgcgaaagtgaacgggatgcttttggatgggaagaaagtgtttgttggaaaatttgtgccacgcactgctcgtgagaagcaaattggtgacccgtccagtcgtttcaccaatgtttatgtgaaaaattttggcgaggcaatggattcggagaagctgagcgaagtgttctcacagtatggcgaaatcatcagtgcaaaagtgatggaggatgacagcggcaaatccaaggggttcggctttgtcgcctacaaggaccatgaaagtgctgcgagggcggtggagaagatgaacgaggtttcggtgccaggcagtgagaaggtcgagcaaaagtttacggtgtgccgtgcgcagaagaagagcgagcgccaggctgagctgaagcgtcgttacgagcagtacaaagctgagcgcatccagcgttatcagggagtcaatctgtacgtcaagaacctgcacgataccatcaatgatgagacacttcgaagcaattttgaatcctacggaaacatcacaagtgcaaaggttatgtgtgatgagcatggtcgctccaaaggattcggttttgtgtgctttgaaaaggcggatgaagcaaccaaggctgttgtggaaatgaacaacaaaatcatcgaaaacaagccgctttacgtcgcgcttgcgcaacgtaaggaagaccgcaaagctcaactggcctcgcagtacatgcagcgcttagccgcgatgcgcatgcagaaccctgctggcctcatggggacaatgtatgcgcctgccagcggtggatttttcctgccacaggccatccagaaccaacgtgctgcgccgttcatgcaaacaccgaatctgtccggggcacaaatgcgtggcgctgtccctcgctggaacaatatgggcggtttcaaccatccaatgcaaggctacatgatgggtccagctgttggcggtcagttcggcggtgctaatcaaattgctcgtggaggacctcgctccggtggtatgggtggtggcggtggaatgcgtcagtacgggggacaaccccgtcagcaacagaaccgcatgccgggcatgggcggaggtcatcagcagcaagggatgcgctaccagggacagccgaaaggaatgcagcaacaacaacaccagcaggctcagcaaccacaaattgcctattcgtcgtatccgcagcagcagagccgtggcatggcaccgcaaatgggcggcggaggcggtggaggagtcaaagctggccatgcgatcactgcaacacaccaggaaccgttgaatacacagatgcttaccgaggctgacatgaccggacaaaagcaaatgcttggtgagcgtctgtacgcgatggttgcgcgttgcttccgggacggtgatgtcgagaaagttggcaagatcacgggaatgcttctcgagatggagaatgccgagattttgctgttgcttggagacgaggaaatgttgcgtttgcgcgtggacgaagcagcaacggtgctttaccaggccacgtgtcataaggaggcgcagtaggataaatgaagtggatggattggatgaataaattgatgagtaaaaggagaaatcaaaaaaattgatatgttatttggcttctttgtctgagtaaatgcttatctgttaaaanaaaaaaaaaa

SEQ ID NO: 48950 - DNA, 611 bp, Heterodera glycines
  SCN-specific regions: Sequence locations=1-50,89-611
gaattcaagaaaaagatatcacaaattttctttatttgtacaaacatatgaataaattaatattttatacatttttgtattattaaatgtcatcacttatccgtggtgaaattcagcagtttgcatcttttgcaaatgttttccactggtttgatgagcttcatggatgcttccgacctcttcactcttttaaccaattgagaattccttggctctccgcccatttggccacttcttctttgaatgccgtccatcttccgttgtctggtaaacagattttagatgtcggatgtggtgcaggcattttatcgacttctctttgtcgacgaggcgctttagtcactggcttagatgcggataaatctgtgctagaaattgctaatggttataaggaaacaatggcgccgagtcttcgcaaaaaaatagaatttattcctggcacgattgagagacttgcgcaagaaaaggatcgaatcggaacattcgatgcggtcgtttcttcggaagtggttgagcacgtttccgacttgcccttgttcattcggagttggtgcaaattggctcgtccgaattctccaatttttttcacaacaatcaaccgtacaatttgg

SEQ ID NO: 48951 - DNA, 693 bp, Heterodera glycines
  SCN-specific regions: Sequence locations=1-693
gttaagccttcactttcagtaattcttattgttaacataatgacgcaatttctccccgacaatttgttggctctgtttgcgcctcgtccgccgattcaattcaaaccgccgccagatgatctattcatccaccgaaaacacatgcaaatggggggcatggccgagtgtgtccatggttttgaggatccgaaggacactcctccaaaacccaaaattgagacccgagaggagaagagagcgcgaaaacgcaaggaaaaggaggagctaatggcctacaaaattgagcaaggcattgccacttggacacctgcggacaatccgaaggcgaccgttgacccgtacaaaacactttttattggccgaattaattatgaaacttcggagtccaaactacgccgtgaatttgagaagtacggcaaaataacgaagattattatggtgcacgacaaaaacagcaaaccgcgcggttacgcctttatcgaatatgcccataagtcggagatgtcagccgcttacaagaaggccgacgggaccaaaattgacggacgtcgcgtggtggtggactacaagcgtggccgcacgcaaaagaaatggctgccgcgtccgttgggtggcgggaaagggggaccccgcccaatgcgggagtccaaggcgaaaatgttggcgcgtgagttggcccgaaaagggggggga

SEQ ID NO: 48952 - DNA, 597 bp, Heterodera glycines
  SCN-specific regions: Sequence locations=1-597
gtccaattaagctgacaaatgttttcaattgttggaaaaaaggtcttcaacactacctcgtgcaattttctttcgaaggcattttacgctcatatgagcaaagatgaaataatgtggcattggcctgcgcagaaatttgaccaacatttcatcgattacttgaacaagccggacattgacgggtgggaaatccgaaaagctctcactgaactcgggaactttgacgtggtgccagaccccaaagttgttgaagcagcgctcagagctattcgccgtgtcaatgactttgcgcttgccatccgttttctggagcagattaaatacaaatgtggtggacccaaaagccgatccattgtgtatccgtatatcattcaagaggtcaaaccggtgatggatgagttgggcattccgacgctcgaggaacttggctacgacgagcccgaattcttcactcccgaccccgagtggtactgggagaagtcctggtacaagctttacgggttcgacaaactgcctggatacaaacacttggcctgaactgtttggccggagatggcgtgtgcatagaataggaaagaaattgttggacgactcttt

SEQ ID NO: 48953 - DNA, 701 bp, Heterodera glycines
  SCN-specific regions: Sequence locations=1-701
aataaagaaaaagctttgaaacatttttaagaagcttctctcttttgatcaaaatgacttcgaaaatggtggccgtgataacaggggcgagttcgggcctcggcaaagcaacggccgttttgttcgctcggaatggctaccatctctcactttgtggccgtaatgaaaaagcgttggagggagtggcgtcgaattgtttggcagagggcggactgacccgagaacaggttctgacaataattggcgacgtttgtgaggagaaaacgcttcaaaacattgtgaaacgaacggatgaaagctttggacgaatcgatgttttggttaattgtgccggtgttattgcgtccggaggagccgaaaacactccgacttcagttttggatggtttgatgaatgtgaatgtgaaaagtatgatcagactaagtcaattggttgttccgtatttggagaagacgaaaggaagcattgtgaacgtgagtagcatcgctggcatttgcgcgtttcctgctgtgacttactattgcatttcaaaagctgccgttgacaaatttacggaatgcctttccatggaattggcaccgaaaggcatccgagtcaatgccgtcaaccctgcactaatcgtcaccgaattgcatttgcgttcgggaatgcccgaggagcagtacagtgattttgttcgtcgcggtgcccaaactcacgca

SEQ ID NO: 48954 - DNA, 895 bp, Heterodera glycines
  SCN-specific regions: Sequence locations=1-895
ggtttttcgagaaatgacaaatgagcgtgatttttctcacgatgaccacattaacaacgctattgggaccaatggcgacagtaaagacgcagccaaaagaaaggacatctgccgtgattttctgaataatatttgcagcagggggaatcgatgcaaattttatcatccggaagacagtgtcgaaaagaatcaaaactcggcggatgagccttatcagttctgcattgattttcagaaccagggctgttaccgcgaaaattgtcgttatgttcacgcgtttcgcgaggatgtcgatcgttacaagcgcagcggcgacgtgacgcttgggttggcgcgagctttggcagcgctgttgaaaggcgatacgataaatggaattccgctttgcaaagagttccaaaatggacactgcgcgcgcggcccgcaatgtcgctattggcatatcaatcgcgacgaagagcgacgcaaacgctttggcggcggcaggaactgcggcggttcgccttcgtcgcttgcgttcggcgcttacccggcggtgcctccggcaggagcgcaactcagcagacgaagaggtgacgagttcgtcagtgaagattttgcaccgccctccaaacgatcttttgctcacaatcagccgtttgcaacgattcccggacagatggctccaacgtcagcaccaaccgcaccgtctcacccgtcacctcaattagtaattgagttggaacgtcgaaacgcggaattaaccactgaagtggaaagtctgaagagggagcttaaccgggaaaaggagcgttacgatgaccttatgtcgctttttcgagccgcccaaggccaaccgacggttcaacgttcggtgatttcgactccgtctttggtacccgccaatttgcagcca

SEQ ID NO: 48955 - DNA, 1080 bp, Heterodera glycines
  SCN-specific regions: Sequence locations=1-284,306-776,798-1080
gtccatttaagcgaaaaatgcactcgggagaataaacaaggagagaaacaggcggagacacgggcgcaactcaaagacgacgcctttctcagggaaattcactcgcggctgaaacccggcattgaaaattcggagcgtcgtttcgatgtgcacaaattcacttgcgccgctttggaattgcccgacttttcggacttcgcccgactccgtccgttaattgacgcactcattgctgaattggatctcaacgatttcctcggctgcaccgcggcgctcgaaatgctggcggagacggccgccacggcgccaaagtgtgtgcccttttttggccaaattggcctcctggacaaagtgtacgcgctgttcatccgaaccaaggaggagccggacatgggcatcattcacattgcgtgcattcgcttcttcgcctatctgtgcaccaccgatgacaacgcattgaccaaatttcccaaattcacggccgatgttttcgacgcggtgttcagatttgatgcattcgacgtcacgcgtcgtcagttggccttcgaaacgttggcagtgatcagttcgaccagcggggccaagcagatattctcgcagaacgaaactctctacaacatgcaacgggcgatgagcaatttggctgtggcggtggcaacggccgccgagccgtcgctgaaggcgcgtcatttggaagcagttcggatgttttttgatcggattgccgacgaaagcggttgccaacccgaacagaaatgcaccaccgcgtccgctgaggctgaagagcagctgctccaccggtggttccgctggttgggcgaaccgttcccccggctgttgctccaatgtgtcagggatcccatctccgaagttcagttggccgctctccgcgtgctgatggcactgacgcgccaccaatgggcgtatgcccatttttgtgccataactgatttcgtcaatttgctggtcgaccgttccgtcaatttcgacgccgacgcgatgcagctcaaatacgcgctcatttgtcgcttggttgaggccgcgccgtccgcgctgaacgacggacagatggaaatgctg

SEQ ID NO: 48956 - DNA, 641 bp, Heterodera glycines
  SCN-specific regions: Sequence locations=1-462,484-641
gccaattgattgacggcggtcattgaattcctgttatttgtgttgtttctatcgtttttttgtgacaaatgaaatacgcccagctagttgtcggccccgccggcagtgggaagtccacttattgtgcagctgtgcaactccattgcaaaacggtcggacggacggcgtttgtggtcaatttggacccggcggcggagcaattcaattacgattgtgccgtggatatgcgagaattaataagtgtggaggatgtgctagaagatgaggacatggccatgggaccgaatggggcattggtctattgcatggaatatttggccgacaatttggactggctccactcgcacctcaacgagggcgaagacgactactttctgttcgattgtccgggtcaaattgagctgtacagccatctgccggtgatgtgtcaaattgtgcaggcgctgcgcgagtggaacttcaacgtgtgcagcacctttgtcatggacaccaccttctgcttggactcgaccaaattcatgtcagccactctcaccgcactgtcaacgaccgtttcgctgcaaacgccggcagtgaacgtgctcagcaaaatggacttactgaggccggaagaccgacggacagtcgaagaaattgtggac

SEQ ID NO: 48957 - DNA, 538 bp, Heterodera glycines
  SCN-specific regions: Sequence locations=1-61,85-538
gtccaattaagttgtcagttttaatgtctaacataacacctgggaaacacaacacagactcagagaggagagggaggaggtgacctcagcgcagataaacttagggaaatcaactctctgattgcggcatttccgagttccattggacaaacgccgcctgattccgcgcttggcacagcactgaacaatatgatggtgcaatggaactcactgctctcgcaggtggtcacagaggttgaccacccacagccaatcctggagcacatcaaagaaacggcggaattctccgtcaaacagtttcgtgacgcatgcttgggtatgatcagcgaattgacacgcacttcggtcgattggcaactgaacttcccaaacgaaatggcagaacaggaaatttccgaatatgagaactcaatccgaagacaagaacaattgttgggtaaaatcagacagaaattggacgacgaaattttgtcgggagaaaattcgaattttgtaccttaatgtttggattatcacttggatgaatcgcttatcatta

SEQ ID NO: 48958 - DNA, 675 bp, Heterodera glycines
  SCN-specific regions: Sequence locations=1-226,297-675
gtttgagataattattttttgctttttttgaaacttcgattgcattgattgtgaaccgtgtcccttaaattcctttcttcctcgacgtgtctcgcgcgagttcggctaaaaataccgaaaaagctgaatatcaaagagcaattcaaaacagtggcaaagacctttctgcacatcaattcgagtgaacgtttcttccatccgttcgtccgttttcaatgaatttccgtccctttgcctttctctccctccgcttttcctcctcctcttccgcctcttcttcgtcccttcttccctcttaccggaaggcaattgtccatccaattgttcgtgtcgaccacgcgggcgaattggcggctgacagaatttatgccggtcaactcgccgttcttccgaaaacccatcgtctcgttccgataattgaacaaatgcgacgcgaagaaagacatcatttggacgagatggagcgattgatagtcaaatacggagtgaggtcgactgcgttggctccgatttgttcggtggccggttttatgttgggtgttggcaccgctttgcttggcgaaaaggcagcgatggcatgcacaattgccgtgggaggaagtcattggccaacattacaatgaccagatcaaagaattgatggcggatgatgccaatgccaaccgcgaattaatg

SEQ ID NO: 48959 - DNA, 1193 bp, Heterodera glycines
  SCN-specific regions: Sequence locations=1-530,552-769,804-1126,1157 -1169
aagagacacaaattgttgtgggagtggcctccgtgtgctcccttttggccattgtggccacgttggtcgttgtgccgtcattgtactcgcagatcaacgaaatcagtctgaaggtgcacgacggagtgcaggcattccgcgtgaacaccgactcggcatggaacgaactgatggaagtacaaattacggtcactcctccggcaaaaccccgcgagaatcctttcgtctccatcttccgctccaagcggcagctgcctggacattgtcaatgtgccggcgtccaacagccccaatgtccgcctggcccaccgggacccgcgggggcacccggacagcccggataccctggacaagccggagagccaggacagccgggaatgcctggacagcccggagcgccatgcccggatgttcctcacgtctgccagcattgcccagctgggccgcctggaaagcccggagatcaaggacctgccggccaagccggtcaacctggcaggccaggccagcctggacagagcggaggagtgggcccacccggacctcctggcccgcaaggacaagccggaagcccaggacgacctgggggatcgggacaaccaggacaacccggacaaaatggagttgtgtataagaccgttcctggaccgaagggacaacccggccaacctggagcaccgggacagcctggcgcacctggacgacctgggaagcctggagaccaaggacaacccggagccccggggcacccaggacagccaggccaacccggagcaccgggacagcctggtcatcctggcgctgctggagcacccggcaaagatgcctcgtactgcgcctgcccgccccggtcgggcggcggttatggcgtttccgggggaggcggaggcggtgccaaagtcgaacacgcgcccttgcccgctgaacaggcacctgtgccggaacaaccggcagaaagcgtcggcgtagcgcctgcaccggccgaagtggcgtcaaacgccgccggtggccaaggcgaagcagaagcggcgaaaggatacaggaagaaaatgtgaaagatcggataattattaatgcagaataaagtgattgttgatgagaggaagggacaaaccaaaattcattgaaattaaataattaataacattttaataaacaaaaacaaccggaaaaaaaaaaaaaaaaaaaaaaaa

SEQ ID NO: 48960 - DNA, 746 bp, Heterodera glycines
  misc_feature (732)..(732): n is a, c, g, or t
  SCN-specific regions: Sequence locations=1-3,25-746
atggaatcttctaatgaggagcagcagcttcaggaaattgaggctttggagtcaatgtattccaacgaactgagggttttgtgccgggactttccgaatatcagtgtcgagttggatgtccgccccgatttggacgaattcactgaactcttcggcaagagtgtcatttctctgcgcgcaacttttccctcggactatccgaattgtttccctgtcatcgatttgccagattttgatggggatgacgatgaaaacacacttcagaagactcagttttgggacgaatgtgaacggagagtgaggtcggaattggacaaagtgatggaggattgtgtcggcatgccaatgcttttcacactgctcggcgctttgcaggaattctttgtccaaatggcagatgattaccttaaaaaccgtgatgaattggagaggataaaagcggataaaattgaacgcgaggagcgggccaaattcgaagggacacgagtgacggtcgaatcattcaaaaaatggaacgatgcctttttgaagtctgtcagagtgccacaggaaaaaacaaaagacaatcagacgacaaagagaatgaccggaaaacagctattcctttcggacaatcacttaacatttccgatttgcaatttattggaaatgccaaggacgaaaatgcagttgaaattgaccaatcactttttgagggcgacatcgattttgacgacgatgatgaggattacnagcccgaggctgat

SEQ ID NO: 48961 - DNA, 892 bp, Heterodera glycines
  SCN-specific regions: Sequence locations=1-803,825-892
tgtttttattccatttgttgatctgtgtttattcattggtttcctatttatttcgcctttgattacggaatgcctgagaaaaaaccgacgaaatgcctttcaaagggcaaagaattgccttgcggacgtgagattattcaggattttgtaatgatgatgcccggctccatggacaaataccatcagttatgttccattctcagctcattcgaattgtggagtgaggaatcgcgcacttccttccttagccaatttttggattcctacgatattttggacgtgaattgttcagacttggtgcttaaattatgcaaaattcgttggcataccgttcctccccaaatgctttcgcaatttgctgactttttatgcgctttggccatcaaccatgtccaccatatcaattcagtgttcaattgcttcgtcgaccatttcttgccaattggcaatgcgaaagatccttcaaattttgaggcgcatcgtccgccagcggtggtggacgaccatttccaagagtcgctgtacgccttggccaacctttccatccaaaacgttgtttcctgcaaccctttgacgacgcctcttctgctcaaatgttttgtgaaacgctttccgcacatcaaacagccgtctccgaaactgctcgcctttatgcgaaatgtgctccgttttgccgattggattagggacgaggaaatctctgccgaaatttggtcgcttatcgtcgagaaactcctgcacatcgatgctttatgttttgagcgggaggaagaagaacaacggccgactcattccaatcgattgaaacagaaaaaattggacaacgaaaccgctagcgaagaaacaacaaatccgatgagggaaaaactgaacacattggtcgaattcattc

SEQ ID NO: 48962 - DNA, 776 bp, Heterodera glycines
  SCN-specific regions: Sequence locations=1-130,154-515,537-776
gtccagttaagttccttcgccttgtgaatttttgctttgacttttttatggagagattgttcaataccccgatttcctccctttctacgaacacatcaaattgcacacgaaacaccatttgtcttggctttttggatgggtccatccaatgtttttcctttgacacacagcgagggatcactccatcgatggaaagttcggtaaaactcggtggaatgtggcgcaaacggatgaaacggtccgtcagggcaatgcaaatttctgaggatggcacttcgctttatgcgaccagttcgaacagggccgtctgtttgtatgacgttgagacggggaagagagtgcgctgtattcgcgaagggcacaaaagtcggcccagtgcgatggcactgctgccgggcgaaagacggcattttgcaacgggtgccgaaaacggcgaaataaaagcatgggactttggacagcccaagccgaacgtgcacacatttggcgagcaggcggacataatcaatgcgttgcacatttggcgcaataatttgctggccgcgagtggcgacggcactttggccgtttacgacacgcacaaaggcaaagtgcgaattcagtcggagacaatgcacagcgaattgctcagtttggcggtgactgaaagattcacttacgtcggagcggccgatggacacattgaagtgttcaggcatggccaatttgggaacatccgcgaacgtatggaaaccccctttctgatgggcgtcgagcaaatggtcgtcttgcgcaac

SEQ ID NO: 48963 - DNA, 899 bp, Heterodera glycines
  SCN-specific regions: Sequence locations=1-858,880-899
aattaatccgcgcattgccattaaacaattttctcttttggattaaaataccgcaaattatgcgtttgttttgaatgaaaagtgcgtaaagaacatgcaatcacagcggggaagcagcagccggtcgaagacgacgacgacactatggaataatttatatttgaagcttaaaacactgcctaatcacataacataaaatgtgtaattaaggctaatggccgctcaattagcctcggctctatcctcgcccgactattacaattgccaaatgcagccgggattgacacggcgccaacgcgacatttgcgtccgacatccgtccgccatgcgatcaattagcgatggcctacgagcggcgattgacgaatgccacgcccaatttgaaagggaacgatggaattgctccgccacttttaacgtcggagtcccctcggaagaagattctacgcctgaaacagcttatgttttcgccatttcttcggccggtgcttcggccgccgtggcgagggcatgcgcccgaggggaaatccccgagtgtggctgtgggggaggggaacaaacggtgatcaattctccagacgttgaaggcctttccggagcggaccctcagcagttcatttgggccggttgttctgacaacattcgctttgggaatcaatttacgcgtaaatttattgacactgccgaaaaaaagcgaagcgatgcgcgctcattgatgaacctgcacaataatcgcgtgggacggctccttttggccacaaatatgcgcaaaaagtgcaaatgccacggcgtcagcggttcatgcgtgacaaaaacatgttggaaaacggtgccgacgatggaagaatttgcggcacttttgaaacagaaatacacaaatgccaaacaaatggcattgg

SEQ ID NO: 48964 - DNA, 807 bp, Heterodera glycines
  SCN-specific regions: Sequence locations=31-255,285-807
ccgcccctccgtccgtccgtccatccgtcccccgttttaaccccttcctcccccctttctcgcccatcttttcatccaattctccgtcttccgcctgcccattcttctccagcaaattatccattttgacgctcaatgggtggggaagggagcggcagaagcggtggtgtatccccggaatgcctttacgctgtgctgggagtgcagaaaggcgcggacgaagcggagatcaaaaaggcgtatcgaaggttggcattaaaatggcacccggacaaaaacccggaacggaaggagaaggcggagaaaatgttcaagcgggttgcacaagcgtacgaagtgttatcagatgagaaacgtcgaacggactacaaccggcacggaatgtgccggccagcagaggcggcgttcgcctcggcacaccgacggcggacagcgccggccgattcccactacgcccaccaccagtcccaccctttccatgctcatttccgttcccctttcgatattttccgtgaatttttcggcgaccctttgtcatcgtccgactttcatcgttcgccgtttttcgcttttcccgccaacggcggaatgaaacagaggagacggcatacgacaaatctattcggagacggggcatttggagcgcattttgcgggaaaagacgagaacaattgcgaattctccacggtgattcggttcagcacgagctcaaaggacccgggaaaaaagatcaaaaagacaatcacacaaactagacttgtaaatgggaagaaaattgtgacaaaaaaggtggaggacaacggacaa

SEQ ID NO: 48965 - DNA, 490 bp, Heterodera glycines
  SCN-specific regions: Sequence locations=1-305,329-490
ttgagctttatttacatttcacttttgtcaattcgtccgtttattcaatggccaagcatcatcccgacctcatcttttgtcgcaaacagcccggcgttgcgatcggacgcctctgtgacaaatgcgacgggcggtgcgtcgtctgcgattcgtacgtgcgcccgtgcactctcgtccgcatttgcgacgagtgcaactacggaagctatcagggtcgctgcgtaatttgcggtgggccaggcacaagcgacgcgtactattgcaaagagtgcaccattatggagaaggacagggacgggtgtccgaagattgtgaacctgggcagtgcgaagacggaccttttctacgaacggaagaaatacgcgttcaaaaagacgtgatcatagccgggggttggactgtcagggtttttgtctgttttttccgaccgttcgacctccgtttaatttaccatcgtttctttttataaaataaaaccgcgttctccaaa

SEQ ID NO: 48966 - DNA, 491 bp, Heterodera glycines
  SCN-specific regions: Sequence locations=1-262,284-434,456-491
atatttttaagcgttttttaagccaaaatgtcaaacgagttttattattcgaacaaatacgaagacgacgaatacgagtatcgacatgtccacgtcaccaaggaggtcgccaagcaggtgcctcacaatcggctcatgtccgagtctgagtggcgaagccttggcatccaacagagtccgggatgggttcactatttgatttggccagctgagcgtcacattttgctctttcgccgtcccaagccgaaggtgaacggcgctcagaagacgatgatgaagacgactgccaatccgagtcaagtccgagttggctgattttgggatgccgatcgatcgagagcagatgaaaaagtaccgcaatcaattccaatactcccactcatcacaccattcctacgtatcgccgtcgacagtctttctatccgatcaaacaccaaccaatgtgctcttaattacctgctgctgacttaaaataaattattttgctaaac

SEQ ID NO: 48967 - DNA, 910 bp, Heterodera glycines
  SCN-specific regions: Sequence locations=1-154,179-254,276-711,734 -740,762-885
cacattctcttctcgccaaagccttctccgcatttgttaagccgccgttctcctcaacaaataacacacaaccatcatgtcggaaaagaaggtcaaaaaggtgaagaagaagtccaggaccggctccgaggcgagctccttcgaccagaagaccatccaggagttcaaagaagcatttggcattatggaccaggacaaagacggagtgatcagcaagcaggacctgaaggacttgtacgccacactcggagttgtggcgagcgactcgcagatggacaacatgctcaaggaggcaccggggccaatcaatttcaccgttttcctgacactgttcggagaacgactgactggcactgaccccgaggcgacaattatcggcgcctttcaaatgttcgacaaaactgactgtggcgaaatcacagaagagacattgatgaaaattctgaagaacaaacggggggagccattgacggaggacgaagtgcaagggatgtacaaagggaaccctccaattagtggaggcaaagtggactacaaggcattcgcgcatttgatcacgacaggcgcagcggaggagttggccaaagtgggctaagcggggccatggacggacgggggaggaaggagtggcggggccgaggccaacgagtgacctgccgattcgggggaaaaccgatcatccatcccgtcgttctttccatccttacgatcgatcacccttttccccctcgcccattgtatctccttttgttctctttctaatcgctccctctccaaaatgtgtgtcccggctggcgagaatggcagcaccttctaattctataaaatgcatcgtttgttttcgcttcactcagtgcacttccaaataaaatcgaatggatgggtaaaaaaaaaaaaaaaaaaaaaaaaa

SEQ ID NO: 48968 - DNA, 322 bp, Heterodera glycines
  SCN-specific regions: Sequence locations=34-322
cctcgtgccgaattcggcacgagggtttgagtgaatagctttgctttatctaattttgcgtaaagatggacaagccaatcaaactcgcgaaagtcacgcgtatccttggacgtactggtagccaaggccagtgcacgcaagttcgtgttgagtttttggatgacacaaatcgttcgatcattagaaatgtgaagggccctgttcgggagggcgacattcttaccttgcttgaagctgagcgtgaagcacgtcgcctccgataaatcaacactaccattttgttgcgtatttctgaattgttgataaagaatgttgttaaaaa

SEQ ID NO: 48969 - DNA, 763 bp, Heterodera glycines
  SCN-specific regions: Sequence locations=1-184,208-627,661-763
cctacttctgatcaatcccgttatcctctcccaattttgtctgcaaaatgtcggacgactatcgcagttcgattggcccacggcctgcgttcaaccgcaactcaacagcctattcaagtacgggcggacctgtctcgggcggcaaccgcgtgctgaaaattgtcacggagacaatgtcatcgagcaccagcggcggcggcggtggcatgtcaccgtttggcgccaacgcggctcaaatccgtgactcccgtgatcgcgagaagaaggagctgagtgatttgaacaatcgattagccaattacattcaaaaggtccgcttcctcgaggcccacaaccgcaagttgaaggcggacctggacatgctgcaaggacgccgcggcaaggacaccatcaccatcaagacgatgtacgagagcgagattcagacggccaaaaagctgatcgaagacacgggccgatcaaagcacgagttggagcaggacgtggccaaactgcaacgtgacttggacgtagcagcgccgcaaatacgaggaagctgttcgctcacgggccggtgaccgtgaaaagttggacgatttgctggtccaattgagcaatttggaggccgaaatcagcctgttgaagcgtcgcattgccctgctggaggaggagctgagcaaactgcgcaaggagaactcacgactgcaggccgacctgcagcgcgtgcgtgccgagttggatcaggagacgctgaaccgcattgactaccaaaaccaagtgcaga

SEQ ID NO: 48970 - DNA, 1023 bp, Heterodera glycines
  SCN-specific regions: Sequence locations=1-119,141-439,463-599,626 -746,768-833,855-1023
gtcacattttatggcgttaaataattgttttactgagaatagatatccaaatgaatgcattctttcctatggctcgatcgctgtttcggatccgctcgatgcgttcgtttgttgtcgtttttccatccatgaacaccaggagaacatctgcgcatttggcacagaatatggcagagtagtgatttgcgatgtgacagctccgattaagggcgaggattttatcaaacatcgatttgccactggaaaaaatgctgtgttcgacttatgtttcattcctgatcgccctaatttattactttctctttgtggtgcctcaaacctagagcttttggacatcgaacggtcgtcgtccatttttttgcttggtcatcgtgacacggtccgatgtgcttccgtgtggcctgaaaatcccttttgcgttttgactggttcaagggacggtgacattttgctttgggatttgcgtgaaaaaccattgaaaagagaaattggtcggaaaagtgtgtcaaattctgtttcttctcttcgacgatatcaaactgctcatgaggcaaccattgcaataacaggccttttgcacatgagcgagaattatttcatctcttcttcatcgtcatcttcaagtggtattagaatttgggatttgcgatatcaaatcgcttcttcgccaatccgctctcttttcgttccccagaagatgagcaaagaatcgggcgttgcctcaatgtgttgggaccgattccgttcttccttttttgcactttgcactgacaatgccatttacgaatatgtcccctctcttaacagttcatttccagtgcgaagtttgcggacaaattttgtcaattcattttttgtacaatgcgctgcttcacctttctctgaccatcttttatgtggctcctctttttcaaaggcttttatttgggatttacagttttaggaggatcgcaaatattttcacgacatttcgtctcattatggaaaaaatcatgcacataaaaggaataaaaaaatgttacc

SEQ ID NO: 48971 - DNA, 520 bp, Heterodera glycines
  SCN-specific regions: Sequence locations=1-520
ccttgttgtagtcgaaactccactcttccccacccacccacttttctcaccatgtcgtacggcgattaccagcagcgcccccgtggctgcttcaactgcggctctgccgaccaccaggcccgcgactgcgaccaaggcgtcaagtgctacaactgcggcggcaccggccacacctcgcgcgactgctccgagccccgcaaggccaagacctgcaacaactgcaaccaggagggtcacattgcccgcgactgccccgatgcgccggcccagtctgcccgctcgtgctacaagtgcggtgaggtcggccacatttcccgcgactgcacccaaggccgtttcgccggcggtgaccgcatggccggtcgcaactgctacaagtgcggcgaggccggtcacatctcgcgtgagtgcccgcaaaacgctggtggcgactcgtcgtggggtggcaactcgggcggctcggcgcgcgcctgctacaagtgcggccaagagggccacatctcccgcgactgccccccag

SEQ ID NO: 48972 - DNA, 640 bp, Heterodera glycines
  SCN-specific regions: Sequence locations=1-640
aaatatggttttcgacccgaaatcgaaagacaaggcgcgggaacttggttcctaccgcgatatgcggttcgaggggtcgttgcccgaacaagaacgtcggcttgcacagtccaccactctctacattggtaatttgtcttactttacttctgaagaacaggtatgggagctgttccgccgcgctggagacgttcgtcgggtgattatgggcctggaccgttttaacaaaacgccatgcggtttctgttttgtcgagtattatacacgtgaagatgcagaaaatgcactgagatacataagcgggactcgccttgacgacagagttgtcagatgcgattgggacgcgggttttaaggaaggtcgccagttcggtcgtggtaaacatggcggacaagtcagggacgagtatcggcagaattttgattcgggaagaggcggatggaacaaaacaattcaaaaacgaaatgaccaattcacccagcgaaatatcaaagcctgacattcgacttcgttggacaaaattcaatttaaaatctcattgcttattattattgaccgttgttttgttatccatttaaaatttgctcttatactttcatttcattacatttttggtgtatcagtgaacgcattcattcat

SEQ ID NO: 48973 - DNA, 924 bp, Heterodera glycines
  SCN-specific regions: Sequence locations=660-660,753-790,896-897,922 -924
ggatggccgaaccctcgcggactacaacatccagaaggagtctactctccatcttgtcctgcgtcttcgtggaggaatgcaaatctttgtcaagaccctcaccggcaagacgatcaccctcgaagttgaggcgagcgacaccatcgagaatgtgaaggcgaagatccaggacaaggagggcatcccaccggaccaacagcgtctcatcttcgctggaaagcagctggaggatggccgaaccctcgcggactacaacatccagaaggagtctactctccatcttgtcctgcgtcttcgtggaggaatgcaaatctttgtcaagaccctcaccggcaagacgatcaccctcgaagttgaggcgagcgacaccatcgagaatgtgaaggcgaagatccaggacaaggagggcatcccaccggaccaacagcgtctcatcttcgctggaaagcagctggaggacggccgaaccctcgcggactacaacatccagaaggagtctactctccatcttgtcctgcgtcttcgtggaggaaagaacatctttgtgaagactctcaccggcaagacgatcaccctcgaagttgaggcgagcgacaccatcgaaaatgtgaaggcgaagatccacgacaaggagggcatcccaccggaccaacagcgtcccatcttcgctggaaagcagctggaggatggccgaaccctcgcggactacaacatccagaaggagtctactctccatcttgtcctgcgtcttcctggaggaatgcacatctttgtgaagagtctcaccggaaagacgatcaccctcgaagttgaggcgagcgacaccatctagaatgtgaaggctaagatccaggacaaggagggcatcccaccggaccaacagcgtctcatcttctctggagagcagctggaggacggccgaac

SEQ ID NO: 48974 - DNA, 777 bp, Heterodera glycines
  SCN-specific regions: Sequence locations=33-110,132-193,215-777
cctcgtgccgaattcggcacgaggtaaaatcactgtttgactcgcattttaattcgctgccaaatagcaaattcaagtgcatgatttcaagaatggcctcctcttcgtgttcctcgccgtcttcctcctccaaatttggaccacaaatgaaatgttcaacgccaaaacccgtgccaatggatgatgacggcacggaggagggcgaccacggcgaacagttgctgttggaccggcacgagttgcgcattctgtgcgacgagcatttgcagagcggtgactgtcagacggccgcattttgggccgaaaaattgttggcattgagcatcgggaggacactgaacgaacggttgccggacattgcgcattatttgtcggtgcttacggcggcccaattttggcagacaatcatcacattaattgaacggcatgacctgttccccaagcatttggtgttcgcctttttccacatcaatgcgctgttccatcgcgagttgtactcggaaatcattgcactgcccgtcggctatttgtgccattgggacgacgtgccgttcattcagccggacagtgccacgtacatttgtgccgaaaatgacgcggtccgtgagcccggcattcgccaacagttggacacattgttacgtgaaaagaaatacgaaagtcgaatgctgttgctgctggccaaaacgtatttgatggtgcagaacaggccggccgccgccggctgtttaaagcattgtctgacggcgaatcccttctgttccgaggccatccatt

SEQ ID NO: 48975 - DNA, 1080 bp, Heterodera glycines
  SCN-specific regions: Sequence locations=1-368,391-512,543-1080
gccatcgtcgccattctttcgtatggtggctataaccaggaggactccgtgattatgaatcaggctgggattgatcgtggtctgttccgttcggtgttttaccggtcatatcgtgattcggaacaagagattgacaatgtgaacgagcaactgattgagaagccgacgcgcgacaaatgcaaagggatgcgaaacgccatttatgagaaattggacgatgacggcatcacttcgccaggcactcgagtgtcaggtgacgatgtgatcattggaaaaacaattgctttgccggaggtggaggacgagttggaagccagcacagcgcgctactctaagaaggatgcgtcgacaacacttcgaagcagtgagacaggcattgttgaccaggtgatggtcagtgtcaacgcggagggcaacaaattcgtcaaaattcgcgtccgttcaattcgaacacctcaaatcggggacaaatttgcttcacgtcatggtcaaaagggaacaatgggaatgatgtacagacaagaggatatgcctttcacatgcgagggcataacgccggacattatcattaatccacacgctgtgccgagtcgtatgacaattggacatttgattgaatgcctccaaggaaagctttctgcaaacaaaggcgaaattggcgacgccacccctttcaacgacacagtcaatgtgcagaaaataagtgctttgcttgagggctacggctaccaattgcgtggcaatgaaataatgtacaacggatttaccgggcaaaagttgagcacacaggtgtttctgggcccaacttactaccaacggcttaagcacatggtcgaggacaaaattcactcacgcgcccgagggcctgttcaggggatgaaccgacagccaatggaaggcagggcacgtgacggtggactgcgatttggtgaaatggaaagagattgtcaaatttcacacggcgctgctcaatttttacgggagagactttttgaggtgtccgatccatacacagtttatgtgtgcaatcaatgcggattggtggtgattttcaatcaacggactaacactttcgagtgc

SEQ ID NO: 48976 - DNA, 1129 bp, Heterodera glycines
  SCN-specific regions: Sequence locations=1-17,54-1129
atttattttagttttccaaaataatttaaattttctttattttaataaaataacaactaaaatatggataaaaatataggaaataaaaacaacaatgaatttttattgcttggaatgggaaatccattgttggacctgcaggtcgcaactttggacacacaaattcatgcaaagtatggacttgcagaggacggcgcggacctaatcaatagtgaaaatagtgcctcacttttgccaatttttgacgatatttccactcttggcaataagattgaatttgtacccggtggttcagcacaaaacacggtccgagtttgtcaatggatggtcaaagcattcggcgtaaacctcaagtcctgctacttttttggtgccgttggcaaggacaaatatggtcaaattttgcacgagaaggcccaggctgcaaacatcgaagtgcgttaccaggaagtgccaaccgaaaagacgggtacctgcgcggttttggtgttcggcaataagaggtctttggttgctcatcttggcgccgctgaacatttcacccctgtccatcttaacattgaggccaaccaatcactgattgaaaagattagcaatttttacgtcgagggatactttctaaccgtctctttggaatcgattctttttctggcaacgcatgtcatctcttccactcggcccaaacatttcgctctcaatttgagtgccgaatacatttgtcagttttttttccgaccgacttgaaaaagtgctcccctatgttgacattttgtttggcaataaacaagaagcattggcttacgcaaaaactcgagaaatcggaaaaacgtgacgttggggacatcgcattgtatttgagtgaaaaggagaaagtgaacggtgagaagaaaacggatagtcgtgataacacagggccctttgccggttttggtggcccatgactgcgaactcactcagtttccagtggagccaatttcggaggacaaaattgtggacaccaatggggcgggcgatgcattttgtggaggctttttggctgcattttccaccggccgctctttggatctttgcgtccgtgctggtaattttgctgctcgtacaattattcaacaaattggctgcacttttc

SEQ ID NO: 48977 - DNA, 615 bp, Heterodera glycines
  SCN-specific regions: Sequence locations=1-5,27-268,292-331,353-615
gtccaattaagatttattgtaattttgccacgcatttaaagtaggctgaaccaccgaatcatcccatccctcctaaaaaaatttggacgcaaaatttttaaatggccgaatccggtgaacatgaccatgactttacatctggcgagtcgggtgcagctgccacttacccaaagcaatgctctgccttgcgcaagaatgagttcgtcatgatcaaaggccgtccttgcaaagttgtcgagatgagcacctcgaagaccgggaagcacggccatgccaaggtgcacctggttgcgttggacattttcaccaacaaaaagttggaagacatttgcccgtccacccacaacatggaagtgccagtggtcaagcgcaaggagtaccagctgctctcaaccaacgaggacgggttcatttcgctgatggatttggagacttgcgacaccaaggacgacctgcgtctgccggaaggcgaaattggtgaccaaatcaaacaggcctacgaaaaggacgataacggcattcttgtgtcggtggtgactgcgtgcggtgaggaggccatcctcggctggaagttcatgccaaacaaatagttggaggacgacgacggcgatgacg

SEQ ID NO: 48978 - DNA, 641 bp, Heterodera glycines
  SCN-specific regions: Sequence locations=1-641
tgctcatttgtcagcccatcccaaaaactgataaaaaaaatggcgttcctctcccgtctctccatccttccaaattcgccaatttcgctgcttgcagtttctttggccgttttggctttcgtcgctttggcatcggccaatccgccgacggcacgcgaaacggcgccaaatgcacagcaaaacaatgccaattcagtggcaactggggaaattgcgaaaaatattgcggaaaagatggagcggatgaatgagttcattaaggcgaagaagttcatcgatgcacataatttggcatttgagaagggcgaagtgtcgttcaaagttgcgccaaaccatctgatgcattttacacctgcccaatataatcgaattcgcggcttgcaaatgcgcagcaaccgacaacggcacaacatggcaactctggcgggaaacagcagtactttgccggaaaagttggactggcgcgagaaaggggcggtgaccgaggtcaaagatcagggggactgcggctcgtgttgggcattcagtgccaccggtgccattgagggagcattggcacagaaaaaagcgtcaaaaattatttcattgtccgaacaaaacctgatcgactgttcgtccaagtacggtaacgagggctgtga

SEQ ID NO: 48979 - DNA, 507 bp, Heterodera glycines
  SCN-specific regions: Sequence locations=1-22,44-283,305-425,455-507
cactgtttgagttggattctgtccatttcgctgtgtcttcctcagaaattttgttgcatttgtgcaagacggaaatttgcaagtcggccaatgtggagaatgaggaccgaatgcgccgcctcatttcgcatttgttccgtgctcgctccctttacccgctgtgcccgtgtgaccaaaatttgccatttgcgccctctgcgagtgccaatgccaaactgcgcctgcccaggaagccacacgtgatggttctgccttcgctgcttcagccagtcacaaaggtggtggatgactgcgtggtgctcaatccgggccgcttcgacagagggaagggcaccggcacattttccgttctcgacttggacctttcgagtgccattggcgccacttcggtctcaccgttttgcgaagtctcactcttttcaacccaacaacaacaatgacaaaaatcacatttttgagtgtcgcaattgcccattttaacatttttgacaaaataaattttcggat

SEQ ID NO: 48980 - DNA, 656 bp, Heterodera glycines
  SCN-specific regions: Sequence locations=1-252,280-539,563-656
gtttgagcatattataaaatcgtgccaacaatttgagggatgtccggtgacaattcggcactcattgcagcggagcaagcggcgtatggcccattttttggctcacttggcgtcactgcggcgatgattttcaccgcggccgggtcggcctacggcacggcaaaatccgggactggcattgcttgtatggctgtagcaaggcctgacctcgtgatgaaggcgatcattcccgtggtcatggccggcattgtggccatctacgggctggtggtggcggtgatcatttccggccggctggaggcggccgggcccggctacaccatcgaccgcgggttcagccagttcgctgcaggcctcgtgtgcggtctatgcgggttgggcgccggctatgccatcggcgtggtgggcgacgcgggcgtgcgcggcctgtcgcagcagccgcgcctgtttgtcggcatgattctgatgctgatcttctcggaggtgctcggtctctacggaatgattgtctcactgctgctaagttcctcctgaacaatggaaggaagaaagaaggaaagaatggcacgtctgctgaacattgtgccgaccgtcgtgttgtgatgatcaaaatgaccagccaccgtatataatagataaataccgtattttccatc

SEQ ID NO: 48981 - DNA, 1429 bp, Heterodera glycines
  SCN-specific regions: Sequence locations=1-31,53-277,299-1429
gtaaaccttttttttcttttccatggacatcgaaactgatgcaaatgcagttacacttgccttttaacatttgttagcattcattctcattttgctgttgttcttttggatgtttccgtttcgcccaataagaaaagtcccgtggtaccggcgcaaagttcctgatcggataagcttagttgcagaagaaacaattagccctgccgatgagaaattggttgggtggcgtttacatgactattacgaaattcaagagctcgtgaatatattgccgacgataaaggaaaagatcgattttgtgaacccctacgagaggccgtggaaacagtcggagctacgttggcacagaccatggatggcacctttatctaagcctcgctcggcatgggtcgtcccaccaactccagcttattttgatgtgctcgacttttccaaatatatcaccaagacacggttggccaccgatgaggaagccgaatgggaatttgacgcatattacaaaggcataaatttgccaacagccaaatttgaggaacgtgttgccgaaagtctggcacttcatttggaaagagaagaaatgtctaaaagagagaatcaccccgaaaaggaaagggaagaaaaccgcgccaaatttctccgctcgctcatcgatgatgcccatttaattttggcacatggaaacccaaaaatcatcgaccatcgcatttcacattctgaccgttgcgagtccttttggataagggccggttttctccctctgtacgagagtttgcccgtttgggaaatggaaaaagtgccgtccattcgaaaagtgaagttcaccggcgatgacagacgccgtcttggcgaactttcctttacaatgcgcgacaaacatacgatgcaagtgcggacgaaaagcccaatgaaaaggctcttcgattgggatgaacctgacaaactcgaggcaccagtgtttccgccgtcttttgacgttgcggatgaattgataatgtcacccatggtttataatcttctcgccgacacagagccattgtggcaatgcccaggctacgaatatgactcgggtgaaacgcataagtacggtcggttggctatcaaggacattactccgctgatcactcgtctggacactcattggcgttgcgacacggaacatgagcgaaaggaagtgctcagagaatgtttggccgcaacggcggtcgtatctctcttcaattggttgaatggacaagcgcattgtcttggacacactcaatacacagaaattgtcgccccgttgagttcccaattgatactttctgacggcttgcaattgttttatttcgctctcggtcaactcaacactctcgcaattaacattgatgttgaaggcttcaataatcagcggtccaatttttgttgtgttaatggacccttcaaactgtac

SEQ ID NO: 48982 - DNA, 716 bp, Heterodera glycines
  misc_feature (695)..(696): n is a, c, g, or t
  SCN-specific regions: Sequence locations=1-369,405-654,678-696
gtgctttttaagaaatataatgccaattcaagagataaacaattaggtatttgctttgggaaattcacatatttgatttgttggttaccaatgactgctccttgcattgatgttggcaatcttttactcattgatgttgagacggacgccgaagatttggccagtagcaactcagaacggattaacgaacttacaagcaaaaatgcccagcttttgttcaatgaaatatggaaattacccagaaaaattgtgcaagatgcgacttgttctcagcttcccgaatacacttatggccttcctcgtgaaaaacccattccaaaaccgaaagaaccaacgaaatgggagaagttcgcgagggctaaagggataacaaagaagaaagacaggaaagtctgggacaaaacgactcaggaatggaagccgaaatacggatacagacgagccgagaaccaatcgaaggaatggctcattgaaattcccgaccaaaaagacccatacaaagattattttgctgagaagacggaggaaaagcgggaaaagaataacaagcaggagttgcaacggctgaagaacatttcccgcgcctctaacaaatacaaagttccaactgggaacagaaaggtgttcaaagattgatcaaatcaaatctgtcaattgttttatgtttttgttgttttcataaacaattttaatcnnaaaaaaaaaaaaaaaaaaaa

SEQ ID NO: 48983 - DNA, 644 bp, Heterodera glycines
  misc_feature (590)..(590): n is a, c, g, or t
  misc_feature (609)..(609): n is a, c, g, or t
  SCN-specific regions: Sequence locations=1-187,227-233,260-377,401 -471,507-552,587-644
cacagagggtttgagatcactcgatttctctgctttttgtccattagactttatttaattccttccattctaaacagcgaattgcttttacgccaccataaaatatgggtttggccatttccggtctgttcagtcgacttttcggcaaaaaggaagtgcgcattttgatggttgggctggacgcggcgggaaagaccaccattctgtacaagctgaagttgggcgaaattgtcaccaccattccaacaattggcttcaacgtggaaactgtcgaatacaaaaacatttcattcaccgtctgggacgttggtggacaagacaaaattcgaccgttatggcgatactatttccaaaatacgcaaggactgatttttgtcgtggacagcaacgaccgcgagcgtgtgggcgaggcgcgtgaggaactgatgcgaatgctggcggaagacgaactgcgcgacgcggtgctgttgatttttgcgaacaaacaggatttgccaaatgctatgaacgccgcagaaatgacggacaaactcggactgcacaatcttcggaaccgcaactggtacatccaggccacctgtgccacgtcnggcgacggactttacgaangcttggactggctgagcaatcagctgaagaacaga

SEQ ID NO: 48984 - DNA, 635 bp, Heterodera glycines
  SCN-specific regions: Sequence locations=1-210,234-635
gttttggcttctgtataaatgaatggaggtggcagcaacaacagttttctctgtgtaatttttgactgtaatgcgtacaattggggctgtgtggtcgctgaacgcggtgtgtctacgcttaacgaaactgtctccgcactaattgctctttgcaatgcgcacaatttctcctcgctcggaaatcgtcttttgctactcgcaaaaggagccaaacaacaagaaaagaaattgttcaccaacgaacgaattactgcgaaagaattgacaaattttgggccggccattgaaggaattattcatcaaattttggctaagaatgtttctgctgaagaaagccctttcaatttgtccagtgcattgtctttgagtatttgcgcattccaaaggttcaagaagcaatttccctcttcatttgggcatgttgtcttcataaacctttcggaacaatttacttctgagcaaaatgccctgctgaatttgtttttcgcctctcgtcagtactctctgcactttcatgtggcctcttttcacaaaactgtgccaatcctgcagcaggcttcggacattaccggtggttcctacatgtacattgacaacaccaagcttttggcccacaaactgctgtgtcactgcat

SEQ ID NO: 48985 - DNA, 826 bp, Heterodera glycines
  SCN-specific regions: Sequence locations=1-826
gtccaattaagatatcctttctatttgacaaatgtcccgttttgtgtgtgctatttctggaaatgagcccgaggtggctgtggcatcgcccgtctccggagaagtctttgagaaacggctgctcatcaagtacattgaagagaacggcaccgatccgatcaccggccacaaacttgacacttccaacttggtcgagctgaagcaggacccgggcattcgttctatgcaaaagtcattggccaccgcctcgttgccttcgttgcttaagcaattgcaagacgaatgggacgccaccatgctgaacaacttcacgctcagacaggagttgaaggcagcccgcgaggagttgacccacgcgctttaccagaatgacgcggcatgccgtgtgatcaaccgtctgagcagtgagctgcagtccgcgcgtcaaatcatcgcgacactgccgcacggacgacgcgctgccgcggagagtgagacggaggcgaccgatgttgagatgcgtccggaggaagcggaggagggcgctggtgcggacggtctgccgggcatcagcgaagagttggtcaattttttcaccgacaaatgccaagacttttccaccgcgcgtaagcagcgtggccgaaatttgcccgaggggttggcatcagtggaacaaattcaaaagtatgaggaggttgcgtgccacgatgcgctgcacagtgccagcgtgcccggcatcaccgcgttggatttgcagaaaaatttcatcgcaaccggcggaatggacaagaccatcgtgctgttcgactcggagacggagaacatcaagaacacgttcaaggggcac

SEQ ID NO: 48986 - DNA, 575 bp, Heterodera glycines
  SCN-specific regions: Sequence locations=1-575
taataaaccaatctacggtatataattcaacatgtcgtctggtgtaatggtgaattccgaatgtcaaaacgctttccaacaactttcggaagggaaacgctatcgttacatcatctacaaaatagtggacaaggaagtgattgttgaggtggcagtttcttcggaagacattggctccactggaactgaaagttatgatgacaattcgaaggccgcgtatgaaacatttgtgaaagacctcaaggagcgaactgagggttttgtggactgtcgctacgcagtgttcgacttcaaattccagacacagcgccccggcgcaggcacttccaagatggataagattgtcttcattcagctttgcccggacggtgcgtcaatcaaaaagaaaatgctttatgcttcatctgcgtcggccatcaaggcgtctctcggaaccgctaaaattctgcaatttcaggtgtctgatgagtcggaaattgcccacaaggaattgctgagcaagctgaacgacaaataccgcgacaattgaatgattggttgggatatgatgtcctgcacattcctctcaatttttg

SEQ ID NO: 48987 - DNA, 885 bp, Heterodera glycines
  SCN-specific regions: Sequence locations=1-885
ccaagtttgagcatttgtgttccgtttagcagaactatgatatttttgacttcgttttccaaacatccgttgtccgctgcctttcggttcttttcttctgttaacgaagtgaccctccaaacgcgtccctacaaactgttcaaactcgattcgggtccttcgacggaggtgcgactgacgcgggatgaggcgttggattattacagaaaaatgcaattggtccgacggatggagacatcggccaataatttgtacaaggaaaagcgtattcgcggcttctgccacctttactccggacaagaggcgtgtgccattgggatggtggcagcgactgacccgaaggatgccgtgatcacggcttaccgatgtcacggatggacatatttaatgggcgcgacggtccaggacattttggccgaactgacaggacgcattgctgggaatgtttacggaaaaggcggatccatgcatatgtacgccaagaacttcttcggtggaaacggaatcgtcggcgcacaagttccgattggggcgggcattgcttttgccatgaaatatcgccgccagaaaaacgtttgtttgacactttacggagatggggcggccaaccagggacagctgttcgaagcgacgaacatggccaaactgtggggattgccgtgcattttcgtttgcgagaataacggattcggaatgggcactcccgtggaccgtgcctccgcctcgaccgattattacacgcggggtgactatgtgcctggcatttgggtcgatgggatggatgttctgaccgtccgcgaggccactcgctgggccaaggagtactgtgacgcgggcaatggcccactgatgatggaattggccccttaccggtactacggccaa

SEQ ID NO: 48988 - DNA, 574 bp, Heterodera glycines
  SCN-specific regions: Sequence locations=1-217,239-574
ccccgagaacctcctctagaagcgctggggcaccgagaagaacgccaccgctgccctcgaggccgccaagggtcgccgtgccgccagcaaggtcaagcgcgtcgtcatcttcaagcgcgccgagcagtacgtcaaggagtaccgcaaggctgagcgcgaggagatccgcctcaagcgtgttgcccgccaggccaacaacttccacgtgcccgctgagcccaagctcgcctttgtgatccgcattaagggtatcaacaagattgcccccaagccccgcaaggtgctccagctcctccgcttgtaccagatcaacaacggtgtcttccttcacctcaacaaggccaccttggagatgctcaagctcgtcgagccctacgttgcctacggtacccccaacctcaagaccgtgcgcgaactcatctacaagcgcggttaccggaagggccacggccagcgcattgccctctctgacaacgctgttgttgagaagtcgcgcaggcaaggcggaccttatctgcgttggaagattttattcgacgagatctacactgtcgggcccaaccttcagaaaggg

SEQ ID NO: 48989 - DNA, 596 bp, Heterodera glycines
  misc_feature (576)..(576): n is a, c, g, or t
  SCN-specific regions: Sequence locations=1-437,459-521,552-552,575-576
ctttgttcatttattttgtttgaatgcgattctatgtcaaaaacatcgaagaaaaattttgtgacaaagcaactcgttaaagaaattgttattccagctgacaatgaatttgttgggaaaattttagcttcacgaggcaacaacctccacgaagttgaaaccgatgaaggggaaaacttccttgtgagtatgcccacaagatttcgaaagaaattatgggttcgtcgcggcacttatgtgattttacagtcaattgaagaaggagacaaagtgcgagctgaaattgttcatgttttggacccggaaaacattgcgtttttgatggaaaaagaagtttggccggagagatttattgtagaagctgcgcaattgaccaagcgagggcagcgaactgaagaaaatgacgattcggacctattccccgcaacttcggaatctgaaaattcggctgaagagagttcttccctcgtttctgaagatgtagctttgaatggacagacaaatgccattgatgaaacaacgatttaaaagaaatttaattttgttgcaaagaatttttaaataaattttttaacnaaaaaaaaaaaaaaaaaaaa

SEQ ID NO: 48990 - DNA, 464 bp, Heterodera glycines
  misc_feature (458)..(459): n is a, c, g, or t
  SCN-specific regions: Sequence locations=1-310,333-464
ttgagacattgcagcattttctctgatggacgaagaggcgaagcaggaaaacctggcgaaagagcttctaaagctcacttcttctctcaagcaaaattttacgactgccggttcggtgctaaaggaagacaatgcgacattggatgttatgcaaagggtcgccctgtccaacaaagaaaatctgataagggagaggggccgacttggccaccacgcctaccaatcgtgcttcaactgtgtgatggtcatgacagtgattgtggtcatttggtcgttcattgcgatgattattatgatgcgaatgttccccaaaatttaagtgttttatattttccttggataactcaaaacgggcccaaaccaacaaaataagaacgattcacttctgtgattgcttctgagctgtgttattctgttttgtttatttatttttcgtcatttaaatttgtttttctttnnaaaaa

SEQ ID NO: 48991 - DNA, 645 bp, Heterodera glycines
  SCN-specific regions: Sequence locations=1-645
tgtgcatttggacaatgagcgggtattgaaagcactgtaccatcttttacaaggcttttcagccagtccaccgaacattttcgtattttgtggcccttttctcggcattcaacgggcgcacagttacatggagcaggcggccaacgcgttcaggcattttgcaaacattttgtccgaattttcgcacgcttaccacgccaccgaattcatttttgtgccaagtgctgacgatgcgcctccgttgcaaatttttcccaggcccactttgttgcagttgatacaaaaatgctttaaggaggctaaaaatatgcattttgccaccaacccatgcaaattggtcttcaaggaccggcacattgtcatctttcgtgacgatgtggtggagaaggtgtgccgttcagcagttttcatgccaaaaaacgcgatggccagccgaataccaaaattgttctgtgacacaatttgggcccaacgccatttctcgccgttgccactgttcatcaacccaattcaaccccattttgacccactgtttcaactgttcccgtcacctgatgctcttgtgatcgctgatcgtttcaaagccttttttgagccagcggacgaacggcgacgactgacaatgaacccgggccccttttcact

SEQ ID NO: 48992 - DNA, 651 bp, Heterodera glycines
  SCN-specific regions: Sequence locations=1-217,239-651
gattgccaagctgtcgtttttgccggaggtcgtggaagtcgaatgccgtctttgaccaatcaaatgccgaaggcgttgttgcccatggccaatatgccactttattggttttcgcttaatttacttcgactgaatcgcgtcagagattgccttttgattgttcccctggggcaaaaattgcaaattgaaaatgcgctgaaaacggacggcggtggacgatggccaacacttaagggaatggacatcgaagtggtggccattgacagtttggaggaggacgtggatgactggggaacagcggacgtactcaaaagactgctcgggaaattgaagagtgatcacattttgttgattagcggtgacttggtcagtgatgtccggctgcgtgacatgttcaagcagtacatggagaacaacgctgtcctgtcctgtctgctcaccgattcggctttgggtgggcctatccccgggcctaaagatcgcgttaaaaagtacagagattttgtcattttgggtccgaacggacaattgctctttttggtggacgaagacgattttgcggaggaggaaggaatcccaatttcattgtttgacagatgccccaaggcaaaagcaaccgcaaaatataaggacgtgcatttgtacctcgtc

SEQ ID NO: 48993 - DNA, 572 bp, Heterodera glycines
  SCN-specific regions: Sequence locations=1-572
caagtttgagcatttttatataaacaaaataaatatgagcgcggagcggaaaaagtccgtcttatttttgttcgatgtggacggaacattgacggcgtcacgacagtcaattacgccgtcaatgctcgcctttatgcactcggtgaagagccgtgtgcctgttgctgtggtgggcggttcggacctggccaaaatttttgaacagctcggcggcacgcaacaacgcgaccaatgcttggccctgttcgattttgtttttgccgaaaatggtctcaccggattcaaaggcactgagccgatgccatcggagtcaatcagcaaacaattgggagaggcaaaatgccaagaactgaccaatttctgcctaaggtacatgtccaacattgagttgccattgaagcgcggaaattttgttgaacatcgcaatggaatgatcaacgtgtcgccgattgggcgcagctgttcccagtcggaacgtgaccaattcgtgcagtttgaacgcacgacgcccattcgcgcccaatttgtcgaggcattgcgccaacgattcccaattgaacagtacggactgg

SEQ ID NO: 48994 - DNA, 843 bp, Heterodera glycines
  misc_feature (822)..(822): n is a, c, g, or t
  SCN-specific regions: Sequence locations=35-69,92-717,744-843
cctcgtgccgaattcggcacgaggcaagtttgagggtatccaattttttgcattgttttgcaactgatacaacatgatcatctacaaggacgcgttcacagacgatgagctcgcctctgactcgttcccgatgaagttggtcgacgacctgatctacgagttcaagggtcgccatgtcgtgcgaaaggagggcgaaattacgatgagcggggcaaatccgtcagcggaggaaattgacgagggcactgaagaggcggtggaacgcggcattgactttgtgctcaaccatcgactacaggagatgaattgttacgagaaccaggcaacatttaaaggctacgtcaaggacttcatgaaaaagatcattgagtacatggagaaggagcagaagtcggctgacgaaattgctgcgttcaagaagaagatccaggcctgggttgtctcattgctggccaaggaccgtttcaagaatctcgcattctttatcggcgaaaacatggccgagggcaagggcgaaggacaggtggccattgttgagtaccgtcaggagaatggtgaggaagtgcccactctgatgctgatcaaggaggcgctcattgtggagaagtgctgacgacgacgacaagcgatatacgagaaatgcgcgcgatattattattataacttttttgttttaatatgatatggtgacacaatgtccagttactctattacatattgttgttgttgttgttgttttgttggctggccttcgtttgacacggaactctcaattggttgattatattgatggtagataagatcgcggttcgcaactgttanaaaagaaaaaaaaaaaaacaa

SEQ ID NO: 48995 - DNA, 800 bp, Heterodera glycines
  SCN-specific regions: Sequence locations=1-398,421-736,777-800
agacattgtggcacacaacttcattttctactatcattgaattggctcaacaataagctcacatcgggacgatgactgtcagcaaagaattaaatgagctcaataattgcctgtcgactcgtgcttatctccacggtttccttccgtcacaagaagaccaatacgtatttaaaagtatcaagtctgttccttccgagaaagaatatgcgcacgttgctcgttggtacaagcacattcaaagcttcgatgatgttgaacgtttgaattggtcaaagaaagctggacaaacaacacagactgtcgcttccaaagagactccggcaaagaaagttgaagccgaggaggacttcgacctcttcggagatgaggaaagcgacgacgaggaaaaaaagcgcatcactaaggagcgcctgaaggcttatgcggagaaaaaggcgaagaagcccgggccggtcgccaaatccaacgttatttacgacgtgaagccatgggacgacacaattgacatcaaagagattgaggcgaaagttcgttccgtccaatgcgacggcctcgtttggggcgcttcaaagattttacctgttgcatttggcgtgcagaagcttcagatctgctgctgcgtcgaggatgacaaggtttctacggactggctcgaggaacagatcacagacttcgaagacctggtccagtcagtcgatgtggtggcgtttaacaaggtttaaaggaacgattgatcttttaccatttgttaatttttgttgttgtttcattttgttaacagtaaaagctgaactatcaaa

SEQ ID NO: 48996 - DNA, 468 bp, Heterodera glycines
  SCN-specific regions: Sequence locations=1-88,111-438
tatgactacaaaaatttcttcggcagtgtgctggtgatcactttggacgattttaaaaaggtgaacggaatgtccaacgaattttggggctggggcctggaggacgacgacttttacctcagattgaaggcggcgggaatggccaacaaaatccgtcggccgtccaatttgagcaccaatcggtccaacacatttttacatttgcacacgcggaaccgacgaagggatttctcagtggaagaatccaggaaaaaggctttcgtcgcggtgccgagccgttgccgaacggcgaaattgtgccattgtcaatcgcgtcactcttttggggctgaacaacttttggcgtgtgatttttaacgccgacaaaatacattttcaataaaaaaaatgagcaaatgtttttttgttagtgcttttgataaacaatttttccaaagcaaaaaaaaaaaaaaaaaaaaaaaaaaaaaa

SEQ ID NO: 48997 - DNA, 1374 bp, Heterodera glycines
  SCN-specific regions: Sequence locations=1-147,174-339,363-809,831 -1108,1132-1200,1269-1374
cgcaaggacaatcgcgcagtgcaaaaactccgccgagaagttgaaaaagccaaacgggcgctgtctgttcagcatcaagtcaaacttgaagttgagtcgctgattgacggcgaagacttctccgaaacgctcacccgagccaaattcgaagagctcaacatggacttgttccgagggacgcttaagccggtgcagaaagtgctcgaggatgccgacctgaagaaggaagacatccacgaagtcgtgttggtcggaggttcaacacgcatcccaaaagtccagcagctgctcaaggaattcttcaatgggaaggaaccgtcccgcggcatcaatcccgacgaagctgtcgcctatggtgcagccgttcaagcaggagtcatttcgggggaggagaactcagaaattgttctgttggatgtcaaccctcttacaatgggcattgaaactgtcggtggagtgatgacaaaactgatcactcgcaacactgtcattccgaccaaaaagtctcagatattttctaccgcggcggacaatcagccaactgtgactattcaggtcttcgaaggagaaaggccgatgacgaaagacaatcatttgttggggaaattcgacttgaccggcattcctcctgctccccgaggcgttcctcaaatcgaagtcacttttgagatcgatgtcaatggaattttgcacgtgactgccgaggacaaagggactggcaataagaacaaaattacgatcaccaatgatcacaaccgactgtcgccggaagagattgagcgaatgatcaacgacgcggaaaagttcgcagaggaggacaagaaaaccaaggaagtggtcgaagcgaggaacgagtttgagtcgtacgcctactcactgaagaaccagctcggagacagtgaaaagttgggaggaaaactcagtgcggaggacaaaacgaccatcgaaggggctgtggatgaggccatttcgtggttggactccaacaaggacgcgccacctgaggagcttaaggagcggaagaaggacctcgaggccaaagtgcagccgatcatcagcaaactctacgcagggcagtcgcctccgcccggcagcgaaccgccgccgactgaggagaaggacgagctgtgaacggtggaatcaccaagtgctaactgtgacgactttccttggtctatcccccttccttcccccactatctctttggtttttcatttatttatgttattggtatttttcagatcttgattctgtttttgtttttttttggatttatcctatctcatttcttgatcgagttgttgtgtggatatgtacggttttgttgactattttgtgcagcgttatatataaattctgcgataacctaaaaaa

SEQ ID NO: 48998 - DNA, 776 bp, Heterodera glycines
  SCN-specific regions: Sequence locations=1-660,682-776
gtccatttaagccattaaaatgtcgtggatcctcgactggttttctggcgtgctcaactatttgggactaaccaaaaaaagcggcaaattggtgtttctcggccttgacaatgcgggaaagacgacgcttctccacatgctcaaagacgaccgtattgctcagcatgtacccactcttcacccaacgtccgaggaactttcactcggtggtattcgcttcaccactttcgatttgggtggtcatgtgcaagcgcgtcgtgtatggaagagttactttcccgcattggacgccatcgtttttttggtggacgctgccgatttggaacgcattcaggaggcacgagaagaactgtggagccttttacaagacgaacaagttgccaatgctccactgctcatcctgggtaacaaaattgacaaaccgaatgcactcggagaagatcagctcaaatactacttgggagtccaacaatattgcactggcaaaggacaagtttctcgagccgacttgaccacgcgaccgttagaaatgttcatgtgttcggtgctccggcgtcagggctatggggagggattccgttggctgtctcaatatttggactgattgaatgaattgctttgaccattgctgtaaacgatcggaaagacggctggaatttgttcgataattcaaaccatttgtgcacatcatttttacttgggttaagccgactttaagttgtattactataaaattttatttcccgatatccgtgataatgaagaaattaaaattg

SEQ ID NO: 48999 - DNA, 689 bp, Heterodera glycines
  SCN-specific regions: Sequence locations=1-689
acctcaaaaggaggcaagtttgagattcagtttctttttattacaaataaatgggacgtcgtatccgagctcaacgcaaaggacggggtgggattttcaaatcgcacagcaaacatcgcaagggcccggctaaattgcgcccagtggattactccgagcgtcatggcttcatccgaggcattgtaaaagacataatccacgatcccggccgaggggcgccattggccattgtacaattccgcgatccatacaaatatcgggtgaagaaagagacgatgattgcggcggagggattgcacactggacagtttatttactgcggcaagaaagcacaagtccaaattggaaatgttatgcctattggagaacttccggaaggtacgaccgtctgcaatttggaggagaaggccggtgaccgtggacgtttggcaaggacttcaggtaattatgccattatcgtcgcacataaccccgacacgaagcgcacgcgaattcgtcttccatctggtgccaagaaggtcgttccatccgccaaccgtgcaatgattggcattgttgctggcggtggtcgcacggacaaaccgcttttgaaggcaggccgagcctaccacaaatataaggtcaaacgcaactgttggcccaaagttcgtggggtggcaatgaacccggtcgaacatcctcacggagga

SEQ ID NO: 49000 - DNA, 676 bp, Heterodera glycines
  SCN-specific regions: Sequence locations=1-51,73-202,224-228,251 -473,497-676
attttgcacctttttgccaccttttaagcctaataattaacaaatagcacgacaatttaaagagttgcaaaatgaccgcctctttgcaacaaattcgagcccaacccggctggacggcggacaaatgcaaagagcaaattgaggtggccaagagcgagaatcggacattccaacgccaaacgctgcaggcgcatctggtccatttgctgaacaaagagcacaaattcaacgaggccatccaattggctgctcaacttgtgcgcgagctgaagaaggtggacgacaaggatttgctggtcgatgtgcaattggaggagagcattggcttttaccatctgtccaactacacaaaggcacgtgccgagttggtcagcgcacggactatcgccaacaccaaatacactccgcccgccatgcaggcccgtctcgacctccaatcgggcattttgcacgcggccgacgaccgcgacttcaagacggcctactcctacttcttcgaggcgttccaggcgttcgactcggtcaatgagtcggcgctcgcgcagcaggcgctgaagtacatgttgctgagcaaggtgatgttggaccagtcggacgaagtgcactccatcatgacgggcaaaacggcacaaaaatatgccaaaacggagacggaggcaatgcacgccatcgcaga

SEQ ID NO: 49001 - DNA, 593 bp, Heterodera glycines
  SCN-specific regions: Sequence locations=1-593
tgaaaactctgcaaccagcaaccaacatcattttgcacatcggtgctcgcgcaatgagctcaatgtccgccgctggcggtgccattgccgcatccgtcgaacaacaaccggcggtggagccagatcgatccacattctaccataaagatttgtccattgtccgtgccactgctggacaaatgcagcccaagccgctgggaacggttgatcagatcaaatttggacatcacttttctgatcacatgatggaggtcgattggtcggacaccgcgggatggaatcagcccgaaattagcccgttgcacagtgttcagcttcatccgggcgcaaaagtgcttcattatgcgattgaactgttcgaaggcatgaaggcttaccgtggcattgacgacagaatccgattgttccgtccagaaatgaacattgcacgcatgaagcgtaccgcggcacgtgcggcacttccggattttgatgcggaagaaatgctgaaggtcatcgccgagctggtccggcttgatccggaatgggccccctacttcgccccctcctccctgtacattcacgccaaattgcaccgcactgatccaaggctt

SEQ ID NO: 49002 - DNA, 652 bp, Heterodera glycines
  SCN-specific regions: Sequence locations=1-86,120-143,168-191,215 -320,344-495,530-542,566-583,605-652
ttgagatttaatttattgtgcaaagctcttaaatctccgacttcaacatgggcaatatgttcgctaatctgttcaaagggcttttcggcaaaaaggaaatgcgcattttgatggttgggctggacgctgccggaaagacgacaattctgtacaagcttaaactgggcgagattgtcaccactattccgacaattggtttcaacgtggagactgtcgagtacagaaacatttcatttaccgtctgggacgttggtggacaggacaaaattcgaccgttatggaggcactatttccaaaatacgcaaggactaattttcgtcgtggacagcaacgaccgcgagcgtgtgggcgaggcgcgtgaggaactgatgcgaatgctggcggaagacgaactgcgcgacgcggtgctgttggtatttgcgaacaaacaggatttaccaaatgctatgaacgccgcagaagtgacggacagactcggactgcacactcttcggaaccgcaactggtacatccaggccacctgtgccacgtcgggcgacggactctacgaaggattggactggctgagcaatcagctcaagaacagaggatgaacagcgagcggaccatgcgaattggaagatgacggaagggaatttgtttttgcgcgcag

SEQ ID NO: 49003 - DNA, 788 bp, Heterodera glycines
  SCN-specific regions: Sequence locations=1-418,442-666,688-764
cgcatccgaaagtggaagtgacaaaattgtgttccaaaagaatgttactgggcgaggtagccaggttttggatgacgccgagtttgttaaaatgtatgatcggtcgacttcgaaaaccttgaacacttcctcagccaatgacaacgcacagtcaaaccaacagaaagaacaggttcagaagtggaaagtcggtgatcaatgcatggcactctacgaagtggacggaaagtggtacccggccaaaatcgagcagatttcgcctgtaaaaaacacatgcactgtctcttacattggttacgaccaaaaggccattctgaagttggaggacattttgggtgaatccgatgttgaggctgccgatgaccatggcgatgagcgtgaagcggaagggacaagcggaacgactaagattgcggacaatgatgtgaaaaaagatgcatttccgatcccggatttatgtcctccaccaccgccatcgatgtttggaaagatagccgttgcgggcaatgagaaggaggcactgaccaacatgcttatgtcgtggtacatgtccggataccacaccggcttctaccagggtgttatgcatgaaaagacgacccgtcagaagccaaaatagataacgttgccatacggcttaaaaatcatctcactggttgctgtccatttttattgtctctcccctccctcagttattgtttaattttcttgttcagacataaattgccggtcaacatttccaaagcaataaacggatagcctttaaaaaaaaaaaaaaaaaaaaaaaa

SEQ ID NO: 49004 - DNA, 591 bp, Heterodera glycines
  SCN-specific regions: Sequence locations=1-493,516-591
aaaccatctgtactatgtaaaagatcaacaatccacaattttgtggcctcacatatgtgggccgaatttctccggcaaatccagtttatttgagcttccaatgcacgcaacgacgcttggcattgccatccatgaaacaatgcacgcactgggcctgcaccatgaacagctccgactcgaccgtgatctgttcatcaacatcaattgggcgaatataaatccgcaaaactatgacacatttgcgcgctcggagtctggtcaaatacactagctatggcgtccgatatgactacggttccatcatgcattacgccagcaacattgcgtccaaatcagctggactgaaaacgatgacggcaaagaccaaccccggtgccaacgatgcgcagatgggccaacggagagggctgagtgcaacggatgttgaggaactgaggcgaatgtactgcatgccgggttgcgcggatgccaacgtttactgcggcgtttgggccaccaacaatttgtgccaattggccagcacgaggccgtggatgatgcaaaactgtcgcaaatcgtgctcactttgtggctaaaggcaaaacgacggac

SEQ ID NO: 49005 - DNA, 536 bp, Heterodera glycines
  SCN-specific regions: Sequence locations=1-78,100-135,160-536
cagtttgttcacttcttcgtggttgcgcacagccaattgcaaatggcgcgggttgattcgcaactttttgttctccgtcgccgcgttgccggccagctcgagcacttcggccgccaggtattccaacaccgatgccatatagacaggcgctccggccccaatgcgctgagcatggcgaccgtggcgcagcaaacgatggatacgtccgacgggaaatgcaacgccagcacgagcagagcgcgtgctgtacgttccgctcgcagcaatcttcacaaataccaccctttccgcccgccttcttcgccccttttccgcccgccttcgcttttccgtccgccttcgctttgccgccctttccgctagccgtcgtcttcgtagtagcttttccggctttcactggagacgccacttgagactcctgactgttggtcgtaccggtcgaagcaacggaggcaccacgattgtcagacattgagttgttgttgttgttggttgagatagagagagaaaaccaaaatatcagtgagatgagctat

SEQ ID NO: 49006 - DNA, 694 bp, Heterodera glycines
  SCN-specific regions: Sequence locations=1-672
caagtttgagatcaattttctgtttaaacataacgaaaaatgaagctgattgaatccagcgacatcgtcaaattcccagacaatgtcactttcgcgctcaacaaccgtgttgtgactgtgaagggaccgcgcggtacgctcaagcgcgactttcgccacttaaacattgaaattatgcgagaaaacccgaagctgctccgtgtgcggaaatggtttggcatccgcaaagagttggcagccattcgcacagtgtgctcacacattgaaaacatgatcaaaggtgtgactgttggatttcggtacaaaatgcgctcagtctacgcgcattttccgattaacatcacgcttcaggagaacaacaccgtcgtcgagattcgaaacttcttgggcgagaaatttgtgcgccgtgtcggactaccgcaaggcgttagcgctgtaatgtcgaccaaacagaaggacgagttgatcattgacggtaccgacatccaaaaagtgtcccaggccgctgctcgcatccaacagtcgacgaccgtcaaaaacaaggacattcggaaattcctggacggcatttatgtgtcggagaaggtggccattgccgatgaatgagcacacaaagataaaaacccattgttaccccttttttgttggtcaaatggataaagaaatgttgttaaaaaaaaaaaaaaaaaaaaaa

SEQ ID NO: 49007 - DNA, 492 bp, Heterodera glycines
  SCN-specific regions: Sequence locations=1-492
caagcttgagacaatttatgcgttttaccattcaattacttcaaaaatcgcaacgttgttataaacttctttttgcaaattacaccaaacaagttgcttctgtgtcgccgcttttaattcatcgtcaaaatttgataagtttttcggccttccgcaatttttgctcttcaattgagacgaaaaaggaggaaatcggccgaatcaaatcgcaattggcaatcatttttacgtgtaaagtctgttccacgagacaggggcctaagcaattctcgcgttcagcttatgaaaacggcgttgtgctgatccgatgcgatcactgcagaaatcaccatattattgcggacaatttgggctggttcagcgatttggacggcaaaaagaacatcgaagagattttggcatcgaaaggagaggcgatcaaaaaggggacggcggtgttggagatggaagtgccagcggaggaggagggggacaacgccaaatacagcaaat

SEQ ID NO: 49008 - DNA, 1316 bp, Heterodera glycines
  SCN-specific regions: Sequence locations=1-252,274-474,514-547,571 -595,623-697,745-762,785-1316
gatcgtttaatccacataaatcaattgcgcaaacgaagtccaaatggcagaagtcggaaactcgtacagaccgccgctaagcgaagagaaacaaaacgaactccgcgcaattgctcagaaaattcttcagccgggcaaagggattctcgctgctgacgagagcacaggttcgattggaaaacgcttcgatactattgggttggagaatacggagaacaatcgccgtcgctaccgccaacttttgttcaccacaccgagctttggacagaatcttagcggcgtcattctttttgatgagacattccgtcagtcaaccgacaacggagtccgatttgttgacgtcatcaaaaaggcgggagccgttgctggcatcaaagtggacacgggagttgtgccattggccggcactctcgatgaggggacgacccagggactcgacaaattgtcggaccgctgtgccgagtacaaaaagggcggctgtgactttgccaagtggcgttgtgtgctgaacatcggtgcccacaaaccgtcccatttggcattgatggagaatgccaatgtgctcgcccgatacgcgagcatttgtcagcagaacggacttgtgcccatcgtggagccggaggtgctttgtgacggcgaacacagcttggaacgatgccagaaggtgactgagttgactttggcctacacctacaaagcattggccaaccaccacatttacctggagggcactctgctcaagccgaacatggtcacccccggccaatcccactcgcccaaggccacgcccgaccaaattggtctcgccaccgtgactgccctccgccgttctgttccgattgccgtccccggcattgttttcctctccggcggccaatccgagatcgaggctacacacaatcttaacgccattaacagtgtgcccgggccgaagccgtggacgctgtccttttcctacggaagagcgctgcagtcgtcagtgatcaaaaaatggaacggcaaagacgagaatttgggcgatgcgcagaaagtgttgctgcaccgtgccaaggccaacggcgacgctcagcaggggaaatacaccggcgaggaggcagccgcgtctgccgctgaatcactttttgtggcaaagcacgcctattgaacagaagtgtggaatatgcgatgaataggcgcgaatccgagaatcactcatcatatattttagctggaggaattggcagaataatctgacaatgaacacaatgataattttgtttcatatttcattgttgtcactttccgtttggtgcacttaataattaacatatagtgat

SEQ ID NO: 49009 - DNA, 714 bp, Heterodera glycines
  SCN-specific regions: Sequence locations=1-474,496-572,594-714
taatttctttggcattcggacaaaagcgaacagatctccgcctagccccaactgatcatgaccgaacgaccttgtcgttgaaaatgcagcgcgacaaattgcgccaagcgtatcaacggtacgagcgcaacatcgccaaggacgcggagagagcgcgggcactgctcagagacggacgcaaagaccgagcattgttactgttgaaaaggaagcgcttccaggagacgatgatcaatcggatcggtttttttttggagcaggtggagcggacgatcaccgacatggaaatggcacagatcaacagggaagtgttcgacaaccttcggcttggcaccgaggcattgaaggcactgaacgagacaatttcgttggacgaagttgaacgtttaatggaggagagcaaagaggcgcaagagtttcaggaggaattgtccaccatgttgggccaacaaatgtcggaggaggacaacgacatggtggaggaagagttcgagcgaatgctctccgaacaaatgccggcagtgccaacagagcaaccgacggacacaaaagagggacggaaaacagcggacaaagagaggacaaaggaggagaaggagccaaaacgacggagggaggcggtggcgcaggaggcgacctaaaggcgtcggcacttcaaattggtgccatcgacgggtcggacaaatgccaaagacagtggccatcggctgcttt

SEQ ID NO: 49010 - DNA, 619 bp, Heterodera glycines
  SCN-specific regions: Sequence locations=1-35,58-619
attcacactccgtattcaatcgatatacctttcaatttgtctttactatgcctcttcattggacttctgtggacactcgcaacgcacttttgtgcgccgccgttccttccattggcgccttcgtgggctcgacgatggccatcaaagatcaggaattggttcaattcctcaagaaacaaaactttccttctttcgcccgttgttgcaaatacaattatttgctggccaacactgccgtcaccattccgttcggttacgcttcttatttggtctacaaaattggaggaggtgtcagttgcaccgactcaaaaatcgcattgggactgtacggtgcgacgctgctcagcggctgttttttggtgccaacgctcaaaaaacatgataccaaggcgctgactgccaacgctgttgtccttgccggactttccgtcgccacttcagtggctttctacaacatcgacaagatttccgcttattggaccatgcccttcactctttgggccattttatgcgctggacttacggtgaaggcgaatttcgatgcgccgcccgcgcagccgctcgatgcgccgcccgcgcagccgctcgaagcgccgcccgcgcagccgctcgaagcgcc

SEQ ID NO: 49011 - DNA, 640 bp, Heterodera glycines
  SCN-specific regions: Sequence locations=1-640
ataagaacaaaaaatccattgactgacgattaaatgttctcaacagatgcgcaagatatactcggtggtggtggtagtggatcccaattggccaagaaaagtgggttaccaacgatgaagttgaccaatttggacaaaaagaaaaaaatcacaacaaatggacagccaaaacggcctgtcggaatgcatcgggaactgtacaatctcttcgttcaccagggcaaggacaataacaaagaaaagatcgaattcgttgatgccaacacagacaaagaagggattttctctcgcaaaagcgcagctgggtaaacgtcctgtcagaaaatggctttggtgtccatttgagaatgaggcgagaaaggatggacttgcgcttaagcattgggaacgtgaggacaaacattcaacgccctactcctttgtgcagttcaataagcaacttgatgtgccttcttttacggatgaggaatatgaagaacatttggtggacccgcgttggactcgtgaacagacacagcacttgttggagctttgcaagcagtttgatttgagatggccaatcattgaggaccgatttgatcaaaattgtgccggaatcgaaaaagcatggaggacatgaaggagcgctattacgggttgg

SEQ ID NO: 49012 - DNA, 646 bp, Heterodera glycines
  SCN-specific regions: Sequence locations=1-250,272-646
taagttcgttttaatgccttccgctagagtttcttcggctgattcttctgccgtctctgtgtccaacaaaggcatttctcttggtctttcctcctctggcacttctccgagtaatgtcattgtttcctccgtgcctgtcaatagcggcacttttcgtggtctttcccccattggcaatgtttcttcgctcgttcgcgacgtcttcggccctttagcggccgttcgaaggcaaagtccgacggttcaagtcgccgcgggggcaggcggaggaataatcgcaggttacgtttttgggaagaccagcaaaatggttgccattctcctgggctcgaccgttctcttccttcagttcgcccaatgcaaaggctatctgcaaattcaaaacggaaaactccgagaggacttcgaggcggcacgcgacaaattgggcgaaatgatcgacggaatgggtgccattggcggcgaagcggtggtgggaatgattgacggaacgggcggccgtagttcgggaaatgagttattcaaaattgtgtctgacagtgcgcactttctctgcggaatcgtcggcggaattctcgtcagatttggcatgtcataatcagagggcggattaaacagcagcggtaaaatgtaatgtcttatatgt

SEQ ID NO: 49013 - DNA, 719 bp, Heterodera glycines
  SCN-specific regions: Sequence locations=1-719
gtttcgcttcctgttttatctttcttttctgtgggaattgatcaacaatccaacgtaatttctttgtcccatcctccaacggatggctccggcagcgccactccaatttgtggccggcactgcgctgaaagtggtcatcgtgctgctcaccatcgttgtgctcgttctattggacccctcctacgtcactgcgtacatttccatcaactatgagatcgtgctcatctacatcatttgtgcacttaccctcctctattgcattgtttcgatcatcatgtacgccattatgcagaaaagcgtgcgggaaggcgaagagcttcacctgaccaactgtgccctctccgagattgtcttcgctggcgccggaatgatttgctggatgctcgtctgtggcatcggtggcactgtcgcgcaacggacaatcattgagaccggtcaatacttcggctggctcggggcgtgtgccggcatcatcgtctgcctcttcatgggcgtgttggccgtttttgcgctggacattctcacgaacaaaattttgtcgccaacccgaaagtatcgctacagtacgccgcaaatgtgagagggggaatacgatgcaacgcgaacaaccatctccagctacagtacacacacataccaaataccaatacaaatttctcatttaccatttgctttttgtctcctgccaacttttgagtgtaagcaaaataaagagaatc

SEQ ID NO: 49014 - DNA, 433 bp, Heterodera glycines
  SCN-specific regions: Sequence locations=1-37,59-74,101-334,356-392
agaaagtgtttcgaatttgcatttgattcaatgacgaaaggaacttcatcgtttggcaagcgccacaacaaaacccacacgctgtgccgccgctgtggtcggtcctcataccacattcagaagcacacctgctcgtcctgtggctatccggcgaagcgaaagcgcactttccaatggtctgtcaagtccatccgccgacgcaccaccggcaccggccgaatgcgtcatctgaagcttgtgcaccgccgcttccgcaacggattccgcgagggagtgaccgcgccgcgcaaaggcggagtgaaagcgtgagaagagtgaagaaaaaaggcatcaaaaaatgatggaaaatgttttgttgttgactgattgttacaagaaaaaaatggtcatttaaaaaaaaaaaaaaaaaaaaaaaaaaaaaaaaaaaaaaaaa

SEQ ID NO: 49015 - DNA, 756 bp, Heterodera glycines
  SCN-specific regions: Sequence locations=1-455,489-645,667-677,707-756
ctaaagcctgccgctttttcattgttgtttcaaattctgtaaatctcttcaagcagaaaatgacgtatgacctcgagaccgctgaaagggctgcctatgcgccattctttggctacattggtgctgcatcggcacaaattttcaccgtgttcggcgcggcttatggcaccgcaaagtcggcggtcggcatttgttccatgggcgtgatgcgtcccgaattgatcatgaaatccgtgatcccggtcatcatggctggtatcatcggcatttacggcctcgtggtggcgatggtgctcaagggtaaagtgacctccgcttcaaatggttacacgttgaacaacggttttgcgcatcttgctgccgggctgacctgtggcctgtgcggtttgggtgccggctatgccattggcattgttggtgacgcgggcgtgcgtggcacggcacaacaaccgcgactgtttgtcggcatgatcctcatcctgatcttttctgaggtactcggcctttacggaatgatcgtggcactgatccttggcacatcatagaatgttgtggcccaaacaaagaacacacacaaatacaaacattacaaccgcacatattttcttcgtacgactcgaaaaaagaccacttttcttcaccgttttattattttttaagtttgatgcgttgtgaagaccaaaaaatttaagtaattttcatctctcactttctgatgatatatgtttctctacgataaattttgtactttcaaaa

SEQ ID NO: 49016 - DNA, 1338 bp, Heterodera glycines
  SCN-specific regions: Sequence locations=1-53,75-247,269-429,451 -914,938-1055,1097-1300,1322-1338
cgagcttatacacaccaatatttcaattctcccaattctataaagcaagtaaaatgtttcttcttttcttattatcaatgcttctacttcagacaaatggttggcgtgcccgcgagcgtgcaattgaattggccgactcggacgaatcgatcgaattgcagaacattggccaacggaaaacggacattcgaacaccgacagaacgaatgtctgctcttcgtcaaatgatcgaacgcggcttttccgattggaatgcttacaaacagaagcatgggaaagcatacgcggaccaagaagtggagaacgaacggatgctgacttatttgagcgccaaacagttcattgacaagcacaacgaggcgtacaaagagggcaaagtgtccttccgagtgggagagactcatattgccgacctgcccttttccgaataccaaaagctgaacggattccgtcgtttgatgggcgatagtttgcgccgcaatgcgtccacttttctggcgccaatgaatgtgggcgatttgccggaatcggtggactggcgggacaaaggatgggtgaccgaagtgaaaaaccagggaatgtgcggctcgtgctgggcattcagtgccaccggcgcattggagggacaacacgtgcgcgacaagggacatcttgtttcactgtcggaacaaaatctgatcgactgctcgaagaagtacggaaacatgggctgcaacggaggcatcatggacaacgccttccaatacattaaggacaacaaaggcatcgacaaagagacggcctacccctacaaggccaagaccggcaaaaagtgtttgttcaagcgcaacgacgtgggggcaaccgactcgggttataacgacatagccgaaggggacgaggaggacctgaggatggctgttgcaacgcaagggcccgtctcagttgccattgatgctggtcaccgttccttccaattgtacaccaacggcgtttactttgagaaggaatgcgacccgcaaaatttggaccatggtgtgctcgtggtgggctacggcaccgacccaacccaaggcgactattggattgtgaagaacagctggggcacccgctggggcgagcagggatacattcgcatggcacgcaatcgcaacaacaattgcggcatcgcttcccacgcctctttcccattggtctgatcggagtgaatttgttgcccttgcgctgattcagagacatttcatttgattaatcgtgcaaaatgataagataattgataatccatcagtcaatcggtcgatttccattttttatgttcgcaattttattcacatataaataaataacttattttaaaaa

SEQ ID NO: 49017 - DNA, 789 bp, Heterodera glycines
  SCN-specific regions: Sequence locations=1-668,690-693,720-735,762-789
gtttgagtttccgccttaatttgcccttgataatttgttatttctctctgctgaccaaaaacaataatggtgggcatcacagagctggctgaagcgaccaaaaaggcgtttggcgccgggccactgatcgctgcgaactgtgcgacagcagagaatgctaagagcggcaatgaagtggagtttggctcgatgaagttctacgggttatgcggcattggcggaattctctcttgcggtatcactcacaccgccattgtcccgttggatttggtcaaatgtcggattcaggtcgaccctgccaaatacaaagggatcatcggcggcttcaaagtcactctccaagaggagggcgtccgcggcttggccaaaggctgggcacccaccgccattggctattcaatgcagggccttggcaaattcggactgtacgaaatgttcaagaatgtgtacgccgggatgatcggcgaggaattggcttacagctgccgtacctatttgtacttggccgcctcggccagcgcggagttcttcgccgacatgatgctggcgccgatggaggccaccaaagtgcgcatccaaacatcgcccggagcgccgccaacgctgcgcggctgtgcgccgttcatttaccggaccgagggactgatgggcttctacaagggactgccgccgttgtggatgcgccaaatcccgtacacaatgatgaaatttgcctgcttcgagcgcaccgttgaactgctctacaaacatgtggtgcccaagccagagccgaatgcacccaagcctgac

SEQ ID NO: 49018 - DNA, 842 bp, Heterodera glycines
  misc_feature (793)..(793): n is a, c, g, or t
  SCN-specific regions: Sequence locations=1-809,831-842
tgcgcatatgcaccgaagcatttgtattcgtcccaattggtttttatggcggatggatggatgaaaaaaagggcagcatttattatcgcatttgggaccatttgttctttggatttgccggcagaagcaaattcaaaagggttgctgagacgggttggcgcttcacttattattccatcatttggttcgtcggagtgtccgtgctctacaaagagccgcagttttccagtgtaatcgaatgctttcgcgagtggcccaaacatcacttgccaaatgatgtttggcaatattacatcatccagtcaggcttttacctttctctcctcttcagtctttttgcctttgacgttcggcggtccgaccattacgaaatggccacgcaccatttggccaccattttgctcctcttcatgagcttctctatcaattttgtgcgtgccgggacgctcattttgcttctccacgacagtgcggacgtttttcttgagcttggcaagctgttccgttatgctggctgggaccgggcggtgaccatcgacttcagtgtgttcatgttggtctggatcagcacacggcttgtctacttcccactgaaacttgtccggtatatgctgttcgacgcacccaagctcattatggagacctatcgatggaccgacattcttcaaaaaccgatcatccctcgcgtctttttggccgttctttgtattttgctgctcttgcacatcttctggacctatttgttgatcaaaattgccatcaaatccgtgaagagtggcgttgatgacatcanggaagatgaggacgacgattcggaggaggaagcggagaagaggaaaaat

SEQ ID NO: 49019 - DNA, 979 bp, Heterodera glycines
  misc_feature (940)..(940): n is a, c, g, or t
  SCN-specific regions: Sequence locations=1-818,840-898,920-979
tttatttttgactttccaaaatggtttccgttggacttgcaaatgctcagcgacttgttgcgattgtgactggcggtgcttcggggcttggctgtgcgactgttcgtcggttggtcgccaaagggttcaacgtttctctgttggatttgccaatgtctgaaggagcgaaagtggtggaagaattgggcaccactgacaatgtgcttttctctccggtcgatatttcgtctgatgatcaagtgtattttgccatggacgcaacaacggagaaatttggtggtctcattgttttggccaattgcgctggaatcgctttcgcgcacagattgtacaatccgtcgagcagagcccaaatggacctcgacaaaattcggcgactcatcgacgtgaacatcttcggcaccatcaacgtgatcagacacgccctcccgctgctgattgacaatgtgccggacgaaaacgaccagcgcggagtgatcatcaacacttcatcaattgcagcctttgaaggacaaatgggacagaccctttattccgcttcaaaaggtgccgttgcatcattaaccgttccattggcgcgcgattattccaacaatggcattcgcgtgatggcaattgctcccggcttaatggacacgccattgctttcctcgttgccaccaaaagtcaaaaagttcctttctggcactgttccgtttccgaaccgattggggaagccggaagaatttgccgcattggtggagcatatcatcgacaaccattacttaaacggcgaaatcatccgattggatggtgggattcggatgaatgcttgagaaggacagcagcagaagggcacaattggctctttgatcacttttgttgactttttatctttgcattgttttttgttgtgcgtccattcccacaaccctttggattttataaattgccaaaggcngactggacaaaacatcaaaaaacaaaagccaaaaacaaa

SEQ ID NO: 49020 - DNA, 568 bp, Heterodera glycines
  SCN-specific regions: Sequence locations=1-259,288-568
gtgactctctttttcgtttctctccgttttcccatgtttacccctggcgacgatttctgcgccgcctgcggttccatcatgcaaactccgaatgaattgaccgccggctccggtgtcaccaatttcatcaaatgctccgtctgcgatgcaaaatggccctataaaattgtccacggccaattgcttagtcggcacgaaaggaatttcgagcagcgaaacgccgtgggggaagagcggcaaaaacagcagagaaaagagacggcgagggaagaggaggaggaggacgtaacggtggaacacgtgtgcccaaagtgcgagtggaccacggcgacttacaccacacaacagacgcggtcagcagacgagggacagacagtgttctaccaatgtgtgcgatgcaaacaccggagcatcgaatattcatagagagagggcgaagataagagaagagagacaaagaaagggcagacggatggacggacaaattgccacgcttttgagtctgtcgtctacgacaatcgcacaattttctttgactttttattggcaaaaaagttgttgagttgct

SEQ ID NO: 49021 - DNA, 551 bp, Heterodera glycines
  SCN-specific regions: Sequence locations=1-521,548-551
gtccaattaagtcggcagaaaaaaaagacatttttctgctttcggcccaaatacgaataatgagtgtcggtttgtcctcaattgtcgatgattctcaccagcgacaaagtcacttttgggctgagattctcccgcccggcgttggtcacaccaacgacatttcgggagatgccatttggacactttcgagctgtaaggagggccttggcgtgcatcagttgttgaacgaccgcgaagacacttattggcaaagtgatggtcttcagccgcactcaatcaccatagaattccaacggaaaacggaagttgactttctgctgatgtttttggactacaaactcgacgagtcgtacactccctccaaaattcaagttcagaccggcgcttcggtgttggatttggacgaacccaagtccctttccttcacagagccttcggggtggcaaatgatcgaccttcgccatgccgggacgaagcgaccggcgaatgtctttgtcatcgttgttcagattatccaaaatcatcagaacggacgggacacacacattcgg

SEQ ID NO: 49022 - DNA, 595 bp, Heterodera glycines
  SCN-specific regions: Sequence locations=1-44,76-595
gtttgaggaaacaaatgacaaagttcgaagagaccaaatcaaaattagaggcagaatttgaaaagcttcgaaatttggaaaaagatcgttcaaaatgcatgaccaacagacggcagttggagagccaactgacagagaattccatggtcaaagaagagttcgatcggttgaaaagcgatgccggcgttttcaagctgattgggcccgtgttggttaagcagaatttggaggaagcgaaacaaaatgtggcgaagagaattgattacattcggacggaaatcgaaagaattgagtcattgctgggcgatttggagaaaaacatcgaagtgcaaaaggaatccgtcgaacgaatgcgcgacactttccgacaaacgctggcggtggccactgccccaacggcgaattcgatcaacgcttaatgagtgaatggacgaggaccgatcagactgattgtgagactgatcacttctttcccaacccgaccaaatatttttttaacatttttgcccggctattatcatttctaaaatcgtttgttcgttttaaagtgaagcagtgttgttgattgattcgtttgttgatttgtcataatcta

SEQ ID NO: 49023 - DNA, 669 bp, Heterodera glycines
  SCN-specific regions: Sequence locations=1-378,408-669
ttttagattcaaatttattttcgttgtttcatttcctttcattcgcaatgcatcagtacaatctgctcgcaaaccgatcgttgctcttcactaaacgtttcttcgccgtcggtcctcccggcactaaggccacatacaagcggacgaagccgcacatgaacgtgggcacaattggacatgttgaccacgggaagacgacactttcgtccgcaatcacaaaactgttggcagccaaaaaacaatgcaaaattcctgaagtatgacgaaattgacaatgcgccggaagagcgctcgcgtggagtgacaataaacgcggcgcatttggaatacgaaactgacaacagacactacgcccacgtggactgtccaggccatgcggactacatcaagaacatgatcaccggcgcagcacaaatggagggcaccattttggtggtggccatcactgatggaccaatgccacagacccgtgaacatttgctgttggcacgtcagtgtggcattccgcaggagaacatttgcgtgtttctgaacaaagtggacgaagtcagcgacgccgagacgcgcgaattggtcgaaatggaggtgcgcgaactgctcaacgagttcggctacccgggggacacggctccgatcattgcaggttcggcactgtgcgccttggagggc

SEQ ID NO: 49024 - DNA, 1213 bp, Heterodera glycines
  misc_feature (1187)..(1187): n is a, c, g, or t
  misc_feature (1189)..(1189): n is a, c, g, or t
  SCN-specific regions: Sequence locations=1-768,790-1187
gtttgagagaacatgtcccaaactgaaaaggaactactggcagaaaaggtggacaggcagcccaatgaggaggcgaagccgacagcttctctaaatttgttcgacctcagtgtaatgcccgactcagaaacgagcattgaactcaaccaaatgcgagtggacgctgtgccggacttggcaaggttcacccaattacagtttcttggtctccgccaaaacttgttgacatcgttgaatgcgaaccttggccggttgaccacgcttaccgagttggagctgtacgataaccaactgactgaaattgccggcctcgaccagttggtcaaccttgtgatgttggacatgagttacaacagaataaccaaaattcaagggctttccacaatgacgaagttacgccgtctgttcctcgttcacaacaaaattaaacggatcgaaggcctggaaggtttggacgcgttggaactgctcgaattgggggacaaccgaattaaggtcatcgaaaatttgtgccatttggtcaatttgaatgaactgtttgtggggcacaacgacattcagcgaattgagggaatccaaacgctgataaagttgcgagttctcagtctgccggctaatcgcttgaccaaattggaaggattggacacactgacggagttggagcagttgcacctcagtgaccagggcattgaaagcctcgacggacttggcaatcagtcgaaactgatcattttggatgccgcgaacaacagaatcgtcaatttggatggcttgggacatttacagaaattggaggacctttggctgaacaacaacaaaatcgttgtttggtccgaggtggataagttggcccaacttcgcgccctcgacacggtgtacctggagcacaacccgttgtacaccacggacaccaaccagtacaggcgcaaggcgatgctggcactgccgcacattcgccagttggacagcaccgtgtgccgtcagcaaaaaaatgtggtggaggaagacacaaaacaaaacagcgaagacaacaacaacgcgaagccaaacagccaaagaagtgccgtggcgacgacggcacagaaaacttaatttattttcccgctatcaaacgaccaaagactgattgatcatttcacgtttcattagccatgtaatttaacgtgtttaataaacctatgcatctnanaaaaaaaaaaaaaaaaaaaaaaaa

SEQ ID NO: 49025 - DNA, 583 bp, Heterodera glycines
  SCN-specific regions: Sequence locations=1-195,232-340,371-583
acaagattgagtttcattgctttttctattgaaaatgaccgaacaaactgagcgcgcataccaaagacagccgaccgtgttcttgaacgacaagttcagaactcaaggaattggaaagaaggcggccaacaaagaccgttattggaagaatgttgggcttggctttaaaactccccgtgaggctattgagggcatatacattgacaagaaatgccctttcactggaaatgtttcaatccgaggccgaattctcaccggagtagtcatcaaaaacaaaatgcagcgaacgattgttatccgtcgcgactatctccatttcgtgccaaagtaccgtcgttatgaaaagcgccacaagaacatgtctgtgcattgttctccgtgtttccgggatgtgtccattggtgacatcgtcacaattggcgaatgtcgtccgctgagtaagacggtccggttcaatgtgctcaaggtgatcaaagcatcgggggcgaagaaggcgttcgacaagttttgagagacccttatttgaccaccctattcattgttgctgtttgttatgacaaaattttggttgaaaaaaaaaaaa

SEQ ID NO: 49026 - DNA, 699 bp, Heterodera glycines
  SCN-specific regions: Sequence locations=1-699
gtccatttaagattacctaattagttaattatcttcaaaatggacatgagtgaattgtgtgcaaaagttaatgcaatttataagaaggaaacggaccacaaagtgcaatcggaaggacttcagaaactgcttgagggggtgctcacctccgtgccgtcggataatttgaagcaaattaccgaggccgtgagcaatttggtcgagactgtggtgaacaatgagagtacctccatggtcgtgtcccgtcaattcatcgccgacatcgcttcctatttgagtcagccttcgctgaacaccgcactgatcaaaggcattggcgaggccgtgctcactcagcttcatgcacgtgcacttgcctacgaggagcagagcacccaaatccgcatgattctggccaatgcgcttgagcgtgaccgccaatttgagcaatccgcgcggacgcttatgggcataccaattgaaactggtcaaaggggctatcgccacgaattcaaaatggaactgtacttgcgaatcactgagctgtttttggaggccgacaatgtcgaggaagcggaccgacacgtgaaaagggcctcacttttgcagcaggacgtgaaggaggaggccctggtcatcaaatacaaggcactttacgctcgcgtgttggaccgtcagggcaatttcacggaggcggcgcaccgttaccccagctatcgc

SEQ ID NO: 49027 - DNA, 739 bp, Heterodera glycines
  SCN-specific regions: Sequence locations=1-177,206-344,381-674,697-739
ggattatcacttgcaggcttcatcgctatacgtcctttaccgcgcgccgccctcgtatctcactccaacgcaacatcaatctaacatgggctgacactgttgaggttgccgccgccgaggtccacgttgcgtcgaccatgactgtggaggaagccctccaggacgtgctcaagcgttccctcatccacgacggccttgcccgtggtatccgcgagtccgtcaaggctcttgaccgccgtgaggcccacctttgcgtgctcgcccaatcgtgcgacgagaaggaatacgttcgcctcatcgaagccctctgcgccgaacacaacatccgcctcatcaaggtcgaggacaacaagaagctcggcgagtgggccggtctctgcaagatcgaccgcgacggcaacccccgcaaggttgtcggcgcctcggtcgttgtcgtcaaggattggggagaggagtccgaggctctcaacatcattctcgagtacttcaagtcccaataagttgggtcctctgcgaggttggtcggcgcacgttgcgcacgcatgattgtcggtttgctcgctcgctggcgttcccgggtttctcgttccaagattgacctcggcgctcgggttttgttggttgcgagtcgagccggtttctttgtctgtgtgtgtttctgcgtgccttcccatcagcccattgtactttttcttgaatgcaacgttgcgtgtccttgtggcacactcattttcgcttt

SEQ ID NO: 49028 - DNA, 852 bp, Heterodera glycines
  SCN-specific regions: Sequence locations=1-527,549-852
attaaaatactagtttttattttttgaataatggacgatgatgacgcaatcggtggtgctgaggcattcaaatgggaacaagcttacacggaagggctgaacattcgttcggtgctccaagaggacgaacatggctccgtcgaggagtccatccgtcggttggtcatggacgagaagcgacagcgacggatggaccgactgccggccaaaatccgactcggaatgatgcgttatgtccatttggctgtcgattgttcctccgccattctctccgccgatttctttccctcgcgtctctccgtcgcgttggaatgtcttcgtaaattcgtcgacaaattcttcctgcttaatcccctctcccaaatgggactcatcgctgtgcgcgacaaacgcgccgagcgcatcagcggatttaccagttctgtccaatttctgctcgaatctctgcaggacatcagttccaccaattgtggtggtgaattctctctccaatctgtcctccaatgcgctcttcactctttccaggcttttcctttgccttttccctttttaaattcgttcgctttttagggtttgcccgcccattccagcaaagagtgcattcttttgattgccagcttaagttccgtcgatgcgtcccctctccgccacactttcgagcagctcaaaatgcgttccgtccgctgctccatcgtttcatttggtgccgaagtgttctcatttaaacgcctttgtgcgacaacggagggcaaatacagcgttgccctggacgaacagcatttggagcttctgcttgacgaacatgtccaaccgccgcccgtccaacgccgtccgggtcagcaggactcaatc

SEQ ID NO: 49029 - DNA, 461 bp, Heterodera glycines
  misc_feature (447)..(447): n is a, c, g, or t
  misc_feature (460)..(460): n is a, c, g, or t
  SCN-specific regions: Sequence locations=1-24,46-318,340-461
gtttgagtttacataaatagaaaattgcattttaactgttattccgaaattaaatgttcgcccatctgacaagagcagagcgttcaggctgtatttttaacaggattctcggcttgatcattgctggccatttgaaatgggaacaacggccgctttggttcgacgcttatgtcgcccattcaccgcattacgagccaaaatgggacatcaaaatgccgaagcgtgacgaaccgttgccacaaattttctaccaagaggaccttatcagagccaagaaattgctggagatgcgcaacgaagaaccgaagtatgagcttgatcagcaacaacagcagcagcctgatcagcttaattagttttccgattttgatgaatttgtgttttctattattattttttgtttattttcgtttgagattttagagaaaaaaaagtcgcgtaaaaaanaaaaaaaaaaaana

SEQ ID NO: 49030 - DNA, 1851 bp, Heterodera glycines
  SCN-specific regions: Sequence locations=1-904,927-1141,1163-1851
ccacccgaaaaatgtcggcgtcaattccaaggcgttcttctcaggattcgctggcagaaaaagtgaaaagcaaggagctgatctacgaggccagaatgaagatccaggaacgactgaaggaactcggtttccccgtccaaaacacaacggtcaaagggccaagtggcagcgaacgtttcagagaaactgtgctcaaacccgaggaggcgagcgcattcactcagttgcacatggagaagataaagcgacttaacgaggcaaggagtcgggctgccaaaggcctttccactctgaatttaaagacaccgtcgttagtttttgacacaatttctgccgaaaagcaaatggtggcgaagcgtgaaccctcggggcctatccgccaatccttggagaaggccgattcgtcgactatagaactgaaaaaatctgctgcttctccacatggccaacaaattgaacccgattccagcacaagtgccgctcagcaagaatttttggacccgcgaatttacataaaaccggccgctcgccaaaaacgacactttgaattcaaactccctggagagtatgaaaaactggccaaaatccagcggtcaaaagccaaattggagcgacttcagtctgaaattgaaaaggcggcaaaacaaacgggcatttcctctgcggtcaaattggcaattgtgacgcctagcggactgccggagacgagcactggcgaatacattccgttggtggagtggtgggacgaagtggtgctcgggaacaactgcaaagactacaacgaaatgccctcgcaggagttggccccggttgaacgttacgcggattctgtcaccgatttggtggagcatcccatccaactgaaaccaccggacgaaccattgcaaccgcaatacattaaggcttctctaaccaaaaaggagaggaaaaaattgcgacgccaaaaccgtcgcgaggcattgaaagaaagagcggagaaaattcggcttggattggaaaaaccgccggatccaaaattgaaaatcagcaatttgatgcgcgtgttaggcaccgatgcaattcaagacccaaccaaaatggaagcgaaagtacgaaagcaaatggctgaacgggcgcaaaagcacgtggaggacaacagaagcagaaaactgaccagggaagagaaggccgccaaggccatccggaagattggggaggacacaactttggcagtgcacgtcaccgtttttaagatcaaatcgttggcaaaccctgcgaagaaattcaaagtgatgatgaacgccaaacagttgcaaatgaccggtgttgtcattgtgttggaagacataaatgttgttgtgatggagggaggtcccaagcagcaaaagttcttcaaaaacttgatgctcaacagaattcgatggtctgctgaaattgccggtcaaaagcacgaccgaagggcgacgcataacagagcgaatgaaatgggagaagggacggaggatggaccagcggaagagaagaggaacgagtgcgttttgatttgggagggcgtcgtgcaaaagcgagcattcactggtgagccacgcttcactcctgtgaccaatcataagcaggcccgtgaactgctcgaaaagtacggagtgccacactactgggacctgtgttactctacgactgtccttctgaatgacgagacctgatgagagtgaacggctaaatgagactacaaattgactcaaattcattcagtttttagtgattttgagtttaatcgtgtaaatctgctgaagtgatgagatttatcggtttttatatttgagttgttcttaactgtcgacagaaaaatgtatcacagaaattggaccaaag

SEQ ID NO: 49031 - DNA, 623 bp, Heterodera glycines
  misc_feature (598)..(598): n is a, c, g, or t
  misc_feature (601)..(601): n is a, c, g, or t
  SCN-specific regions: Sequence locations=1-595
caagtttgagctactctattcaaatcaaagtgtaaagcgtattcaaaatgcttatgccacaaggtgatcggaagaaaatttacgagcatttgtttgaggatggagtttgcatcgcgaagaaggactactgcttgaagtcgcatcccgaaattaagggagtgaagaacctttacgtcatcaaggcattgaagagtcttgcatctcgtggacttgtcaaggagcagtatgcctggcaccactattatttctaccttcaacccgaagggattgtccatttgcgtgcttaccttggacttcctgacgatgtgttgccgaacacgcacaagcaaaggaccgacgctattcaaaaggcttttgcagacaaaggaggccgaggtccgattcgcgccgacaccgatcgtgggggttatcgcgctgccgcagataaacaagcggaggctgggcctggtgctgctccgattagtcatcgtcagggcttcggacgtggaggaggtgcccctgctccccaataagaacttcgggaatgcttgatctttgatttctggagattttttttgttgattttttggttataaagtgttgatcagttgacatgaanaanaaaaaaaaaaaaaaaaaaaaaa

SEQ ID NO: 49032 - DNA, 843 bp, Heterodera glycines
  SCN-specific regions: Sequence locations=1-170,192-267,292-687,715-843
acttgatttattccccactttaaattgaaggattagttaaattatattggcagtaaaatgggaattaagtttctcgagtttgtcaagcccttttgtgggttcgttcccgaggtttcaaagccagaacgaaaaatacagtttcgggaaaagatgctgtggacagcgattacgttgtttgtttttcttgtgtgctgccaaattcctctctttgggataatgtccacggacagtgctgaccccctctattggctccgtgtgatcatggcttccaacagaggcacactgatggagttgggcatttcgcccattgtcacttccggtctcataatgcaacttctcgctggtgcgaagattatcgaagtgggcgacacgccaaaggaacgggcattgttcaacggggcgcaaaaactgttcggaatggtcatcactattggacaggcaattgtctacgtggcttccggaatgtacggaaacccacacgaaatcggcgccggaatttgcttgcttatcgtaattcaactcgtcgtggctggtctcattgtccttctgctggacgaattgcttcagaaagggtatggacttggctcgggaatttcgctgtttatcgccacaaacatttgcgagaccatcgtttggaaggccttttcaccggcgacgatgaacacgggccgtggcacggaatttgagggggcgatcatcgcacttttccatctgttggccactcggaatgacaaagtccgtgcacttcgtgaagctttctaccgacaaaatttgccaaatttgatgaatctgctggccactgttctagtttttgccgtcgtcatttatttccaaggttttcgt

SEQ ID NO: 49033 - DNA, 468 bp, Heterodera glycines
  misc_feature (447)..(447): n is a, c, g, or t
  SCN-specific regions: Sequence locations=1-242,265-468
ggacacttatcaaaatgaccaaggtcaagactttcgaactccgcaccaagtcgaaggctgagctttccaagcagctcgacgacctccgtcgtgagctcctttcgctccgcatcaagcagcaatctggccagtccaaccagaagccgctcgagatccgcaacgtccgccgctcgatcgctcgcgttctcaccatcatcaaccagtccaccaaggctgaggtgctcaaggagtacgccggcaagaagtacatccccattgacctccgcgccaagaagacgcgtgccatccgtcgcgccctcacccccgccgagcgcaagatcaagacgacccgcgccctcaagaaggccaagcacttcccccagcgccaattcgccgttcttgcgtaagttttggatgttggaatcttgtgttacacggaatcaatgcatggttgactgctgctgaacnaaagactgaaaagaatggaca

SEQ ID NO: 49034 - DNA, 543 bp, Heterodera glycines
  SCN-specific regions: Sequence locations=1-105,138-381,403-543
gtaggatacaagtattaaaataatatgccgccaaaaacctcgaagaaaactgacccaaaagggggaaaagcggcaccagcgaagaagaaagagggcggaggaggagggaaggccaagaagaagaagtggtcgaagggaaaggtgcgcgacaaactcgccaacatggtcttatttgaccaagccacctatgacaaattgtacaaggaaatcatctccgtcaaactgatcactcccagcgttgtctccgaacggctcaaagtgcgcgcttcgctggccaaggcgggcctggaagagttgcaccagaaggggctgatcaaatgcgtggtgaagcacggttcccaattggtgtacacacgggccaccaaagcggaggaagcctaagaaaagggggaaacggggcgatttggtttttccttttttttagattgttgatttgttgaatgaatatgtttttttaatttttaaaaacatttgttaacctgtcactatatgaagcatatgcaacatattaattcatattcgtttttaaaatattagcggtat

SEQ ID NO: 49035 - DNA, 620 bp, Heterodera glycines
  SCN-specific regions: Sequence locations=1-568,590-599
gagattatacacattttctaccgatcaaaaatgccaccaaagtttgacccaactgagatcaagatcgtttacctgcgttgtgtcggtggtgaaattggtgcaacttctgcgcttgcacccaaagttgggcccctcggattgtcgcccaaaaaaatcggcgaagacattgcaaaagccacccaggattggaaaggactgaaggtgacgtgcaagctgacgattcagaatcgtgtcgccaaaatagacgtggttccatcggccgcttctctgatcatcaaagaactgcgtgaaccgccaagggaccgcaagaaagtcaagaacgtgaagcacagcggcaacctgaccattgaacaagtgatcaacatcgctcgtcagatgcgcccccgttcaatcgcacgaaaattgcaaggcaccgtcaaggaaattttgggcaccgctcaatcggttggctgtaccgtcgatggacaacaccctcacgacattgtggacatgatcagggcgggagagattgaagtgccagaagaatgaacggaccggtgatacgctgagaaagtttggagaaagaatcaaatttgttgttgtgttttggacttttccgttaaatttgatttattttaaaa

SEQ ID NO: 49036 - DNA, 694 bp, Heterodera glycines
  SCN-specific regions: Sequence locations=1-83,105-694
gttttgagatttgacatccctaaaataagcatttgataatgagcaatcttcgtctgcaaaagcgcttggctgcttcggtgttgaaatgtggtaaaggaaagatttggctcgacccaaatgaagtcaacgagatttcgaatgctaattctcgtcaaaatgttcgacgtcttgtcaaagacggtctcattatccgcaagccggggaaagtccattcacgttatcgcgctcgtgaacgtttggaagcacgcagaaagggccgtcacatggggttcggcaagcgtcatggtactcgcaatgcgcgtatgccagagaaagtgatttggatgcgtcgaatgcgtgtgcttcgtcatttattgaagcgttatcgtgatgctaaaaaaatcgacaaacacctttaccatgagctctacctcaaagcaaaaggaaatgcgttcaagaacaagcgcaacctcatggaatacatctttaagaaaaaaaccgaaaaccaacgttctaaacagcttgcagaacaggccgaggcacgtcgcaacaagaacaaggaaacccgcaaacgtcgcgaggagcgtttggttcagaagcgaaaggaacttttgcacaaaatttcggagagcgagaaagagaagacgcctcagcccctagtgacaaagccagccgagaaagagcaaccgaagccacaacctgtcgctgcacggac

SEQ ID NO: 49037 - DNA, 692 bp, Heterodera glycines
  SCN-specific regions: Sequence locations=1-191,216-667
gtttgagactaaccatcctttcattgactctgtctttttcatcttaatacgaaatggactctcccgctggtgctcagccgtcgaacccaaacgctcaacaacaaggtggagcccgaccatcgaacaaacgactccagcaaacgcaggcacaagtggatgaagttgtcggcataatgaaggtgaacgttgagaaagtgttggagcgtgaccagaagctgtcccaattggatgatcgtgctgatgctcttcaagaaggtgcgtcgcaattcgagaaatctgccgcgacgctgaagcgcaaatattggtggaagaacataaagatgatcgtgatcatgtgcgcaattgtcatcctgctgatcatcatcatcgtcatttgggctggaaaatgaacgacgtgtgctgcggtcggatgctcgagaatttccaagtcttcgtgaattgaaaagatccatttacaaacaaaacccgcgaatctaatttgaccagagttcttgaccaacaattcctaagtctgtttctcatctcctgtttgtgtaccacccaaaaatccgagtacatacgacacttacttcggtcccttcccacattcctaattttcaaaactgtagagtacgcttggaatgcgatggattgacacattttatgtgatgtggataaactgaatatgtaaaaaaaaatataaaaaaaaaaaa

SEQ ID NO: 49038 - DNA, 791 bp, Heterodera glycines
  SCN-specific regions: Sequence locations=1-267,289-518,541-582,605 -706,728-730,767-769
atttttggctggcaatgacaacgaaaagtgagggggatgaaaataattctgtggatgagaatggcgagccctctggcaatcacgcggagaattgcagcaccgggccctcttcgcctgccccgtcagtgtcctgcgaggcgtgcggtaccaatttctcacaacttgagaaggatgcttttgccgcagtacgcgaaatggcgccgtacgtcaaaaccatcgccatttccgaaatactatcccgcactcccgagctcatattcctcaacattgtcactttggaaaatgagagttattgcgtggaactcactcaacgaggctggcgggtgagttccgaccgtctcgactgtatgaacggagacattcaaaagttggaaatgcacgtcacttactacgacgccattgagcagctgttggacagcttaagcgagcagtaccgcgagaattttggcgccgcactctcttcaaaactggccgctctgcagacggaacagaagcaaagacagcaagacggagaatcagagggaaacggcggaggggcggcagagagaagcgacgcggggcaaaggacggacgacgagccgaactgacaatgagcggagcaaagaaaagcacagaatgtttgtccattttgattgtcccacccttcgttggtctgttactcatttacacttctccgaggcgagtgtcccatttctcttccattcccttcagtttcattttgaccgtaatcatatttaaaaattttttgtaaaataaaaattattttgtcaaaaaaaaaaaaaaaaaaaaaa

SEQ ID NO: 49039 - DNA, 698 bp, Heterodera glycines
  SCN-specific regions: Sequence locations=1-218,241-698
caaataagtgccaaatttaatgccaaatgttgtctcaaattgaggaccatctcttcctcagtttttggattgaatatgctcaaaagtatttgattgatgctaagattggccgtgttctcactgttgcacttgaccatattccccaaattcggcaccttcaaaatgtggagtaccgacacattcgaatggctgatgtcgagtcggaggagctgttggcgagtcagaagctgcaaaatgcattggattacgtcgaagactcagtgaacagaggaatcaacattgttgttcattgtcaatgtggcataagccgatcggcaacagttgtgatggcttatctgatgaggaaatacaaatggaatgttaacgattcgttttcttttgtgaaagcgcgacgttcatgcgttcagccaaatccgtctttcttacgacaattggaagttttccagaagttggactatcgttgtgacttgctaactctgcgcaactcgaagctgttcaaggaattcgaatgcatttccgaaaatccatccgaaggtcaacttgtgacatttactcattaaatgaatcggcaaaactttctgttgggaggcgattttcgtgcaaaaaatgtcgctgcgatctcttctatgatttcaatattttatcacacaattttgttgttgccagcggccaaaatgaaagcgtaaagttggcaaaaa

SEQ ID NO: 49040 - DNA, 658 bp, Heterodera glycines
  SCN-specific regions: Sequence locations=1-566,588-658
tttgagtgcgattaacccccttttttgaactgtttgaattttctgatcagtttgtttttacatcattcaatggacatcgttgacgaccctttgtccgagccttgccatgtttgtggtgacaaatccaccggcacacattacggcacggtttcctgcaacggatgcaagggcttttttcgccgtactattttacgaagtcagaagttcacttgtcgtttcaacaagcaatgcgtcatcgacaaaaactatcgctgtgcgtgtcgcttttgccgcttccaaaagtgtctgagtgccggcatgaaaaaagaagcaattcaatttgagcgcgatgcgattggttcgccgcttccgttgaaaaggcggcgcgtcgccgacgacggccgggccgaccattccccgtcaccgaccggtggacggacagcgaccgatggcattgggacggcggtgggccgacccgtaatggcacaaggggacggaaagggtcagatggaaagtcctcccgagatttacgttgacatcatcggcacattggtggagatggagcaacgcgtcaattacgaaatgagtcttcgctatcgttctctgtgcggcgccgtctttccctcctccgtcggcactgacaacgcatcgtttgccggcgacgcttcgtccgttttca

SEQ ID NO: 49041 - DNA, 659 bp, Heterodera glycines
  SCN-specific regions: Sequence locations=1-659
tgagaatgcggccacccgttgacgaggattatcgcccgatccgcgtacttggccaaggcgcgtacggcgaagtttggttggtgaccagcaaagaaaatgagagagagcagttcgccatgaaaaaaattcccgttaaagcgacggaggagggaattccgcagagtgtcgtcagagaggtcgcttctctcgtcgcactcaaacagatgaaacacccaaatattctcaggctccacgacgcattcattcgccgaaagggcggcaccatcagtttgaacatcgtctgcgaaaagtgcgactgggacttgtgcgactttttgcgaaaaattccgaaaaatatgtgcgacgcgcagtgcaaatattttgcacgtcaaataatgacgggcattgatttccttcatgccaacagtattattcaccgtgaccttaagcctcaaaacattttggtgaacaaagaccacactttgcggatcgccgatttcggactgtctcggaactacggtctgcatgccaccttcaccaccgaggtggtcaccctgtggtaccgtagccctgagctgctgctccagtgcaagtacggtactgcggtcgatctttggtccgccggttgcattttggcggagctgtacacgcgcgacgcgctcttcagaggggatacggag

SEQ ID NO: 49042 - DNA, 858 bp, Heterodera glycines
  SCN-specific regions: Sequence locations=1-214,279-437,460-521,544 -716,739-750,779-858
gcaaaaataacgatttaatattttcacagtgaccagaaactttaatttggtgtgcttccaaatgtcatattcctatttgttcaaatacatcattatcggggacacaggggtcggcaagtcatgtttgttgctgcagtttacggacaagagatttcagccagttcacgacctgaccattggcgttgagtttggagcacggatgatcacaattgacggaaaacaaatcaaattgcaaatttgggacactgcaggccaggaatcctttcgctccatcacccgttcctattaccggggcgcggctggcgctttgctcgtttacgacatcactcgacgcgacacgttcaaccatttgacctcgtggctggaagacgctcgtcaacactccaattccaacatggtgataatgctgattggcaacaaaagtgatctcgaagcgaggcgtgaggtcaaaaaggaggagggggagcagttcgctcgcgagaatggacttgtctttatggaaacgtcggcgaaaacggctgccaatgtggaggaggcattcattgatacggccaaggaaatttacaggaagatccaggagggcgtgtttgacattaacaatgaggccaacggcatcaaactcggtcctcaacacccgcccagttcgccaagctctcccggtggtgcgccgttaggacgtgcgagcaactgttgctgaatttgaccaacggaatgcgaaagtgaaaaagaccgcaccgtcagaaactcacgccctcccccccccccttcccctccctctgtggataaatcaaagatttctcacaaatctgtatctttgacaaatttgtcgatcaagtcagcatcataaatacctattaa

SEQ ID NO: 49043 - DNA, 645 bp, Heterodera glycines
  SCN-specific regions: Sequence locations=1-7,29-245,269-645
tttgagatttgtttttgtgctttggtattccacgggttgttctccactcaatttgtgaagaaactgcacagcaacagcagtgaaaatggcctccggcgtgaaagtggacggcgagtgtaagcaggcatacgacgagctgcacaacaagcaccagttctcctttctgatcttccgtatttcggacgacgacacgacgatcattgtggagaacaaaggcgagaagaacgcgccgtactccgattttgttgaggagatgaagaaagtggtgggcgacggcaaacagtgccggtacgcggcggtggacgtgcacgtggaaattcagagacagggcaccgaagggtcgtccaacctgtccaaagtggtgttcgtccaatactgtcctgatgaagctccggtgcgtcgtcggatgctttacgcctcttccgtgcgggcactgaaggcgactttggggctggagagtctgctccaaatccaagcggccgaactgtcggacattgacgaaaaagtggtcaaacacgaagtgatgggtcgtcaacgaacctaaaattgccccgccgttactttcaacaaaaatgcgtctgattttctcttttcgcgcataatgaaggaaagttcgttaaaattctctgctgatcgatgataatc

SEQ ID NO: 49044 - DNA, 1087 bp, Heterodera glycines
  SCN-specific regions: Sequence locations=1-191,213-343,365-1087
cattggccactaatggaggaccaacaaggccaattgagatcacgaagggcacaaacacaacagacagaaacaacggtggaaggaccaactgacaacagaaatgggaggactgggggagaagaaacgacggcgaggactcatcgaaatgggggaccgaatgaggcgagttttcatggatatgtgaccagttttagaatttatgtccagaatttcaaaattcgcttttttgagtattattaaaaattaaaggagaattgaggaccgaaagaatgtaggcattgaccaagtaagaaaataaagttatgggccaaagaaactgaacattggatgcctaaaattagctgtccaaaactccaactttagggatataaatttttatcgtttttaatgaaaattaggaattttaaaggaaattgtgaaacggaaataggccactttaactgaatccgcctagccctgttaacgaggctgcccgtttagcttggctttcttcactggattctcgtcttctgtctcgtgggcactctctacggaatgatggtttggcaggaccagcgcatgcccttcggctgtctcttcgtctgaaaagggtaatttttcggaagagcgtgcccgagttgtgctcaatgcgctgacagatcttggacctcggcctagtgggtccgacaattgtgaaattcgcgcattccgaattttgacctcgaaaatcgagcagctcataacggcgattgagcgatttggcgtcaatcgattggaattggacgtccaaaggccaagcggctgtttcgacttacaatttctgtctgtgtttactctttgctaccacaaagtgaccaatttggttgttcgcattggaccgccaggccaacgggccactgatcattccattctgatcaattgccattatgacacgctgcccgacacgcccggcgctactgacgacgcggtgtcctgtgcgattatggtccacattttggaagtgtttgtacactcggaaaagcctttggaaaatgacattctgttcctcttcaatgctgctgaaaaaaatttcctgcaggcgtcgcatggttttataacggaccacccc

SEQ ID NO: 49045 - DNA, 680 bp, Heterodera glycines
  SCN-specific regions: Sequence locations=1-582,604-680
gaggtatatatcaacatacctaattatctgacctgcagttttagcagaatgggcattttaactgcttcgaaagtatgcactttgccacggctttcttccgctcgctctatgacttggtggtggggcccggagaaaaacaatgggcgcgaagttgttggccccactttccacggggatgaattttaccaagatcgtcttgaccgttggtacccgtccattcgatttcgcaaaaatgacgaagtgatcacgcccattcgccacaaggaattgggagattggaagaagttgagcattgaggagaagaagcttatctaccgctactccttccgtcaaactttggccgagtttgaggcactgacgccttatggctatctcacagtcactttgttcttttctatgcttgggcttactattctgtacgcttcgtttgttaggacttacgtgacaaaattcaatgaccgattgcctgacactttcgatgatgaatataaagaaagtcaggccgagcgccgtgtggtactggaaaggggcaatccttatggaccggcctactactacgattacgagaaaaatcgttggaaggactgaagtggacggaaaagtcctactcgaaattcgttggagtgttttttaattttaggggatttttaatggacatttcaaatttgcacattttttcg

SEQ ID NO: 49046 - DNA, 585 bp, Heterodera glycines
  SCN-specific regions: Sequence locations=1-585
gcattttccattaaaaaaataaaatggtgcgcacattgaaattccatgagaaaaagttgctgaagaaagtggacttcatcaattggccggccgagttggacaacagtcttcatgagaacaaaatcatgcgccgttaccatgtggagaagcgcgagcactacacactgtacaacaaactgtccagagagatccgagaaatggccaaacgcatccgcgagttggacgacaaaaacccgaacaagttggtgttggcacggatgctgctcggcaagctgttcgacatgggcgtgattccgaccgcggacacactcgagcgatgtgacaaagtgacggcatcgtccttttgccgccgtcgcctccctgtcgtttgccacaaaatgcaaatggcaccgacggttaggaagtccagccaactggtggagcagggccatgtccgtgttggtgtcgaaatggtcaccgatccggcctttttggtcacgcgaaaccaatcggatcacatcacatggacgcgggaatcgaaggtccgaagacatctcagcacttacaacaacgaattggatgactttgaggggtgttgatttgaag

SEQ ID NO: 49047 - DNA, 614 bp, Heterodera glycines
  SCN-specific regions: Sequence locations=1-614
atgtgtttttggctgttggaagagttgggtccacctctgagaacatcggtcaaaaagttgtttgggttgaagagcacaacaaacgccatttcctgatggatttgctcgatgccagtgagcccgaggcactaacactgattttcgttgaaaccaaacgcggctgtggagatctgagttacatgctccagcaagaaggctaccattgcgtagcaatccatggcgatttgaagcaaatggaacgcgagcgtcatttggagaacttccgcaacggaacggcacccattttggtggcaacagcagttgccgcccgtgggttggacattccgaatgtcaagcacgtgatcaattatgacctaccgaatgacatcgatgaatacgtgcaccgaattggcagaaccggccgtgtgggcaacattggaatggccactagctttttcaacgacaaaaaccggaacatttctcatgaactcactagtctgattgtggaagcaaaccaggaattgcccgattggctcgaagaaatggcacgcgattcaggccgacacggaggcggtgggggacggtcgcaccttggcgccgggtcgaaacgtggaggtggcgggaatcgtttcggg

SEQ ID NO: 49048 - DNA, 714 bp, Heterodera glycines
  SCN-specific regions: Sequence locations=1-714
gatcgaatgtggagctgtacacttgcacttcttcagagtgctcttccatcgactttctctttctcgtgattacatgggtggtgtatttctccattccaatcgcgcttccgcgtccccatcctaagctgatggcacgtgggcttcccccttcgacacagatccttatatgatcgtggagtgcccatcgtccgtatcttaaactctccacaaatttcgaaccgtcaaacaaataaaacttcggcactatcaatgccccggggcacgaccaaaacggcggcacagcgaaggggcgggcggagaccgcgagaagcggaagatcaccagctaacggatgaggacaaagaccgacgggcgaagcgacgcgagcgcaacaaacaagcagcggcacggtgccgacggaggcgggaggagaaaatgcaaagtttgcaggaacaggtggacgaattgcggaagcaaaatgaacgccgggagaatgaaatccgaaaaatgcgagaaaaagagcagcgacttttggaaatgttgcgactgagaaacggcggaattgtgcagcagcagttgcaccaccatttgcaagcagttcacgtccaacaacagcaccaatccgtcgctgatcatccgactgtcagtcggcccacttctcttcttcagccttttctggtcggactgaataacaaaagagattctgtgaagccccggcagtgccatcctcgtcct

SEQ ID NO: 49049 - DNA, 671 bp, Heterodera glycines
  SCN-specific regions: Sequence locations=1-197,219-671
gttttcatagtgacttttttccgtgctcctcagctgctcatgtttgaatacatcgaccaacttgacagtgagaacaaacacgaggaggccaattgcctgttggccaagcagagcctgaacaccggcttaaatcagcaggaaattctgtggcgacttgctcggtcatgtgttcagatggcgtacccgctcgacatgaaaaacccgaagaagaagaaactgcttgacgaaggccataagtacgcctgctccgcctacgagctgtgcagcgacgacttcaacgtgttgaaatggactgctgccgcggttggctcacggacggactttctcggcacgaaggagcgcatcgaacagggcaatttcttcagggatgttctcgacaaggcattggccatcaacccggaggagtacactctgcttcacatgcgcggcaggctcgtcctctcggtggcttctctgtcgtggattgaacggaaggcggccaccgtccttttcggcccgccgcccgaagtttcactcaacgaggcgatcagagacttcacggcggtgttggagttggcgccggattggctggagaacactctcttcctggccaaggcgtatttggccaacagcgacagggaaagtgcggtgcaccatttgaaacagctgatcgattcctaccagcagaacga

SEQ ID NO: 49050 - DNA, 445 bp, Heterodera glycines
  SCN-specific regions: Sequence locations=1-445
gccgtttctccctctttcaactttttgcgtcgtccgttgcctttgttggtctttcgtcgttccctttttaaaccgccattggactcaccgttctgtggcatttaccggacaaatggcgaaatttgccggacggatgacattttggtgtgccaacgcaagatgaactatcaccctggagcaaatgtccgccatcaacgggaccggaaccagcacttgttgaaagcggtctgcgacgggacggttgtgatcacacgcgagcactgcgaagtgaacccgaagaacgagtggatgtacgcgcagtacgcgtaccgcgactttgagaacatttacaagctgaccttcaacgtgataccacgacggatgtccaacacatttaaactgatcagcgaagaatgaatgaccgacccgaaattttgtgtattttcgttgttttttatgaatgaat

SEQ ID NO: 49051 - DNA, 858 bp, Heterodera glycines
  SCN-specific regions: Sequence locations=1-22,48-818
aacgagggtttggttttcaacattaaatttttacaatttaaatttacggatggacgcggaaacaaaaaattataaactcacttatttttcgtcgagaggaattgcggaacccatccgtcttatcctccattacaaaggcattccgtttgaagacgtcactttcagctcaactcttgccgatgagtcatcgcgagaaaaatggctgaagcagaaacaaaactatctttacggccaattgcccaacctcgaatgggacgagggaactgagcacaaagttttggcccagtctcaaacaatttgtcgttatttgggcaataaatatggtttggccggaagcgacttttgggaagcggcaaaaactgatgaaattgcggaatggttcaaagacatttgggccgcgtttctgccctttttgaaagtggcggtgggagccgaggcgggcgataaggaagccatgaaaaaggaaattttcgtgccgctgatttatgaccgtttggtgacgacgctggtggaaatgctgaacaaatctggctccggctttttgcttccgtccggcctcacttgggctgactttgtctttgccaatgccttaaccacttttaacaacatggacaaaggccttctgttcgaaagtcacaaagtgttggccgactacgaaaagcgcgtttattcggccaacgaatcgataaaaaaatatgtggaggggcgcgaggccaaagaattttgacggctcgcaattcgatgatgatttgttgatgacaattaatgctttttttaatgtttttgactttaaggacaagtaaaaattttctaagcttaaaaaaaaaaaaaaaaaaaaaagaaaaaaaaaaaaaaaaa

SEQ ID NO: 49052 - DNA, 581 bp, Heterodera glycines
  SCN-specific regions: Sequence locations=1-121,166-182,205-223,245 -307,329-420,442-581
aattaaccgcatatttgccactgacatcaccatggcggacattcaaactgaaaaggctttccaaaagcaagccatcttcttgaacgccaagcaggttggcgccaagaagcgcggtcagcgctggtacaaggatgttggtcttggcttcaagacgcccaaggaggcgatcgagggtcactacgtcgacaagaagtgccccttcaccggcgacgtttctatccgcggccgtatcctcaccggcaccatcgtgtccaacaagatgaagcgtaccgtcatcttgcgtcgcgagtacctccactacgtcaagaagtacaaccgttacgagaagcgccatcgcaaccttgccgctcacttgtcgcccgctttcgttggtgtcgagtccggtgatgttgccaccgttggccagtgccgccctctctccaagactgtgcgcttcaacgtcctcaaggtccagaaggccattgctggctccaagcagttcaagaagttctaaaatcttgagttttggacttgtgctgtgcctcgttgtgtgcttgctgctcaatgcttgtcacccaataaatttggttcctctgaaaaaa

SEQ ID NO: 49053 - DNA, 616 bp, Heterodera glycines
  SCN-specific regions: Sequence locations=1-510,533-616
ggaggctttttacgactttaaaaaatacggcgcttcttacatattgcccggtgacgcatcaacgcatacgcctgtcctattccgttatgttgtttttcaaccaatgataaatgaaattcttgagggcaacatactgcgctcgaaccaggaagggatcacaatcagtatgcagtttttcagcgacataacagttgcgccagacaaattgcctgcagtttctaaatttgatgagtctgttcaagtttggagatgggagtatcaaaatgaaaatggtgatatcacgccattctatatggatccaggaaaacgcgtaagatttaaggtgataagcgttaagtatcaaaatgtcgaaccgggcgctcctccagaagccaccaaagctatgacgattgaggcatcgatgttcgatatgggcttgggttgtgtggcatggcgggaaccgcagtgcgcaagtgaattgaaacaggaagcaaatgatccaagcgaagatgaatagtaacaaacgaattgaagattttgttattgttttatttgctccaacggattcttttttaaaaatgttccatggaaatggcgcggaggcgggcagacgagacagggtagacaactcggaggg

SEQ ID NO: 49054 - DNA, 516 bp, Heterodera glycines
  SCN-specific regions: Sequence locations=1-15,37-484
ccaagtttgagctgttaataaaagcatagaaaatgccggaacgtttgacttatcgtagaaggctttgctacaacacaaagtccaataaaacgaaagtggtgaagacgcccgggggacggaatgtgttccactaccgcaataagcttggttcaatcccaaaatgtggcgacaccggtgtgccgttgaaggggattaaagccgcgcgtccgcgtcaattggccaaaatgacaaagcgaaagaagacggtcacgcgcgcttacggcggttgtctcagcgctgcggctgtccgtcaacggatcatccgcgcctttttggtggaggaacaacagctggccaacaaaatactgaaggcgaaaagtggcggtgggaagaaataatgcggaagacggacggacgaagacgggcggacagttcggtcattttaaggacggaattatttttgttgcttttttgttacctttgtgagtaaaagcattgctctgttaaaaaaaaaaaaaaaaaaaaaaaaaaaaaaaa

SEQ ID NO: 49055 - DNA, 630 bp, Heterodera glycines
  SCN-specific regions: Sequence locations=1-405,429-630
acgagggtttgagaaaaaaatttttgtgatgcgaaagggctaatgagattctcgcccagaatttttccctcatttttgcagcaattaatcaacagaaattttctagccttgcactgtccccttccggcaacttcggcggccaaattctcaaccgacggaaagtcggacgtattttgcgcttcgcttttgcacaacgaactttgcgaaaagctcgataagcgtaaggaagagtggaggaagcaaaggccgggaacgaaggaatatacggcgaccaaagaacagcttaaccaattgcaggaagaaatcatcaaaatcgaaaactccaaatacgaatttttgcatactgaaagggacaaaatgagcattgctaaccttgttttggcgccaactcaagtcacactggaggtgatcagcaacgggaccacccacctgcgcccgtcggtggtgctccgtacgccgctgaatgcctacttgttcaactgccccgagggcatttgccgctttttgcccacctttcggctgaggacaaatgccatcaacgacatgttcttcaccaaggccaattgggacaacacgggcggaattgcgtcagtgcttttgaacaaagaaaacactgacgaaactttgcgg

SEQ ID NO: 49056 - DNA, 734 bp, Heterodera glycines
  SCN-specific regions: Sequence locations=1-89,111-622,649-734
gagtactctacataaagaaacagaaacagacatttctgttggcaattacggctcttacggacttgttcaatcgtctgagaagcgggaggatgttgtttttgtagaaattgagaaaataaatgctgattttgacggaaaagagatttggcttcgtggccgtctccacgactctcgcggaaaaggcaaaaattgttttgcgaaaattcggcagcggattcacagcgtacaggcggtgttattcgtgggagcagacattagcaaacaattcgttaaatttgtccaaaacattcccaaagaatcaattgtcgatgtttatgggcttgtggcgcgcacccctcagccggtcactgcttgcactcaaagcgatgttgagattaaagtgcacaaatttttcattgtctcgcaagcagagcctcggcttccgcttcaacttgaagacgcggttcggcccgacaacgaccaagaggaattggccgtagtcaaattggacactcgtttggacaacagagtgctcgacttgcgaacgccaacgagtcaggcaattttccgtttgcagggtggagtttgcgacgcctttcgcaagattttgtcctctcgcggtttcatggaaattcacactcccaaaatcatttctgctgccagtgaaggcggtgcaaacgtttttgaggtttcttacttcaaaggccatgcttttctggctcagtcgcctcaactttacaaacaaatggcaattg

SEQ ID NO: 49057 - DNA, 1041 bp, Heterodera glycines
  SCN-specific regions: Sequence locations=1-177,202-366,403-622,645 -1041
gtaatgtgcggcatcttcgcttacctaaatttcttttcgccgaagaaacgctccgaaatcatcgacattcttttgcaaggactccgtcgcatggaataccgtggctacgattcggcgggcattgccattgactgcagcaacgacgtgaatctgccgcatgccgacgtcgctgtgtatcgcaagacgggcaaagtggacaatttggacgacaccatcaaaaattccgaaggcgtggacatggacttcacctacaacgtccattgcggcatcggacacacccgctgggcaacgcatggaaagccaaaggacgaaaatgcgcacccgcaacggtcgaactttgacaacgattttgccgtggtacacaacggaatcatcaccaactacaaggagatcaaggactatttgctgaccaagggctacaaattcgagtcggagacggacaccgaagtgatcgccaaactcacgcaacacatccaccaacggcacccacactacggcctccggcaactcgtcgaaattgtcgtgcaacaattggagggtgcttttgcgttggcgttcaaaagtcgccgttttcctggccaattggtggccactcgtcgcggcagtcctcttttggttggcattaaaagtcagtccaagctgaccactgaccatttcccggtcttctacagcagaccacgccgtggccccgtttcgctggtgttcgacgaaagttgcaccactgcgatggaaacgccaaacaaactcaacgcttccgacatgttcgcctctttcagcgctccttttaatgacacaataaattctacggcacgtaaaatcgaatgcagcgattcgacgcgaagtgttcggccatgcgacttggcaaactttgaggtggaatatttcgtggcgtcggatgcgagcgccgtcattgagcacacgcgtcaggtgatctttctggaggacgacgacgtcgcatttgtcgaggacggcgctttgtccatccatcgcatcaaacgcagcgacgacaccgctgctttgacagaacagacgcgagaagtg

SEQ ID NO: 49058 - DNA, 467 bp, Heterodera glycines
  SCN-specific regions: Sequence locations=1-77,100-152,187-187,216 -265,328-436
gtccaattaagttattttccgttaatttcttcattttcgttcgcttgcattttgttcttccgtaattatgggcgacagaaaggcggtgattaaaaacgcggatatgaccgaagagatgcagcaggaggccattgagtgcgctacgcaggctttggagaagtataacattgagaaggacatcgctgcgtacatcaaaaaggagtttgacaagaagttcaacccgacatggcattgcatcgtcggacggaacttcggctcttacgtcacacacgagaccaaacacttcatttacttctacttgggccaagtggccattcttttgtttaagagcggctgatccgactttttgagacgaacggaagccgacgatgcaaaaaacttattatggccgtgctgtaagacagttttgtcatttcatcaccaataaatacttttcaaaaaaaaaaaaaaaaaaaaaaaaaaaaaaa

SEQ ID NO: 49059 - DNA, 457 bp, Heterodera glycines
  SCN-specific regions: Sequence locations=1-9,31-32,55-70,92-193,215 -434
cagcattccaattaaaaatataattattttcgttatttttacacaaataacaaataaatattcatcatggcaacaccaaaattgtacaaattccatgtcgaaatgacctgcgaaggctgctcaaatgcagtgaaacgtgtacttggcaaattggaagacaaggtaaagctgctcagtgtggacctgaacgccaaagaggtgcaggtggagagcagcagtatgggccaagatgagattctcgaggtgctgaagaagacgggcaaagcagtgagtccgatcgaatgaggaacgcattcgatgtgatcaggattattccacctcctttttttttggccgatgcgatcagttccctgttgtaccctttaaacattccattccctcctctccatactgatcagtgatcgatggtcatttattaaaaaaagaatttaatcaaaaaaaaaaaaaaaaaaaaaaa

SEQ ID NO: 49060 - DNA, 642 bp, Heterodera glycines
  SCN-specific regions: Sequence locations=1-121,143-642
gtccaaataagattgaccaatcaaaaaaaaataataatgttgagccgtttctctaaaattattgtccgtggatatgcaaaagatctcaacctgaaggaagtgttggcaaacaaaattcctgaacacaacaaaaaggtggtcgaatttcgtaaggcccatggctctacagttgtgcagaacatcaccgtcgacatgatttacggcggaatgcgttccatgaagggcatggtcactgaaacttcggtgttggacccggaagagggcattcgcttccgtggctactcaatcccggagtgccaacagaagttgccaaaggcagagggtggtgaagagccattgcccgaaggcatttggtggttgttgtgcaccggcgaaattcctgaccagaaacaagtgaacgcgatcagcaaggaatgggcatcgcgtgccgatctgccagcccatgtggcccaactgttggagaatttcccgcccaatttgcatccgatgtcccaattcgtggccgccattgccgcgctgcaaagcgagtccaaatttgccgaagcctactcaaaaggtgtgccgaaaagtacctactgggagtatgcgtacgaagactcgatgaacctgctcgccaaactacccaccattgcggcaatgatt

SEQ ID NO: 49061 - DNA, 750 bp, Heterodera glycines
  SCN-specific regions: Sequence locations=1-727
cgaaccgccgatgaggcgatcgttgccactgtgagtaaagttggcgagaatattcaactcgcccgagcatctgtcatttcttcttcaccagcgaacaaactttttggccaaacccatccaaaagaggaatttaacggcgttcaattggggcgttttatttcgttggtgtctttgggtcacaaatcggatgagagtgtttctgactttccaacagcacaacttggccaagtgatttgtcagcacatcattggaatggcgccggaaagtttgggtgaaccaaggaaaaagggagctaaacgggcaactcaaatggaaatcgttgacaatggggagggaacggagaaggaacgctcagctaatgcggaaaatgaaagtgacaccggagaagaggaggatttgaacgcttcacaagttgaccaatccgagctgacgagaatggacggagaagaaactcagctgttgcaccagccattcatgctcaatcctgaacagactgtcaacgaatatttggaagcacatggggcaaatattgcggatttcttgcgcattgagatgggccaagaacacaccaagacaaatgacctcgtcacacggtcgaaaggatttagttttctcggctattaaattacgccaattccctggcaatctcgttaatgagcacacgtcggcgttccccagttagaatcactcaagaaatggcgtaattttaatcaagaaaagacagtataaaaaaaaaaaaaaaaaaaaaaa

SEQ ID NO: 49062 - DNA, 503 bp, Heterodera glycines
  SCN-specific regions: Sequence locations=1-71,93-326,348-503
ttacagagacgagggtccatttaagctttacatcccgctgatcactttcggccctttttcatctgtccatcgccaaattggccccaatttggccatcatttttctccggcactttgtgccaatgttcgccgtgttcgcttttgtgctcctttggcacggactctcccccaattacttctggtgggatactctcagggcaaccgcacttatcgctgaacgcataggacactcactgcccaaatggcacacaagtaggccaaatttgttcagaggcgactttcgtccgacttaaagccgcttctatgcttttcactgtgataccaggcatttttggcattttctttttcctcggcctcaacggcgtcggcgccttcgttttccgttctctccttttggacggtctctcgcaaattttgtccctccgaattttctcttcaaattcggctggctttgtgctgctccatttttttctgctcggcttttgctttaacaacgtttgctta

SEQ ID NO: 49063 - DNA, 565 bp, Heterodera glycines
  SCN-specific regions: Sequence locations=1-97,119-565
tttggaaaaagtaaatttaaaaatggtcgcactccgtgcccaatttgaggcgagcaatgatgtcggagttttctgtaaactcaccaatgcttattgtctggtgggcattgcttcttccgaaaatttttacagtattgtggaggctgagttggccgacgtcatcccggtcatccattgcacagttgcgggctgtcggattgttggccgtgtgacggccggtaatcggcacggactgttggtgccgaacgcgaccacggaccaggaattgcagcacatccgcaacagtttgcctgactcggtccaaattcgaagggttgacgaacggttgtcagcgctgggcaatgtaattgcatgcaatgaccacatcgctgttgtccacgcggacataagcaaggaaacggaggcggcgctggccgaagtgctcaaagtggaagtgttccggctcagtctcggcgaaaatgcattggtgggctcttacgcaacgatgacctcaaacggtgcgttggtggcggcaaaaacaccgccggaggtgcagcgcgaattcacctcgctcgcccaagtgccg

SEQ ID NO: 49064 - DNA, 684 bp, Heterodera glycines
  SCN-specific regions: Sequence locations=1-65,123-123,168-189,213 -219,304-339,370-382,405-429,483-684
gcccatacacctcgtcgctgctctctccgcacttctcaaccccacctcctccatacacacttcaccatggctgaccaacttaccgaggaacaaattgccgagttcaaggaagcgttctccctcttcgataaggacggcgatggcaccatcaccaccaaggagctcggtaccgtgatgcgctcgctcggccaaaacccgaccgaggccgagctgcaagagatgatcaacgaggtggacgccgacggcaacggcaccatcgacttccccgagttcttgaccatgatggcccgcaagatgaaggattccgactctgaggaggagattaaggaggccttcaaggtgttcgacaaggacggcaacggctacatctctgccgccgagttgcgccacgtcatgaccaacttgggcgagaagctctccgaggacgaggtcgatgagatgattcgcgaggccgatgttgatggtgatggtcagatcaactacgaagagttcgtcaagatgatgatgtccaagtaaactcgtacaccactgtccctttgaccagatcccgccaagtccccctttgtcttcggcaccacatctttccccttgtttttttccgtcccgcatcctaactatgtcttcttgtctgtcattataatttgaaacgttttcgtgggtacaacaccctgtcccatttgtttt

SEQ ID NO: 49065 - DNA, 868 bp, Heterodera glycines
  misc_feature (844)..(844): n is a, c, g, or t
  SCN-specific regions: Sequence locations=1-505,527-668,692-842
attttaattaaaaaatggtccaacaatacaaattgtattattttgacctgcgtggtttgggtgaacccatccgccttttgcttcactatgttggccaaccatttgaggacatccggtttaaagacatggaagaatgggagaaaacgtacaaacccaaatttttctacggaaaggccccagttttggaggttgacggaaagccattggcacaaagttcggcaattttgcgctaccttgccgaaaaatttgacttggccggcaaagatgaatgggaaaaggcgaaggctaacgaaatcattgactttctgaaggatgctaccactgatttgctcccgtatttgatggtcaaaatgggacgccaagaaggcgatttggacaaattgcgtggcgaagtgttcgagccgggagtcaagcgcatttttccactttttgagaaacttttgaaggagtccgggtcagggtacatgctcaagtccggcctctcaatggtggactttcaagtggccaactttctgtacagctttaccatgttggagccggacaccatcaatgcgtacccggagctgatcaaatacgttgaccgtgtccatgcgctgccccaactgcagcagtatttgaagcagcgcccgcaggaccgctgatcagtgatcagaaaagtcgagattgaatgagaaaagaaaatcaatcataattaccgattttttaatgagaaaaatcaataattgagaataattatccgatcagctttttgatgagacaaaatgcttattttgattgttgcttcttactgtttatcaacatttagtttgaccattattttatgataaaaatcagtttgaactanaaaaaaaaaaaaaaaaaaaaaaaa

SEQ ID NO: 49066 - DNA, 495 bp, Heterodera glycines
  misc_feature (482)..(482): n is a, c, g, or t
  SCN-specific regions: Sequence locations=1-495
tggccaggacacattcttcgaccagggctgtgtccgtgccacgtgtctttcgtgcagtccttcgggccaattcatcgcctgcggttctaacacgggaattgtcaatgtttacgacctgacaaaactctctccgagtttggccaagtcgaatgcaccaagaccagtacggatgttcgaccagctgaccactttggtgtcattcgttcgctttaacaacgactcgcaaatgttggcatttggttctgcagtgaagcgtatgtccggtcgcgtggccaattgttcttccggaagcgtatttcaaaatttccctgctaaacaagagcacttcgccagcgacaaattcacaacttgcgatttttccccgaatagtgcctttttttcctttggcacaaaacaaggaaagatgagactttaccagttacaccattctgatgtttactaaattttgatgttattaatttgataaattttaacaacttagncaatcatttaaca

SEQ ID NO: 49067 - DNA, 685 bp, Heterodera glycines
  SCN-specific regions: Sequence locations=34-112,135-135,157-685
cctcgtgccgaattcggcacgagggtttgagaaaggattttttctttttttattattccggcggcacatcatttctagacaattgcctcaaaatgagcgtttctccgccgattgctttcccttcgccttctcattgccatttttcttccattgaaagaaatttctctccgttttctgtcaattctcagcccgggcttcgctatttgcgccacgccagcggagttgtggtgctgacgttggacaaaagccatgtgttgatgcgggatcagtgcaaaaacattgcccaagtgttgtgggacatgtcgttggcaaagacttcgtcggccaaaagcaatgaaagcaaagggcgaaagagaggcgtggaccgtagcaaattggagccgactggaaagggaaaaaagggtggtcttccgatgtcgccgcagacacgcatttgtatcattcgcgacagtgatggggtggactatgtgattcgtgcaggcattcgcgcaactctgctggaagtgaacgacgaatggttgacaaaggagcccaatttattgcgtacagcagcggataaccaaggattcatcgcaattttgatgccaccaatcagcggaaatggattgcgcaatatgaaaataccaaaggaatttgacgggacagaagggggagaacgacgggacagagaaacggtgtggggcgg

SEQ ID NO: 49068 - DNA, 1249 bp, Heterodera glycines
  SCN-specific regions: Sequence locations=1-509,531-659,682-1249
tgacaaagacgacagaacggcgatcaatcggatgaccagcgaagagaaaaaggctttggacagcagttacgaagagatttacaacgattttcgacgtgctgcagaatcgcacagacaaacgcgaaagtacgtgaagtcatggattaagcccgggatgaagctgatcgacatttgtgagcgacttgaagcgcacagtcgtcgaatgatcaacgagtcgggactggaggctggcctggccttcccgaccgggtgctccattaatcattgcgccgctcactacacgcccaacgccggtgatgagacagtgcttggaccctccgacgttgtgaagattgactatggaacgcacgtgaacggtcgcatcatcgactgtgccttcactttgacattcgacccaaagttcgacactctcttaaacgccgtgagagaggccaccgaaacgggcattcgcgaggcgggcatcgatgttcgtctttgtgacattggcgaggcaattgaagaggtgatgacttcatacgaacttgaactcgacggaaaaaccttcccaataaaaccaatacggaatttgaacggacattccattgggccttatcgaatccatgcaggaaaaacggttccaattgtgaagaatggcgagcaagtgaaaatggaggagaatgaattctttgcaattgagacattcggaagtacgggtaaaggacatgtgcacgacgacatggaaaccagtcattacatgaagaactacgacctccatgaggagcacattcctctcaggtgaagtgttaatccaatgcgtaaaaaaagggtttttatttgtataagctaaatcgtttcagactcacgcgtagcaaaaaacttcttgccacaatcaacaagaacttcgggactttggcattttgtcgccggtggttggaccgactgggcgaaaccaaatatttgatgtcactcagagacctttgcggtttgtaatagcttctattgcacactttggcaacaaaaacttttcagagaaggacattgttgcgccttatcctccgctctgtgatcaggtccaaagcccatggcaaattaacgcctttttcacatgtttcacttttctacagaaaggctgttacacggctcaatgggagcacaccattctcttacggccgacatgtaaagaagtggtgagccgtggcgaagattattgatggatgagttggtgaattggcggatggaggcaaagaattggccaaaatggcgtaaaaag

SEQ ID NO: 49069 - DNA, 625 bp, Heterodera glycines
  SCN-specific regions: Sequence locations=1-59,103-114,146-271,302 -330,361-625
caccatgtcgtccgcttcgcgcttcaacgaataccaggtggtgggccgccaccagccctctgagaccaaccctcagcccacgctctaccgcatgcgcatctttgcgcccaacgcggtggttgccaagtcccgcttctggtacttcctcaagaagttccgcaaggtcaagaaggccactggccagattgttgccgtcaaccaagtgcttgagaagaaccccactcaagtcaagaccttcggcatctggcttcattacaactcgcgctcgggtacccacaacatgtacaaggagtaccgtgagttgacccgcgtgaacgccgtccaggcttgctaccaggacatggctgcccgccaccgtgctcgcttcaggtcggtgcagatcatccgcgtcgccgaggttgccaccaaggacgtgcgccgcccctacattcagcagattctcgagaagaacctcaagttcccgctcccccaccgcgtgtaccgtgccgcctccaagcgccacaactcgctcttcattgcttcccgcccctcgacccacgcttaagcgtttgcgtgtttgcattgaagaattggttggctgccgtgtcggtgatgtgcagtgtgtggtgacgctttgcggatcgag

SEQ ID NO: 49070 - DNA, 394 bp, Heterodera glycines
  SCN-specific regions: Sequence locations=1-323,349-370
gtccaattaagcatttctctgcataatttattccaatgctaataaaagtgaaaacgctgaccggaaaagaaattgagttggacattgagccgacagacaaagttgatcggatcaaagaaaaggtggaagaaaaggagggcattccgccgccgcagcaacggctgatttttgcgggcaaacaaatgttggacgagaagacggcgcaagactacaaaatccagggtggctccgtgcttcatcttgttcttgcccttcgcggcggatgaatgttcgccatttggacgcttttgttggataaatgatttgattgtctaatgtctcactgactttttaaaaatatttaaatacaaacataaattgagttccacttaaaaaaaaaaaaaaaaaaaaaaaa

SEQ ID NO: 49071 - DNA, 576 bp, Heterodera glycines
  SCN-specific regions: Sequence locations=1-576
gagtgctgaaatattgtagacattcaaatggtttactacaacaacgcctccagctacattcagtggcaagtcattcgcaaaaacagcgccttcctcaaacgtcagcgtggcatcccgaaacacttcagcaccgagccgttcaacatggcgcgtctgaacagcattcgacacaacggaatgatcaacaaaaaggcggtggacatttctgctgcgaaggacggcaaaggagtggttatgagtgtaaagaagcacaaaaatgtggcgaaaccattgcaggcagttgccagcacagcgttgacaagagacagtcgccgggtgatctccgccgtcggaaatgcggtgaccgcctacaaaccgtcgcacgcgaagctggcgcagcgacgcgcctcgcaaatcctccgctcgcaaaaaaccaaggccaaaccagcgacagtgcgcaaaggaaaggccgaatgaacgaggggattttgtggctgaaagacctttaaatgatcgaaaaatgttgttgtttttgttgaaattaattggaaaagaaccattcccgtgggaaaccaatgtttagctcggaaagaaccg

SEQ ID NO: 49072 - DNA, 732 bp, Heterodera glycines
  SCN-specific regions: Sequence locations=1-30,61-180,202-525,548 -673,697-732
gcgtgctttcctttcctctcgcgatgaagatttgtccactttttggaccaaagatgtctgctttttgtatgattatttccgtgtggggaatcgtctttctaggccttcttggcgttttcttttatatgcacgctgtgactttgtttccagaccttcaccttgaggaagaagcaaagctagaaagacaaatggtggaagaaaagtacgaggaaaaggcgaaacaatgctggatagctgcaggcatgtatgtggtcactttgattgcagtgttttggcaaaaccgattcaacaccacacaaattttataattcgttttcaatgacaaatttattcgttcattatgttacacacattatttgtaaacaaacatattttaagaccatttgattaaagaaaattttctcctaccccagcagactattgtaaatctcccatttattaagatccgttccaaatctattttttcttctgggtcagtcgcttttgtcccgtttatcttcagtgcaccagctctcatcaaatttattccatcctgttttgtcattgcggcgagatcacccattgtctttatcgaaccacatacaatttcgaaggttgaggccgagccgaacatttctgtgatttcatccgggttgagattttccagttccgaactcgaagcgcctaaacattagacattaaaattcaaatatttaatttgtggtattcaccatcgaataaaattttagagca

SEQ ID NO: 49073 - DNA, 815 bp, Heterodera glycines
  SCN-specific regions: Sequence locations=1-240,264-312,342-619,641-815
gtgatgcgttctccatcaccgaccgataatgacaaagcgcgttccttaaatgtgtacagacgtaaattggccgaatataaagaaattgagaatcggcttaaggaattgcggactaaggaacgcgaaagtcacaaattgttcgacaagtcggaaaatgagattaaatcgcttcaatcggtcggtcagattgttggcgaagtgcttaaacaattgacagaagagaaattcatagtcaaagcgaccaatgggccacgatatgtggtcggatgtcgtcggaccattgacaaggagaaactgaagcagggcacacgtgtggctttggacatgaccacgctgaccataatgcgccaacttccgcgcgaggtggacccgttggtgtacaaaatgagccacgaagaccctggcaacgtgagctatgccgaaattggaggtctctccgagcaaatcagagaactgagagaggttgttgaactgccgctgatcaatccggagttgttcaaacgcgtcggcataacaccgcccaagggctgtcttttgtacggaccgcccggacctcctggcgcgcccggtcagcccggccagcctggaaactctggccagcctggacagcccggagcaccgggacagcccggcaaggacagcggctactgtccgtgcccgccccgctcttccgtgttggcagtcaaaaagaagatggcggcagccaagaaagcataagcgacaagcgcagggagaagagaaccgaaagacaaaggaccgacgcgaaagcgaagctgaagatgatcataattgggtggaagttgttgtcggaattt

SEQ ID NO: 49074 - DNA, 1257 bp, Heterodera glycines
  SCN-specific regions: Sequence locations=1-613,637-899,922-1086,1110 -1144,1174-1220,1242-1257
gtccaattaaggccgaccaaattttccactcattttgcgtccaaaacattccatccaaaaatgaccatttctgcgcccgctgacgttgacaagctccaggatgcggccaaccgaatgcgcatttcgtccattgagcagacgtgcgccgccaactcgggccacccgaccagcagttgcagcgcagcggaaattgtggccactctgttctttgccgaaatgcgttatgacgtgaaggacccgcgcagcgcatccgccgaccgtttcattctgtccaagggtcacgcttgcccaattctgtacgccgcttgggaagaggcgggcctgctcagccgtgaccaagtgctctccctgcgcaagattgactccgacattgagggacatccgaccccgcggctcaacttcatcgacgtggccaccggctcgctgggccagggtctgtcatgcgctgccggcatggcgtacactggcaaatatgtggaccattcgtcctaccgcgtgtactgtttgatgggcgacggagagagtgcggaaggctccgtgtgggaggcggcagcatttgcaagtttctacaagttggacaatctggtggccattgtggacgttaaccgacttggacaaagtcaggagacccaactgcagcacgacattgaagcgtatgtgcaacggtttgccgcgttcggttggaatgccatcggattggaggacggacacgacattacggcacttttgaatgcttacgccaatgccaagaacgtgactggcaaacccacggcaatcatcgccaaaacgctcaagggcaagggcattgacggcgttgccgacctgaacaaccagcacgggaagccggtgtcgaaggacaaggcggagcccatccgggcattgctcaaaagtgacaagccggcaaattggaccatcccggcaccgattcgggacgcaccggcggtcgacttaggcatcggtgccatcgcaatgagtgcaccgccgcagtacaaaatgggcgaaaaggtggccactcgacaggcgtacggaaacgccttgctgaagctggcggaggccaacaaacgcgtcattgccttagacggtgacatctccaactccaccttctccaacctggtgcaaaagaagctacccgagcagtttgtccagtgttacattgctgagcagaacatggtcggtgttggagttggcatggcgtgccgtgggcgtgtgcttccgcatgtcagcacttttgccgccttcttcacccgtgccggtgaa

SEQ ID NO: 49075 - DNA, 561 bp, Heterodera glycines
  SCN-specific regions: Sequence locations=1-178,201-429,451-561
cttgagaaatgttgaaggcaaagcctcatgttctgttcgtccaatgtcggtttttgcgaatgatgaaaagcattcctaaggacagcaaattcactgccaaatttggtgacacttccatgttcgattttggcgaggttcggacgagtctgctgaggaaggggcaagcgccggaagagaagtgcaagcagttgttcccgacggaccccgacgcaccgatccaattgggcttcaacccattccaacgggccgaccgaaagtgtctgttgtgcgagctgggcatccaattggactacaaaaacggacggctgctccaacagttcgtctccaacttcagcgggcgcgtgtacgaccagcacgtgaccgggctgtgcaaaaaacagtaccagactctgttggccaccatcgcgaccagtcgcaaggctggctacatgccggtgctggtgaaggacgccaaatatttgcgagacccgagactgtttgacccactgaaaccgatcagaacccactcatacgattgaatgacgcgcatcaaattttgtttgcaattccaccatcatttta

SEQ ID NO: 49076 - DNA, 675 bp, Heterodera glycines
  SCN-specific regions: Sequence locations=1-93,117-675
ccatgcccgtcctgaaaagggagttcgtccgatccgaaccctggaataaatttttggcttttccaaaagattatgactttgcgtttgggttctaaattaaaattttccattttactccaaaatgttggaatcagaaaaaatccttttcgcaattcttataactatccgattacttttgaacacgtggttttcccgccaaataatcagtttaagttgccaacaatgcctcctgagcccatttatgacgagtcattgggagaaacgaagcacaaattgactaagcagtttattgaagcgaggggatttgagccaatccacacggagttgatccacaagcagtacggcttggtggcgatgagcggtggttttatcaaagccgaagactttgcatggattcagcaggaagtgaatgagaaattagtcgataagcaattcgccatttggcgcgttaacgccccgtggcttccgcgggtgcggcgtccgccatcaacaaaaaagggcggtgggaaggggcccatccatcactacgagacaccggtcagaaccggacgggtcattgtggagctcggcgggtaaagcactgaacaggaggctcggtcgatggtgatgcatcgctatgagcatatgccattcccagtggaatgtgtcagccaagaattgatggacaaacgcagg

SEQ ID NO: 49077 - DNA, 559 bp, Heterodera glycines
  SCN-specific regions: Sequence locations=1-12,35-379,401-461,483-559
gtccaattaagatttttctcaatttttatttttggaattccaagagccaacggtcagtaagcgcgatgaagcttgtccgctttttgatgaaattgtcccatgagtctgtgaccatcgagctgaagaacggcacacaagtgagcggtgctattcagggcgtcgacgtggccatgaacattcatttgcgctcggtaaaaatgacagtgcgtggacgagagcaaatcagtttggacacactctccatcagaggaaacaacattcgctatattgttcttccggattctttgccattggacactttgctcatcgatgacgagccgcgcaagaagcccactcaacgccgatttggtggccgtggaggacgcggtgggccgcgcggacgtggacgaggccgcggagggcctccacgcggcggcggcgggggacgacgctgatgatggaccacaatgggagaagggatcagtgtctattgttgttgttcatttcaaaccactggctgaacatctcatttatttttctgatataaaatggggttactcgaaaaaaaaagtcggactac

SEQ ID NO: 49078 - DNA, 879 bp, Heterodera glycines
  SCN-specific regions: Sequence locations=1-67,89-837,859-879
taagaactccatttattgtgatcaattattgttggctcgtcaacatgacaacaacgggatggccagcggttgtgaacagcactgcccataatgcgctgttgtcccagaagaactacagcaaccttaatcggactatcaatctgtatccgctcactaattatacgtttggtacgaaggaaccccaatcggagcgagaccattccgtacaggcgcgtttccagcgattgcgcgacgaatacgagaagacggggatgcgccgaagtgtggacggagtgctgctggtgcacgagcattcgctgcctcacgtgttgctgcttcaaatcggaacaactttcttcaaattgcctggcggtgaactgaaccatggcgaagatgaggtggacggattgaaaaggattctgaccgagacgctcggtagggatgacacgccgaagacgcaatggatagtggaagacgccatcgcacagtggtggcgtccgaacttcgatccaccgaggtttccgtatgtgccagcacatgtcaccaagccaaaagaacagaccaaattgtttttggtccaattgcctgacaaagcttttttcgctgtccctaaaaattttaaattggtcgctgcgcctctttttgagctatacgacaattccgcaggctatgggccgctgatcgccagccttcctcaaattctgagccgcttcaatttcctctacaactatgcttaagtggctctgccgttctccccgcttcgctttatgatgacgaattcttcatttgtccgatcattttctgttgcaccaattggttgcttgttaaatctcatctcatctattttcggtcctttctcatcgtttcgaattcgattcattgtttgttccattatttggt

SEQ ID NO: 49079 - DNA, 690 bp, Heterodera glycines
  SCN-specific regions: Sequence locations=1-690
ggtctccgcctcgttggacaagccgatgttgttgaagcgcaaggaggccaagacgtacggtaaaaagcagttgatcgaaggccgtttcgaggcgggccaaagcgcactgatcatcgaggacgtggtcacctccggtgccagcgtgttggagacggtggccgccctccgtgcggttgggctgcgctgtgtgcacgtcttttgcgtgttggaccgccagcagggcggtgagcagcgactgggccgggaggcggacattgttttacggagtttgctttccatgggttcactgttggactttttggtagcagtgcgggaccattgacgcgggcaaaaagacgcaaattgttcaccaacttcaaaacccgatctttgacgacagcgccacgcatttgcaggagcaaaaaacggagaaaaatgaagcagaatgcgtgccattggtggtgtcctcctccgtcgtgccgacgacgacatccgtcggttgggcccaacaatttgcggacggcacactgaaccggcggttggcacaaattatggtggccaaacggaccaacgtttgcctggcggtccactgcacacactgggaccaaattttggagattgtttccgccgtcaaagaacatgtctgtgccgtcaaattgcaccacgacattgtggtggactttggcgctgaatttgtggccaaattgcaca

SEQ ID NO: 49080 - DNA, 954 bp, Heterodera glycines
  SCN-specific regions: Sequence locations=1-954
caaagatcggttttctctctttcgaggcgtttttacgtgtcctacgcgcaacctcagcagaaagtgcaaacacataaacgggagaagccgcatttgaacgtcggtacaattggccacgtcgaccatgggaagacgacacttagtgcggccattacgaaagtgctctcacggcagaaaaaagcgcgctttgtcagttacgaggacatcgacaagggcgcggaggaaagggcacgcggagtcaccataaacatagcgcacattgaatacgaatccgacaatcgtcattatgcgcacacggactgtcccgggcacatcgatttcataaagaatatgatcaccggcactgcccaaatggactccgccgttttggtcatcgcagcggacgacggagtgatgccgcagacgcgggaacatttgctgttggccaaacaaatcggactgcgcgagatcatcgtgttcgtcaacaaaaccgacttggtggacacggatgtaatggaattagttgaaatcgaagctcgcgaactgctcaccgcctacggcttcgatggagagaatgccaaaattgtgtttggttctgcccttcgggcactcgctgatgacgacgacaagtgcattttggagttgatcaatgcgctggacggactggaggagcccgtgcgtacagagaacggtccatttctgatgccgattagcagcaaatgcaaaatcaccggccgtggcagtgttttgattggcaccatcgaatcgggcacagtcaaaaagggcgacacgttggaactgttggggcaggaatatgcgcagaagacactcattgcggacattcacgtgttcggcaaaagcacagcgcagagttcggccggtgaacacgtcggtctgctgtgtaagaatctttactatgatccaatttcgcgtggtttttggttgacaaagccgggaacagtgacgccaacgaac

SEQ ID NO: 49081 - DNA, 812 bp, Heterodera glycines
  SCN-specific regions: Sequence locations=1-73,95-101,125-147,169 -307,354-452,479-575,599-698,720-812
gagcactgtgtcgacaaactaatcttattacattgcgctcgaatatgacaattcactctcgtaaagtggtggcctactattatgatggtgatgtcggcaattactactacggccaaggccatccgatgaaaccccaccgaattcggatgactcacaaccttctgttgaactacggactctatcgcaaaatggaagttttcagaccaaaggctgcgtcactagaagaaatgactaaatatcacagcgatgactatatgtgttttctgaagagcataaaacccgacaatatcgccgattttggtcgtcaaatgcaacgcttcaacgtgggcgaggactgtcccgtgtttgacggtctatttgagttttgccaaatttcaagcggtggctcaatcgcggctgcaactaaaattaataagaaacacgtggacgtcgcaattaattggatgggcggacttcaccacgccaagaaatccgaagcttccggattttgctacacaaatgacattgttttggccattcttgagctgctgaaataccatcaacgagtgctatacgtcgacattgacatccatcacggagacggagtggaggaagcattttacaccacggacagagtcatgacggtctctttccataaatacggtgaatatttcccgggcactggcgacttaaaggatgtcggcgccggaattggtcgttactatgccgtcaattttccattgagagacggaattgacgatgaaacttacgagcgcatttttgcgcctgtcatggagaaaatcattggcgcctatcagccttcggtcattgtg

SEQ ID NO: 49082 - DNA, 783 bp, Heterodera glycines
  SCN-specific regions: Sequence locations=1-267,291-315,342-345,379 -594,648-653,675-731,753-783
attgctcacacccagatgaaactgatgaagcaccgcaacaagaaggcacacataatggagatccaaatcaatgggggtaccgttgccgaaaaagtggactgggctcgtgagcactttgagaagcaggttcccgtggagcaagtgtttgagcaggacgagatgatcgactgcatcggtgtcaccagaggaaagggtttcaagggagtgaccagccgatggcactgtaagaagttgccgcgcaagactcacaagggtctccgcaaggtggcttgtatcggtgcatggcatccgtcgcgtgtctcattcacagttgcgcgtgccggtcagaagggctaccaccatcggacggagatcaacaagaagatctaccgcattggcaagtcgtgtttgacggccgacggcaagaaaaacggaatgaccgacttcgacatcactgagaagaacattaacccgatgggcgggttcccccactatggtctggtcaatcaggactttctgatgatccgtggctgttgcattggttgcaagaagcgtccgatcacattgcgcaagactttgatcaagcagaccaaacgttttgctttcgagaagataaacctgaagttcatcgacaccagctccaagtttggccatggacgcttccagacgagtgcggagaagaaaacattcatgggcaaattgaagaaagactttctggcggaatcggcgtaaaattggccaatttcattgtttattattttgttgaaagtaaagaattgttgtgttaaaaaaaaaaaaaaaaag

SEQ ID NO: 49083 - DNA, 1767 bp, Heterodera glycines
  SCN-specific regions: Sequence locations=1-62,85-252,274-696,718 -777,801-943,969-1767
caaaaagttaaacttttcctcaacccgcgacaaaaaatgccaccgacgacaagagaacacattaaggaatcccaatatggctttgtttacggcgtttcgggaccggtggtaactgctgagaaaatgtccggtgctgcaatgtacgaactcgtcagagtcggccattctgaattggtgggcgaaatcatccgattggaaggcgactacgccacgattcaagtctacgaggagacttcgtccgtcacaatctgtgaccccgtgctgcggacggggcagcctttgtctgttgagcttggcccgggcattatgggctccatttttgacggaatacaacggccattgcacgacatttcagaaatgaccaaatccatttacattccgaagggggtcaatgtgaaggcattaaaccgtgcaaaacgatgggaatttatgccgaggaaagatttgcgagttggggaccacgtgacgggcggagatatcatcggaatggtgcacgaaagtgcgttggtcaagcacaaaattatggtggagccgaaggcgtgcggaacggtcaaattcatcgccccgcaaggccaatacaccgtcgaagacaccattttggaagtcgaattcgctggacacacccaaaagcttacgatgatgcacatttggccagtcagaaacccccgcccgtccgccgaaaaattagcggccaatttccctctcctctgtgggcagcgcgtgttggacgcgctcttcccgtgtgtccagggcggcacaacggcaattcctggtgcctttggctgtggtaaaactgtcatttcgcagtcgttgtccaaatattccaactccgatgccattatttacgtgggctgtggcgagcgtggcaacgaaatgtcggaagtgttgcgcgactttcccgaactgacgatggaagtggatggagtgaccacgtccatcatggagaggacggcgctggtggccaacacttcgaatatgcccgtggcggcgcgtgaagcgtccatttacacgggaattactctggccgaatacttccgcgacatgggtctgaacgtggccatgatggccgactcgacctcccgatgggccgaggcgctccgtgagatttcgggccgtctcggggaaatgccggctgactcgggttaccccgcctatttggccgcacggctcgcttccttctacgaaagggcgggaaaagtgaaatgttttgggtcgcctgaacgcgaagggtccgtcactattgtcggcgcagtgtcgccgcccggcggagacttcgccgaccccgtcacatcggcaaccctcggcattgtccaagtgttttggggactcgacaaaaaattggcccaacgaaagcacttcccttcaatcaattggctcatttcttacagcaaatatatgcgtgcgttggacgattattacgagaagaattttgccgaatttgttccactgagaacgaaatgcaaagaaattttgcaggaagaggaagatttgtcagaaattgtccaattggtcggcaaagcatcgcttgccgaggccgacaaaatcactttggaggtggccaaactgatcaaggacgatttccttcagcaaaatggctattccagctatgatcgcttctgtcccttctacaaaactgttgggatgctcaaaaatatgattggcttttacgactttgcccggcactcggtggaaacgactgcacaatcggacaacaaaatcacgtggaatcagatcagagatcacctcggggacatcattcacgaactt

SEQ ID NO: 49084 - DNA, 569 bp, Heterodera glycines
  SCN-specific regions: Sequence locations=1-569
gattaattcatcccagcaggaatctctttttttgtttatttccttcatttaatatacataattgtttcattccaaatggagggaatattcggcactcagcgggggggaggggacattctaccgaataacgacaacaacggcaatcacaacgacaggcaaccgctgctactcgaagaaaatgaaaaagccagctacggggcgctggggcctacagaggactcatttaggcaagacaaacattggtggaaaaggagcggaaaactaaaggcctcgaaacgacaacttggcatatttgcttattcctcctccgttgattatgcgctgattgcttttggtacggtcgcttctgtgctccacggggccggcttccccttactttcgattgttctcggtgggatgacctcagggccgaaaattccgattttgttcatggccaaacgccgcgtcaaaatgctactaattcctctgccatttcgccaatttcaaaagaggaattccaatcggaagtggccgctttctccgtgtactatttggtcttgggtttcgtcatggtcgtcacttcttacatc

SEQ ID NO: 49085 - DNA, 854 bp, Heterodera glycines
  SCN-specific regions: Sequence locations=1-291,326-654,677-854
aaaaaacaaattacgtgctctcgtcacattgcttggttcatatcagagaagtcttcaatattgctatgccaaaaagaaacgcatctgaagcagcgaatgccaccaaatttgaaaaggggccatcggcgaagaatgcacgaattcagacgaagaaagtgtcagaagaattattaaacggaaagaatagattgaatgaagccaaggaggacgatgtgcccgtttggtgcttgaagaaggcacaggaagagaagccaagtcgacagtgtccttacctggatacaattgataggggtgtgctggactttgattttgagaagctgtgttcagtgtcactttctcacatcaatgtgtatgcctgcatggtctgcggtaaatacttccagggccgtggaaccaatacgcatgcctacactcattccctggactcggaccatcgcatttacttgaacttgggcacactgaagttctactgtctgcctgaaaattatgaagtgattgacccttccctggacgacatcaaatatgtgcttaagcccacttatactcccgaacaaatcaagcttattggtagaaatgtgaagatggcccgtgcatggaatgacacgctttattacccggggatcatcggtctgaataacatcaaagcgaacgactacaccaatgttgtgttccacgctctttcccatgttccgcccttacgcgattatttccttcgtgagcaaaattacatgcacattaagcgaccgcccggtgacaaattgacactgatgccacaacgttttggtgaattgttgcgcaagttgtggaacccaaaggcgttcaaagcgcacgtgtcgccccatgagatgctgcaa

SEQ ID NO: 49086 - DNA, 1061 bp, Heterodera glycines
  SCN-specific regions: Sequence locations=1-752,774-934,956-1061
attaattctgcgattaacaacggcgaaaatgcacattatgacgagagttgctcctccactttggcctcgaccttttccaacggtggtcgaaacccggagagtggcgtggccaccaccgacctttacggccgttgcactcgttctcattccggcacttcggccgccgcgcccgaagctgccggcgtttttgcgctgactttggaagcgaatccgaagctgacatggcgcgacctgcagcacctcaccgttttgacgtcatctcgcaattctctcttcgatggtcgctgtcgggaattgccgcctctcgaattggaagacatcaaacggcagttggtctcgcggcaggcgagctgctcgcacttcgagtggcaaacgaacggagtcggtctcgagtacaatcatttgttcggttttggtgtgctcgacgccgcagaaatggttctgatggcaaaggtgtataaaacggcaccgccgcgctttcattgtgaggcgggcacaattgaaatgccaagggaaatccccgcaagcggcgaaatggtgctgacgctgaggacggacgcatgtacgggttcaacaacggaagtgaactttttggagcatgtgcaggccatcgtgtcgctgaacagctcgcgtcggggagacacgacgctgtacctcatctcgcccgccggcactccttcgatgattctctcgagaaggcctaaggacgacgatgccaaagacggattcaccaattggccatttatgacaactcacacgtggggagagaaccctcgcgggcgttggcgtttggtggtgcgcttccaaccaggcaaatcgacgccgaagggccataaataccgagggacgctgaaaaagttcacgctgatgctgcacggcacaaaggagccgccttatcgcggcattgagcccctgcagggacacgccaattccaagctgagtgtggtggaaagtgcgcacaaacggatggcaaacaggcgatgatggcacgacagacgaatggccccacgatgggccctccaaggggcacattttaccccattctctccccccccccccct

SEQ ID NO: 49087 - DNA, 706 bp, Heterodera glycines
  SCN-specific regions: Sequence locations=1-65,88-230,252-331,356 -378,401-547,569-706
agacgtcttctgattggcaaattcagacatcctataaaattgttcttcaacttccgtcattggtccagcaacaactgtatgtttgagccaagttttaaacaatgccaatcaaagcatccggagaaactttaagaaagtacatcgttgttggacgtaaactcccaactgcaaatgacccaaatccgacactgcatgaaatggttatttttgccagcaaccacgtcgttgctaagtctcgcttctggtacttcactagcatgttgcgtcgtgttaaaaaaacacacggagaaattatttcatgtcaagaggtcttcgagaaaaagcctggctccgtgaagaactttggcatttggctccgctacgattctcgtactggacaccacaacatgtaccgcgagtatcgcgatgtttgtgaagcgggtgctgttacgcagtgctatcgcgacatgggcgctcgtcaccgcgctcaagcggatcgcattcagatcatcaaagtgcaaaccatcagtgtggcggactgcaagcgagccggggtgaagcaatttcagaactccaagatcaaatttccgcttcctcaccgtgtgaattccaagcgacgcaatatgactcctttcacgacacagcgtccgagaactcattttgtgtagagaaagaaatgagacgacttgtatttccgatttgttgattaaagttgttgtgttaaaaa

SEQ ID NO: 49088 - DNA, 627 bp, Heterodera glycines
  SCN-specific regions: Sequence locations=1-105,144-177,216-225,279 -555,577-627
gtctcatacatggaatggccgctcaaaacccgatgcgcgagctcaagctcgaaagagctcgtcctcaacatttgtgtcggcgagagtggtgataagctcacccgtgccgccaaggtgctggagcagctcactggccagacccccgtttactccaaggccaagtacactgtgcgctcgttcggtatccgtcgtaacgaaaagattgccgtccacgtgactgtgcgcggtgccaaggctgaggagattctcgagcgtggcctcaaggtcaaggagtacgaactccgtgccgccaacttctcgcaaaccggccacttcggtttcggtatcaccgagcacattgatctcgacatcaagtacgaccccaccatcggtatttacggtatggacttctactgcgtcatgggtcgtgccggtttccgtgtgtcgcgtcgccgccgcgccgtcgccaaggttggtgccccccaccgcatcaacaaggacgaaaccattgagtggttcaagaagaactacgatggtgtcatcctcaacaagtaagttggccgcgtcccaccgccttgttgatgtgtgtcgttgtgcatttcggccagtcgtgttgagagattcgcgtcgctcgtcttgtcttggtca

SEQ ID NO: 49089 - DNA, 701 bp, Heterodera glycines
  SCN-specific regions: Sequence locations=1-36,60-277,299-510,532-701
tcccttaacggtgtttatctcttaaaattaccgcagaaaaattcttaaaacaaaaattcaagggccggatctaaacagaacaaaactgttgcatacatttacatgcacttttcggtttgatgttgcatcccatttaaaaagaacggtgaacaaagggcaatcgatacgcataaaaatcgatcgtttttcggagtggacggagcaggaccagacggacttctgcaaacaccttctgcagcgcatgtgtcaccaccaacacggccaaattgaccaatttttgggcccaatgcttcagcgggacttcattgcgttgttaccaaccggtttggcggagaatgtgctccatttgttggacgccaagtcgttgtgcgcctcggagtttgtcagccgccggtggagtcgtgtcattgtcaacggattgctgtggcgcaagcacatcgagcgccaagtgcgcaacgacgcgctgtgggccggactcgccatccgacgcggatggaagaagtacttcttctgctccaaggaccaggcgacacgcgcaatttctcagtcgtggagacagccgaagaacggggaggacgcgttggagttccagcacaaattctaccgcgaactttacccaaaaatcactgctgacattcggcaaattgagcagaattggcgcgagggacgacaccgattggagcgcatcaattgccaatcgg

SEQ ID NO: 49090 - DNA, 785 bp, Heterodera glycines
  SCN-specific regions: Sequence locations=1-391,413-785
tcatctaaacgattgaaatgagttttggcaaggaatgcgttgatttatttgggacgaaggatctgtaccaaattttgaaattggacaggagcaaaagcaacttgagcagtgcacaaatcaaaaaggcctattatcgccagtcaattctgtggcatcccgacagatttgcatcggcacagcatgacgaaacgacgcgcgagttggccaagcagaaattccaagtgatcggcagagcatatgtaattttgggggatagtgagaagcgcaaagcgtacgacgaaacgggttcgctcgacgatgagaacgaattttacgaaggcaaagattggtcggccgtgtggcgaggcgttttcaaaaaagtcactccggaagagatcgaagcgtacctggccaaattcagaggttcacaggaggaaattgacgaggttaaggaggcgtatcagaagcacaaaggcaacatggacaagatcatgcaaagtgtggtcggcgccgagcatccggacgaggaccgaatccgcgagatcgtccgccatggcatcgagcggggcgaactgcgtgcatatgctcgcttcgtcaacgagcccgcctccgctccgactcggcgtgccgcgcgcgcacaacgcgaggagggggaaacgcagcacgcgctggaagagttgcgccagagggaagacgtcagcaaagggacggacggcgacgactctttgggcgcattgaaaagggcaaagcagcgcaaacgcgcccaaaagatggacgatttcttggacaaactcgcacaaaagtat

SEQ ID NO: 49091 - DNA, 752 bp, Heterodera glycines
  SCN-specific regions: Sequence locations=1-752
gttcatcgcggttaatgaactcaattggttgcccttcctcctccaatggtccttcctccgctatgccttcttcttccgctgattgttctgctgatcgctctcttccgtcttcctcttccgttatcttccaacaattcacgatcgatcagcgacactttgtggacgaggattacttcagtctcgagagtattttcgccaccaatacgaatatttgctgcactttcgagtctaaaacgccccccgcgctttttcctctgctcggccggaaagcgcctgaggtcatttctgagaagggataccgtgccaatgttcccgcttggctcgtccccgccgtcgaccacatttgctcgtttgccgtgcccaccgtttacaattccgtcaatcgcgacgtaatccacgcgggtgcccaatcggtcaacttggaacagttgcaacgccactactacacattgggcacgttcatttgcagattggtccccggcgaacaggcgcaacacatcgccttggcattgctttccgcgttcacccaacgcatcggtcgaattgtgcgcgactgcaccaacacgggggcaaagccgacgcggctggacgagacggagaagcggattttctggacaatgcaaaggacggagcatcggaagggactttggatgggcaaccgaagggaggacgaaggacggcaccgaagggccgccaaaaggaaacattgcggcggcatttcgacacttctctctgtgaaaaactgctgatca

SEQ ID NO: 49092 - DNA, 573 bp, Heterodera glycines
  SCN-specific regions: Sequence locations=33-166,188-573
cctcgttccgaattcggcacgagggtccaattaagatagaaatggcaacgcggaagttgagttttcctgagaaaattgccaatattcttggagttatttatcgctatcatgaaccgcgacttccacgttacaaagacattctgaagaaagtgtgtgtccgagaattggctcctccaactccaaaggattggcctcagatcaaagcggattatgccaaattggacacagtgatgagaacgcaggcctacagacagtttaagttgaaggaatttctcgtttattcggctgttttcgtggaagtgctctgttggtttttcgtcggagagatcattggacggggcagtctcaccggatacatcgtccgcagttctttcgttgacccgaaggccgcaaagaaaatggcgcactttaaatgggacgatcatcatgaactcaaagtggagaacgacgaagagcaaagcgggcactgatcggcgttcgatagatgatgcatatttctgtattgtaatgcttaggaactcgactcgaaagaaaattgttaattagacaataaaaacgatgctttcaaaaaaa

SEQ ID NO: 49093 - DNA, 762 bp, Heterodera glycines
  SCN-specific regions: Sequence locations=1-257,279-762
cttctattctcttgcattttccgtggaccttcaacacataacccacaaaaacaaatgaaccgaattcgaaaagcagtgacagtactcagcggcaatgaatcaaacattccggagaagatcgcaaaggccgagcctcaacaccatgacattgagaagccggtgtcctccttgaaattcggtggtggcgcaacattgttccccgctgaatacgccgacgacgtggacctctacttgcgacaactcgaaagacgcaccccgctggacttcgactttctgtccgtgcacaaaaccgttgacggacgaatgcggcaaattctcgtcgactggcttgtccatgtccaagtccgcttcaagctgaccattgaaactctcagcctatccgtgcacattctcgaccgcgttctattggcactcccggggattaacaagacaaatttgcaactgttgggcgtcacgagcattttcatcgcagccaaattcgaggaagtggtcatgccgaatgttgacgactttgtctatgtggcagcaaacatgttcaagagggaggacatcatgcggatggaaccgcgggtgctgtccgggctcaagttcaacctcagcgtgccatacgccgtgcagtttctgcgtagctatcgcttctacgcttcgccgtcaaagagtgtgtgggaatttgcgaagttcgtcagcgaagttgccatggtctgttacgcgttggcccacttccctccctccgttgtggccgccgtgtcgctccatttggct

SEQ ID NO: 49094 - DNA, 724 bp, Heterodera glycines
  SCN-specific regions: Sequence locations=1-104,126-195,230-255,277 -420,442-689,711-724
ggttcgtttaaattgtctgattgaatggcaaaaaagcagtacgaccttttgttcaaacttctgttgatcggcgacagcggagtgggcaaaacttgcattttgtacagattcagcgacgatgcctttaacacgtcttttatttcgaccattggaattgacttcaaaatcaagacgattgagctgagagggaagaaaataaagctgcagatttgggacactgcgggtcaagagcgttttcacacgattaccacctcatattaccggggcgccatgggcattatgatggtttacgacataaccaacgcgaagagcttcgacaacatcgccaaatggctgagatacatcgacgagcatgcctctgaagatgtcgtaaaaatgttacttggcaacaaatgcgacatgtccgaccgaagagttgtgccgaaggaacgtggggaaaaaattgcgattgaccatggcattcgtttcctggagacatcggccaaggcaaacataaacatcgaaaaggcgttttacgacttggccgaagccattttggacaaggtgccggacagaaactcgatgggccccggtccgaatataaagccgctgacagatggcgcggacaggagtaccaagtccaattgttgttacccgtgactgccatttctgtctgaatattctggcattgattttcttctattttcaggactaaaattgtaatcaataaacaagcggcttttta

SEQ ID NO: 49095 - DNA, 559 bp, Heterodera glycines
  misc_feature (556)..(556): n is a, c, g, or t
  SCN-specific regions: Sequence locations=1-46,75-378,408-416,442-559
gttctacatgataattaattaattatgagcagcagcgatttgttggcccacaacagcagcaccagtggctccagcagtggcgcaaccgacaaattggcggtgttcggcggctgcgagggccccgacgcgtgctatgtgatgctggtgagcagtgacggacatgaatttgtcatccgcaaagagcatgccctgatttcgaagaccatccgagcaatgctttccggccccggccaatacgcggagagcgaaaccaacgaagtgcatttccgcgaaattccctcccacgtgctgcagaaggtgtgccattactttgcgtacaaggcgcgctacacgaacagcgcgacggaaatccccgaatttttcgtggcacccgaagtggcgctggaactgctgatggcggccaacttcctcgactgttgaccaaacaaacaaacaaaatttgatgcaaaaatggtagcaacgacagacagacgaaccgatggccagacaaaacactgactgattgtgattggcaccgatttggaatttttgtgccaaagataaagccaattattantta

SEQ ID NO: 49096 - DNA, 581 bp, Heterodera glycines
  misc_feature (564)..(564): n is a, c, g, or t
  SCN-specific regions: Sequence locations=1-182,204-308,348-532,554-581
gctctttgatataagcgttgctattgaattgcgatttctatcgtctcttttaattgttttacgccacaacaaacgacaaaaacaacatggcttttccttataaggatgacaaaccgcaagaggcagcgcccgttgaggaccgaattcgcattaccctaacatcacagaatgtgaaatcgctcgaaaaagtctgtgagcagcttattcgcggcgcaaaggacgagaatttggtggtcaaaggcccagtgagaatgcccacaaaaattctgcgcattaccacacgcaaaacgccgtgcggagaggggtcgaagacttgggaccgtttccagatgcgcatccacaaacgcatcatcaatctgaacagctccagcgacgtgctgaagaaaatcacgggcatttccattgagccgggcgtggacgtggaggtgacaattgcggagtcgcccagcaattaaacagcgcgtgccgaggggcggacggagagatttcccttttttgtcgttgcgttcgttctattgttgctttatgccacaaaattgaaaaaaaaattgttgtttatcaaanaaaaaaaaaaaaaaaaa

SEQ ID NO: 49097 - DNA, 682 bp, Heterodera glycines
  SCN-specific regions: Sequence locations=1-36,58-74,99-382,404-682
cacagtaaaacaatttctattcggctctttccacaattaatcaacaacgtttttatcattatcacataaaaatgcgtttttgagccaaaatggaagtcgaagaaacgaaagcgacaaaattggagcaaatgtttgccaatgtatggcaaaattggagtcattttgtgctattaatggaagtcggcctttggaagcaaaggcagagtttcggccgatcaattcgatggactttcattccgacgtcggccgaatgctgtacaccatcgccattctgctgatgttttccttcgtcattttcgcccttatggtccgttccattagtcgttcgcgttcatccgccgaattggagacgcttttggatgccatgcgtttccgagaggaattggacattcagctgaggcaaaagcatcggctgaggaaggcgaagcgaaaagtgaccgcttggctgtgccgaggaaacggggcgaaactttggcaatcgtcgccacacattctgatcccaaacaacgccgtttcagtgcgtaaccactctttacagtccaccgggtcttacattccggaaattgtgatcagcacagaaaacacaaaccccgccactgtcgaaggcattcttcgaaacatcgaacggcaaaactctttcacgccaagtctctcactcatttacgacttttcgtatgattcg

SEQ ID NO: 49098 - DNA, 840 bp, Heterodera glycines
  SCN-specific regions: Sequence locations=1-280,302-307,329-840
ccaagctttagagagtaaaccaaacatggaaaatccgagtgattttaccctaggaggtgcattgcccacatcaagcacagacgattatttgaagctaaaacgtttggagaataaactagcaaacttggacgttatggaggagtatctgaagatggacatgcgaaatttggagaaggaattggtgcacgcacaggaagaagtgaagcgcattcaatcagttccgctaatcatcggccaattcctcgaagccgtcgattacgaccacgccatcgttggttccactactggctcgaattactacgtgcgtgtgctgtccattttggaccgtgaactgctgaaggccggctgcagcgtgtccttgcacaagtacagcaacgcgctggtcgacgtccttccgcccgagtccgactcgtccattcaaatgctgcgagcggacgaaaagccggacgttgtctactcagacatcggcgggctcgacacgcagaagcaggaagtgcgcgaggcggtggaattgccattgaccaatggcgagctttacgagcagatcggcattgaaccgccccggggagtgcttctctatgggccgccgggttgtgggaaaacgatgttggcgaaggcagtcgcaaagcacacaaaggcatcattcatccgagtggtgggcagcgaattcgtgcagaaatatcttggcgaagggcctcgaatggttcgcgacgtgtttcggctagcaaaggagaacagtccatgtatcattttcatcgacgaaattgacgccattgcgacgaaacgatttgacgcgcaaacgggcgcggaccgggaagtccagcgcattttgttggagtt

SEQ ID NO: 49099 - DNA, 910 bp, Heterodera glycines
  SCN-specific regions: Sequence locations=1-356,380-449,472-734,775-910
tgttgctcccgcacctaatgcaaacgcagcctcggctcaggcaacccaaccgcaggttatggcaccatcctatccgttggcttctctctatgtcggcgatcttcatccggatgtcactgaggcaatgctctttgagcggatcagcaatgctggtcctgtgctctccattcgtgtttgtcgtgacgcgatcactcgtcgttcgcttggctatgcctatgtgaattttccgcagccggcggatgccgaacgcgctttggacaccctgaactttgatatgatcctgaacaaaccgattcgcatcatgcggacgcaacgtgacccaagcattcgtcgctcgggtgctgggaacattttcatcaaaaacttgggcaaggaaatcgacacaaaggccatctacgacaccttttccatgtttggaagcattctgagttgcaagatttccactgacattgatggaggaagcaaaggatatgggttcatccattttgagactgaggaagcagtgaacagtgcaattgcaaaagtgaacgggatgcttttggatgggaagaaagtgtttgttggaaaatttttgccacgttccgctcgtgacaagcaaattggtgatccgtccagtcgtttcaccaatgtttatgtgaagaattttggtgatgcaatgaattcggagaagctgagcgaagtgttttcacagtttggcgaaatcatcagtgcaaaggtgatggaggatgacagcggcaagtccaaggggttcggcttcgttgcctacaaggaccatgaaagtgctgcgagggcggtggagaagatgaacgacgtttcggtgcccggcagtgagaaggtcgagcaaaagtttacggtgtgccgtgcgcaaaagaagagcgagcgccaggctgagctgaagcgtcgttacgag

SEQ ID NO: 49100 - DNA, 715 bp, Heterodera glycines
  SCN-specific regions: Sequence locations=1-715
cctcaccctatcttgcaaacattctgtttacatacagatacgttttttcctgctcgatgaggccgattctttgcttggtggccaaagcgactcggcccaaattgtgcacgaattgcactcgcgaattcccaaatattccgaattcggtgagcgtctccaaatgatcgttagttccgcaacacttcacaacatggcagtacaacggctggcgactcaggatatgtacttcccccaatggattgatctgaaagggcaggattcggatacggaaactgtacaccaggttgtctgtatggtcgatccatgtgaggacaaaagttggattcggcttcgttcaaagactggccaatcagttcataccgattctgtccacgcacgtgatcagcttcagaccggaagcgacaacccagaaacactgtcggaggcggtcaaagtgttaaaaggggaatatttggtgaaagcaatcgaagagcacaaaatggaccaagcgatcattttctgtcgaaccaaattggactgtgacaacatggagaagtttttggcgccacgcgggtacaaatgcgtttgtttgcacggcgaccgaagcgcggacgaacggacgcggaatttgctttcgattaaagaaaacatagtgcgctttctcatctgcacggacgtggcggcacgaagactcgacatcctaggcgtgccctatgtggacaatgtgacattgcct

SEQ ID NO: 49101 - DNA, 813 bp, Heterodera glycines
  SCN-specific regions: Sequence locations=1-76,118-187,209-230,316-393
atttcccatcattaattagccgataaaaatgtgcgacgaagaagtccctgctctcgtggtggacaatgggtccggaatgtgcaaggccggtttcgcgggcgatgacgcgccccgcgcggtgtttccgtccattgtgggccgcccccgtcatcagggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgtgagtggtggtgccatcgtcagcattggcattggcactcgccgtcggtcacttggccaatccgtccctttaaggcgtgtcgcccccgaggagcacccggtgctgctcacagaggccccgctgaacccgaaggccaacagagaaaagatgacccaaatcatgttcgagacgttcaacacgccggccatgtacgtggccatccaggccgtgctgtccctgtacgcctccggccgtaccaccggtctcgtgttggactccggcgatggtgtcacccacaccgtgcccatctacgagggttacgccctgccccacgccatcctccgtttggacttggccggccgtgacctcactgactacctgatgaagatcctcactgagcgtggttactccttcgtgaccacggccgagcgtgagatcgtccgtgacatcaaggagaagttgtgctacgtggcactcgacttcgagcaggaaatggccactgccgcctcctcctcctcgctg

SEQ ID NO: 49102 - DNA, 1146 bp, Heterodera glycines
  SCN-specific regions: Sequence locations=1-1053,1075-1146
cttaatatgttacgtgagaagtgcaaagaggtcaaagcgcaggctcgtttcgcacttaaagcattgaaagagcacagcgaacgcatcagtcgcaaggcgcttttccttgaggaggattctgcccttttcatctccgttaagtacaaaaaggtccccctcgcccgaggcaattccatgcggaaattaattgggttgccctgcaccgatcagaatgcatcaaatacgtccatttgtttgattcttcccgatttcgaccggtcaaacgctgctgcgagggatccggatgtggacggacaagctaggagatgggcggaactgttgcgggaaaagtacggactgacgggtgaacacatcgccaaaatattcacaatcactcagcttaaacgggagtacggaaaacaagcggacagagcgaagttggcgaacacttacgacattttcatggtcgacaaaaagttgatgaaaatcgctgtaaattttcttggcggcactttcagaaaagctacaaaaatgcctttgcccattgattcttccgtcgacattagcaaaaaactgaaagaggccttctcattggtccaattacattttgcgcctttgaaggactcagtcgcagtgagaattggcaatttgagtcagtcattggctgaattggattcgaattttgacgtaataatcgaagccgtttttgcccatttgcctggtggtccgtcaaacattcgcagttgctacctccaaacttcagcaaccaaaacttcccttccaattttcgtcgattttggcccatctgatgaagtgcttgtggagcaacccaaaaacgaacaatttgcggtggaattgggcgagtgcagcactttgccggagggattaatggtcaaagtgagggcggacggaaaagtgaccgtggtaaagggaaacgcgggggaagaggtgctttatccgacggcacaggacgaatgggagcagggcgacgatattcggccattgaacgacgacaccgtgcagaaagtgttaaggaagaaagccattgggatgagcaaagggcaaagaaagcgaaaagacaaagcaaaatgaaaccactcatttgtgttgtgttcgttgtgttttgtttgttaattttgttcgaaattcattaaatttgctacttta

SEQ ID NO: 49103 - DNA, 829 bp, Heterodera glycines
  SCN-specific regions: Sequence locations=1-175,199-829
aattttcctataaatttattaattggactgcttttgctgttgctcaatctcgatggcagaggaaccagtgaaactgattcttgtcaccggcggagtgatgagcggcgttggcaaaggcattgtgtcgtcgagcatcggtgtcctattgaagggttgcggttaccgagtgactgtgatcaaaatcgacccgtacatcaatgtcgatgctggcactttctctccattcgaacatggcgaagtttttgtgttggatgatggtggcgaagttgacttggatcttggaaattacgaacgttttttggacattcgactgacacgggacaacaatatcacaacgggtaaaatcttccaccaggtcatccaacgggagaggaacggcgactatttggggaagacggtcaaaacggtgccgcacataaccgacgcgatcattgaatgggtggagagagtttcaaagatttctgttgatggcagcggaaagacaccgcaaatttgcattgtcgagctcggtggcacaattggtgacattgagggcatgccgtacacaatggctttcagcatggcatttcgccgcaaaacataccgtaatcgttttctgactgtgcacgtgaccaaattgttgcacgagtcgggcgaaataaaaacgaaaccggcgcagaatgcgctgcgcagtcttcgcgagacgggcctttaccccgaccttttgctctgtcgttctcaaaaaccgttgacccaagcgctgcgctccaaaattgccagctttgcccaattggacatcaacgaaatcatcgacgtgtacgactgtcacgacattcacagtgtgccgttg

SEQ ID NO: 49104 - DNA, 973 bp, Heterodera glycines
  misc_feature (2)..(2): n is a, c, g, or t
  misc_feature (37)..(37): n is a, c, g, or t
  SCN-specific regions: Sequence locations=1-580,603-938,960-973
gntttttggttgttgttgccgcctctaaaggttttgntgtttctcatcacttttgtacagattgctgtttttccgtcaaagttgcatggcacagatgaacgcagccaagctgcaacaacagttgaccgccagtgggagcagcagcaaatgccgcagcagcagcaccagttgtgcgtgacaattccgtaccgcgaccgatggacggaattgcagcaaatgttgccacttttgcacaatttcttggtcaccatccaggccatcgccccaccgccccggtacattgtggtcaaccaatcggaggaggacgcgctgcgcttcaaccgcgccgcgttgataaacattggagcgttggaggcggaacgcgtcggttgcgattacatggcaatccacgacgtggacattgttccgcttaatccgaacttgagctaccattacccggaggatgggcacataatgcacgttgcagctggtcaataccatcccatccgaaggtatgactacaaaaatttcatcggcagtgtgctggtgatcactttggccgattttaaaaaggtggacggaatgtccaacgaattttggggctggggcctggaggacgacgacttttacctcagattgaaggcggcgggaatggccaacaaaatcaggcggccgtccaatttgaccaccgatcggtccaacacatttttgcatttgcacacgcggagccgacggagggatttctcagtggacgaatacagaaaaaagaggaagcgcagacggaacactttgagcgggttgcgcactctcaactacaaactgaacgggaggcacaccatcgaactgacggaagacattcaaatttgggtgttggatgtgcgtttgtattgtacaccaacaatttttggaacggaatgccatcaaaatgttgcataaaaagccatttgatatttcttggcatttagaccatcaaataaatgaagatggatgaaaa

SEQ ID NO: 49105 - DNA, 876 bp, Heterodera glycines
  SCN-specific regions: Sequence locations=1-876
tatcccttcaattctcatatttttcattgtctacagtctgatcttacgcgtcttcgtcgaaactttacaccgatggaaattcagcgtgatagccatttacgaagtatgaaagagcttctcagcacgatggacccgcaagtcgaccccaattcacacattgaattcaagcagaagacacacattctttgtgcccgctttttgggtggtgcttggaagaccgtctcattggaggacatgaagattcacagaattaaaggcggaatgagcaacatgcttttcttttgccgtctgactgaaaatcacccaccactaaaaggggagccggacaaagtccttctgcgcgtgtattttaacccagaaacggaaagtcatttggtggcagagtctgttattttcacccttctctctgaacgacacctggggccgaaactctatggaatattcagcgggggccgtcttgaagaatacattccgtcacggccacttacttgccatgaaattgcattgcccaccatggccaacaaaatagccaagaggttggctcgagtccatcaacttgaagtgccaatttggaaagaaccggaatatatttgtgacgcgcttgaaaggtggcttattcaattgaaacaaatgcccagtggttctcgtgatttcgatttgccggctgaaagtcacgaatgggctcctccgagcataaattgcgaagatttacagaaagaaattgagcacctgaggagattgattgtaaagagtcggagtctggttactttctgtcataatgatcttcaagaagggaacattctcttgcccaaagcacattctggcaatatccgaatcggctccgaatcggacgaaattttatctggcattgacggg

SEQ ID NO: 49106 - DNA, 983 bp, Heterodera glycines
  SCN-specific regions: Sequence locations=1-534,556-870,898-983
gtttgcccaattcggatatttagatacaatctaaagcttcgtttgcatggatttagtttaccacgaaaagcaagttggacgtatgtgtgctcaacatgcactgaacatgcttctgcaaggcgattacttcacgcccgattctctcgcttcaattgctcaagaattggaccaaagagaacgtgcgatgctaagggacgaatctgagtttcaaagtcaaaattacgacgattcgggatacttctcaattcaggtgaaactgaagctttgcgtcgtcaagcgaatttgagtctggagcctatcataagcccaaatgctatgaaggttttgcaaaatccgagtttggcacatgcttacatttgtcacctggaggaccattggttcacaattcgcaaaattgggacgacttggtttatcctcaattcgctgttcaaagcaccgcgcattgtatctgaaacgtttctcgaattgtacgtccatcagcttaataccgaaggttggtccctttatgttgtcgaaggcgaattgcccgcttgtgcagcggaaactgtgccaagagaattttggaatgagacgcgacggacaaaaaagtttgaaaatgacatggaaagggcaatcgcattgagcctaaatgaagcacggccgtttcttgttacaaagactgccgatgaagaattgtttggagcggcgacaccggtgatcagccaagccgaggagttggacatccagcgtgctttggaggacagtcttcgtgaggcgaatagggccacttcggtaagcactgccgaatcgtttctcgtcggagaagcgatccgcaacagtgtgttggacttggacgcctcttctagtcacacttcgacaaattcgcaaacgagcagcagaaatgaggaggaggatgacccgcacaaccgacagtcatgttcaagtggataccaaagatagaggaaccattattcgtcccttagatgcgtcattctcacaacccg

SEQ ID NO: 49107 - DNA, 813 bp, Heterodera glycines
  misc_feature (8)..(8): n is a, c, g, or t
  SCN-specific regions: Sequence locations=1-813
ctccatgnacatacaatatttgcttagatggatttgttaaaatcttacgacggctcttcatcatcggacaatgaacaagaattggcagatataccttcttcgtccaatcacaacaaattgctcgctttgaaaatcccatccatcaacttaacacccaacgtgattgaacaacgcgccattcaacaggttgcggttgtggatccaaaaaccaaagagttgtatcacaatccgcgcttcgacgaattgtttaaaccagagagcggcccacaaaatccgtttaaaagtgaacatcaacgagcagaaaagaacacactgaccggctatgtggagccagcgcatttcaacgccttccattttgagcgttcacttcgctcctacgatacgcttggctatgcggataatccaacggcagacacaaccagcgcaaagttcgttggtgacgttggacaagcgcaagaaaaggccggcgagtcgctttttgaatcagtaaaaactggcggacagaagcgaaagagagtgataaattacgacgcatcaaacgttgacggatatacgggaccgtgggcaaggtttgaggacgagaagacaattgctcgaccggacccagaattgcagaaggaaatggacgaaattgtgcggaaacggaaactgaaaagtcgtgctggccgaaaagcggccatcgcggaattgcatttggcagaagagagcaccaaattgcacataaaagatgacactgactatttgggccgttcctttatggaaccgccgaaatacacgggcaccaatctgcgcgaggactttgtgcccgaccgc

SEQ ID NO: 49108 - DNA, 795 bp, Heterodera glycines
  SCN-specific regions: Sequence locations=1-622,644-795
atcattactctaccacaatttgatctgcctgaatgtgtgtcgaaccccaacggatggggtccggggtctgtaagtgacagtcaagtactctcagagtttgtgggccttccgtatcaacatttcaacaaatgcgatcggattgggcgtatcgtcgattggttgggcgtcgatcgctttttcaaaaaaggcgaaacgcgagatcggtacaatgagcgtgtgtatggctcctcagcgactgcgggcgttcaattcgattacatccacgacaacgaggaatcgaacttccaattggtcgactcgagtcgaccacaaaagccgcagaggcctttccgtcgtcaaattccatttcgtaaattggctcaacgtgagcaggaacgccgagaatatgagaagtacaatgtttcgacgaagatgaagcggagtatactcaaggagcaacaaaaagcgtacaaagtgtttttgcgtcggggcggtggaactcgcggcacagcgcagcgaccgaccgggcggcgcttcaatgaccgacaggcgggcaaagggcgacagccttcggttcaagttcgacccgattgggcggttctgaaggagttggactttgtccagctgaacaaactttacctgccaaacattgaacctggaaaggatatacccggcgaaacgtacggcacccttcacttttatgataaagcattaatggacaaactgagcgtcaaaaacccgctgcatttggagaaattccacgcgtctttttattcgctgaccaccactgaagacccggtgttcagaaagctgtcc

SEQ ID NO: 49109 - DNA, 527 bp, Heterodera glycines
  misc_feature (500)..(502): n is a, c, g, or t
  SCN-specific regions: Sequence locations=1-419,442-498
ctctgctaaccgcctttttcaatgtgcgaccgtttgacccaaacccttgaccttgtcaacgatttggctaaccacatgtgtaattcggttggtgttctgcacgcgagtgccgggccgtgcgaatttgggacagctccggaggaactgaagaatgaacccaactgtcgcctcttcgctcagcaaattgcacggaccgccaaagacatcgaaattctgatcgattctttgcccgccgacgaacaatcgttgtccgtggaagagcatgagaaggcgttgttggagttggacgacgaacgcgcacgggcggccaaagagcttgaacaagcagtggaaaaggcggagaaactgacggatcagttgggcgaacttttgtcacgcattgcgcgccttcaaatggaatcgcgcccgatggcattttccacctgaaaacaaccttttcaacccacattttttttgtcgaatttatttgaatattaatacgcataaattaattttattannnaaaaaaaaaaaaaaaaaaaaaaaaa

SEQ ID NO: 49110 - DNA, 746 bp, Heterodera glycines
  misc_feature (666)..(666): n is a, c, g, or t
  SCN-specific regions: Sequence locations=1-454,476-746
gtccgtgtgattcctttgttacatttggccaattgcgatttttccttttattctgtggccccataaatgccatacactgatgccgtaacgatgggcaactcttcagcgtctggtactgtctctgttccgaagaacccggcgcggctcggcactttcctttggggcgtttccgctgcaacggggcgtcgcgtacttttggctgagttgggccccgccagcgcatccaccgtcgtagcaaagaaacgggccaaaatcgtcgcccatttgtccatgtcccacgagtctctgctccttttctgcgacccctttgtccatgccgaacgcaccttcctccgctgctccttccgtgccgatcttggccattgtgcccatttgctcagtgcattttattccgagggtttgcccgagtcggcgcttcgtatcattctcagggcgacgctaaacgcactcgaacacctccactcgcgcggggtcattcacaggagcgtttgtgccgagaacatttggctcgactcggatggtcaaattcgtcttgcgctcactcgccatgccacccgaatttccgactgtcccaaatggatcggtgtggaggacagagtgcacgaattcacgtcggatttgagtgaaatggtcgcttggttggccccggaagtgctaatgcagcgntgggatatgcctttgcgaattggccaatggcgtcgtgcccttccaagaaatggaaccccttcgcattttgtacgaaaagc

SEQ ID NO: 49111 - DNA, 607 bp, Heterodera glycines
  SCN-specific regions: Sequence locations=1-8,30-62,87-132,175-280,303- 315,360-369,393-405,427-490,517-559,581-607
gtgcattctctgcctctctgctgttctttgtgcttcattcacacaaacattttcgctctcttcaaaatgtctggacgtggaaagggtggcaaagcgaagaccggaggaaaggccaagtcgcgctcttcccgtgcggggctccaattccccgttgggcgtcttcatcgtctgctgcgcaaaggtcactacgccgagcgtgtgggggctggcgcgcccgtctatctggcagcggtgcttgagtacctcgcggcggaggtgctcgaattggccggcaacgcctccagggacaacaagaagacacggatcaacccgcgccatctgcagttggcggtgcgcaacgatgaggagttgaacaagcttctctcgggcgtcaccattgcccagggcggtgtgctgccgaacatccaagcagttctcctgcccaagaagacccatggcgaaagtcagtgagcgcaggacggtggtggaacggcattgaagaaaaaactatcccaaacggccctctttagggccacaatcatgcaattgaacggattggctaattttcgatttttaacatttaaataaatttgctcctttcaaaaaaaaaaaaaaaaaaacccaaaaa

SEQ ID NO: 49112 - DNA, 818 bp, Heterodera glycines
  SCN-specific regions: Sequence locations=1-794
gtcttattaagcaattcgagtgctacaaatagttcgaaatggtaactgcggaagataccgttaaaacaaaggaagaagaccccaaaaaaacgacaacggacgacggatcgagttcagaggaagaagtgcccgagctcgaagagggcgacgttactgaagagcagaaaaaagttgctgaggcggccggactcagtgagcaggttgccgaaaagggctccaaacaatcgcgttctgaaaagaaggctcgtaaactattcagcaaacttggcctcaagcaagtgcacggcgtttcgcgcgtatgcatccgtaaatcgaagagcattttgttcgtcatcaacaagccggacgtgtacaaaagtccgggctccgacacatacgtcgtttttggcgaggcaaaaattgaagatttggcacaacacgctcaaatcactgacgtggagaatttgaaaccgccctcaatcattcgcgatgttcgcaaccgaatcacaccggcggaggaggaaagcgatggcgaagaggctgatgctactggaattgaagaaaaggatattgagttggtgatgtcgcaagcaaatgtttctcgaaacaaagctatcaaagcattgaaaaaggctgacaatgatttggtgaacgctattatggcattgacaatgtaggaggaagccagaggaattcagagaaaacattgttgaccttcgaatttttgcttcaatatttttcctacgggaatcagttcttttaccattgctgattatgttactttacgaattttgcttataaaaattaaaaagcgtaaaaaaaaaaaaaaaaaaaaaaaa

SEQ ID NO: 49113 - DNA, 811 bp, Heterodera glycines
  SCN-specific regions: Sequence locations=1-498,520-811
tcatcaaagggcctttgctcactttccgactcttcgcacaatcaatcgaagtgtcttctctcctcccaattgttctttgtttcgtttggcttttttcctcgtcttttgtttgcttagtgccaatgccatgaaatttgctgtcaaaggcgatgacaacaaatattgcatccttctcgactctccacaaatcactggcgcaattcgttacgaagaaaaaaatggttccttcaacacgaccactttttcgctttcaaacagctcggcttcggttgacaaaaatgccagcagttgtgatgcttccattcagcgaatttccatccaatttgcgcctctcattgagggaattgccaccgaaatgagcaaaaaatggaacatcactttggaattcaccaaaaaggacgggaaaaactacgctttgtccgactattcgctgggtgtcgttttctttccggcacaaaaggcatcgcaaaaatcccatgtctacgagaagaacggaaccgcggaatgggtcgcacagctcgaaagtgaccagtccaaacaccccaacgggttcacctgctccgagaacaaattggcgctgtccgacgcgtccacgattaattttgaatttctgaagttggttgcctttgacgacaatgaaaaggacgaattcagagacgggcaaatcttcgagaactgtcctttggatgcgcgtacttcggatttggtgccgattgtcgtcggtgctctgttggccggccttgttgtcattgttctgatcgcttatttgatcggccgcgctcgtgcaaagcgacagggatacacttcggtt

SEQ ID NO: 49114 - DNA, 797 bp, Heterodera glycines
  SCN-specific regions: Sequence locations=1-299,321-762,795-797
cttcctgcaccggcttgtgcccttccgaaattcgttatttcctttcttttcgacctctgtttcgtcatttccgtcgtttctcttctgcccaaagtgcaggaacgaatgcccaattcggggctcatccaggccagtatgatgtcactgtacgtttgttacctgacttggagtgcgctcatcaataacccggacaaggagtgcaacccgtcgcttattcctcggcacaattccaccggcgacgcgggagggaatgtccaagtgatcaccacttcgctgcccgtcaattcgctcgtctctttggtcatttggttttgttgccttctctacgcttccattcgcacttcttcatacacggcactgggcaaaattggtggggcgatcagtgaaggaaatgccgaaggtcaggacatccctctgagcgaagcttcaatgtccgtcgaggagggcgaccgtgggacgacggggcgcaatgtttacgacaacgaaaaggggtccgtggcctattcctactcgttcttccacttcatttttgcgcttgcttctctctatgtgatgatgaccctcacttcgtggtacaccccgagcgatgatttgcgctatttgaacgacaacatggcatctctttgggtgcgcgtcatctcttcttggctttgcgctgcgctttacctttggactttgctggcgcccgtccttttccccgacagggatttcaattgatcaccaaacaaatgaaaatcggattcgaattctccaccttgtatcaaatataactttattataaatcacatttacaaaaa

SEQ ID NO: 49115 - DNA, 723 bp, Heterodera glycines
  SCN-specific regions: Sequence locations=1-493,515-606,639-647,669 -696,719-723
attcctcatgagtccaagccccactacacacctgagcccgacatccttcacgaactgttgggccattgtccactgtttgcggaccccgattttgcccagttttcccaagaatttggactcgcatcgcttggcgcctccgatgaaatggtggagaaattggctacgctctattggttcaccgtggagttcggcatttgcattcaaaatggggcaaaaaaggcgtacggtgcgggactgttgagctcatttggcgaattggaatatgcgctcagcggacagcccgaattggctgcgttcaacccgccggagacgtgccaaaccaaatacccgatcactagctaccaacccaaatattttgtggccgaatcgttcgcggatgccaaaaacaaactcgcgtactgtatttgtcgcgctcgcgttttgagcatttttaaccctccccgctcccgcagtacatggtcaacgagcataccaagacagttccaagtcaactacaacccatacacacaacgcatcgaaatgttggacaatgagagtgcagcaaacaagcttgtccgggatgtgaaaagccaagtttcaaagctcgaagaagcactaaggaagctggacaaagagaaggcaaaggcaaaatgaagaaaattgacttgccaaaaagcagagaaaatgtgaatttcttttcaacggcgtgttggagttgtgaaataaatcagatactgtaaaaaa

SEQ ID NO: 49116 - DNA, 932 bp, Heterodera glycines
  SCN-specific regions: Sequence locations=1-468,509-578,603-932
ctccataaaggcttgtcaattaattgcttgcaaatttgccgatggctgctatagacccgaaggatttcttcaacaagtttgccaaaccgagcaaaggtgccggagtcggcgctggcttgatgactgcagctgcggtggccggttatgcgctgtacaagtcgatgtatacgattgaggctggccatcgtgcgataatgttcaaccgaatcggtgggctcggcgacgaggtgtaccgggaaggactgcactttcgcattccatggttccaatatccgattgtctacgacattcgtgcacgtcccaaccaaattcggtcgccgaccggcagcaaggatttgcaaatggttaacatcgggcttcgtgtgctgtcccgaccggacccggggcagctgcagacgatctgccggatgctcggcaccaattgggaggagcgagtgcttccgtcaatttgtaacgaggtgctgaagggcgtcgtggccaagttcaacgcctcccagctgatcacccaacgtcagcaagtgtctctgctcgtccgaaagggtctgattgagcgtgcgttggacttcaacatcattctcgacgatgtggccatcaccgagttggccttctcgccccaatacagtgccgccgttgaggcaaaacaagtggcggcacaggaggcgcagcgggccagtttcatggtggagaaggccatccaacagcgccaggagaaaattgtccaagccgagggagaggcgcaagcggccaaattgttgggcgagtcgatgaagaatgaccccggcttcctcaaactgcgaaaaatccgtgcggctcagaaaattgcgcgtttcattgccaactcgtcaaaccgcgtctatttgccttcggacggacttttcttgaacttggccgacgaagactatttgagtttggcgaccaacaaagggcgccgt

SEQ ID NO: 49117 - DNA, 824 bp, Heterodera glycines
  SCN-specific regions: Sequence locations=1-43,65-824
cagttcattctcctgctgtccattgtctggtccttcaatggcgcttggaattgcaccattcattgtttgggccgactgaggacggcaccgactgtgcttcttccaccaaatcgtatgctttgcgcagtgacggggcttcctgctcgacaacaacagatgcgaagcccgactttgcttcaacgtatgagcattgcattgacttgacctccactgttggcacgtctcaatctgcaaatttgttggatttagtgaccgaatccaccagtccattggaagtgccgatgtgtaagaaatgtgccaatgcagtgactgcggagctgaacaagcaattgggtcatttggagaaggaatgcatccaatacaaaaagtcgttggaccatttgttgcaacggcgtgcggactgtccatttgacatggaggcatcgcgcatcaaattggacgctttaaaatcagaagagcgcgacctattggaacaactgacgctgttggaagacgaggaacggacactgcttcatgaattggatacaaaacaggaggagcgcaagaaaattggtgaacgagacgagcaactttatcgacagttgcgaaacaaccacagtatactcattgaacaatcggatgaacagcggtcatttaaattgcaaatcaatcaggccaatgaacaaattcgacgtctgtcccgcatgaatgtgctggatcgtgagttccacatttggggggatgcagagtacggcacaaaaaggggcttcagggtgggtcgactggagcatgaaccaagggaatggagtgaaatccatgccgccctgggaaagacggcccttttg

SEQ ID NO: 49118 - DNA, 484 bp, Heterodera glycines
  SCN-specific regions: Sequence locations=1-96,129-372,394-447
catccataaaataatatgccgccaaaaacctcgaagaaaactgacccaaaagggggaaaagcggcaccagcgaagaagaaagagggcggaggaggagggaaggccaagaagaagaagtggtcgaagggaaaggtgcgcgacaaactcgccaacatggtcttatttgaccaagccacctatgacaaattgtacaaggaaatcatctccgtcaaactgatcactcccagcgttgtctccgaacggctcaaagtgcgcgcttcgctggccaaggcgggcctggaagagttgcaccagaaggggctgatcaaatgcgtggtgaagcacggttcccaattggtgtacacacgggccaccaaagcggaggaagcctaagaaaagggggaaacggggcgatttggtttttccttttttttagattgttgatttgttgaatgaatatgtttttttaaaaaaaaaaaaaaaaaaaaaaaaaaaaaaaaaaaaa

SEQ ID NO: 49119 - DNA, 403 bp, Heterodera glycines
  misc_feature (383)..(385): n is a, c, g, or t
  SCN-specific regions: Sequence locations=1-403
gtccataaaagttttcaacgaaatgttcttcactcgaatcttacccttggagaaggcgaaatacaggacatccaaaccgcgtgttctgttccgtcgtttcaaccgccccttctatcaatacacaatgcggccgttggtgcagtgtccccgttgcagcgcttcgcatgagccatgggtgctgtgcatggactgctaccgcgtgttgcgcgacgccacggagccaatcaaacgacggatggtgtcgcataacgcatacattggccagcgacagcagccgatgccgcgatggactgacgaaaatggcattaatgccaaccccgtaataattgttttttccatttgattgtattggccatttttatttcttaaatagttattgagcnnnaaaaaaaaaaaaaaaaaa

SEQ ID NO: 49120 - DNA, 607 bp, Heterodera glycines
  SCN-specific regions: Sequence locations=1-607
tctttgataagtggactcctcaaacggttggaagaggattgtattgggtcagccccagcagcaatggacaaggacgacgccaaacaatttgaagaatatcgggcgaggaaagtcgcaatgataactggcatttctggtcaggatgggtcgtaccttgccgaatttctcctcgccaaggggtaccaagtgcacggggtcatccgtcgttcctcctccttcaacactggtcgaattgagcatttgtactccaatccgatgacacacgctgtcggttccagcttcaacttgcactacggcgacatgaccgactcgtcctgtttgatcaaactgatcagcaccattcgtcccaccgaactgtaccatttggccgcacagagtcacgtcaaggtgtctttcgacttgcccgagtacaccgccgaagtggacgccgtcggcactttgcgcctcctcgacgcgatccacgcgtgcggactcacccgattggtccgcttctaccaagcatcaacatcggaactgtacgggaaggtgcaggaagtgccgcagcgggaaaccacgccattctacccgcgttctccttacgcggttgccaagttgtattcctattgga

SEQ ID NO: 49121 - DNA, 654 bp, Heterodera glycines
  SCN-specific regions: Sequence locations=1-444,466-654
gtccgtgctgtggaaaatgcttgctctgaagtcgcttttgggtaggagccctctggtcaatcctttggttttgtctttgcggaacagatccatcaaaaaagtgaagaaaaaacttgctgcaggggaaacactcggcggtccggaggattatgcgtataattatgttgaaaaaaagagaggatttatcaaaccgatccacacacttgaggaacagatagaatacatgaacagcgaagtttttgccgaaacttacaaaggacgtccaatttgttttatgtggaaacgtaatatgaaaggccagtggaaattgcaaccgccgcctcgacttttttgcattgaccgcaatggtcgtttcaacgttggaaatgcgtgtacggtgtgtcgtgatgagtatttgttcttcgattatagaaatcccaaattgcttgagcatttcctttaccccggcactgatcagcccctgcccataattcaaaccggactttgtcaagaacagtacgtcaatttgcaagcccaacttctcaaggccaaagagcacggtacgtttattttcaacgtgcccttccgtcacttcaattatggtcaatggtatccaaaagatgcgaatgcattaataagcagtgatttggaggaggaccaaccgagcagagactt

SEQ ID NO: 49122 - DNA, 801 bp, Heterodera glycines
  misc_feature (792)..(792): n is a, c, g, or t
  SCN-specific regions: Sequence locations=1-59,87-801
gttcgtgatttaggcttttatctattgattggatgaattgttgacttaggtagtttacctattaatttttccacattttttgccatggcttcaattgacttgtcacaagaagttcgcctttatgacaacaatgcggagcgcgatcgaattgacaacatggctgaactgtacgcgatggtcaacgcgttggagtgcctggagaaggtgttcagccgggattatatccacaccaaggagtacacggcggaatgctcaaaactgcttgtccaaatcaaggtggctttgcgattggttcccggcatgacaattgacgagtttttccgctcatattacattcaatgcccggccgcgttggagcgtattcgtgaggaccgacccattacggtgcgcgacgacaaaggaaatgctctcaaatgcattgcggacattgtggagctgttcatcacattcctggaccaattgaagctgaacattcgcgcggtggacgaactgttccccaatctgaacgacctttacgcctccatcaacacaatgagtactttgccggacgatttcgacgccaaactcagggtgaaatcgtggcatgacaagctgcagggaatggctgctcatgaggagattacagacgaagttgcacgacagatgatttttgaacttgaaactgcttacaacgcattccaacggtttttgcggagcggttgaaacgatctaagcctaaaattggtgatatttgacatccaaattcattctgtaattacgaacccatgtctgcttttataaataataaactanaccctacca

SEQ ID NO: 49123 - DNA, 777 bp, Heterodera glycines
  SCN-specific regions: Sequence locations=1-513,536-777
cctcgctccgtccaaataagttttatttctgaaatgaaaacttcacctaagattaaaagcagaaaaactgcttcaacaaatgaagtgaaaaaggaatgcccagaaggcacagagaaccgcgaaaatgttgggacgtcgagcaggttaattgtgaagaatttgccgtgtggcaaaaagacgcgatgggacgaggccaaagttcgagcgcacttctccaaatttggcactttgacggacgttcggctgaaactcagcgaaaagaccggagcttgcaaatttgcctttgtcggcttttcatctgccgaacattgccaaaatgccatcaaagcgttggacggcgcgtacattggcggctcaaaacttacggtcgaagagtgtaaagcattgacaactgaccgaacggcgatcaccaaacaactttcgttgaacaaacgcaaaaaactgaggcaaaaaggcaaatgcgaagttgatgaggaggaggacaaagaagaagctgccgaagaggcggacgtcgactcactaattgaaaagcaaattttggacaccggacgacttttccttcgaaatttgccctttgtgtgctcggaagagcaaatacggcaacttttcgagccgtttggaccactcgccgagttggaatgtgtcgtggacaatgcgggcaaatgcaaagggtacgccctgtgcaccttcatcttcccggaacatgcggttgccgcgtggaaagcgttggacggcaccgtttttatgggccgaatgctgcacataatcgccggcgaa

SEQ ID NO: 49124 - DNA, 578 bp, Heterodera glycines
  SCN-specific regions: Sequence locations=34-389,413-555
cctcttgccgaattcggcacgagggaaattcagcagtccaaaaacaaatttcaccagcaatgatttaccaccgatttgttgagattggccgtgtcgtttacattgccaaggggaaggaccaaggcaaattggcagtcattgtgaatgtcatcgacggtaacaaggttttattggacggcccctcctcgggtgtgcctcgcggtgtttggaatttcaaagacttgcagttgacaaaattcaccctcccattgcgtatcggccaacgtacgaaaggagtgcgcgaggcttatgaaactgccaaaatcaacgagttatggcaaggcactgagtgggcaaagcgcattgatcggaaacagaagcgtgccgggctcaacgacttcgagcgcttcaaagtgttcaaagccaaacagcaccgaaaccgtttggtccgcgttgagatggctaaactgaaaaagatttcgaagccgacagcgaagtaaatgactgaatttggcctgatcatattttgaacacacaaatgccgtcttttttgttgatgaaattatttgttggagttaaattgttttttaattcaaaaa

SEQ ID NO: 49125 - DNA, 645 bp, Heterodera glycines
  SCN-specific regions: Sequence locations=1-645
cttccatacacataagcattttgttgccgcattgtaaagtccaacttggcatccgaaattggcatgatcgttctcaggtgcctcgcatttttgatgatcggagaaaggcaacaaacaaaatcaaagacgtgggatattactttcgttatcatcgacctggaatcgacgcattgccgcggatccccgactgcaaagagcagctctaccggccgaaatacaaaattcgtgagccttggcgcgaaagtcaggcgagatttggcgagaacgactacatcgacctgctcggagacggctctctccatccggcccaacttcagtaccacgtcccccgttggctgcgcgggtttcccgggcaaaacagagcgattgagccggtcaagctgatccactacagaaacctgtacaagtcaaagttggagcagaattcgcctcacaaatggcaccagctgaacaagcgcatcaaatatttgctgcaatatcacaactacgacaaatcggacgaattgagggccgaacggtcgctgggactgtgggaggaggagccggactatttctacaaggacaaatcacgccgatcataccaagaccttgtgtagtttattgtttcgtcattcagttagtgaaaaatgcattggcaaaattgaa

SEQ ID NO: 49126 - DNA, 667 bp, Heterodera glycines
  SCN-specific regions: Sequence locations=1-5,27-228,250-667
agccctttaaatgtgcatatcatcatcctttgtatcacttcattttttactaatttctgaacgaatttaattcccaaaaatggcctccggtttttgggcatttgttggcagagcttgggaatggctgaaaacgttgattctgccacagagtatcaatgggacttgtctcaaccaaacgttcatcaacgacacgccatcggcgggagaatttttggccgatttggagccctttcaaattgtgcttctctctgttggcagtgtgctcactttcaccgtttttctgctcgcctttctccagtggaggtacattttcaattacgtctcctcggagcagcggcgcaacaaactttacttgctcatctcattggtccccgtttgcactttttgctgtctcctcagaatggtctggcctcgcaccgctctgctcgtctcctccttcggccttctccatttccgcctcggactttttgttcttgtttcactgatgcgccatttgtccggtggtcgtgccactttggccctttctctcaccgacaaaggcaaattgatcgatttccgtggtcctccattttgctgtcttctttactgtcttccaagggcaaatccgacagaggtcaatttgacacgacttgaatggatcgtcctccaggcgcccatcatccgagtt

SEQ ID NO: 49127 - DNA, 807 bp, Heterodera glycines
  SCN-specific regions: Sequence locations=1-807
tttttgttgacccaccagcaacggaaaatgggcaacgaacacagccgtggtcgctttggtggcaacggcacaaacaaagaaaagggggacgacgatggcggtcaaacatctccgagcacttccactggaattcccgcctcattttcttttctcgctaagaaacgaaattcgacaaaaagtgcgctgatgggcagcattgtcgtggtcaacgagggggccagctgttcgtcgtccgctgaccctggcaaagacgtggaccttcggaggataaaggaaattcctcgttttttgcctttactccgcggagttttgcccggtcacagagacatccccgaagcgcagcagaaaatcgacagcaaaagcattcttagttttatgcatcgccttcagcaacattttaaaagctgtgctcaaacggtggcgactgagcagggccgaatgttcgcccgaattgtcgaaattgaccaattaatttcgtcgctgttcaaaaagacttcgacggccacaaaaagattggacgcactgaacaacgaattgagaaaggtcggcactttttccagccaattggaggaaattcaggcttctcttctcgatttgtcctcctccgccaattcgctaaaccaacttttgtccttcgacgaccgtttgccgcctcttcaattcgcatttactccaattttaacgcgaaaaaagttgtcagaaagtgccgggacaatgttgcctcaaaacagtgacaatattaattcgggtgacagaacggcgattgaaagggatttgaggaaagtgagcgaattgcgagtggtggac

SEQ ID NO: 49128 - DNA, 889 bp, Heterodera glycines
  SCN-specific regions: Sequence locations=1-225,247-764,809-829,851-889
ctcgctaaactacccaccattgcggcaatgatttacagaaatctctaccgtgatggttcttccgtgggtgtgctcgacccgaacaaggattggtccgctaacttttgccatatgcttggctacaccgaacgcgaattcgtggaactgatgcgtctctatttggtcatccattcggaccacgagggtggcaatgtgtccgcgcacacgtgccatttggtcggctccgcgctgtccgacccgtacctgtcatttgccgcttcgatggccggccttgctggtccattgcatggactggccaaccaggaagtgcttgttttcttgacaaaaatggttgccgacattggacacgagtactcggagcagcaactcaaggaatgggtgtggaaccatctgaagagtggacaggtggtgcccggctatggacacgcggtgctgcgcaaaacggacccccgctacacgtgccaacgcgagtttgcgctcaagcatttgccggacgacccgatgttcaagctggtgtccacactgtacaaggtcacgcccgacattctgctggagcaaggcaaagcgaagaacccgtggccaaatgtggacgcacactctggcgttttgctacaacactacggcatgcatgagatgagctactacacggtgctgttcggtgtcagtcgggcactcggctgtctctcccagctgatctgggcgcgtggcatgggccctccgttggagcggcccaaatcgcacagcacggacggactgataaaattggcggcggcggcgacagcagcgaaataaatattttagaccaaaacaaaaagagaatagaaccaaaccccaattattattattattagatgtattatggttgttaaagtgtgtgtaacttgtgaac

SEQ ID NO: 49129 - DNA, 596 bp, Heterodera glycines
  SCN-specific regions: Sequence locations=1-4,34-199,221-376,439 -439,479-489,511-596
ctctgttgccgaattcggcacgaggatttaagcattttctaatttaattaacggtttgccaacctctgcacattcttcgttacaacttccgagattaatggcgtcgcacaccgccggcatccaacaacttcttgcagccgaaaaacgagctgctgaaaagattaatgacgcccggaagcgaaaagcacagcggctcaaacaagccaaacaagaagcacaggcggagatcgaccaataccgacatgaaagggagcagcgttttcgcgagtttgagcaaaactatttgggcacacgcgacgacattgaggcgcagataaagcaggagacggaagcgaatctgaaagccatggacagtaatgttgcaaaaaacaaacagcaggtcattgtgcgtctgctgcaattggtgtgcgacatcaatccggaactgcacacgaaccttcaactccaagtcaaactgttcggcaaagcggcataaactgaacggacggaggagggagttgggaaagaatgttttttgatgtgatcgtttatttaaaagacaacaattagttttatattccatcaaatataagaggttattaaaagtatcgtaaaaa

SEQ ID NO: 49130 - DNA, 666 bp, Heterodera glycines
  SCN-specific regions: Sequence locations=1-396,418-597,638-666
gttcgtgttcccaggcaaaatgcgacccctcaccgatgaagagacggaaatgcttaacaataaattgtccaattacatcggccgtgacaacattcggctgttgttggaacgcgaggacggcgcctacgcgttcagagtgcacaaagaccgagtttactattgcagcgaacagttggcacggcaggcggcctgcgtgacgcgcaagaaactgttcagtgtcggcacctgtctgggcaagttcacccattccggcaagcgcttcttcctgcacatcactgcgcttgactatttggcaccgtacgcgggcggacgcgtgtggctgaagccgcaggcggagcagcagttcctctacggcaacaacgtggtcaagtcgggcgtcagccgcatgagcgacggggtggaggcgaacaagggtgtcatcgtctacaacatgtcggacattccgctcggcttcggcattgtggccaaaaacacatcggactgtcgacgggcggaccccaccgcgttggtgctgctccatcagtccgatttgggcgagtacatccgcaacgaggcgatgctcacataaacgcgcggcgacattcccccccccccaatttttgcttaaatttgtgttgaaaacatcaaatttttcagtacttgttctcaaataaatcctgggcattc

SEQ ID NO: 49131 - DNA, 1081 bp, Heterodera glycines
  SCN-specific regions: Sequence locations=1-708,730-1081
atctttccagggagagtgccatttgctgccatcacaagtcgctccccaaacttcgtccctccgcctcacttattccgctttccatggcgtcggctccaaattcgtccgccgaatgttcgctgagtttggctttccctcggagaacatttcgtacgttaaggaacaagacaagcccgaccccgactttggcactgttccattccccaaccccgaggaagggcaccgggtcctcaaactgtgcattgagactgcaaatgccaatgactcgactttgctcctcgtcaatgacccggacgccgaccgactccaattggcggagaaagaggcaaacggagagtggcgcgtgttcagcggaaatgagatgggcattctgctgacgtggtgggcgtggaccaattggcgtgccgccaacccaacggcggactcttcgcgggtgttcgtcctccattcggccgtctcttcccaaatggtcgccacaatggccaaaaaggagggcttcaaagcggcgcattcgttgacgggcttcaaatacataggcaatttggcacacaaattgcggtcggaaggcaacaccgttattgccgcctgggaggagtccattgggtttactcccggcacaacgctggacaaagacggcgtttcttccgccgcggtctttgctgaaatggccaattggctgcgcacccaaaagggcgtttcgctgcgtgaacagctcttccgcctcttctccatctacggctttcacctccaacgcaattcgtattggggggtcaaatcgacggaagtgacgaagaaattatttgcggaccttcgctccgattatcccgaaacgattgggcagaatttcgatgtgaaatttgtgcgcgacttgacgacaggttatgacaacgctcaaccggatgacagggccattctgccgctgagcacctcctccgaaatggtgacgttcactttggtcgacggaagggcggggacactgcgggcgagcggaacggagccgaaagtgaaatattacatcgaactgcgcaccgaaccgggcaaagaagaaaaggatctgagttcggtgcttgagcagctcgac

SEQ ID NO: 49132 - DNA, 1079 bp, Heterodera glycines
  SCN-specific regions: Sequence locations=1-77,113-126,149-212,234 -1017,1043-1079
acaattattttcattcttttctgttctaccgtacattttgtttgtcaaatggttgcacttttcttctccaaatttgttgttgtcccttcctcctcttccctcggtgtctcttcgtcctctgccatcctttccctcgtctctcttctgtcccccgtcgccctcccccaccggcgttcatttgccgtggtgaataacgtcaaaatcgtcgacccgatggatgtgcgcaaggacaatgtgtctacgaagaaaaaggatgatggcgttgcggctgaagtacgccgcaagaagaaggtgtacgcgctggccgaattcttagaccgtcccgaaaattggggaaagttcggcgcattagacccgtccgatcggcccgggcgttcgtggaccgttgaggagcttcgcctgaagagcaactccgacctgcacaagctgtggtacgtgctgctcaaggagcgcaacatgctgctgagcatggaccacgcgtacaaagtgcgcctccgcaacatgccgaaccccgagcgaattgaccgtgtggccgagagcatggaacgacttgaggcggtggtgcacgaacggaacgacgcctttttgcacttggagacgggcgacagcgcgtcgcccccgaaacggacggtcacttccttcatgggcttcacctacgatgagtacgcaactgaacattatctgccggccgaggccaccggggagaagcagtacgagcagccaatgctggacgaccaggcccatctgatgcaagtgctgtggcgagagaaggagcagctgaagaaggaggtggcactgatggacgagtatttgtacatggacccggagcgggacggacgcaacgatatgattttgacacgtccaaagcgtcgctactacgaccgggtggaggacttgccgcagaatgttgttgcccggtggcgcaaggagcgcgagcagttccaaccaccgaccgacccatatgctggaaaagaggacgaagaatgagcacggagcggataggatgatgattaatgatcatgaagatggtgttgaacaacatataattaatgaatgcaaatgataaaaataaatatgcc

SEQ ID NO: 49133 - DNA, 670 bp, Heterodera glycines
  misc_feature (602)..(602): n is a, c, g, or t
  misc_feature (604)..(604): n is a, c, g, or t
  SCN-specific regions: Sequence locations=1-7,31-302,332-400,422 -565,587-643,666-670
ctccgtgaagaattcggcacgagagtttttgatttgctttcaaaatgaagctgaaccctttcgtctcctcctcagcgcgcaaatcgcgcaaacgccatttcaacgcgccctcgcacatccgtcgtcgcattatgtccgcgccgctgtcgaaggatttgcgcaataaacacggagtgcgttctacgcccattcgcattgatgacgaggtgactgtcacccgaggccactacaaaggcaatgccggccgtataatgcgtgtgtatcggaagaaatatgtagtgcacgttgacaaaatcactcgggagaaggccaacggaacaactgtccacgttggaattcatccttcaaatgtgcagatcacaaagttgaagatggacaaggaccgacgttcattgctcgaaaggaaagcggccggcagagcgcgagtgacgggcattttgaagggaaagcacacggaagagaccattgaagagtgagagagcggcaggggaggagagggacagagaaaacgaattgttacgccgaaattggacatcatttgttgttatttgttgtttgcaaatacaaaaagcaggcagttaaaaaacaaaagagcaggaggngnggagcccccctccgggggggggccccgtgcccaagttcccccagaaatggggccgtttacacaacc

SEQ ID NO: 49134 - DNA, 769 bp, Heterodera glycines
  SCN-specific regions: Sequence locations=1-245,268-487,509-769
gtcctattaagcagtttttgtttccttacctcattgacaattttttcttcattttgtgctgttttcatcatgagtgacgacaactgctgcggctctgttggtgcccgttctccgactggctccatctcatcaagcggttccgctgattatgacgttgccctttcgccaacccaattgcttgcaatggcaatcaagaaacgtcgtcacttgctcgaggacaagcagcgcgactaccaacgggagctgctccactcgcacctcatccagaacttgtgtaagttcctcggtgaaggtcgagcgcgagtgaggcgacaccgccgcagttcatcgcggcgtaagttggtgagacatcgtcgttgggacgacgacacgagtggaaacggtgacgagaggggccagcaagtggtccctgacgatagccgatcgccttcctcttcccccaatccatcggggattgtgtttgagtcgacggttcagagcgatgccaattttggtggtgatggtggaggccggggcccacggtggctcaacaaacgctcttctcactctgacgacgatggacctccgatgaaacgaaaccgggcggactcttccgaggatgggctcacgttcattgatctcaaccaaccttgtgaggttgggaagttcgatggagaatttgcagatggtggacggatattctgatcggaatggcatggtcgtcatgatatgattacagtttctttccttttttctacgtgtatttttttttaccgcagataaataattt

SEQ ID NO: 49135 - DNA, 752 bp, Heterodera glycines
  SCN-specific regions: Sequence locations=1-269,291-542,565-752
ccgtttgaggttaaatggcaaggtcaccgctgtttttactttccatttttatttgcactgaatttgtcctttgtgcagtaaaatcgaagaatcttttgaatctaaatgaggaaaattggcgaaacattctcagcggcgaatggatgatggaatttcacgcgccgtggtgccctgcctgcaaagacctccaaaaatcatggaattcattcgctgattggtcaagggatttgaacataaatgttgcggaaatagacgtgaccacgaatccagggctttctggacgatttcttgtcactgctctgcccaccatttatcacgtgaaggatggcgtatttcgactttacgcgggaccacgcgacaaaaatgatttcatctctttcatcgaagacaaacgatggaccagcatcgaccccctcccgtcctacaaacatccggacagctctcaaatgggcgtagtcgccgtcttcttcaaactgtccatggcagtcagagacttacacggacattttgtcgaaaatgtcggtgttcccgcttgggcttcgtatgcattctttgccacagtgactctcgcgttgggctgtgtcctcggatttatcatcgtgtgcattattgactatgtgttcccaactggggcgcttaagaagaaggaagccgagcgaaggaaggagcaaacaagtgccaagaaaaatgcaaaagaaagcgctgagaaagcaaatgggcaaaaggaagttttatcggacgaaaagaaatcg

SEQ ID NO: 49136 - DNA, 543 bp, Heterodera glycines
  SCN-specific regions: Sequence locations=1-543
ataccgtttcttttattcaaatttgataatggcagatgatgaagactatgatgggggagaaatggacggcgatgagtttatggaggaagagcccatagaagaccttgatgcggaacaccaagcgggagaagaagaggaaggcgcggagaatgtccaagttattaatgtttctgacaaagttgcatcatccaaccgagtgacaactccttttatgactaagtacgaacgtgcaagagttcttgggacgagggcgctgcagatagctatgggtgcaccagttatggtcgaaattgaaggcgaatcggaccctttggaaattgcgcgtaaggagctcaaggaccagaagattcccataatcattcgtcgttacttacctgatggttcattcgaagactggggcattgatgaattgcacattacggattggtgaaaatgattaaccgcgtaattggcattttttctatttatgtttaatgaatttttgattcactaatattttctgcttattttgaccgatttttaattgacgttaataccttattt

SEQ ID NO: 49137 - DNA, 786 bp, Heterodera glycines
  SCN-specific regions: Sequence locations=1-786
ggctttggacccgtccacattcccaaccagggcttccgattttatgtggaatgcgtgcgcgggacggacggacagtgtcagcaaagtgcggcccgacggaagacgctccactgcgcggtgcaggcgaaccccgcggcgaactctttccgctggctgaagaacggcggaccgatcagcggcggaaatgggcccgagtttatgatcggcacggacatgatcggacactcgctgcagtgtgccgccaataatggcctttacggtgaagagctccaatcgcccgccgtttacatcgattcgtacaccgccgcccggctaattcaggacaattttcagcaagtgcagagcagcgcgcccttccaacagggaaaccgcgtcgaaatgggccagcgagttcagatgagttgcgtcgtcgaaggcaatcctcgtccggcggtgttttggaagttgcgaaggagcaatggccaagtggtcgacgcgccttgtccccagggtctgaacggtcagtaccgggaagtgcctccgacccaattgccgacgggcgcagccgccgtcgcaaattcattggcggcacaacagtctaattcgttgatccgtctgcaagccatttgcgacctgcaagtggccaactattccttctccggacagtattggtgttctgcctgttcctacgtgtcccagggactgcccgagtgttctccgggacaagacgcgccgggagatcgccttctgaatatccaagtgcagggaccgccgcaacagtccgagacggaaccaagcgtggagcag

SEQ ID NO: 49138 - DNA, 734 bp, Heterodera glycines
  SCN-specific regions: Sequence locations=1-734
gaaccaatgcacaaccaattccttccgcttgcgactgcgttgtcgtccatccgtcagtaccattcgccttccgtttatggcaaatcggatgaactgttgcagctgcgcattgagctgaacatgaccaccgaaaaagcgaccaaattcgtgtcagattcgcgtcaattggttgtccttccgcatccttttcaacactctgaaaagcgtaccattttggcatttgccggcaccaaagaagcgcaacaggaagtgatgctaaacggagcggacattgcaattgggccggaaatggtcaaaaagattctcaagggtcagttcaacatggacgactacgacttttgcattgcccacacggacatggccaagcacattctgccacttcgcggtgttatcaaaacgcgatttccgactaaaatcaacggaggaattggcgatgatctcaacgaaattttggaaagctttttgtccggaataaatttgaccgtaagaagggacccgaccaacaaggaatggggcctaagtgagcctttgatcggaagattgagcatgtccgatgagcaaattgaggagaacgtggcggtcattgttgacactctgtgcaaaatgcgcaaagccgtgcttggcccgttcatcaaccgcgcctctctgatcacagcctctaccggccctcaacagtcgtttttccctgtcgacgtgagcccttgggaagcgttgccgacggaagaggaaattga

SEQ ID NO: 49139 - DNA, 742 bp, Heterodera glycines
  SCN-specific regions: Sequence locations=1-35,58-89,111-704,726-742
gtctttaagtaattatttgtaggcctttgcgatgaaagtcatcaacgagtttggctatcgtcaagatgcccgaacacccagccaaatccgcaacattgtctatcaaatgggagtttactcacatgcggacggctccgcttacattgagcagggcgagacgaaggtcctttgtgcggtttacggtccgcacgaatgtcgcttccgatcacgagccaaagaagacgaggccattgtcatttgccagtacagtcaggcaactttttcggttcctgacagaagaaacaggccgcgtggcgatcgtcgaggcaattccttttcccaccttttggagagggctttcgaatcagtcattttcacaaatttatatcctcgaagtcaaattgatatattcttcgaactccttgaggctgacggtgccaatttggccgcctgtgttaatgtcgccagtttggcactggctgatgccggcattcccctgcggggactgctgtccgccgtcgaatgtggtagtgctgatgggttgccttgtgcggatttgagttctcgtgaacatagtgaattggtaccacgcctcacaatggccaccgttggaggtaaagacgaaattgttcttatggacatgaaaaacctactccacaaaaatcatttgccgtctttgttacaaatgggcgtcaatgcgtgtgcccaagtacacatttgtctggagacagctgtttttaaacatgtcgaagcatcgcatccg

SEQ ID NO: 49140 - DNA, 848 bp, Heterodera glycines
  SCN-specific regions: Sequence locations=1-75,105-814,836-848
gtcctttagaggacaactgaactcctatttcttctcgccggaagactttcgtcgtccgtttgtgctcagcccgtgctgatggagaaggaggaggagggtgaaaagtcgatgaacgacctggtgaccgcttcgtccccaacagaagttcgtcctgcttctcctcccgcttcttcctccgtctccgttccgccatcagcagctggtgttcccccgtctctctatgtgcgtcttcctcagcccgacgaccctttctatttttgcgccctcgccgttggcctcgccgcagttccgcccattacttttggcatttccgggccgcctcttcacgtttttgtgcaggctgacggcgtaactgatgcaccgaaggtggagttggaagacaaacagttgtgggaggaatttcacaaatttggcaacgaaatgatcatcacgacgagcggaaggcgaattttcccctcaatgagtgtcaagctgagcgggttggacgagaaggcaaattactacgtggtgatggacattgtgccgagggatcccaatgtgtgggagtttagcgactcgcgctgggccgtcgcgcgaccgataaacccgccatcagcggaggaactgctgacgccgttgcacatccatcccaactctcccgcgagcggggagcattggatgcgcgtaggggcgagcttccatcgagtgaaaatcgccaccagcaacgagacgaaccgtgccgaatttgtgcgttggttggcacaagcgacgggagggggcggggaaaacggttgtcattagagactgtacaggccctgagggcatttaccgagccgttttgtttctgtcccgttttttggacaaaccac

SEQ ID NO: 49141 - DNA, 719 bp, Heterodera glycines
  SCN-specific regions: Sequence locations=1-719
ccccctagagtactctttttgaacgacggcctcgcaatttttcaattggacaggacattcaaccgaaacgggacctaactcgctttgttcgttggccaaaatacattttgctccagcgacagcgtgccgttcttgaaaagcgtctgaaaattcctccaccaatcaaccagttcaaatttgctcttgacaaaccaaataccaaccagctcttcaaattgcttaacaaataccgtcctgaaactcgccaggcgaagaaagaacgtcttcgtcaacgagctcaggatcgagcagatggaaagcaagagaaactgacgaaacgtcctcctgttgtccacttcggcattaaggatgttgtcaaagccgtggagaacaaaaaggccagcttagttgtcattgcacacgacgttgacccaatagaaattgtgatttgcctgccggcaatttgccgcaaatttggagtgccgtatgccattgtgaagggaaaagcatttctcggtcaagttgtctaccgcaagactacttctgccgtgtgtctttgcgacgttaatccggaggacagaaacgcgcttaaaaatttggctgatgttgcggtcaccaatttcaatgaacgcggtgatgaacttcggaagaattggggaggtgcgatcatgtcccagcgttcgcaagcacgacaggctaagattgaaaaggctcggcagagggatgttgggcagaaagtt

SEQ ID NO: 49142 - DNA, 821 bp, Heterodera glycines
  SCN-specific regions: Sequence locations=1-740,762-821
gaaagcatgcaacgaaaaaccagaattttgaaaaacgactgttaactttcttccatccctgatccgcagtcgtggatttaagtcgctgatcgcggttgcgcgccaccaaaaatttcctccaacgccacaaccacactttggcacaaatgttgtcgtcacaaccgacgctgatcatggacaacggcgcgtacagcataaaggcgggctatgccaccgaccaaagtgccagaattttccccaacactgtgttcaaatcgaagggcgagcggaagcgcattttcgtcgccgacgaattggaccagtgcaccgaccgatcggcactgtttttcgtcttgccattcgaacggggatatcttgtgaactgggacacgcagctgcagatttggaaccgcgtgttcggcacggagggcgccggcctcggcgtggactgccaacagtgccgcctggtgctcactgaccccaacgaagtggcatttgcatttgcggacaacacggatgagattgtgttcgagaattaccgcttcaacgctttcctccgaacgtccgcgtccgcctgcaccgcccaggcgcactgctcggccaacaatccgtgctgtgttgtcgtcgactcggggcactcgttcactcacattgtgccatttgttgggggacaaattgtgcgcgagggcattgtccgaattgacatcggtggcaaagcattgaccaatcagttgaaggattggatctcctaccgccaactgcacatgatggacgagacgtatttggtcaattgttgcaaggaggactgctgcttcgtctccaccgactttcagcgggacatg

SEQ ID NO: 49143 - DNA, 526 bp, Heterodera glycines
  SCN-specific regions: Sequence locations=1-2,26-256,301-526
cgctcttttgtctctttcagtttagctcattatctttatcactttgttacttcattaattgaatcgatttggcatggccactgcagtgaaaccgcgaagcgaaatgagcgccgaggaattggcggccaaagagcaggaggagttcaacttgggccctctctcagtgctcactcattccgtgcgaaaccatgcgcaggtgctcattaattgtcgaaacaacaaaaaactgttgggccgtgtgaaggcattcgaccgtcactgcaacatggtgctagaagatgtgaaggaaatgtggacggaactgccgaagaaaggaaagggcaaaaagaagtcgaaacccgtggcgcgcgaccgtttcatccccaaactttttttgcgcggcgacagtgttattctcgtgctgaaaaacccgttggccaacccggacgcttgaagacggaagtgtcgggggatggaaaagtcgtcgttgttcttttcgcatgctttttaatcttttatttaaataaactttgcctttgcaaaaaac

SEQ ID NO: 49144 - DNA, 518 bp, Heterodera glycines
  misc_feature (501)..(503): n is a, c, g, or t
  SCN-specific regions: Sequence locations=1-374,396-518
caaccctttgagattcacctcaactcgccattcaacatccggaccatctacaacttccgcctgatcaacacgggctcaaagcgcattgggttcgccttcaagacgacgaagccgaagcgcatcttcctgaacccgccgtgcggcaccgtgggcgtcggcgacaccgtgaacgtgatcatcaccgtggcacccttcgacccgaacaacgaggacatcaagaacgatcgcgtgatcgtggaatggtgcaacgcgcccggcccgtctgacgccgtgttcaacttggactggttcaccgaaaatgcggttcgaaatgtgcgcctcaacgtcgtctacaacttgtagcggatgcaatatgatgatctgtatcgatccatttcatgaaatgtatttcaatgatcactgttatcttgagactgtcctgtattatgtgttccgttttttcatcatcatgaaatgtatttcaatgatcacggaacgataaatcggcgctagtgtaaaaannnaaaaaaaaaaaaaaa

SEQ ID NO: 49145 - DNA, 1410 bp, Heterodera glycines
  misc_feature (1402)..(1402): n is a, c, g, or t
  misc_feature (1406)..(1406): n is a, c, g, or t
  SCN-specific regions: Sequence locations=1-687,709-1410
gtcctattaagcgacaaaagaaaatggtcaaagacaaaaaatattactacatcctcgaagtaaacaccagtgcaacagaccatgacttgaaaaaggcctatcgaaaattagcgcttaaatatcatcctgacaaaaatccgaatgaaggcgaacgttttaaactcatttctcaggcttacgaagtgttgagcaaccccgaaaagcgtaaagtatacgacgaatatggagaagaagggcttaagggtggcggagaaggcggcggaatgcacaatccaatggacatattcgaaatgtttttcggcggtggtggttttcgtggcggtggtgaaaaaccgaccaaggtcagagatactgttcatcagcttaccgtttcgttagacaaactgtacaacggatgcaccaaacacttgcgcatcacaaggcatatcctttgtccgaaatgtaatggtgtcggcggcgctaaggaaggggtcaaacaatgcgaaaattgtcgtggacgcggactggagattcacaacatgcaaattggtccgggaatgattcagcgaattcaaagagcttgttctgaatgtggcggtgagggggaaataaatcgcaacccgtgcaaacactgtggcggcaaaaaacggatcaaatcagaagagacaatcgaagtgcatattgagaaagggatgcgcgacgggcagcgactgatgttctacggaaagggcgaccaacagccggggctggagcctggcaacgtgatcattgtgctggacgaggaggagcatcccgtgttcacgcgaagaggcaccaacctcaccctgaacatgaaactgacgttgacagaggcattgtgtggctgcactaaacatgtggtgacgttggacaaacgcattctcagctttactcagttgcctggcgaggttatcaatcaccgcgacttctatgtaatccaaggcgaagggatgccgacccatcgtcacccggaccaaaaaggcgacctgattatccaattcttcgtggatttcccagacaaacttcctcttcaaatgaaaaacatggacttgctgcgagaattgctgaaagatcacgagattgagcctgagccggaaacaatcggagcgaacgcgcagaacgctatcaaattggtgcccatctctgaagaaatgttacgccggcgagcgcacgacgaagaggcaagcaacggagaaccgcaagcggtgcgatgtgccactcagtgaacgtgaccgtgaccaatgaaaggatgattttgatggtcaattacggcgtctgacttttacatattaattgctgaagagaatattataaaccgctgtttgtttgttctttctgtattccaatcgcattgtttgatcttttacttggattcttcatgtatttgattagacctggaacagcntggncgtc

SEQ ID NO: 49146 - DNA, 853 bp, Heterodera glycines
  SCN-specific regions: Sequence locations=1-79,101-115,138-853
cctccttccaaattcggcacgaggctttttttaaaaaatggctaacaaaatgaagaaaaagaagaaaaatgctgttgctactacaactgctggaccccaaaaggatggaggcaaattcaagcagaaagggatcaaattcaacacggaaaagggccaacacattctgaagaatcccggcgtggtccatgccatcgttgagaagtccgctgtcaagggcactgacactgtgctcgaggttggcccaggcaccggtaatttgtccatgaaattgttggaccgtgccggccgtctgattgcctacgaattggaccctaaaatggtggcagagctgcagaaacgtgtggtcggaacacccgtccaatacaaattgcgtatcattgctggcgatgtgatcaaagcagccgagtggcctccgtttgatgtgtgcgtctccaatttgccctaccaaatttcatcaccgtttatttttcgactattgctccaacggccattgcccaggtacgccgtgctgatgctgcagaaggaattcgccgatcgactgttggccaagccgggcagtaaggtgtattgtcgcctgtccgtttctgtccaattattggccaccgttgagcatctgatgcgtgtgaagcgttccgaatttgtgccacctccaaaggtggactcggccgtcattcgcattcagccgcgcaatccgccgccggccatcaattacaaggaatgggatggaatgttgcgcattgcgtttatgcgcaaaaacaaaacactgtcggcgctgttcaagcagaagcaggtggtcgatgtgttgcgcaaaaattacgcagtcgtttgcggcacgaagggaaaggaagtgcca

SEQ ID NO: 49147 - DNA, 854 bp, Heterodera glycines
  misc_feature (778)..(778): n is a, c, g, or t
  SCN-specific regions: Sequence locations=1-704,726-854
gtctcatcgacgaaatgattcagtccggtctctgccgactcaccccctacgaattgtgggccgtctgtcagccggaggttggcttaggcagggaaaagatcactctgcgcaaaggcgacggactcaacctgtacatgaacagagatttggcttccatttatgcgcgacatcgtctttacaacgcggacaaatattactatttggtggactatggccagaccaatcactttaaccaattgcgacttttgctgcgcatccgtggcgacgacgacttggcggaccgaatggaacacgtctctttcggtcgcatcatcggcctgtccacgcgcaatggcaaaaacgactcggtggactttctgattgaccagggcgcgcgcgaggcggatgcgtatgtgcacgcgtcgccgacgatgcgcgcggagccggccgaattgggcacaatttgccgacggttggccgagtcgacgctgctctttgagattgtcttccgtcatcgaaacagtcacttcactttctcttttcgcaactcttttcgtccgggtggcaccaacgctttgctgctccatgagaagttcagtcggctccgttcgctggagcacgcccaacacgagcacatggaacgcatccgcgcattgaacgcggacggagaatggaaactgaacatggaaatgcgggagccgggacagaagttggctcggcgcattcaggagttcgacacggtggtgctgaccgcgatgaagaagatggacccgaatccggtggccatttacttgcttanactgtgcaacgaaattggcacagcgatggccgcccttcgggtgcaggacgaaacaattgcggtggcactgccgcgt

SEQ ID NO: 49148 - DNA, 883 bp, Heterodera glycines
  SCN-specific regions: Sequence locations=1-403,425-619,643-883
tttctcgcctaacgaagtgcgcgaaaaagcgagccaaatgatcggctaccatttggtcaccaaacagacgacggccgagggccgactgtgccaggccgtgttggtctccaagcgactgttcacgcgcaaggagtactacttcagcatcactttggaccgttccaccgccggtcccattttgatcggctcctccaagggcggagtcaacattgaggaggttgccgccactgatccggatgcgatcatcaccattccgatcaatattaacacgggcgttacactgcagatcgccgaagacatggccactcggatgggcttccatgacgaatgccgtgcacaggcggccgacaccattcagcgattgtacgacctgttcatcaaaagtgacggtaacttggtcgaaatcaaccccatggtggaggacgcggaaggcaatgtggtgtgcatggactgcaaattcgttgtcgacccgaacgccgagtttcgccaaaaggagctgttcaaactgaaggacagcagccaggaggacgagctggaggtgcgcgcccaaaaggccaacctgaactacattcgactggacggcaacatcggatgcatggtgaatggtgccggtttggcgatggccaccatggacatcatcaaattgcacggcggcgaacccgcaaattttttggacgttggtggcggcgcaacagttgaacaggtgtacgaggcgttcaaaatcatcactgcggacgagaagaaggtcaatgccattctggtgaacattttcggtggcattatgcgctgcgatgtgatcgcccaaggcattatcaaagcggcggtcgtccgagttggacttgaagattccgattgtgtgccgtctgcaggggacgcgcgtgga

SEQ ID NO: 49149 - DNA, 621 bp, Heterodera glycines
  SCN-specific regions: Sequence locations=1-599
tgctatttatgagtctgcatttaactaaaacttaacgtttgagaaaaaatgttcgtaaaaacattttcgaataaaaccgttgttttcaatgtggacccgactgaactgtccgtcgagcaactgaaggcactgatcgctgaggaggaggaaattgctgtgccggaccaaagacttgtctttgctggttgccagcttgtggatggaactctgctcaggacttatggagttgatgctgattcaaccatccaccttgacctcagattgcttggtggtgggaagaagcgtaagaagaagcaatacactggcccgaagaagcagaagcatgttcgcaagaaggtcaaactcgccgtgttgaaactttacaagattgatgacaatggaaagattcatcgacagcgtttggaatgcaattcggccagctgtggagccggaattttcatggcgaagcacaaagatgggcgtttctactgcggcaaatgtcatcaaacattgaaggaaaagaaatgagtgcttgttgagaattattgaatggatagccgttgatgctattttggtttttcgttcggttgttgttatcttgttgcttaaaaatatttttgaaaaaaaaaaaaaaaaaaaaaa

SEQ ID NO: 49150 - DNA, 582 bp, Heterodera glycines
  SCN-specific regions: Sequence locations=1-99,123-147,174-177,211-532
tgcatcggtgtcaccagaggaaagggtttcaagggagtgaccagccgatggcactgtaagaagttgccgcgcaagactcacaagggtctccgcaaggtggcttgtatcggtgcatggcatccgtcgcgtgtctcattcacagttgcgcgtgccggtcagaagggctaccaccatcggacggagatcaacaagaagatctaccgcattggcaagtcgtgtttgacggccgacggcaagaaaaacggaatgaccgacttcgacatcactgagaagaacattaacccgatggtttgtttattatttgattgttgcctgccaaattcctttacaagcagatcacaatcttttaattttaaattgccaattgcgcctaactcttgccttacgattttagggcgggttcccccactatggtctggtcaatcaggactttctgatgatccgtggctgttgcattggttgcaagaagcgtccgatcacattgcgcaagactttgatcaagcagaccaaacgttttgctttcgagaagataaacctgaagttcatcgacaccagctccaagtttggccatggacgcttcca

SEQ ID NO: 49151 - DNA, 553 bp, Heterodera glycines
  SCN-specific regions: Sequence locations=1-553
agccgaagacaaattcatcgtggatgaagtcaaatcaaatgaatgggtcaaggtcaactccaacttctcttcgttttttcgcgtccaatactcaccgaacatgctgcagtctttgctggatggtgtgaaaaaccgcgaactcggagtgttggaccgttaccaactcgccagtgacctctacgcccttgtaaaatcttctcgcgtatccgtttcacactttctcgcgttgctcactgtttgccaggaggaggaggattactttgtgtggtctgcaattgactcgggcattggcagcatcgctcattcactgaaacatttggacgacgaacgcaagctgttggaccgtttcgagcgttttgtgtgcaaaatgattgaatccgtcgctgccaaattgggctgggaacccaaagagggagaaactatacacgttggacgtcttcgtgccctgctcctcagccgtttgtcacattttcgccatcaaccgactattcaaatggcactttccaaattcaatgccctcatcgagaaaggcgtcgatgttgtcccggacttg

SEQ ID NO: 49152 - DNA, 339 bp, Heterodera glycines
  SCN-specific regions: Sequence locations=1-56,93-111,137-339
cggtcgcgtccgactcgaagaacgacccggcaaaggaaaccaagagcttcacagctcaagtcatcatcatgaaccacccgggtcagatcgctgctggttacactcccgtgttggactgtcacaccgctcacatcgcgtgcaaattcgccgaacttaaggagaaggttgaccgacggtctggaaagaaagtggaggacaacccgaaaaacccactccatccctttgttttatcgttattttttgcaattccttccacctccgtctctatccatattgtcgttacgttggataatgttcatttttttgttgttgttctggttggtaaaataaatttggcca

SEQ ID NO: 49153 - DNA, 543 bp, Heterodera glycines
  SCN-specific regions: Sequence locations=36-171,349-420,442-543
ttttaaaattattttctaatcattaatatttaattcctaattatgttttatcaaacggtgtgccttcttttgctgttgagcgcatcgaatgatgttgcggtttttggacaggaagaaacaaccacaacatcgactagtagtacaagtacgagcacaactagttcaaccagtacatcgaccacaccaactacaacatcttcaaccagtacatcaactacaccgagcacaacaacttcttcaaccagcacatctacatcaactacgccaactacaacttcgtcgactagtacatcaactaccccgacaacaacttcttcaaccagtacatcgacgactcccactacaacatcttcaaccagtacatcaactacaccgagcacaacaacttcttcaaccagcacatctacatcaactacgccaactacaacttcgtcgactagtacatcaactaccccgacaacaacttcttcaaccagtacatcgaccactcccactacaacttcttcaaccagtacatcaaccacacccactacaacttcttca

SEQ ID NO: 49154 - DNA, 238 bp, Heterodera glycines
  SCN-specific regions: Sequence locations=1-238
agatcagagatcacctcggggacatcattcacgaactttcttcgatgaaatttgaggacccatccgaaaaaaacggaagatcagatcaaaaaggattacgaagaactgtatgaacggatgcagaacaaattccgagcgttagaggatgaatgaacaaactgtgatcaatgataacaatttctcaaaattttccctcatttctcttagtgtagtgatggaaaaaacgtctcagtgagta

SEQ ID NO: 49155 - DNA, 1195 bp, Heterodera glycines
  SCN-specific regions: Sequence locations=1-110,132-199,221-337,359 -1195
atattccgcccattttgggcttttaaaacacattcaatttcaaacggaagtgttaaatgtgcaacgggtggaggaatttgcacagaatggcaaatggacagtcacttatcggaagacggaggacgaggagcaaaaagtgatggacgacactttcgacggcgtcatgctttgcactggccatcactgctccgaacggtggccaaacccccctttccccgggcagtccgtcttccgtggccaagtcattcactcgcgcgcctttcacaccgcaaaaccattcgaagaccaaactgttgtggtggtgggcattggcaattccgggggcgatattgcggtggaactgagcaaagttgccaaaaaggtgtatttgtcgacccggaccggctcgtgggtgatcaacagagtgtgggagaagggccaccccactgacgcggtactgctcaaccgattcgcatttgccctgcgggcgatcactccgcgcagcgtccaaaacagattgatagagcgcaagttgaacctccgccttgaccacgaacggtacggccttcgcccgtcgcatcgctttttggaggcgcacgtcacagtgaacgacgaactgcccaatcgaatcgcgagcggaacggtggtgataaagccgaacattcagaagttggcggagaaggacgtgacttttgacgatggtacgactgtgtacggtgtggatacagtaatcttcgccaccggctacaactttttctttcctcagctggagaatggcagattgatttctgtgcaggacaacaaaacacttttgtacaaattgatgtttccgcacgacttatcgcctaagaacactttggccatcattggcctcatccaacccaccggctccattatgcccatttcggaaatgcaggcgcggctgttttgtgcccaattggtcggtgacatttcactcccgcaaaaggcacagatggaagccgacgcattggcacaagcgcgaagaattagcaaggaatttgtgaacagaccacggcacacaattcaagtgcaatacgtggattacatggacgagttggccaagttggtcggctgcaagccgaaattagtcggacgcattttcactgatccatgcctggccaaagttctcctcttcaacggcctcgtgccgtaccaattccgattggatgggccccaccgatgggaaggggcgcga

SEQ ID NO: 49156 - DNA, 539 bp, Heterodera glycines
  SCN-specific regions: Sequence locations=1-323,345-365,389-539
tggaagtagaaaacgtaaagcttttcaaccgctggtcttatgaaaccattgaagtcaaggatgtttctttgcaagattatatttcagtaactcaacacccagtttatcttccacacactgctggacgttaccaagttaaaagattccgcaaatctcagtgcccaatcgtagaacgtctcgcatgttcccttatgatgcacggacgtaacaacggtaagaaattgatggctgttcgtattgtcaagcacgctttcgaaattatcaaccttttgactgacttgaacccaatccaagttttggttgacgcagttcaaaacactggacctcgtgaagactccaccagaatcggttcacaaggtaccgtccgtcgtcaagctgttgatgtttctcctctcccccgtgtcaaccaagctggtcacttgttgaccaccggagctaaagaagctgctttccctaacgtcaagaccattgcaaaatgtttagctgatgaattgatcaacgctgccaagggatcatcccactcatatgccatcaagaaa

SEQ ID NO: 49157 - DNA, 714 bp, Heterodera glycines
  SCN-specific regions: Sequence locations=1-18,40-77,118-230,254 -315,344-442,465-470,494-714
acttgttggcaccttattcaaaaggaggaaaaattggtctcttcggtggcgctggcgtgggaaagaccgtacttattatggaactgattaacaacgtggcgaaagctcacggcggtttttcggtatttgccggagttggagagcgaacacgcgagggaaacgacctttatcacgaaatgattgagggaggtgttatcgatctcaaagggaagaactcaaaggtgtcgcttgtgtacggacagatgaatgagccaccaggtgctcgtgctcgagtctgtctcactggtttgtccgtcgccgaatacttccgtgacaaggaaggacaggatgtgctgctctttatcgacaacattttccgtttcacccaggccgggtctgaggtgtctgccttgcttggtcgtattccatccgctgtcggctaccagcccaccttggcaacggacatgggcagcatgcaggagcgtatcactaccaccaaaaagggttccatcacttctgtgcaagctatttacgtgcccgccgatgacttgaccgatcctgctcccgcaacaacattcgctcatttggacgccaccactgtgctttctcgaggcattgctgagcttggcatttaccctgctgtcgaccctcttgactcaacttctcgtattatggacccgaacatcgttggaaaccgtcactatgatattgcgcgtggtgtgcaaaaaattctgc

SEQ ID NO: 49158 - DNA, 713 bp, Heterodera glycines
  SCN-specific regions: Sequence locations=1-713
gttattttattatattcgtttatactcctcgaaatttaacgcaattacacagctaaataccgctttaaaccatggcaaatccttcgattaacgctaaggcggcagttttggtggacaatccgcgggttgaatttgtgcaactcgactcattggtggtcatgaaaattgtgaagcacggggacatcgaattctatgccggaatgtccaaaattgctggcgaaacgtgccaaggcattctcaccggactgatctccgtcgaggacaagcggcttgaagtcacgaattgtttctcgatcactcgtccggatgctctgcacgaaagtgaagagagtgccgctggtcccgagacgtccctttcagacgagaacaaacagggcgagattctcgacatgctgaagcgatttcgaatgatgaacatcgattacgagtcggtcggcttttaccaggcgcacccattcggcgcctgtttcagccacgaactgctcggttcattggtggactaccaatcggacatttcagacgccgttgtcattgtttacgacccggtcaaaacccgtcagggatgtctgacccttcgcgcttatcgcctctccaaaaaggcgttggatttggccatcacttgcgacgacagttggtctcctgaacagaccaaattggctggggtcaactttgccaatttcttcgaagaattgccaattgttgtgaagacagcc

SEQ ID NO: 49159 - DNA, 536 bp, Heterodera glycines
  SCN-specific regions: Sequence locations=1-536
tttcgttgtcttcagtttattgagatagatgccggcttttacagagggacctcttcagagcaggacatccgtttcactgacaaggaacgcaaattgttaaggcaaatgaagttcgaaaatgtgcttgaaacaaaggtcgacttggcaaagataaatcttgatgttatcaagccgtggataacgcttaaactgaacgaaattctcgggatggaagacgacgtggtggtggaatatgtgttcacgcagcttgaggagaaggagctgaacccgaagaaaatgcaaatcaacctcaccgggtttctgaatgcgcgcagagctcgcgaatttatggcagaaatgtggcaaatgtttgtcgaagcccaagacagccccgaagggattccaacgagtttagtggagaagaaagtgcaggaacttaaggcatcaaattcgaacaaacagccaatgcagacgtaccacaaagcgacggaagtggactggaaccagcggtaccaaacactgacgggcggacgctatgggaaaatggacccaaaagc

SEQ ID NO: 49160 - DNA, 553 bp, Heterodera glycines
  SCN-specific regions: Sequence locations=1-65,87-107,130-507,529-553
taaactacctaggtatccaacaaaaaaacattttagtccgcttttaaaaaaattaattgaacccctaatcttattagtcacagaaatattgcaagaatggctccaaaagagaaagaggttggaaagggatggagctttgctcattttttttggcatctaattaaaaaggaaacacgcaatgagaaggagagacacattttggcaaacggacgattggcactttcgtttttggcagttgcttttgccggatttgcccttctgtacgactacttttttccatttccaaagtcaaaaattattcttgcggtttgctccattagctatttcgtcatgattatggtcctccaggcgtaccaatggtacgttgagaagctgacattctttcaagcggaggagaaaaccactgacaatggcgaaccacgacattggaaatggtcatcggatatgaaacgctatgatgacaaatatgtgttgatcgctgagtactcccaaggcactcgtactggctcaatgaaaggggcaaatcggtggctgctatatcacggaggatggg

SEQ ID NO: 49161 - DNA, 1446 bp, Heterodera glycines
  misc_feature (1425)..(1426): n is a, c, g, or t
  SCN-specific regions: Sequence locations=1-341,366-642,664-664,687 -695,722-778,804-930,983-988,1010-1011,1046-1220,1242-1423
ccaaaccgatttggactcgcaatcccgatgacatttcaaatgaggagtatgcggagttctacaagagcttgtcaaatgactgggaggaccatcttgctgtcaagcatttcagcgttgaaggccaactcgaattccgtgctctcctcttcgtcccccaacgcgctccgttcgatctctttgagaacaaaaagagcaagaatgccatcaagctttatgtccgtcgggttttcatcatggagaactgcgaggagctgatgccggagtacctgaacttcatcaaaggagttgtcgactctgaggaccttccgctgaacatttctcgtgaaactttgcaacaatcgaagatcttgaaagtcatccgcaaaaaccttgtgaagaagtgcatggaccttttcgaggagatttctgaagacaaggacaacttcaaaaagttctacgagcaattcgcgaagaacattaagcttggtattcatgaggactcggtgaatcgtaagaagctctcagactttctgcggtactacacttcggcctccggcgaggaaccatgcagcttcaaggactatgtttcgcgcatgaaagagaaccaaacatgtatctattacatcaccggcgagtccaaggacgttgtccaaaactcctccttcgtggagcgtgtgaagaagcgcggcttcgaggtcatctacatggtcgacccgattgacgagtactgcgtccagcagctcaaagaatacgacgggaagaagttggtcagtgtgaccaaggaaggccttgagctgccagagagtgaggaggagaagaagaaatttgaagaggacaaggtcaagttcgagaagctgtgcaaagtcattaaggacatcttggacaagaaagtccaaaaggtttctgtctcaaaccgtttggtctcttctccgtgttgcattgtgaccggagagtacggatggtctgccaacatggaacggatcatgaaggcccaggcattgcgtgactcctccacaatgggatacatggcgtccaaaaagaacctggagatcaaccctgaccattcaatcatcaagtctttgcgcgaccgtgttgagaaggagcaggacgacaaaactgcaaaggacctcgttgtgctgctgtacgaaacttctctgctcacctccggcttttcattggaggacccgcaacagcatgcgtcgcgaatttaccgaatggtgaaacttggacttgacatccccgacgaggaggagccggccgagcaacagccgagcacttcgggcgagccgacaattgcggagaaaattgctggtgccgaagaggaggcctcgagaatggaggaagttgactgaatggtgacatcgtctatccattcttggatctcggctattcaatattttgattcattgtttttttgttttcttgtttgacataaatttgaattannaaaaaaaaaaaaaaaaaaaa

SEQ ID NO: 49162 - DNA, 549 bp, Heterodera glycines
  SCN-specific regions: Sequence locations=1-549
ataggcttttgcctaaaaatcgaagccctaatcataatttatttatcttcaaaaaatctgattttttgacgacggttcagtaccgaagccatttggccacttcacgagaccgagaggagtcgaatgatttatcatttgttagatttggtgagaatgggcattttaactgcttcgaaagtgtgcactttgccacggctttcttccgctcgctctatgacttggtggtggggcccggagaaaaacaatgggcgcgaacttgttggccccactttccacggggatgaattttaccaagatcgtcttgaccgttggtacccgtccattcgatttcgcaaaaatgaagaagtgatcacgcccattcgccacaaggaattgggagattggaaaaagttgagcattgaggagaagaagcttatctaccgctactccttccgtcaaactttggccgagtttgaggcattgacgccttatggctatctcacagtcactttgttcttttctatgcttgggcttactattctgtacgcttcgtttgttaggacttacgtg

SEQ ID NO: 49163 - DNA, 1072 bp, Heterodera glycines
  SCN-specific regions: Sequence locations=1-1072
gtcccataaattcaattaaactccattaattataaatgtttcaattgtatattttgacgagttcacttgaagtggcgggaagcgaagtgatcggacaacagtgctcaattcggacgaagttgaaaatgcaggaatggcaaaacacgtagccggaaacggtgagaacggtgtcatttttgcggatccgacgacaaattgggcatttgtccacttccatgcaaagagtttgctgttcagtcggtaaattgttgaacggatgcgtcggaattcgaatattccgacgcccttccacaaattgcccgaagcgacggccgagttcatccgagtagaaatactcgagaaattggaccaggaaaagagcgtaagtaaagagacggcccaaagtcgagggaagcgaaaccaacgaacgccaaagacgcgcgaaaacatttgtcctccgcaaatgaaaaggcaattggccctcagcgtcgaattgcgccacgtcggagagagttaacttctcaagacgacatttggccaaaagaagggaaaggctggggacagaagagaaggaaaagacgaaggccaattgtaagagcaacgtgacgaggaagagaagggctttcagagacggataaaagcgaaggaaaagacgacgccatcctttttgccgaattgcatccctttcactttcaatttgttcacttaatctttcgaatttgtcgtgaatgtaaggcaaaacaacaattagaaaaagcgaccgaaagcgatggcccagccgagaaaaggacgacgcattcattcgccacggaacccttttcatcccatagaaattctcggaaaatgaagcggaaaatcgtttgagaaagcgattctccaggaacaaatgaagcagcaaaaacagctcgtcaaaatgagagtcgacgaaagagagacgacggcccgaaaaatgggaaaacagatttaaaacactgcgaatgccctgcttcatcgacccgctcagagattcttgcgccaaatattcgaaaatggacggcaaagtcattgcgcacggattacccgcgtcagtgcgtgcgccgaggacagtagcaaa

SEQ ID NO: 49164 - DNA, 527 bp, Heterodera glycines
  SCN-specific regions: Sequence locations=1-416,443-527
gcaaaggaattttcatctcaaggcttgtcgaagggggactggccgaatcgacgggcttactgagtgttggcgacgaagtggttgaagtcaatgggattgaggtgaatggaaaaaagttggaccaagtcgctgatatgatggttgctaatgcacacaatttgattgtcaccataaaaccggctaaccaacgcaattccctgcagcgtaaaggaaaagccgaccaattcgcagttcaaagccaataccatcaatatttcaccggagatggttcttcatcatcagccgttgggaaaattggcactttcggaagcggtggaggaggaaaagtttacccgactgggcacgggtcgtctctgtatcatctgggaacggacagacaccaccaccaccaaatggatgaattttttgatgattacgctgaggatgaagatgaggatgaaatagtggaccacacaaagacagcgttaaaaatccattgaaaattatgcaagtttttctatatataatgacaaataaaaacttaactg

SEQ ID NO: 49165 - DNA, 535 bp, Heterodera glycines
  SCN-specific regions: Sequence locations=1-63,96-535
atttcaatcaatttctttactaaatctgacatcgaatctgtaaattttatcaatcatctacccgaaaaactttattttttggaatctgatggacaagtttttcacaatttgaatgatatcgacgacggaaagctcatccaattgcattttcgagcatgtggaggaaaaggagggtttggctcgttgcttcgtagcttccgaattcacaagtcaagcaaccaattgatgtgtcgaaatttgcaagggcgtcgactggccgatgtgagggaagaagaacgattgaagaagtacatagcgaagaaggcagaacgggagaaggaaaagcagaagaaaaaggacgaaaaaattgaacgtcttaaggcgggaagggaaacaaagcaccaatttgaggaccagaaacatttgcggaagcgcgacactctcctggacgaaagtgaggatgcggttgaagcaggcatggatgcgcttgaggtgaaagcggcttcatccgaacacgaagtcagcgaaacaattgccgacactgagccggtcgctg

SEQ ID NO: 49166 - DNA, 558 bp, Heterodera glycines
  SCN-specific regions: Sequence locations=1-228,250-401,423-558
ttggtcgttttaagatttggcaatcggttcatttcgcgctcgtggagccgtgacgacatcgcttcggtgaccatttcgttcaaggagaacttcggcacccaaggccggggaggctattttgacaaaagtggcatcatccgggacgtcatgcagaaccatctgatgcaaattctcacattggtggtcatggaaaagccggccacactgagcgcagaagacattcgcaacgagaaggtcaaagtgttgaaagtgatcaaaccggtggaattggaccagacggtgctcggccaatacattggcaacccactgggaaaagacgatgactcgcgcaagggctatttggacgacccgacggtgccgcgtggctccaccacgccaacctttgccaccgccgtgctgtttgtgcacaacgaacgctgggagggcgtgccgttctttctccgctgtggcaaggccctcaatgaacggaaggcggaggtgcgcatccaatacaaggacgtgtccggtgacattttcccggaggattcgctgaagcgcaacgaactggtcatccgggta

SEQ ID NO: 49167 - DNA, 495 bp, Heterodera glycines
  misc_feature (493)..(495): n is a, c, g, or t
  SCN-specific regions: Sequence locations=1-85,109-109,142-149,206 -274,310-397,424-495
atttaattctccacagtcaaacaaccaatctgcaaaaatgtccggacgcggaaagggaggaaagggacttggaaagggaggcgcgaagcgccatcgtaaagtgctccgtgacaacatccaaggcatcaccaagccggccattcgccgtttggctcgtcgtggaggcgtcaagcgcatctccggcctgatctacgaggagactcgctcagtgctgaaggtgttcttggagaatgtgatccgtgacgcggtgacgtactgcgagcacgcgaagaggaagactgtcaccgccatggacgttgtctacgcgctgaaacgccaaggccgcacgttgtacggatttggcggttgagcgggacgggaagaacggaggaggagaggaatcatcaaacaaaactatcccaaacggccctctttagggccacaaccattcaaatggacggatatgctttatcaacttattttaacgataaatttgatcttttaaaaaaaaccnnn

SEQ ID NO: 49168 - DNA, 517 bp, Heterodera glycines
  SCN-specific regions: Sequence locations=36-171,312-330,507-517
ttttaaaattattttctaatcattaatatttaattcctaattatgtcttatcaaacggtgtgccttcttttgctgttgagcgcatcgaatgatgttgcggtttttggacaggaagaaacaaccacaacatcgactagtagtacaagtacgagcacaactagttcaaccagtacatcgaccacaccaactacaacatcttcaaccagtacatcaaccacaccgagcacaacaacttcttcaaccagcacatctacatcaactacgccaactacaacttcgtcgactagtacatcaaccaccccgacaacaacttcttcaaccagtacatcgaccactcccactacaacttcttcaaccagtacttcaaccacacccactacaacttcttcaactagtacatcgaccacgcccactactacttcttcaaccagtacatcgaccattcccactactacttcatcaaccagtacatcgaccactcccactactactacttcaaccagtacatcaaccacac

SEQ ID NO: 49169 - DNA, 784 bp, Heterodera glycines
  SCN-specific regions: Sequence locations=1-220,242-784
gccattgtgccgttgctgactttttcagtctttttctaattagaattgcttggtcatcttccaattagttttaatggtcagaacatctctggaaaatacccacagattggataaaataccaaccacttggtgcaagcattgagggatcgaggatttttgcattcaaaacaccacttttgcccgagttgcaaacatcaatcccaaaggagtgtcgtttttcaactttaactttattacaacagttggctttctctaatcgttcattgggacttgtgattaactgcaataatactaaaagatatttttgtcgaagagacatcgaagggcttgggatttgctacaaagaaataccatgtccaggccgcggctttctgtatcgtactgatgccgtaaaaactttcataaaaacaatagacgactttttggaacttaacagtgacaatgatttgctaattgcggtttgttgtagcaatggaattaaccgttctggctatttgatttgtaactatctcatcaatcgacttggctggagttctcatgatgcattgaatgcatttgaaagtgccagaggttattccatcgagagaggttcatatgttcaagcattacacaaagtcgacagagaacgtcgttctaaaacgatgccgttcggtttggacagaagtgagcatgaaatgggaaatgacgaagcacttcccgcgaagactgaccaattattgcctggcattagcgacttcaacccacaattgacagcgcaaatgatgcaacaattcttcaacatgga

SEQ ID NO: 49170 - DNA, 701 bp, Heterodera glycines
  SCN-specific regions: Sequence locations=1-515,538-701
ggacatattgactgctgctgcaaattgtcgggaatgcccgacctttccatgacattgtccaactctcgcattttggacgatgtgccttttcatccatgcatccgatttcgtcgttgggagaatgaccgaattctttcttttgtcccaccggatgggaattttcgactcctttcctaccacataagccatcaaagcgtcgttgctattcctctttatgttcgtcataacattttgttaaaaaacggcacagctggccgtttcgaactgatggtcagcccgaagcaaagcatgggcaaaatgctggaagacgttgcgctcgaatgtcaaatgcctaagggtgtgcaaaattgtaatttaatggcaagtcacggcaaagtcgcatttgatcccacgacacggcttctacaatggacagttggaaaaattgaaattggcaagccaccgactctcaagggaacggtgtcgacaagtggtaacagtgcaaaagagcaattggaatctccacaaataacggcaaaattcaaaataagtcaactcgctgcttccggattaaaagtgatttgtctagacatatatggcgaagcgtacaagccattcaaaggagtgaaatatgtcaccaaagcaggaaaattccaaatccgaacttagtgttgttttttaaaccaaataaacgatgtacaataaatttcaatccggaaaaa

SEQ ID NO: 49171 - DNA, 358 bp, Heterodera glycines
  misc_feature (347)..(347): n is a, c, g, or t
  SCN-specific regions: Sequence locations=1-309,339-358
catcactacgagacaccggtcagaaccggacggatcattttggagctcggcgggtacatcactgaacaggaggctcgttctattttgatgcatctctatttgcatatgccattcccagtggaatttgtcagccaagaattgatggacaaacgcaagggattggagatgaaagtgcgtgcaaataacagaaacaaattcgattgggacacacttatcaaatacaacatgcagaattgcaaggcttggctgagtccgtacgatgtctattggaagtgccgatacgaatgaactacggaattgtttttgttctttattaattcaaaataaaagtttgttttacaaataanaaaaaaaaaaa

SEQ ID NO: 49172 - DNA, 554 bp, Heterodera glycines
  SCN-specific regions: Sequence locations=1-554
ttgtttcgttgtcttcagtttattgagatggatgccggcttttacagagggacctcttcagagcaggacatccgtctcactgacaaggaacgcaaattgttaaggcaaatgaagttcgaaaatgtgcttgaaacaaaggtcgacttggcaaagataaatcttgatgttatcaagccgtggataacgcttaaactgaacgaaattctcgggatggaagacgacgtggtggtggaatatgtgttcacgcagcttgaggagaaggagctgaacccgaagaaaatgcaaatcaacctcaccgggtttctgaatgcgcgcagagctcgcgaatttatggtattttttcatctcttggatcaccttttgtcattttaggcagaaatgtggcaaatgtttgtcgaagcccaagacagccccgaagggattccaacgagtttagtggagaagaaagtgcaggaacttaaggcatcaaattcgaacaaacagccaatgcagacgtaccacaaagcgacggaagtggactggaaccagcggtaccaaacactgacgggcggacg

SEQ ID NO: 49173 - DNA, 853 bp, Heterodera glycines
  SCN-specific regions: Sequence locations=1-259,284-853
tcaaatggcatctgatcaacttctttcatcccgagatagatttttctcattcagagttttagattcataaataatatatttgtcctggtccatccacaaaaaaataaccacaacatgaggctaaatcttaacatttgggtacactgataattttattgatgaattaatttccatctatttttcatgtcgattaaggcatattttggttaatgtacctatttatgtcgaacctctactgactccccattttcgcgcatctccaaaaataaaatttgaaaaatacgcctccaaaagacgacagatgactgtgacatcgacaaaaaacaattcttttccgagctcatttaaagacattactctacacgacgtatgggccagcaatttggaggccgaatttgccaaactgcgcgacctcatcgacgactatccattcgtggccatggacaccgaataccccggcgtcatcgctacgccggtgggccagttccgcagcaaggaggatttcaattatcaacaactcaggctcaatgtggactgcttgaagctcatccaggtcggcttcactctgatgaatgagaagggtcagctgccgcccgcccgtgacattttccaattcaatttgcacttcgatccgagcaccgattcgttcgcgcacaattcgctggaactgctcaaaacggcgggctttgacttcaacaaacaccagaacggagggcatcaaattgggaggactttgggtgagctgctgaccacttccgggctggtggttgagccgcgcatcacctggctgacctttcacagctgtttcgacttcggctatctcatcagggccattatgctggtcaaactgccc

SEQ ID NO: 49174 - DNA, 1168 bp, Heterodera glycines
  SCN-specific regions: Sequence locations=1-137,159-1121,1143-1168
tttttaaaatttttaccagattaattctacagataaatgacaagtattcgaggtttgttgttcacgctcgcttctcccttgaaggcattttatgcaaatgtggcagtgaaacaaattgatgttacagggatgtccagcagtgttggaattcttcctacccatgtgcctacaattgcagtcttaaagcccggagttgtcaaagtccacgaacttgatggaaacgtctccaagtttttcgcttcttctggtaccctttcaatgaatattgacggctcgtgtcaagtgctcgctgaggaactttgttctcttagcgaactcaacgaacaggccatcaaaaatttgattgatgtcagccaaaagaaagcttctgacctcaatgcaactgatgtgcagaaggccgaggcgggaatttccattgaagtggccgaagccgcgctcagagccatcagcgaaaaataaagacaattgttgacgtatgaaaaatagatggtattgctgtttattgtcgtaatagttttataaatctaatggaaattcccttttctttcatttctcatttgttttttttttcaacaaattatttttgcttgaaatatttgaactttttttcacaaattaatttcgtagcaatggcattattaaaatgcgctatcatccgggggttgcttcatacattcaatggtcgacatttgttttcaacagtcatcgaacggagaggagaatttgccgaacttactgaagatgatctgcggaattttcgtggaattgtcggcgaccgttgtgttaagacagaagagattgacgaatacaacactgactttatagcaaattagggagcgcttgcgtttaccaaaggctttaccccttcatttatgaaacagtggcctcaacaggcgggagcatttcagcagagcatgggataggactgttgaagcgagaataccatcacaaactaatcgaccaaaaacggcgaatgtttagttctggtattgagcgactgtttgaccctcggctgatattgtctccttacaaaatgatagactaacattagagatggtattaaccttgtattaaccaattatcatgcggaaatatattttttattgttccccacttttctcttgcctaaacatatcaaacttttattgtcatgtaatcatgaacaatt

SEQ ID NO: 49175 - DNA, 695 bp, Heterodera glycines
  misc_feature (695)..(695): n is a, c, g, or t
  SCN-specific regions: Sequence locations=1-695
gacagcaacaaaatgggctgggaaaaagcttaaacggagtggtgactaacaaaagcgcaaaaagtttgacggagggcaaaatggcgctactcgaagaaggaaagacggaacagaatggagacgaaccatcgacaaaagtgaaaatggcggaaaatggaggcggaggaggggcagaggtggcccaaaacaaatttggttcctcttcaattcgcccggcttcatctgtgctcagtttcttccgttcctcaaaaccggaggatccgtacgcctcgaaactgttcacttttctgcaggtgctcacagcctgtttttccggatttgcacacggtggaaacgatgtcagcaatgccattgctccgctcgtgtcactgtacaccatttacgatgaaggcagtgtccatcagaagggcgagacttccgtatatttgctgctttacggtgctgccggaatgtgcgttgggctttggctgctcggccaccgagtgatctacacggtcggcgaaaatctgaccaggataactcctcccagcggcttttccatcgaatttggcgccgctctcacagttcttttcgccagcaaattgggtctaccgataagttccactcagtgcaaggttgggagtgtggtggccgtcggactggtccaagcacatccggtggtccattggactgtgttcaggaatatctctctctcn

SEQ ID NO: 49176 - DNA, 467 bp, Heterodera glycines
  misc_feature (424)..(425): n is a, c, g, or t
  SCN-specific regions: Sequence locations=1-258,280-425
tttattcacacataattcaatgttggaagttgttctggaatatttgccatcgtggattcgcactcttaattcgttcatcgattatgagggtcagcgtaagtctgaacgtttttttccaggttattttgattgtccacggtgtgcttgggttttttgctggttatctcactcaacagctgtcggtgactatgtacagcgtcggagttggatttctgatctcttgtctgattgtgcttcccccttggccgttttaccgtcagaaccctttgaattggcaaccaaatagtccggtagaggaagacaaagctgcgaatccgtcatcatcatccggcaataagaattcaaaaaagactcgttgagtgtgatcataattcgatacggtttccttgtacactttcttattgttgataaaccgcttctgttnnaaaaaaaaaaaaaaaaaaaaaaaaaaaaaaaaaaaaaaaaaa

SEQ ID NO: 49177 - DNA, 705 bp, Heterodera glycines
  SCN-specific regions: Sequence locations=1-155,185-190,212-221,245-705
aagaaggttttgtctgttccaaaagccaaaaaatcaaaaaagcattcgttgacaaaatgggcatttccgacaacgatgtccaaaagcagcttcgccatatgatggcatttattgagcaggaagctaacgaaaaagcagaagaaatcgacgcaaaagcggaggaggagtttaacattgagaaggggaaattggtgcaacagcaaaggcagaaaatcatggaatattacgagaagaaagagaagcaagtggagctgcagcgcaagattcagaggtcgaatatgcaaaatcagagtcggttgaaatgtttgaaggcgcgggacgaccatttgaaaaatgtgttggaggaggcacgcgccaatctcagcaaaatttcggcggacagagagcgctatccggccattctcaaaggacttttgcttcagggccttttccaattgctcgaaagcaaagttgtgttgcgatgccgcaagaaagacgaggaaatggtggcgaggattttgcccgaatgtttggaggaatttcagcggacgtggggcaatcgaagcgaagtgaaaattgacaatgagtactttttgtccccggaaagtgcgggcggcgtcgaattgttggccaaagacggcaaaatccgcgtctcgtccactttggaagcgcgtctcgacctcattgccgacaaaatcactccccaagttcgcactgctctgttcg

SEQ ID NO: 49178 - DNA, 1075 bp, Heterodera glycines
  misc_feature (907)..(907): n is a, c, g, or t
  misc_feature (928)..(928): n is a, c, g, or t
  SCN-specific regions: Sequence locations=1-125,147-374,396-563,585 -774,809-844,904-1075
acgaagcaacaaaatatggccatttttgttacgaggacgacaaagaggaagacgaagacccgttcagtttcggcaaaatgatttcggcacaaaagaagggcagcgaggacgacagtgattgacggttgaatatttttgctattgtgctaaaatccatttttgtcagtgcttttacatggtttggtgtttgtttaattaatgcaaatttaaattcgaggcaaaatttcataaatcacattttaattgtttcactgtcttgtccaaaaatttttttgttttgtcttttctgaaaaacaatcacttactctccgccatttcattttcgcaaaacgaacgaataaatcacacatttaaaaaaacttgctcattattttgtttgtaacaatttgtattttcatttgctgattattcaataaaattccatttcattttttcggccttcttgaatatgaatactcctgctgcctatgagccgtttctgttggctgatggagagaaaaaggtggtcattgagaaggacacaaaagtgccgaatgcggcggtgtttacttttaacaaggaggaccacaccctcggaaacctcctcaaacatcagctcctcaaagatccgaaagtgctttttgccggctaccgaaacccccaccccttggaacacaaaattttgctccgtgtccaaacaaatcccgaaacaacgccaatggaagcattgaacaatgccattgaggatttggtggcggagttttcattattggaagagcgatttcgagacgcgataagggaaaaacgagaagaatgagaaattgttcttgtttacggaactgattattttatttcatttttcaataaataaataaaagtaaaaaaaaaaaaaaaaaaaaaaaaaaaaaaaaaaaaaaaaaaaaactcnagaaaagttaccacggcattnataacgatggataagggggtagctctagaggacccacgcttaaggtccacgggtttgctacgccgtaactcttctataatggcccctaaattcgtttccctggccgcctttttacaacgccgtgactgaaaaaaccgaggggtaacc

SEQ ID NO: 49179 - DNA, 544 bp, Heterodera glycines
  SCN-specific regions: Sequence locations=1-544
tttcggtggctatttggcctcgtcctatgcccttgagcatccgtcgcgggtgcgacatttggtgctggtcgacccttggggtttccctgaaaggccacaaattgaacaattgcacatcccaatttggatgcgtgtcttcggcagattgctctctctgttcaaccctttggccactttgcgtgcggctgggccttttggcgctcggctggtgaaaaaattgcgttccgaccttgggattcgctatgctcaccaggacccggacgccatttacgaatacatttaccaatgcaatgcgatggaacccacgggcgaaattgcatttggaacaatgtccaagaattttgggtgggctaagcgaccgatgattaatcgcttccgtgggataagtccatctgtgccggtcactttcatttggggtggaaaatcgcggatggaccccggcccggcctatgaaattcaatacaggagacaagacgcctatgcggatgttcacattgtcacccgcgccggccatcacgtctacgccgatgcgccagcggacttt

SEQ ID NO: 49180 - DNA, 546 bp, Heterodera glycines
  SCN-specific regions: Sequence locations=1-5,27-137,159-511,533-546
ttacgaaatacaaaaaagaggaggatgtgctgtgttacactttgcacctgtatcagcgatcaatgatgtgcgaagcaccacccagctcgacaagcgttgtttaaatgcaaaatggccggtatcgcagcaggaagactgacggaggagcggaaagcctggcgcaaagaccatccattcggtttcatcgcacgacagtgcaaaaaggaggacggcacattggacctgtacaattggatctgtgccattcccgggcccaagtcgaccatttgggaaggtggtctgtacaaattgcgcatgatcttcaaggacgacttcccatccacgccgccaaaatgccgttttgagccgcctctcttccacccgaatgtttatccgtccgggacggtctgcttgagtctgttagacgagaacaaagactggaaaccgtccatcactgtgaagcagttgctgctcggcatccaggaactgctggtgtcgcccaacccggaggacccggcacaggcggaagcgtaccaaatttatgtgcaaaatcggcccgagtatgag

SEQ ID NO: 49181 - DNA, 1273 bp, Heterodera glycines
  misc_feature (959)..(959): n is a, c, g, or t
  SCN-specific regions: Sequence locations=1-743,765-1194,1234-1273
gtttgggcatcggtttggaggactttgaactgctgacggtgatcggacggggttcatacgcgaaggtggtccaggcggagcacaaaaaaactggtcaaatttacgcaatcaaaatcattaaaaaatcgttagttgtgactgatgaagaggacatcggttggattcaaacggaaaagtccgtttttgagactgcctccaaccacccttttctcgtcggacttcactcatgctttcagactgattcgcgtttgtttttttgtcattgaatttatccctggcggcgatttgatgtttcacatgcaacgtcagcaaaaattgcctgaagagcatgcgaggttttactctgcggaaatcattttggcgcttcattttctccattctcggggcatcatttaccgtgatttgaagttggataatgttctccttgacgccgaaggtcacatcaaactcactgatttcggcatgtgcaaagaaaacattggccctggcgatggcacttcaactttttgtggcactccgaattatatcgctccagaaattttgatgggcgaagagtacggttttagcgtcgatttttgggcccttggtgtgcttatgttcgaaatgatggccggaaggtcgccattccatctcccaacaacggaagaggacgaacaaactgctgaggaccttctctttaaaatgataatggaacatcaaattcgcattccacgccatttaagcgtgagggcagcgaatgtattgaagggatttctaaataaaagtccttctgagcgtttgggctgcaaaaccgacttggaggagggactggcagacattaaaatgaacagtttcttcaagtcgaacatcgactgggaattgcttgaacagcgacagatagcgcctccctataatccaaatgtgtccggagacagagacttacaacgatttgacacgagtttcaccaacggaaatccttncctaacgccggacagtccatcttttttcgcgcggattgatcaatcggagttcgaagggttcgaatatgtgaacccattgatattcaacaaggaggatgccgtttaaatatcaggacagaattattcacttttcgagattatctgccaaaaataattaaattaacgccaaaaggattcataagtattcaaatgcccactgtcaactgaatcacttggtttctttattccaaaatacaaaaatattaattaattaaattttaatttctaaatatttcactgaattgtgtttaattgtgtgcataaattattgttat

SEQ ID NO: 49182 - DNA, 548 bp, Heterodera glycines
  SCN-specific regions: Sequence locations=1-488,515-548
ataacgcaaagctgtgggagcagtccgggcattggcaccattatgcggagaatatgttccggttcgaaattgagaaggagcagttcggactgaagccgatgaactgtcctggacactgtctgatgttcgactacaaaccgcacgcctacaacgaattacccatccgttatgccgacttcggtgtactccaccgcaacgaaatgagcggcgctttgtccggtctgacgcgcgtccgtcgctttcagcaggacgacgcccatattttttgccggaaggaccaaatattgtcggagatttcgggctgtttggattttctgaattttgtctacgtggaagtgttcggcttttccttccgtctccatctgagcacgcggcctgaagagggctatttgggcgacttggccacttgggaggcggcagagacacagctgaagcaggcattggacaacagcggactcaaatgggagctgaacccgggcgacggagcattctatgggccaaagattgacattcaaatcaaagatgcgttgggcagacattggcaatgt

SEQ ID NO: 49183 - DNA, 684 bp, Heterodera glycines
  misc_feature (665)..(665): n is a, c, g, or t
  SCN-specific regions: Sequence locations=1-486,508-684
ggagaattgcgaatgtcgtcgattcttttaattatttttggttttaaaatgctctcaatccctaattaacggatgtgatttgagttatgtatttaaaagccgtaaaaatgttcagaaatttaccgcaaaatcatcagagagagaatgtccgccggtcgtgccaacattggcaaaccggcgccgaatttcagcgccgaagcggtggtggactttgactttaaaacggtgtcgttggacgactataaaggcaaatatgtggtgctgttcttttacccggaggatttttcgttcgtttgtcccactgaaatcatcgctttttcggaccgttcgaatgaatttgccaacataaacacgcagcttttggcctgttcaactgactcaaaattctgtcattttgaatgggtcagcaaaccgcgcaaacaagggggacttggcgaaatgcaaatcccaattttggctgaccgaacccaacggatcagccgcgactacggcgtgctgaaggaggacacgggaaatgcttatcgcggtttgtttatcatcgacacgaagggcattttgcgtcaaattaccattaacgacacgccagttggacgggcaatcgacgagacgctgcgcctggttcaagcgtttcaatttacggatgaacacggcgaagtgtgcccggncaattggaagccgggcgaa

SEQ ID NO: 49184 - DNA, 522 bp, Heterodera glycines
  SCN-specific regions: Sequence locations=1-2,24-165,187-522
aaccccagcatcttccagaaaatcattcttctcaacaaagagattattatcatggaagagaatttctgttgctttgtgttcggatggattaacatttaccttttcttccacacggcttttcgttataaatttgaaaagtacgtatacaaagttacccgtgaacgatttggcaaaatgaaggcttacattgacaatgaattgaaggaagccatcgagttccgcaagacttcaaaggagcaggccgactcgttgaaagcagtgcatgaaaactttcccacaattttccaagagaatttggcgctgcaacttgaagcgacctaccgaaaaaatgtggactacgcctggcaagagatgaagcgtcggttggattacctgcaggaagtgcaagcaatcaaagaccgattcagcaaggaaatgatggtcaaactgatcactgatggcgtacgaaaacaaattgaaatgaatgagggcggaattcgcgacaaatatttggaccaatgtatcgaacaacttcgcgttctg

SEQ ID NO: 49185 - DNA, 671 bp, Heterodera glycines
  SCN-specific regions: Sequence locations=1-671
tccccctaaacaaaggcaaaagccaaacagatcaacaaataaacacgtcagattagggtcgattcggaatggcacaatatgtgccgtggtattacaaacgctcaccgcccattttttgtggcgtttgtgtgcccgtttatttgggcgtttggtccgttcgtaagttcatcgttgtgcttggctttctgctctttctgatcggcgttctgctactgctcggtcttctgctcatttgcgtggccatcgaatgttccgctgctgccggtgctttacttccgttcgccttagtgcttatcattgctgggctactacttttgcactgcggatgggctgctcatcttttggacgttggcgagggaatgccgtacggtgaatactcgacgacaaaaacggtgagcacttcgaccagaacgaaaaggacggcgccgaagggggaggaggagccggtgttcgaagagatcgaaggcaaacagccgccgcccgagatcaagcagggattttggcaattcgatgagcgcgaggcgtggcaaacggtggccaatccgtacccgataaattacacgctgaagccggtgattgaacgccaaccgtacgtgccataaccatgggaaagcaatgaaaatgccattctctgtgccaattttggacaatcccatcgaatgccactgaat

SEQ ID NO: 49186 - DNA, 424 bp, Heterodera glycines
  SCN-specific regions: Sequence locations=1-424
ttttggaccctaaatttgtgaaataatttgcttattctcaaaattaccatccaaattgcttattgcatttaatacattgtcaaagcgaggccatgaagcgagtgtgtgtcgggatttggaattgttccaagtgtcacaagaaagtggccggcggcgcctacgtgtacgccaccaccaccgcggcaacagtgcgaagcaccatccgccgtctgcgcgagaccaaagagtgatttgccgaatcccaacggcggagaacaatggtggtgacgacgacttttgcaccccactgccactgttttttgttgttatgtgttgtttttgaatgaaaatgggaattgtttttgctttttgacatttcaacatttaaattatataggtagaagcaatatttccctgggctatcaaatttagcttatcttttgaa

SEQ ID NO: 49187 - DNA, 638 bp, Heterodera glycines
  SCN-specific regions: Sequence locations=1-572,594-638
cactcgcaaatgccccaaaagggggccttttcgacgcgttcacctcaaatccgttgttcaccggcggtgccggattgatgtgtgtcggtgttttgttcaactatggacgcaaattgtcgacggttggtgcctcggttttgcgtcggaaatatgtgtcaacattggaactgagcaacgaagaccagtgcgttcatagtaggacgataaccattcaatgggggttggacttcatcaacaagcaaagtcaacgcaaaaccaaccaactgtcagtcagttcgacggagctgatcagcgaaagcggcaaagcgtccacgcaattctttttcatgccgggccagggccaccattacatgagttaagggggtcgattagtgcgagtggagcgcgagcgtacagagcaaatgctgcaaagggcggacaaacgacggacaccgctggaaaccgttcgactgaccacaattggcgtcaagcccgaattttggcgacaaatgctagagaaagcggccaaagatgcactgtccgaggtagagacgggccttgctgtgtatactccgttcggtccggaatggcaccattttgggaagccactgaagaagcagccgctggacacaattgtgttggacaacggcatccgcgaa

SEQ ID NO: 49188 - DNA, 374 bp, Heterodera glycines
  misc_feature (330)..(334): n is a, c, g, or t
  misc_feature (336)..(337): n is a, c, g, or t
  misc_feature (340)..(344): n is a, c, g, or t
  misc_feature (346)..(349): n is a, c, g, or t
  misc_feature (363)..(363): n is a, c, g, or t
  misc_feature (368)..(368): n is a, c, g, or t
  SCN-specific regions: Sequence locations=1-60,83-294,317-326
caacggagaatcatcaaagacatggagattctctgggatgaaaaaatggcacgtgaactgggagataaggcacttaaagatacaattcgacaacgaggatgtcgaattcaaacctttgtcagcggactgcaaggttgttcatgagttcataggcggctacatttttctctcaatgcggagtaaagaccaaaaccaaacactggacgaggaagggttccatcgcctgactggaggatggggatagaaaattttatttgtaaaccacaaccgccatttcaatttgtcatagtttctcacatttaaacaaaataaaagcgacaatatgcaaannnnnannaannnnnannnnaaaaaaaaaaaaanaaaanaaaaaa

SEQ ID NO: 49189 - DNA, 608 bp, Heterodera glycines
  SCN-specific regions: Sequence locations=1-201,240-245,271-312,334 -382,420-492,519-608
gcaagcggatcgattcacccagagcgttctcttcagcaaaaccttcacttttctccatattttgttaacaaaatgccaccaaaaccatccggcaagggagcgaagaaggcagtcaagtcgaccaaggcggtgcgcacgggagacaagaagcggagaaaggcccgcaaggagtcttactcggtgtacatctaccgtgtgctcaagcaggtccacccggacaccggcatttcctccaaagcgatgtccatcatgaactcgtttgtcaacgacgttttcgagcgcattgctgcggaagcctcgcgattggcccattacaacaagcggtccaccatctcctcgcgcgaaatccagacggctgtccgactgattctgcccggcgagttggccaaacatgccgtgtccgaggggaccaaggcggtgacgaagtacacctcgtcaaaatgagcaggagacgacgaatgcggtggtgatcggacggaaaaacaaaactatcccaaacggccctctttagggccacaatcactcaaatggacgtgcatgactattttttaattttatttatgtaactgataaaatccgtttcgctttccaaaaaaaaaaaaaaaaaa

SEQ ID NO: 49190 - DNA, 657 bp, Heterodera glycines
  SCN-specific regions: Sequence locations=1-657
tttaatcctccaatccgtccgtctccattcatttccaaattattcaaatcctacaataacaatacataaaaaatggagcattttccttctaaatttgttctctgcttgctcattgcattcatcgccgttccatgctctgttttggcactttctgctggcagccgcgtgtcgatgctcgcgtgccacaacaattaccgctcacaactggcaaaaggcactgcggacaacaaatcgggcaaaatgccggctggcagcaatttgatccaacaaaaatatgattcgaatattgagtcggtggcgcagaagtgggccaacggatgctcaatgtcccactcgggttcatcagggatgggcgagaatttgtacatgactagttcatcgacaatttcggaagctgatgcgctgaaacaagcttgtgacatgtggtgggcggagttgaagcagttcggctttcagtcaagtcttgtgctggacatggctcagttcaacaagggcatcggacattggagccagcaagcatgggcctccactgctcaaattggctgtgccatggcacgttgtccgtcctccacctgcaagacatgcgttgtgtggcacttccaagcagctggcaacctcatgaacgcagccgtctacctaaaaagtgccgcgtgcagc

SEQ ID NO: 49191 - DNA, 541 bp, Heterodera glycines
  SCN-specific regions: Sequence locations=1-42,70-104,145-161,247 -307,329-329,373-385,420-421,446-446,525-541
ttctttccaatttcatcactttttctttcccaatgtaattgtaatatcatccttttaatattataatttagcgattgaattcaataccccttcaatttggctatcatgcaaatcttcgtcaaaactctcaccgggaagaccatcgactcttgaagtcgaggcgagtgacaccatcgagaacgtgaaagcgaagatccaggacaaggagggcatcccgccggaccagcagcgcctcatcttcgctggtacatcaacttttaaaccgttgcagcatcatttttatacataacccttattttcagggaaacaactcgaggacggacgcaccttggccgactacaacatccagaaggagtccactcttcacctcgtcctgcgccttcgtggagggatgcagatcttcgtcaagacgctcaccgggaagaccatcactcttgaagtcgaggcgagtgacaccatcgagaacgtgaaagcgaagatccaggacaaggagggcatcccgccggaccagcagcgcctcatctccgctggtacatcaact

SEQ ID NO: 49192 - DNA, 776 bp, Heterodera glycines
  SCN-specific regions: Sequence locations=1-40,62-236,259-434,462 -624,654-776
cgttttcgatcgtccttccttttcttccctctttttttttgctcctttaactcattttcttgatccaccaccgttttgtcctcctacccatttcctaaatcaaataacaatccacagatcgctgagaaatggccgagaacatcgaagaaatccttgccgaaatcgacggctcccaaattgaggagtaccaacgcttttttgacatgttcgaccgcggaaagaacggttacataatggccactcaaattgggcaaattatgaacgcgatggagcaggactttgacgagaagaccctcagaaaattgatccgaaaatttgacgcggacggctcgggcaaattggaattcgacgaattctgcgcgttggtgtacactgtggccaacactgtggacaaagacacgttgcgaaaagagctgagagaggcattccgactgtttgacaaggagggcaatggttacatttcgcgccccacgctcaaaggactgctgcatgaaattgcacccgatctcagcgacaaggatttggaggcggcggtggacgaaattgacgaggacggcagcggaaagatcgaatttgaggaattttgggaactgatggcgggcgaaacggactaaacgaacgatcagaaagaggaaagaaagaacgaaagaaagtgatcaattggcggaaacggcggaacgtacaaaaaacgtcctcaaaacaaaaataaaaaaataattcgccaattattatttttgcagcggaatttcccattaaaattcagtggaaaaaaaaaa

SEQ ID NO: 49193 - DNA, 560 bp, Heterodera glycines
  SCN-specific regions: Sequence locations=1-12,34-408,431-560
aaattaaacaaaatcaaatgcatttgattaacttaatcgccctctttttcatgcttttcggcccatccgtccagcaacacacaaaaaagccgacgaaagaggacaaagaagcggctgtcaattgtcacaacaaattccgatcgcaattggctctgggcaatgccgacaataaatcggggggcaaaaaaatgccaaaggcgggcaacatgcgcaagtttgaatgggacgaaaacttggccaaacttgcggatgaatgggccaacaaatgcacattatcgcactcgtggaacggctgggcaggcgaaaatttggcaatgaaaggcggaacattttcgaacaaggatggcttcgagtacgcttgcggtcgctggtgggacgaactgaaccgttacgggttcaacccgaatctgattatgaccggggaaaacttcagtggcatcggccattggactcagatggcgtgggccgacaccgaccgaattggctgtgccatggcacaaaactgcccaaataccaattggaaaacatatgtggtctgctggtattacacgggtggtaat

SEQ ID NO: 49194 - DNA, 495 bp, Heterodera glycines
  SCN-specific regions: Sequence locations=1-86,110-110,143-150,207 -275,311-389,416-495
catttaattctctacagtcaaacaaccaatctgcaaaaatgtccggacgcggaaagggaggaaagggacttggaaagggaggcgcgaagcgccatcgtaaagtgctccgtgacaacatccaaggcatcaccaagccggccattcgccgtttggctcgtcgtggaggcgtcaagcgcatctccggcctgatctacgaggagactcgctcagtgctgaaggtgttcttggagaatgtgatccgtgacgcggtgacgtactgcgagcacgcgaagaggaagactgtcaccgccatggacgttgtctacgcgctgaaacgccaaggccgcacgttgtacggttttggtggctgagcagaacggtgacggaagagaacttcaaccaaaaacaatcccaaacggccctctttagggccacaagcacccaaatagacggatatgcttttcgaaaaacttgcttttgcattttcttttgtttgaataaatttggaaattatta

SEQ ID NO: 49195 - DNA, 1489 bp, Heterodera glycines
  SCN-specific regions: Sequence locations=1-38,60-221,243-696,719 -803,825-1066,1088-1489
cttctcgctcgacctttccttttcttcattgcccttacaaaaaagaatggcttcatttttacgcagtcggctgcgctgaaaacaaaaaaaaattataaggcaaagaggcggtggatcaccccatttctcaccaccaatcagtccaacgttccatcattaacaaagcagcgttcctaattttgccaatttctaagggtctttttcaagtcgaggatgtcttcgcctccttcctcagtccttccccaggatgttttcattctgtccgctgtgcgcactccgatcgcttcttttcgctcatcctttgccagccttaatgccgttgatttgggcactttcgttgctaccgaagcgatccaaagggccggcttaaggcctgaccaagtggaagagacggtgactggctgtgtgctcagcgctgggtcgggccaaaatgtgtcacgccaaatcgcgattaaatccggtatccccgaggcgaggcaggcgtacactgtgaacaaagtgtgctcttccagtcttaaggcattgattttgggtacccaatctgtgcagttgggacaacgttccatggttttggtggttggcgttgaaagtatgagtcaggcaccattttacttggcgcgtggtgacaacaattacggggatatcaaacttttggattccatccaacgcgatggcatttcggacgcaatgctcggccaaccgatgggtgtttgtgctgagaaaacggttgctgaatttggcttcacgcgtgagcagcaggacgcgtatgcactcgcctcctatgctcgtgcgactcgcgcgtgggcgggcggcgcatttggtgcggaaattgtgccggtgaaagtcaaacagcggaagggcaccgagttaatggtggcagaggacgaagagtatcggcgactaatgcccgacaaagtgacttcgctgcagccggcgtttgtcaaggacggcactggtaccatcacgggcggctaacgccagctcattgaatgacggagcggcatcgcttgtgatcgcatcaggccaagttgaaggggcaaaaccgttggctaaagttatcgcctacgccgaggctggcagagcgcccgtcgacttcacagtggcgcccgttgacgcggtcaaaacgttgttacaatcggtgaacatttcgatcgatcaaattgcgcgttgggaggtcaatgaggcgttctccgtcactgccttggctttcattcgtcagctcgacttggacccggcacgggtaaacgcactcggcggagcggtggcgctgggccatcccattggatgttcgggagcacggattgtggtcactttggtgcatcaactcgagtcacgggaatttggtatcgctgcaatttgcaacggaggcggagaagcgactgccattcttgtgcaaagaatttgattcagaaaactgttcgccgattgttagaatttcttaatttcgaatttgtcctttttaaattataaataatcaattcggtttttc

SEQ ID NO: 49196 - DNA, 544 bp, Heterodera glycines
  misc_feature (6)..(7): n is a, c, g, or t
  misc_feature (12)..(12): n is a, c, g, or t
  SCN-specific regions: Sequence locations=1-35,57-544
atcgcnnaatcnagcagtagacatggacttctgcctaaatagtttttctttttcaccacaaatggcttcttcaacagcttcctcttcctcggcaaccaatgaacaacaaaaaatagtgaatggctttcaaaagcttcgtgaattgcaacaggcgaccatcaacgaattaaacaaaattcaaactgagcagagggaacacacgactgtgcttaagactgtgcagtctcttgaaccgaatcgcaaatgttttcgacaagtgggagacacacttttcgaatttacggcgtcagaattaattgtgctattggaagaaacaattaaaaggttcaaacaaagagtggacgaattggaaaaccaagtggtcaaagttggcgaggacatcaacgcgtacaaagaaaagcacaacatccgttttctgagcaacaaggacgtgatcgaattgcagaagaagcaagctctgtccaaaatttcccagctcgaccttggcccgggtggaaaatcacaataagacggacggaatcagttgctagcaaagtattttgtt

SEQ ID NO: 49197 - DNA, 452 bp, Heterodera glycines
  SCN-specific regions: Sequence locations=1-430
ctgcgcaagaagcaacatttgctggtgcaggcgcgggagaattggacagcgaaagatctgaaaagagtggtggagggcattctgaaggtgccacccgagaaacagtctctgtacaagccgaccaatgagcagcggacggaatgggaggcaatggacgagaagcaaacgttgcacgaattgggattcacaatgaaaaatgcgcgagcggatggcccggctgtgttggcgttggttttgccagaggatggcaaaagtcccgacatagtgccaatgacagtcgcaccgccggtgcccgaagcaatggcacagaacaaacagtccgaagctgaaatggtcgaggagtgaccacaccacaacattttagagggcagtgattttctcagttgacttcgccaaattttattggaaaataaataataccgaaagcattaaaaaaaaaaaaaaaaaaaaaa

SEQ ID NO: 49198 - DNA, 709 bp, Heterodera glycines
  SCN-specific regions: Sequence locations=1-685
ggaagaaactgagggcaaattattgcaaatccgagaaattttccacgacttgctgatgtccctcgaactgcaagagcacgtgcaatgggccgacatggtacagaaattctgttcccttgccggaatgtttgcgtcgctgcaacaactgatgagaaagccgggccataacaatttcgatgacaatgttaaactgatgaaaatgacacaatttgtgccgaagaatgtttcacttgaactcgacccgaatttgacgcatttaacggagggacgactctcaaactttggccacaatatcgttccgattttgctgagaacgaagctaaagccggacgtggaggaagacgagctgaacatcgaacgcgaccggtcgaagggagacattcccaaacagatcaaaacattgaactcgcacattgacatgctttgtggaaagttggctgatttcacaaaattgcacgtggtggacagacgcgaggcaccaagttattcacaagaagaaactgtaaaattggtcaaagcaatttgtctcggcagaggaatctatccaaaagctccctcttctgctcatcccgggtccgcagatgctggacgaagtacgagcagttctcagaaagcgaaatgattcttagatttttatgtatttttttacattatattgtttttggtggcttaaatttttgatacgaaaaaaaaaaaaaaaaaaaaaaaa

SEQ ID NO: 49199 - DNA, 511 bp, Heterodera glycines
  SCN-specific regions: Sequence locations=1-64,86-458,480-490
ttgttattgtatttcttttccattctcggacaaaggccgaatcggatgaggaaggcgccgctgaccaaaacatttgggccgttttggtcgcggggtccaacggatggtggaattacaggcaccaggcggatgtttgccatgcgtggcatgtgttagtcgaccacggagtgagcccggacagaataacgcaaacggaatgccataacaaagtgatgcacactttcaacaaaatttgttttaatttctcaaagagtccgtacgttatgaaatatgcaaaaacattggccaatttgtgcgagcgaagggcggacacggcacaaatcgtggccattttgaaggaacaatgtgctcaaatggaaaagatggaagttcattagtcaaattaattaccaattgaagagataattggttcattgaaacggacgatgcgatgacgtcatccattcatttatcatttggataatttgttaaataaaataaaggccaacggaaaaaaaaaaaaaaaaaaaaa

SEQ ID NO: 49200 - DNA, 689 bp, Heterodera glycines
  SCN-specific regions: Sequence locations=1-667
gttgaggcatgctacaatgcaagaccagctgtagtcttgacatattttcatcctgagacggcacctcgaattgacagaccaccgacgtttgatcctttgtatggttttccaaagggtcgcaagccaagagaaatgcaggcttcgtgggaagaattgttcgttttttttacataaacaactgactaaatggctctacacaagtttacgcaaactggtgatggtaattggttggacgcaaaaactgcactagagcccactaaactataaaataaatttatattctttagggagaaaatgaaaatgccgattagtgagcgagattattgtgcccataaaatggttgctttgcgcaaatgcgtttgggatagggcgccatttgcctcgcattattgccatggacgtcgacacgatttgggactgtgtctttatgatgatcatttgatgcgtatgaaagaatttgagcgggagaaaaggctccttatgagaaaggcaagaaaggaaagggcaaaggctgcttaagaaactaatgttgatttgctagacaattgtatctttgtggcctctgattaggaatatttccatgtttatgtgtaaaatcattgcttaattgaaactttggctcgctcatgaacttgggaattaaatccaattagttttttaatgattcaatgatttttaatttctttgag

SEQ ID NO: 49201 - DNA, 825 bp, Heterodera glycines
  SCN-specific regions: Sequence locations=1-344,367-602,624-825
ttagtgctgcgaaggcgcgcattttccatattttattatctgctgtaaacgcttcacaacagaaaaagcgatgattccgctcaatttgcaaattgcagagtctgctctgaaggtcctccaaacaaaaacgcccgggggagaaattgagcaaagtgcgacggcgggagctcactgtacaaacaatacgtgcaaaaaagtgttcaccggtcccgagagcgatgccgaagagtgcgttttccacccgggcaatgccgtttttcacgaaggactcaaatactggtcgtgttgtgggcgcaaaaccaccgattttaccacatttttggaccaattgggttgcactcggggcaaacactgctggaaaaagaaagaaattgtcacaaatgcgcgcgaggattggtttcaacgaggtggccaagtgcacatcacaatttactgcaagggagcacttccgagcgaaacatccgccaaatcggacggtctgacattggaagtgaccatcaacgggtccaccaaacggtacgaactgttcggggaaattgcgccgtccgaaagtgtggtcattatcagcgaacgcaaagtggaaattgtgttgaagcaagtggccaaaattgggtggacaaacttctaaaggaacaaacgacgggattggcacaatcttcggactgtgagcagcagcaaaagcaaccgcagcagaaaatagacgatgagaaacaacaagaactactcatgtggaacggactgaacgaacctagcgaacgtttcacaacagaaaaagcgatgattccgctcaatttgcaaattgctgagtctgctctgaaggtcctt

SEQ ID NO: 49202 - DNA, 499 bp, Heterodera glycines
  SCN-specific regions: Sequence locations=1-133,160-340,367-499
aatcaaaaataaggcaacattcacaatggtgcgaatgaatgttttagccgacgctttaaagtcaattaacaatgctgaaaagcgtggcaagagacaggtgatcatccgaccgtcttcaaaggtgatcatccgtttcctcacggtcatgatgaaacacggctacattggcgaattcgaaattgttgatgaccatcgtgccggcaaaattgtggtgaatctcactggacggatcaacaaatgccaagtgatcagtcctcgtttcgacattcgaatggccgacttggagaaatggaccagcaatttacttccatcgcgtcagttcggttttttggtgctcaccacttcggctggcattatggaccacgaggaggcacgtagaaaacacgtgggagggaaaattctcggtttctttttctgatgtgaccgacgtttgttgtttaagaaaatgtctttgttcgttattgctgttgttggtttgataaaaagatgttaaaaaaaa

SEQ ID NO: 49203 - DNA, 583 bp, Heterodera glycines
  SCN-specific regions: Sequence locations=1-503,526-583
attttttaaaaatgtcactcactggtgggactgtaattgcgttagcctacaaaggcggagttgcgatggccactgaccgtacagtttttgcatccggtgttcatcgttttcagaacaatacgcgccaatatcggttgaataattattgtctgatttctttctccggagactttgccgaattccaatggttgcaaaatttgctggaacgccgtcagatggaattacagatcgacgcggggatggaccatatgaagccgaaaatggtgcacgcttttctcacctcactcttttaccaaagacggagcaaaatgaacccatttctgaacacaatggttgtctgcggcatgcaaccggtcgagtttcatgccggagaaattaagcctttcatcggcgtcatcgacatgcgtggcaatgcctatgaagttgaccatgtcgcgacagaaattggcaaatatttgcttcgccaaatgttggagacgcgacaaacgcaggcaaatggagcggaacaaatgagcaaagaagaagcacttcgaatggtcgcagcggcgttggaggtgtccgtcagtcgtaacagcagaacggg

SEQ ID NO: 49204 - DNA, 564 bp, Heterodera glycines
  misc_feature (36)..(36): n is a, c, g, or t
  SCN-specific regions: Sequence locations=1-564
acccccccccccccccgctgtacaaggaccttgccnagaacagctctcaatgtcagcacccgctgcaaagttaccccgccctccagagcacatgctgcgttatatggctcacatccgggccaagtctcttgttttctgtgcgatgggggtcagtggtctcattggcctttccttttacttcttttacgtcgaagttcgtcgcaaggcatatatggaatttgggaaaaattacaacccataccagagaatgcgtgaaatttgcgagtatcccgtcaagtacatgcattcctgcccttctgagctagccaagcgcctcgaagagaagggagtgctcattggtgaccgcgactattccatcccattggacgacgttgtgcctgaaagccggaagaaggagttcatgatggcgaatgcgttcgaacgttttatgaaccgttaggcaattaagtcaggtgatcggactgttgacattaggatggatttagcacaattaaagatgctttctttcgagttgtaaatcattcgttcttttacacataaactgaaaatccctcaaaaaaaaaa

SEQ ID NO: 49205 - DNA, 589 bp, Heterodera glycines
  SCN-specific regions: Sequence locations=1-589
gctaattatgcccgaaaaattccacatattcatcgtgtgatgaatacaaacattgatggcaaccgtaaagttccttatgcccttacagcgatcaagggagttggtcgtcgttatgctttccttgtttgtcgcaaagccgacattgacattcacaagcgtgctggagaactttctgaggaggacatggaaaagctgactactgttatgttgaacccacagcaatacaaaatcccaagttggtttttgaaccgacagaaggatattcgcgatggtaaaaatcaacaggttttgtccaccaatttggagagcaaataccgtgatgactttgagcgcatgaagaagatccgtttacatcgcggtctgcgccattattggggtcttcgtgtgcgtggtcagcatacgaaaacgaccggacgtaaaggacgcactgtgggagtgtctaagaagaagggaggctaaaacaaccgtttggttaccgatcatgaagtcgatcagttggaattgttgttgacgttattttcgttatttgatgaggtctatgtaaaatgttattgttgccaacggacaaaaaacattccaacttggacaa

SEQ ID NO: 49206 - DNA, 716 bp, Heterodera glycines
  SCN-specific regions: Sequence locations=1-716
ccccccccccccccagagaggaagagaatgggcaacagttccacttcgcttatgctgcaggaagaggaagtcgttggaattgcgaaggaaacgggattttctcgaaatcaaattgtccgtctgtacagtcgcttcctttcgcttgatcgacagggacgtggatatttggaccgggatgattttcaacggatccctgagttggccataaatccgctcggtgatcgcattgtcgacgcttttttctccgaattcggagattccggtgccaaagttgaactcataaacttccgccaattcgtcaaagtccttgctcattttcgtcctctcagcaaatcgaagccgaacaccgtaaacagcagagaggaaaaattgaaattcgctttttccatgtacgacctgaacaagaatgggtacataacgcgagacgaattcaaaatcattttgaatatgatggtggggacgaacatcaccgccgaccaacttgacagcattgctgaccgcacgatcactgaagctgacgccgacaaagacgggaaaatttcgttcgaggaattttgcaaggcaatggagcgcactgatgttgaccagaaaatgtcgatccgatttctaaattgagttcaaaaatgcaaataatgcgagcacattgtgattttgtctagtgactaatttccccaattaagagtcggatttattgtagagtaaatttattgtaactt

SEQ ID NO: 49207 - DNA, 421 bp, Heterodera glycines
  SCN-specific regions: Sequence locations=1-104,126-159,181-317,339-421
ttatcgctgctagaatctatcaaacataaaaaatgattgaaattactgtcaatgatcgtctgggcaaaaaagtgcgaattaaatgcaatccgacggacacaattggcgacctgaagaagctggtgtcagcccaaattggaacaaggtgggacaaactcatcctgaagaaatggtacaccacttacaaggaccacatcactttgcaggactacgaaatccacgacggattcaattttgagctatattatcaatgacttgctgcgcgcgtgttcattacttttgtgatttacattacattttcccaataaattgcgctgtgttaaaaagaattttgagttgttagtttcgaccctaatggttcgaggctaatggcatatttatgcatccttcactaatcaaataaacccaaagaacaaaaaaa

SEQ ID NO: 49208 - DNA, 790 bp, Heterodera glycines
  SCN-specific regions: Sequence locations=1-33,58-79,101-743,765-790
taaaacatggccatgaacaccaattcaattcattgctcctccgcctcctcctccccgtccgttccgatgacgttgtccatgttctgcttcatcttcgccatttttttgcatcccgcttcttcgtccgatttgctgtcctcgtccgacgatgcgaagctgcagcaaatgctgtgcgcccgtttcccgggactcgcggagtgccaaccgaacgacgaagcgtcgcgtggcatcatgacgaagcgcaagtccgcttacatgcgctttgggcgtgcggcggccgctgccgacccatcggaagaacatgaaatggagaagcggaagagcgcctatatgagattcggcaaacgctcgccggcggaagagggggaaacgtaccaaatctgggcagccaatgagccggacgcccaaatggaaaagcggaaaagcgcttacatgcgcttcgggaagaggaagagcgcatacatgagattcggccgtaagtaatcaggcccatgacaaggcgatgaatgaaattttatcttggcaacgacatacgccaatcaatgcgtggccaattacacaccgtaacatccgattgtgtttcgactgcgttaccgtattcttatttcccattgatccaattgatctctcacatttgcttatttagaaagctaattaaacgcggataatgttttaaggaaaaaaatgaccaaaatgaacaacaaatatttgttaattgaccaattataactcccgtcgtatcatttattttatctttttgaaatagtctcgacaaaaatttttaagcctt

SEQ ID NO: 49209 - DNA, 510 bp, Heterodera glycines
  SCN-specific regions: Sequence locations=1-327,349-510
atttgtggtggtttgttgctgcgtaagggtgcgtctgctgctccgcctttcgccgtcagaaatgccgtccaaatggcctctccgacgaaggtgatgggtccgcatgccttccattacaaatttgaacgttattacgccgctgcgattgttccgctttttcccctcgcttatttcgtccacgcgcccctcgtggattatgctttaactgctgcgattgttctccactcgcattggggcgtaatggctgttgtccaggactacgcgaggcccctggtcattggcaaaacgttggccaaaatggcgccggctgtcccttacatcgcttccgttgtgcttttggttggcttactgatgttcaattacaacgacgttggactgaccaaagcctttgaaatggtcttcagtttataggtgtcgatcatttgttaccgtagcattttaaatactgtataaaaattttatggaatatcaattaatggtgcaaaatcgtataaagttcattgcagcaaa

SEQ ID NO: 49210 - DNA, 591 bp, Heterodera glycines
  misc_feature (490)..(491): n is a, c, g, or t
  misc_feature (508)..(508): n is a, c, g, or t
  misc_feature (518)..(518): n is a, c, g, or t
  misc_feature (555)..(555): n is a, c, g, or t
  misc_feature (580)..(580): n is a, c, g, or t
  SCN-specific regions: Sequence locations=1-591
aaccgaatcgaatggaccaaaagtgcttagaattcttgagattgtaaaaaatgcacaacaaaagcatgggcttagacacgaaaattatcgacgttacaggggttattgttcccgtcggatcgaacggattcgaaaatcactgaagtttatgcattcgtataaatgtgcgcctaaaaggacagcaaaattcattgcgcgaaatgtttctgctgagttaatcggagatttaagatttctccaaattgccgtgttcgaagtcgaacgtaactgggcttacgcaatgcaaatgaaatttgagatgatcgatttgccactttctcgcaaaaaatttcacatgagtacaaaaattgcgtcgggcagtgaaaagtgctcattttttacattcgcttattaatgacaatccgctggtccatgaggtcactcgtgttgaaactgtttcttacgtgtctttcatcttcggcagtttggaactcgaactgaaaaattggannacgaccatcgaaacttngacagaacangaatcggtactcccgactgcttgaacagtccgaaccncgatctccgcgaaacttgatgtccncgtgtcgcgag

SEQ ID NO: 49211 - DNA, 553 bp, Heterodera glycines
  SCN-specific regions: Sequence locations=1-516
cccctcccaaatgtcttctcgcgcgacccccggtggcattggcttccaagtggtggcaaagcaagccagcaaattcaatgaccaagagggcaagctgatcctggactgggtcaaaaagctaagtggtgaaaacttcagcacggatgggagccgtgagaatttctataaattgttgaaggatggcactttgttgtgcaaattggccaacggcattcagcccggatcggtcaagaaaattcaacaaccgaccggcaatttcgcctgtatggaaaacatcaacgcttttgtgtcatttgccaaggcccaaggagtgccaacggaggaaacttttcagagtgtcgacttgttcgaggctcgcgacctgtactccgtttgtgtcactgtgctttcattgggacgaatcttggagaagaagggcaagccgaaccctttctcttgaatggtcagcacttcaaacggacgaagaaacgtacaatttgtcaccccaaatgtttatgaataaatgcttttaaatttaaaaaaaaaaaaaaaaaaaaaaaaaaaaaaaaaaaaa

SEQ ID NO: 49212 - DNA, 469 bp, Heterodera glycines
  misc_feature (455)..(455): n is a, c, g, or t
  SCN-specific regions: Sequence locations=1-469
caggatttgttcaccgtcaaaaacattgaccccgatgggaaaaagttcgacagagtcagtcgtctcttttgtgacagcgaatcattcaaaatgggcctcattttggatgtgaacacccaactctacgccatgggaatcaacgacaaattccggttgatgctttgcacttcgattcgggacgacggactcaccgaagagggcgaatacgacaaatcaatagaaaacattccccgggttcgaatgttcgaatatgtgatgtacggcaaaatttaccggattgagaacgacgagggcaccgcagaaacgagtcgactgaccgcatacgcttctttcggagggcttctgatgcgaattcagggggaggcgaacaatttgaccggatttgagcaggacaaaaacatttatttgttgttaaagaaagttcctaattgataaagagaggaaatgtgtgttanaaaaaaaaaaaaaa

SEQ ID NO: 49213 - DNA, 798 bp, Heterodera glycines
  SCN-specific regions: Sequence locations=1-12,34-760
aacaatcaaaatgaaaggcttcttcgccctgttcgtcttcgccttcaccctttcggtgttttctgccgcccatttgccgcctttggacattaaccaaatcccggccgaataccgcgaattgatccccgaggaggtgaccaaattctaccacgagctgaccgaggatgacaaaaaggcgctgaaggaagtggcagaacgccacgaggaattccaaacggaagagcaggcaatggaagcgctgaaggaaaagagtgagaagctgtacaacaaagcggtcgaactgcgcacccttgtcaagggaaaaattgaccaattggtgcccgacgcgaaggcattcgttatcgggatgatcgaaaaggcaaagggaatgcgcccgaaggccggcgagaagccgaagcttgaggagctgcgcacggcggccaacgagctgatcgagaagtacaaagcattgaatgacgaagccaaagagtcgctgaagtccaacttccccaagattacgagcgtcatccaaaacgagaaattccaaaccttggccaagagtttgctgaaacaggaggcaccggccgcctaaacggcggcacttaggaaggaacggactgatcactgattaattgatggaccattgcgcttaatcttttgccattattttgtaccaaaaaaacagacagaacagaatttgtgcatattcacatacactgataatataatattataataacttttctcagtcttttgtaaatggctaataaattgaattgccaaaaaaaaaaaaaaaaaaaaaaaaaaaaaaaaaaaaaa

SEQ ID NO: 49214 - DNA, 541 bp, Heterodera glycines
  SCN-specific regions: Sequence locations=1-142,166-283,305-541
ttattgactctgaacattattgtttgtcatcgaaaaagacaaatggcgattagcaagggcactaaaattacgccaaaaggtggtaagggcggcaaaggaaagaagaagaagcttacgctaaagtttgtgatcgaatgcaaaaacccagtggaggatggcatcatgaagactgccacatttgaaacctttcttaacgaacggatcaaagtcggcggaaaaaccaatcaactggcggctaatggtgtcaaagttgaagccacgaagacaaaactggtcgttacatcggagcagccattctccaagcgttacttgaaatatctgacgaagaaatttctgaagcgcaatgctctccgggattggttgcgcgtggtagccagtgccaaggacacttatgagcttcggtacttccaaatcaatcaggaagatgaagatgaaagcgacaatgaagcatgagcgatttgccatttcttttgttgggtcgtattatttgttgcactttttaccagcgataaaaacttgttgaaagaagaaaaagagaaaa

SEQ ID NO: 49215 - DNA, 1609 bp, Heterodera glycines
  SCN-specific regions: Sequence locations=1-47,71-83,119-128,150 -191,237-240,263-299,323-326,354-541,566-571,593-657,680-746,770 -812,858-881,906-917,941-1037,1074-1092,1118-1286,1308-1319,1342 -1372,1395-1587
acgagtaagcaatgggcaaggaaaagatccatatcaatattgtggtgatcggtcacgtcgattccggcaaatcgactaccactggccatctcatctacaaatgtggtggaattgacaaacgtaccatcgaaaaattcgagaaggaggctcaggaaatgggcaagggatcatttaagtacgcttgggtgcttgacaagctgaaagccgaacgcgagcgtggtatcactatcgacatcgctttgtggaaattcgagacaagcaagtactatgtcaccattattgacgctcctggccatcgcgacttcattaaaaacatgatcacagggacttctcaagctgactgcgctgtgctggtggttgcttgtggaacgggagagtttgaagctggaatttcgaaaaacggccaaacgcgtgagcacgctttgcttgcgcagactttgggggtcaagcagctcatcgtcgcttgcaacaagatggacaccactgaaccgccattcgccgaggcccgttacacggaagtgatgactgaagtgtccaacttcatcaagaagatcggttacaacccagccaccgttccattcgtcccaatctctggcttcaatggcgacaacatgttggagccgtctgacaggatgccgtggtttaaggggtgggccatcgagcgcaaagatggcaatgcatctggcaaaactctgctcgaggctcttgactccattcttccgccgcaaagaccaactgacaagccattgcgtttgcctctccaggatgtgtataagattggaggtattgggacagtgccggttggccgtgtcgagactggtgttctcaagcctggaatggtggtcacttttgctccgcaaggcatttccactgaagtcaaatcagtggaaatgcaccacgagtccttgccagaagcgcttccaggagacaatgtgggcttcaacgtgaaaaacatctctgtgaaggacattcgccgtggttcggtcgcgtccgactcgaagaacgacccggcaaaggagaccaagagcttcacagctcaagtcatcatcatgaaccacccgggtcagatcgctgctggttacactcccgtgttggactgtcacaccgctcacatcgcgtgcaaattcgccgaacttaaggagaaggttgaccgacggtctggaaagaaagtggaggacaacccgaaggcgctgaaaaccggcgatgctgggatcgtcgatttgattccaaccaaaccgatgtgtgtggaggcattcacggactacgctccgcttggtcgtttcgccgttcgtgacatgaggcaaaccgtcgctgtcggtgtgatcaaggcggtggagaagactgaaggcggtggaaaggttaccaagtcggcgcagaaggctgctgcccctggtgggaagaagaaatgacctatggagagagcggtcccgggagggccatttgttgacgaaaaacccactccatccctttgttttatcgttattttttgcaattccttccacctccgtctctatccatattgtcgttacgttggataatgttcatttttttgttgttgttctggttggtaaaataaatttggccattaaaaaaaaaaaaaaaaaaaaaa

SEQ ID NO: 49216 - DNA, 493 bp, Heterodera glycines
  SCN-specific regions: Sequence locations=1-493
ggtcgacttttgtccgacaaaaaatgcaattgctgcccgagtcgtccattacgaagatggaattgtgatcgaagcgtcaactcgtgagaagactgtccaaagtcaactatacagtcagacggatgtctccgccgctaataacattggtcggctgttggctcatcgatgcaaaatggcggggattgagcattgcatgtcgagtttgacggagaatgaattggagggcagcaaaaagcgagaggcctttctgagggcactgaacgaaagcggacttttgctggaggagcccgaggccatcccccacactcaccttaacgaccccaatttggtatgggaaacgtttccaattcagcacaaccgagctgacaaattggacgagttggacttgagtctggaaccgggcaaaggcgtttgctgatggcacaaataaaccttttttgtcttgtttccattttgtttctatgtgaaagatggcaaatgaaattttcgaacg

SEQ ID NO: 49217 - DNA, 524 bp, Heterodera glycines
  SCN-specific regions: Sequence locations=1-524
ttgaaataattcttcaatgggcaagccgacgagtgtgaaggacgttgaccaacatgagattgtccagtcggtggccacctttctgaagaagagtggcaagatcaagttgcccgactgggtggacttggtgaagtcgggcaaaaacaaagagttggcaccgatcaatcccgactggtattacgagcgcgtggcatccgttcaccggcaggtgtcggctcgttccgcaacgtgtatggtggaaaaaatcgccgtggtgttgcactcagtcacttcaccaatgcgtccggggcagtgattcgtaaggcattgcaatcgttggaggaaatcaaatgggtggagaaagacggaggcactggtggacgcaaactgaccaaacagggccagaaggatctggaccgcattgcgtcacagctgcgttacagaaccgaagaatgaggatttcgacagatagatggggagaacaattatacttttctgttgttgttgcttgtttttttgtcatcaaagaaacatgacaggagttg

SEQ ID NO: 49218 - DNA, 651 bp, Heterodera glycines
  SCN-specific regions: Sequence locations=1-651
cccaaaatggaaatgtcgacttcatttcttgactctttgcctggattttctgttgtagattttaatggaagtcatgagaaaagaacttgtgctcctggtgaacaattattttcagtctcaagtggatatcatgcgggaaatggctgttatgaatttcatggttcaatatgtgcttctcttgcaggatttttgcacgtttattcacttagagattcgcaaaacaccgagacaaacattgtcgaagtgagacgcaacattgacgagagaagcaatgtgctgccgtcacagggaaagatagtcactgcaagggttgagcgtattacgacaacatttgcaaaatgtgcaattatctgtgtagaagacacacccctcgccaacgaatttaactcgactttgcgcaaggaggacatacgtgacaaagagcgcgataaggtggaactgcacaaatttgttcaacctggtgacatcattttggctcgtgttttgggctatggcgaggcgcacacttcttatttgctcacaatcgctgaagctgaattgggagtagtgattggccggagccaaaacggcgaacggctgttaccggagaattccgaaataatgaaagtgccgggaagcgaataccgagaaacaagaaaagttgcacagctt

SEQ ID NO: 49219 - DNA, 1057 bp, Heterodera glycines
  SCN-specific regions: Sequence locations=1-205,227-1009
tttttttaaacatgtctggtggtggcaaagatcggattgcagtttttccgtcacggatgtgagttttcgcttacactttataacaaatccataccaaaaataatcattaagggctcaaactgtgatgaaaacgaggctgaaaggcgctcaaaaagggcatagtttactgaagaaaaaggcggatgcgttgaatatgcgatttcgtgaaattctgaagaaaatcactgaaaacaaaaaacgcatggctgatgtcctgaaagaagcagctttttctcttgccgaggcgaaattcactgctggcgatttctctcacatggttgttcaaaatgtgtcttcccaagcgcagtacacagtcagaatgaagcgcgaaaatgttgttggtgtttttctgccggtgttcgaagcccaccgaaaagagggctctgacggagacgcgtacaatttgacgggacttggcaaaggcggggcgaacattgggaagctcaagcgcaactacaacaaagcggtggaactgctggtggagctggccacgctgcagacgtgctttatcacactggacgaggccatcaaagtgacgaatcgtcgcgtgaacgcaattgaacacgtaatcatcccgaagattgaaaatacgctcacttacattgtcaccgaattggacgaaatggagcgcgaggaattctttcgcatgaagaagatccaagccaagaagaaacgccaacgcgacgaagaaaaagcccgggaaacggagaatgtgctgaccgaacggcagccggacgatgggagggcgccgaagagtttgctggaagatgaggaggaagtgcccgtgttatttgcctaagggcagtcgaacggaaagagggaacaaacagacagactcaattaatatttgtttgattggttgtgataatggcagtgtgtttatatcatgctaatagaaaacaatcactatgtaatttcgcaaattttcattccttttaatcagattttattttccgattcaatttgtagtgaataaaaacgcatcgtacttaaaaaaaaaaaaaaaaaaaaaaaaaaa

SEQ ID NO: 49220 - DNA, 429 bp, Heterodera glycines
  SCN-specific regions: Sequence locations=1-74,111-408
tgaaaatcgtctagacctatttaatttttcgaaaaatgtctgacaacaaagaagaactcgttcagcgggctaagttggctgagcaagctgagcgctacgatgacatggctcagtcgatgaaaaaggtgacggaattgggtgcggagttgagtaatgaggagcgcaacctgttgcgtgacaacttgacgctttggacatccgacacggctggcgatgagcaggaggctggtggtgaggcgggcgaagctggtggcaactgatcgggcggacagacgttgaagaccaagaaaatgccccacgaaattttttccaccgaatcatttaatgacaattatgcttttctcaatatggcacttttgattgggtaaatttttttgaaaaatcgttcaattaaaattgttgtttaccaaaaaaaaaaaaaaaaaataa

SEQ ID NO: 49221 - DNA, 570 bp, Heterodera glycines
  SCN-specific regions: Sequence locations=1-528,550-570
cgcgcagataaaggctcagatggcttcggccgcgccgcccctcggcccttctttggggcagcgaggcgtaaacgtggcgaacttctgcaaggagtttaacaatttgacttcgactattcgatttggtacaaatttgcctatgtctatccacgtcaaaccggacagaacttacgaaattgacattagcactccgaccaccgagtggcttctgcaacaagcggcggggatacgacgtaaccggcaggaggaaggagaaatcgtcggaatgatttcggtgaaacacgtatacgaaattgccaaagtcaaatctcaagacaaatctctcattggagtgccgttaaaagaaatttgtcaattggtcattgagagagcggattcgattggcatcaaagtgcaaaatgaagatttagacccggaagaatataggaaattcctggaacatcgtcaggaagttgtgcaaagacaattggaggaaatagcgaagcaagaagaggccaagctggccagaacatgatcggattttgattcattgttttctttttctcttcagcttatgaatgaacgtcaagt

SEQ ID NO: 49222 - DNA, 310 bp, Heterodera glycines
  SCN-specific regions: Sequence locations=1-310
tagcaaagaacagaaaaaatggctgcgcacaaaaccttcatcatcaaacggaagttggcaaaagctgctaaacaaaatcgtccgcttccccactgggttcgaatgaagacgggcaatcgaattcgttacaacgcaaaacgtcgtcattggcgcagaaccaaactgaagctgtaagcgcaaatgaacaggcggaagacggcgggcgatgatttgacttgttgctgttgattcatacatttttatggactgttgataaaggaaattgtcatcagaaaaaaaaaaaaaaaaaaactcgagactagttctctct

SEQ ID NO: 49223 - DNA, 667 bp, Heterodera glycines
  SCN-specific regions: Sequence locations=1-493,528-667
ttattcaaatggggcgacacaaaaagactcagaaattccgcaataagcttcagaaactgatcaagccaaccgatgacagaataaaagatgaaatccgcgtgaaaaaacctcccaaagaagatgaaaatgcacttaaaatcaaggaagcgtgagttatggggtggggttagtgaccaatgaatgcgaaatgatagcccgaagatttcggcagcgatgtttctcaaatacaacacacaactcgggccccccttccacgtcattatcgacacaaattttgtcaatttttctataaaaaaccgaatcgacattatgacggggttcatggactgtctgtacgctaaagtggtgccgtatatttcggactgtgtgctgggcgaattggagaaaatgggacgacggttcaaacttgcgctaaaaatcataaaggacaaccgcttccagcgactccaatgcacccacaagggcatttatgccgacgattgcatcgttcaacgagtaacacagcacaagtgttacattgtggccacttgcgacaaggatttgcgtcaaaggattcgcaaaatacccggcgttccgataatgtatgttcgtgaccatcggtacacaatagaacgaatgccagatgcatacggagccccgaagttgggttgaaacaatttacaattat

SEQ ID NO: 49224 - DNA, 896 bp, Heterodera glycines
  SCN-specific regions: Sequence locations=1-282,321-560,582-729,751-850
gctgttctcgcgccgggcaagctccgtctgcagaagtggtacgtcgcatatccggacaaggcaaaaaagaaaatcacccgcgagttggtaaccaccattttgtcacggaagcccaaaatgtgcgcattcctcgagtataaggacacgaaagttgtgtacaaacgttacgcttcgctttacttttgctgcgccattgagcagacggacaatgagttgctttgtctggaggtcatccaccgttatgtggagctgttggaccgttattttggcagtgtgtgcgaattggacatcatcttcaacttcgagaaggcctacttcattttggacgagtttttgttggccggcgaaattcaggagaccagcaaaaagcaagtgctgaaggcgatcagtgcgcaggatttgctgcaggatgaggagacaacgcaaggattgtttgaagacaacagacttggctgatgatcgaccacactctaatcagatcagcagaaaaagcagtagcatcaatcatttttcaaaactttttcttccctaattaacccatttttcgtttcaatgtccaacaaaagttgtatttgtgccaaaacaccttaaattttcgtttatggcacaaaatgacaaaagcatcttgttcaccgtcccttaattacctgaaaatgtttttagttcacaccaagcctaatgatcactaattctaattacctatcatttcttttttccgtgatataattgcactgtcttttttattttattctgtcgatcagtctcagatgagccaaaatatttgtttttcttgtaattctttcctgtccattttgttcacttcatttttcctttcgatttcattcctcctaaaataaaaaaaaaaaaaaaaaaaaaaaaaaaaaaaaaaaaaaaaa

SEQ ID NO: 49225 - DNA, 651 bp, Heterodera glycines
  SCN-specific regions: Sequence locations=1-52,78-80,127-549,571 -580,602-626
tggctgcgccaaagactgttgcacgccgtgcccgaccgtaacgggcgaccagcaatgttttcgccatgttcgaccagccacaaattcaggagttcaaagaggcgttcaacatgatcgaccaaaaccacgacggatttatcgatgagcacgacctgaaggacatgttcgcttctcttgggaaggaagtctcggaaaagttcattgaaaatatggtcaacgatgcatcgggttctatcaatttcacaatgtttttaacgctttttggggagaaaattgactggcactgaccctgaagaggtgatcaaaaacgcattccaatgttttgatgaggacaacagcggaacaattgcagaggatcgcttgagagagcttctcaccacaatgggagaccgatacaccgaggaacaggttgatgaactgtttcgtgatgcgccaatcaaaaatggccgctttgactacgtggaattcacgcgaatgctcaaacacgggacgaaggaaaaggacgaggaagaaaagtcgtgaaatggaaaagagagatggtgatgtgctttattattccaattgcttaaatacaaatgtcttttttgtaattttatggggtcctgaaaaaaacaatggcggtgctgaaaaaaaaaaaaaaaaaaaaaaaaa

SEQ ID NO: 49226 - DNA, 644 bp, Heterodera glycines
  SCN-specific regions: Sequence locations=1-644
atttgtcataccacaatccgaagtgaaccataatggcacattttatgctcggcatacgcactgacaattgggtgattttggctgctgatgccacccactttctcagtggagcgatcaaaatatcggaatcacaccaaaaagagtacaagttgggccctttgacttccatggtgtgctttggcgaggccggtgacgtggactcgttcgcaaactgggcaaaggcaaactgcgagctgtacagtcgtcgaaatggttatgaattacggcccaaggaggtgcaccattggctgcgaaaaaacatggcagacaatttgcgctcggaggacatgtggcgcgtcaatgcaatcatcggcggctttgattcaacggacaagaaagcgtatctcaccatgattgattatcttgcgacaaatattcctccccaaaatttcatcttctacggctttcctggtgcatttgcttactccatcatggacagtttctaccgtacagacctaactgaacaggaaggattggaattggtgcagcgcatgattgaccaggtgaagcgtcgtgcgatgatggaccttgccgagtaccgcgtggttgtgatcaattcgaaaagttcgcgcaccattgctgggctgaagccaaaagcggcatga

SEQ ID NO: 49227 - DNA, 540 bp, Heterodera glycines
  SCN-specific regions: Sequence locations=1-540
tgcgttttcaaaaagccaaattcgccatttttcgactgaattcccaccaaattttcattcttttacttttgcttatcaaattggcaatgactgatcagcagaattcaattgtcgggggatggacagagcaaaatgtgaacgacgaaaaaatcaagtctctcgcttctcgctcagtggccaaaataaactccgagtcaaacgatcgcttcagtcttttccccttggaggttctcagtgccaagtcacaagtcgtggcgggcattcagtaccaattgcgcattaaggtcggaaggtcgaactgttcgaagaatccaaacttggctgaccacgcaaactgtgcaacggaggatgatcagacagcgcgaaagacttttttggtaacgatttgggagaaaccgtgggaacaattcgagcagatcacttacaaactcgaataagaggaaacccgaagaaagaaagcgagcaaacagaagggggcggggaagtgattgatcacatcgcaataatcctgttcaaacatttaattatttccaatcggta

SEQ ID NO: 49228 - DNA, 774 bp, Heterodera glycines
  SCN-specific regions: Sequence locations=1-286,308-690,712-737,771-774
caaaatggcgagtccagcattgcacactttcaacgcactgctggcgacgggcgcttcgctcctcactttgatggccttttactacatgttgaccggccaaggagatcgttttgacattgcgtggtttctcactgagacttccccttacatgtgggctggcattgctattgccgcatcgctttccctttctgttatcggcgtcggatggggcattttcactaccggttcatcaattttgggtggaggagttaaagcgccgaggataagaacaaaaaaatctcgtgtccatcattttctgcgaggctgtcgctatttttggcattattatggcatttgtattcgccgggaaattggggaaattcaccagagaaactgcgacgcaagaagtcattgtgaagaatttggccgcgggttatgcaatttttggtggaggccttacggttgggttcagcgatttgatctgcgggttggcagtaggaattgttggctctggggcggcacttgctgacgccgcgaacccagtgctttttgttaagattctgatcatcgaaatatttgctagcgctatcggactgttcggcatgatcataggcattgtgcagaccaacaaattcaacattggcaccacctgagggacgactttgccattgcttctcgtgtttctgtactttaccctctgcggacaatgaactgttttctgctggttgtgtgatcatagaatttaaattcgcatattttacatcagtcgttttttaacttttaaaaatggaatga

SEQ ID NO: 49229 - DNA, 619 bp, Heterodera glycines
  SCN-specific regions: Sequence locations=1-542,564-619
aactcaccagacacttgctccctctgctccctttgttctccccaaattgatcccccgaaatgaccgtccaattgtccgcccttttgctccctctcctcattatcactttgttatgcaattttgcgatggccaatttgattttccacaacattgaattcgattcggactgtatgaaggcgatgtgcatggcggacagcggatgcgaacagcaaggctgtgccgaggatgtgtttggccgactcggctgcggctttttccgcatgaatatttggcagtataagcaatgctacgagccgggacgagagattggcgaactgtcggagaccgcgtggattcgctgctcggaggactacgaatgcgcatcgaaatgcattgtgcaagtggccagcagattcaggttgaaatgctatgggaaaagcgactgcgaaaccatcgcacggattcacgacggaggagcaaatggatgccgcaccggagaaacgcttccctattggttcaatgtgaagtcgttttgtccggactgctgacgcacccatcaaaatcagcagagaaaaaggcagagaaagaaaagaaacaaaatttggccattttcccctcttaaggcataaaagcacaaatg

SEQ ID NO: 49230 - DNA, 521 bp, Heterodera glycines
  SCN-specific regions: Sequence locations=1-295,317-360,383-521
gtcgaaggtggtgttatcacattgcacacgcgcaaagtgctcaacaatcgacttcttttccgtaaacagatggttgttgacattctccatccgaatcgcgcttctgtgcccaaatccgaggtgcgtgagaggctggccaagttgtacaagacgacccaagatgttgtggttgcgtacggtttccggtgtcaatttggaggaggtcgcagcacagggtttgcaaatgtgtacgactcactcgactacgccaagcgctttgaggccaaatatcgcttgttgaggcaaggcgttggtcagaaagccgagaagggaggacgaaagcaacgcaaggagcgaaagaaccgccagaagaaagttcgtggtgttaagaaagtgaaggttcaagcgggcaaaaagtgagcaaacggagaaatgacaaagaaacgagggatggagacgatgtttggtgttgttgaagttgcggccgagaggcttctattgttattcttcactcgttgaaaaaatgaagatcaattcactgg

SEQ ID NO: 49231 - DNA, 407 bp, Heterodera glycines
  SCN-specific regions: Sequence locations=1-372
tccgtgccagcgagaaacattttggcaatttgtcgaaggcttacggttggtattacgttcgcattgctccggttgaacagaaagtatggaagggctttttctttgatgcgtttgttaagccggtcaaagagcagttgccccactggtggatgttcttcttccccgtagtcacttactttttggtcaccgactgggccaagaaagagtaccgtcgtctgggacggatcaaagaattcactgacgaagaatgaatgtcgaattggccattcggactgttatttgtaggaaagaccaccgagtcgacagaatataaatcgaaatgttttggtactgtcaaattgtgtgttatgtccaaataaatttattagtgttaaaaaaaaaaaaaaaaaaaaaaaaaaaaaaaaaaa

SEQ ID NO: 49232 - DNA, 522 bp, Heterodera glycines
  SCN-specific regions: Sequence locations=1-522
atgcccgaaaaattccacatattcatcgtgtgatgaatacaaacattgatggcaaccgtaaagttccttgtgcccttacagcgatcaaggtggttaagctaatattttttgagtttttttcatcttgaagggagttggtcgtcgttatgctttccttgtttgtcgcaaagccgacattgacattcacaagcgtgctggagaactttctgaggaggacatggaaaagctgactactgttatgttgaacccacagcaatacaaaatcccaagttggtttttgaaccgacagaaggatattcgcgatggtaaaaatcaacaaggtttgtccaccaatttggagagcaaataacgggatgaatttgagcgcatgaagaagatccgtttacatcgcggtctgcgccattattggggtcttcgtgtgcgtggtcagcatacgaaaacgaccggacgtaaaggacgcactgtgggagtgtctaagaagaagggaggctaaaacaaccgtttggttaccgatcatgaagt

SEQ ID NO: 49233 - DNA, 403 bp, Heterodera glycines
  SCN-specific regions: Sequence locations=1-44,66-403
ttttttgtccgcagaacgaatgtctgcgttaattccatttataattgttacactgttttgggctgtcattggtgcaggaggcccatttttggtaccaagtggtatgaacagagggatcattcaaacgatgatcgtactgaccgcagtctgctgttatatgttttggctgatcgtctaccttcaccagttgaaccctttgataggaccacaactgcccgtgaaaacgatttggtggattcacaacacttgggggaatgtgaagaattgatgatcgatgattgcagtgattttccacttttggatgtactattagtgaattctctatttctgtgaaaaactggcatgacaaaaagacacatataatttttcaaccttttatttctataaaaattgctttattaaa

SEQ ID NO: 49234 - DNA, 785 bp, Heterodera glycines
  SCN-specific regions: Sequence locations=1-646,677-754
tttttctctgttgaatttcgtttactgcgtttttgtgacttttcccactgcatttaattttaagaatgttcgtttcgaacagtgtttttctgcctgtctcccgctttttccattgtcgcgcgttgtcccctgtgaatttggtggttcatccgtttgtcgctaggaagtgcgcctttttgtctacaccatctttgtcttttccatttcggcgtcaatactcatcattggcatctgctacaacgacgggagcgagcaacgacaagctgaatgtggacaaactgttcgaaaaaataaactttgaagtgcgcggtcacgacttcacagtcctcaagtcgtattcgctttttgttatgaatgtgtgccgtgtgttggacatcgatttcacttctcggcatcgtgctatgatcaatacggatcattccaagagtaaccgacccaaataccagcgatggttccagtggctgctgagcgcaaaatttgcaaagaaaaaatacaaattgcactatgaaacgcggacttatttgatggagttcgatgtgcatcacttgacgggaagcactgcgagtgcttttctggaatatatcgaaaggaatatacccgagggagtggccatgaaagttacatataccgagatgtgctttctgccagaaactattgttaaaacagtgatggataattagttctttgtcgtacatgataaaacattttatgattttcaacagtttgttcatgagctgataaattcatttttcgtaaaaaaaaaaaaaaatataaaaaaaaaaaaa

SEQ ID NO: 49235 - DNA, 626 bp, Heterodera glycines
  SCN-specific regions: Sequence locations=1-503,525-543,573-626
attctctttccgatcgattgatcgctcatcgttcggctaatgccaagcttttcctctcactgatcatttcctactcggcctttgtctcttttccccgtctgtcgatggtttcccccgatttcgaatgtcgcgtttgccatgcctatgccactgggcatcattttggggctcagtcgtgccaagcgtgttgtgccttcttcagacgatccgttgtgttaaaacgcaattatttgtgccaaaaactatcgaaaattggagcgaattgtcccattgtgtacacagagaaagttttgtgccgatcgtgtcgaatggtgaaatgtttgaccatcggaatgaataaaaatgctgtgcaattgccggagaaaaggggcggcgaccacgcgaagaagggaagggcctatttcacaaagtcgggccttctgagaaacaaacgatttgccaacaacgcatttgggttgtgctgcgacggtttgcccaccgccccccgccggtcggccgattcgccgctttcctccgccgcttccgcccattccgccgattgtccctcctcctcctccgcttcgtcttcttccgcttcactaaccattcatccatcttccacttttgatcactctttctccacctct

SEQ ID NO: 49236 - DNA, 593 bp, Heterodera glycines
  SCN-specific regions: Sequence locations=1-60,83-92,114-134,163 -538,560-593
aggcaatctccgagcagtgccggtacgctttatgcattttttcggctgatataccaaaacaaaaaaaaaaaaaattatttttgggccagaaacatttcaattttttgaaattaagtgcctcagagaaaaaaaggatttttattcatattttattatattaatccaatttctgtcaattgtgaacatcggatttggtttaatgaattttaaaaaatgaaaattccaaccaaattttatcatttttccattgctctattaaatcgagtaattcatccaaattcgattacattttttccatcagaccgacgaggccaatgcgtacgcggagcgcaaccaaatggcattcattgagacgagcgcgttggacggcacaaatgtgggcgcggcgttcaccaacattttgaccacaatttgtcgttcacagtcaacaactgcgggcagcacaccgtgagcattttgaggccaccggaaaaattttggccgtattttttaaacggattttcccaaaaattggcgatttttgggtcaaattaatcggaaaaatttgtaggaaaattgacattaatgatgatctgattgacgaggacgcattg

SEQ ID NO: 49237 - DNA, 250 bp, Heterodera glycines
  SCN-specific regions: Sequence locations=1-124,146-250
ggcactgattccaatcaccaagaagagactcggaagggacccaactgtggacacttcatttctgcctgaccgccaaagggacgaacaattgctacgtgcgcgcgaacggatcgcttaataatggcaagaaatgcaggagagtgaaaagaatgaggatattaccctggcattttgctattgggacgggtccagccatcggaaggactcacaaacaaacaaagggacgacaattgctcaatttctgcagaag

SEQ ID NO: 49238 - DNA, 304 bp, Heterodera glycines
  SCN-specific regions: Sequence locations=1-304
tatcgaccaatgcgacgtcaacgagcgaatttgtctcgtcgatgctgaataagttttccgactggacaaattggcggaccgtcacattcgcgatattttgccccagcgcttccctaagcgcgttcgcggcgaaggatacgatcatttgtagcagtgcacaaagtacgtagactactacgaaaatgtcgagttgaacttctttatcaagtatgtcgaattgtgcagtgagctgactgtggtggcgtgttacatgaagtatacgcatccgctgatgtgggagcgtcgtcacatcgacataatggat

SEQ ID NO: 49239 - DNA, 619 bp, Heterodera glycines
  SCN-specific regions: Sequence locations=1-301,330-619
cgctgattgccaaagtgaggccgtccagctacgggcaacggcgcaactactccagcattgacatttcggcggagaaatggttgatgcactacgacgccgactcgttggccaaactcgagaacccaccgtcactggcggacggaatcaatcgcgaattggagagggacattcgctatttgggctgtgaactgatacaatccggtgccattctgttacggttgagtcaaacatcagcggccaccgcacaaattctcttccaacgttattactacctcaaatcatttgtgcgctacaatttcgagcacatggtccaagcttgtctgctgttggcaagtaaaattgaagaagaacctcgaaaaccgcgtgacgtgctcaatgtgtacaatcgccttaagcaaatccatcatcggagaaatgcggtcgcatcacaacaccccgaagatttgcaaaagctgagcaaaaagtttgagcacttggagttgtgcagcaaaaggtaccaagaattgaagaacattgtgatcaaagcggaacgtcgactgcttaatgtgctcggatttgttgtgcacgttcaccacccgcacaaactcatctacatctatctgcacatccttgaccagct

SEQ ID NO: 49240 - DNA, 623 bp, Heterodera glycines
  SCN-specific regions: Sequence locations=1-109,136-281,305-540,562-623
tgtcctttttgcaacgacctccttcgtccgtgaaagaccatcgacggacttgggacaggacggaatatgaagtcaaggcgcaggagagactgactaccgaaagggaggcgttggaaatcaaaaaaggaaacatacggccaccgccgaagggtccgaagattaaacgggaaatgctgaagccgagggaattcaaagtagacctcgagtcgaaagtgggcaggcaagtggtgatcaacaaaaccacgccttcctccgagacaggcggttattactgcaatatttgtgactgtgtggtgaaggactcaatcaactttttggatcacattaatggtaaaaatcaccaaaggaatttggggttttcaatgaaagtgaagaaaagcactgtcgaggaggtccgagagcgtttttcaatgaaaaaggcacaaaaggaaacactgcgcaatgaggacgtagaggagaaacaacgcgatttgaaggaggaagaggccaaaatggcggatctgaaacggatgcaaagggaacggcaaaaggagaccagtcggaagaggacggcagcggcggtgacggcaccgcccacggacgaagaggcggacgcggaactgatgaaagtgatggggatcggc

SEQ ID NO: 49241 - DNA, 217 bp, Heterodera glycines
  SCN-specific regions: Sequence locations=1-61,84-217
tcgcctgcacaacccgggaaaaggcatttcgcgctcggcgtggccttaccgcccctctgtgcccacgtggcagaagctgaccaacccacaggtggaggactatattgcgaaggcggccccctgagggttgcggccgactcgaaatggcgtgaatttgggtgatactcatggcgcagcgcaatttcgtcgtctaacctgcaacccaatagggcgcatt

SEQ ID NO: 49242 - DNA, 609 bp, Heterodera glycines
  SCN-specific regions: Sequence locations=1-609
cacttcattcccaaaatgtccttccttcgtctgatcacttttgttcttctgatcactctgtgctctttgccttctctggtcgaaagcggcctcattggcattgtcggcactcccgttgaagccgcttggtgcggtgttttgggcaaagaatccagccattgccctactgctggaggcggtcaacatggcggaggaggaggacgatgcgaccgcaccattgcacttggactgagtatgggcgagctcagcaaagtgctcaaatgttccaaatcggaggacactttgatgattcgctttgaggacagtgagcaggacatggtcacgttcacttttgaggacaccaaaggacggaagcaggacatcacactgaaactgatggacattgacaacgaacacttgggcatcccggaccaaaaatacgctgccgtggtcgaaatgccgtccaccgagttccaaaaagtgtgccgtgacattgcctccttctccgactcgatgaacatcaccgccacaaagagcggcgttgtgttcagcggcagcggagattcggtcacaaacacaattcgctactccaaggacaaaacggcggatgacgacgatgacaaagatcgc

SEQ ID NO: 49243 - DNA, 623 bp, Heterodera glycines
  SCN-specific regions: Sequence locations=1-476,499-623
gtttctcgtctcacatttccttccttttggtaccaattgcgtgaatttgtttatgatccacgagtgatcgtcgttcaaggagttcttcatttgcgcacgagaaattctttacgaacgcgaattgcagagaatgcaacatggattcggatagacggaaacaccaacactttcaacaatccgcaactatttgaactcgaacaagcggctgccctcggcgttagtcgtgcgaaagacgtcgccaaaatcttctctctgatgctttccggcgaactgatctcacgcaaatcgctgattcggctgtccaaacctcaaatcataaaccaaattgattacgtgatgaagggaaaatggctgttcggacacccggggttcggcggatcatcggtgatgatggacccggaggaggaattggtcattgcttatgtgtccaatgggatgaagtccggcatgggtgagctgacacgaacattcagacgattgaaattggctgcatttgactctctcaaagcaatttccgatggacgaactgatggcaaaaatcagacgcaatataataaatttaacagcagcaaagcagaaggagactccccaaaaatacgatagaaatggcacttttttctttt

SEQ ID NO: 49244 - DNA, 232 bp, Heterodera glycines
  SCN-specific regions: Sequence locations=1-232
atttcccaccgctctcggactcccttcatcctccgcccgttttgccgcacttgccttaggcctcggcaaaattctccgcttgactgacccagacgttgtcagaatgacccgaatgggctcgggctcctcgtgtcccatcattcaaggcggctttgttcactggacggagggcgctcatcaacacaacgactccgactgtctttgccagaaactggcgaccaccgaccattgg

SEQ ID NO: 49245 - DNA, 220 bp, Heterodera glycines
  SCN-specific regions: Sequence locations=1-220
aattctggagcgcgataacgagagaggatataagattttcccgctacggtgcttgcactgccgtgtgattgactcgactgctactgctactgggccaacgctcgacgaccttgggaagacgaagagtgtctctgaccgaacttgctattatgctgctgcgaacaaaatcatggccgtcgtatgggacatcgacacgctgtccgaatacattgtcaaccca

SEQ ID NO: 49246 - DNA, 288 bp, Heterodera glycines
  misc_feature (136)..(136): n is a, c, g, or t
  misc_feature (139)..(139): n is a, c, g, or t
  SCN-specific regions: Sequence locations=1-23,45-288
gtccatttaagattaaacttcatttctatccattcttttcaaaatggccgacgaaagtggaacaaacgcaggaggaaccggtgcagctggaggcgctcagcctgctgagtacatcaaactgaaggtcgttggctanggnactcaaatgaagtgcatttccgggtcaaatacggcacatccatgggcaagctgaaaaaggcgtacgccgagcggactggcgtccaggtgacttctttgcgctttttgtttgacggccgccgcgtcaatgacgacgacactcccaaatca

SEQ ID NO: 49247 - DNA, 631 bp, Heterodera glycines
  SCN-specific regions: Sequence locations=1-209,231-429,451-475,497-631
aaagttcaaagtgtggcgatcagtcagaatggcgacttgtacatgacgaaacagccgacccacgggacggaagagtccgccatttggagatcacacatcgatcatccaatagcatgggaggaattttgctcgacattcgacgaatgtttccaatcactttgtgtttacgataatgaaacccttgcagtcgccgttgtttcatcgcctgttaatttatattcaaaacagtgcattaaatgggttgctacaaaagactgtcgaatcattgggtcattttccgctgccggcaaagacaatgggcaaatatttttcccgcgatgtttgcaaaagcatggtgactcattgctcattttggacaaaaccggaagaatacaaaaatttacacgggaagggcatttcgtagaaatatcagccaaaattgatgattatattgggaacggattcacaattcgagaggatgaggctgtgatcgcgtgcagtggtattgtgaaggatgaggaaggaaagaccatgtgcgacgattgggtggaaaacattcgcttggatgggtcgagatggacggaggaagcataaagagcggcttaaagaaaagaacacataaaccgaaagagaaaccaagaaatatctctca

SEQ ID NO: 49248 - DNA, 623 bp, Heterodera glycines
  SCN-specific regions: Sequence locations=1-69,92-623
tgaaaatgtcgtccaactcgtccatggcactgcgaatgccaacaacagcttggaaaaggaaatttccatccaaatattgcatgttctcattgaacccattctcaaaaatgcgtattcgttggcccaaaacgaattcgccaattacctcgtccaatttattatcaaatcgccctatctccgccgccaacgctgttacatcatcaaaactcacatcattcgcaacgtttaccatctctcgctgcttaaatactcttcgcacgtggtcgagcaggcttttaagcacgcggaggaccgctgcaactgtttggccatgttattccgggaggtgttggaggggtacaaaccttcaactgatggaaagcagcggactgctctgtatgaaatgctgttcaatcagtacggcaattacgtcgttcagaggatgatccccatcgcccgtgacgtgtaccaaagccgtcgtcccggcgacccgaattggctgcgtcacattgcgcactgtgtccaaaccaacattgaagcactgagtcgttactcctctggcaagaagatcatcaacagcttgcaccctgttattttttgaattgtgaatcatcctacacccccacaactctcatgtcgatttt

SEQ ID NO: 49249 - DNA, 632 bp, Heterodera glycines
  SCN-specific regions: Sequence locations=1-239,269-322,345-555,618-632
cgcaaatacggcaccgccgacgaaagtgtcgccgacgccggagaccaaccgacaaacgactacggcacaatgcgtcccgcgttcaatgcctgttttggtccgttccatcgcatttgtctccatttgcccgtggccaattacccggcccaattggcggacgaagcggcacgactcacccaactgttggccaaactgatggcacagaatgggcgagtcatgcaaatgaaacgcatcagcaaaaggggcacaacaacaacaaccaacagtgccattaaaatgttggagccgcgctttgacgaacggtttgacccggaaaggcgaaacaacaaaaacaacgacagcaacggcatgaaggcgcgagaaaagagttgggcaaagcgtgccaaaaatgaacggcgcggggcactcaaagaattgcgaaaaggcgccaagggaatggccaatgcgtacgccgagcgacagcgcaaagtgcgacgggagagggacgagaagacgaaacgaattatgcagtgtttggaagtccaagaatcggagcacaaaaaattgaaggctttgaaaaaataaaaaaataattttttttgttttttttattttgttgaaatattttaaatttaaaagacgaaaaatgacta

SEQ ID NO: 49250 - DNA, 630 bp, Heterodera glycines
  SCN-specific regions: Sequence locations=1-57,79-284,307-437,459 -507,530-552,575-630
tgcgaatttattcaaaataagggaaaatggtcgaagccgccgaacaatcgcaacaacagcccatccgtcgccgtgccggaccgaagtcggcacgtcgcctttatgtgaaggcggtgtttaccgggtacaaacgcggacaccgttctcaacacgaggacacgtccctgctgaagcttgacggggtcaatgacaagtcggatgccagcttctatcttggtaagcgtgctgcctgcatgtacaaggggcgcaaaacgatcgcacgcggtggtgggccgaagacgagcgattttttgttggctttgtttatgtgccttctttttgtacaaagtgcttgcgccgaggaatctttttcaatgaaagacctagcgctggagtacaagataaaatatgacttctttttcgcacctgtgacgttgattttggctgtgttaagcctagcgatggcgttttctgctggctttatggttgtcctcaaccgcatgttcagtttgcacatggatgtgcaggaaaacaaaaaccaagtgaaagaacttcgaaaagaattggacgagaatgttaaaaattttaacacattgtattctgaatttgttaatttgaaaggagaggtcaatttgctgaaaggcaaatagg

SEQ ID NO: 49251 - DNA, 630 bp, Heterodera glycines
  SCN-specific regions: Sequence locations=1-112,134-630
caatgaataaaatgcttcccaatggtcgcacaatgacaccaattcccatccaagtgaacaaagctgcccggaagagcatcgatcggcacacgcatttcggattgcaccgtaggcccagcgaagtgccaccaccggtgcgtgaaacggtgtgggcccgtgacgactggttcgagcagttcggcttcgtccatctgagcatctacgggcgcggggcgcttgcggatgggacgcacgcggagagtgacgggctgacactgaacgtgacggtagtgcacgcgtacggcgccaaacagagcgtgaagcagtacaaactgtacgccgaaattgtgccatcacacagcgtgatgctgatcacggagaagaaggtggagctggtgttgaagcagctgaaccgggagaagtggaacaaactgtgctacgacgggggcgaggacggcgccatttgcgacggcggagacgacgacggcgcatttctgttggacccggcggacgaagcggcggaggacgacgaataggcgaagcggaacggacgggcgaagcgaagggcgaaagtgccatcattcgatgagaaatgccatattgttatcactagggcggcgaaaaaagaaattcgcgaaaaaaaaaaaaaaa

SEQ ID NO: 49252 - DNA, 621 bp, Heterodera glycines
  SCN-specific regions: Sequence locations=1-127,151-558,580-621
tttgaagctaaatttacaaatgccgcccttctgaagaaaattgtggaagcgatcaaagagttggtcagcgaagcgccatttgactgtacagaaaattcaatgtgtctacaggcaatggatgggtctcacgtggcactgatttccctcaaattggacattggccttttcgaagtgttccgatgcgaccgcaccattgcacttggactgagtatgggcgagctcagcaaagcactttttgtacgcttcgaaatgatccaaccaaatgccatcgctgtcgccacccaccttcagtgcaaccgaccagattgtacccgaacctttggtctggacaagcttgggacattgagacctcacatttgtaaggctcaccgcgaggaccatcatcaggggaatcgcaaaccaagcttggtcattggactgaccatcgtccctcctggccgaactttcctcttcaccatatatgagtcaagagcgcaagcggtccctgcacttatcgtccgattcgccgtcagtcccgtgtctcgggcatcttacgacacggcactcgcccgcgcgcaacaactgctgggctatgagatcatcccaccgcttgccgtcaggcgctggccgaagcgacatacc

SEQ ID NO: 49253 - DNA, 622 bp, Heterodera glycines
  SCN-specific regions: Sequence locations=1-1,23-40,62-622
ctcaaagtgatttgacatttttaaatcaaatggctcgaaatgctgagaaggcaatgacggcgttggcccgatggcgccgaatgaaagaacaggaggagaagggaccgatcgccaaacggccgaacgacgttcgcgagtgcaaaaagttgggcgacgctgaacgatttcgtcgcgaattgatccatgacatttcgaaaagaataacgggaattcagaacccgggacttggcgagttcaaaatcagagacctcaacgacgaaattaaccgactgttgcggataaaattggcatgggaaggacgcattaaggagctcggcggagtcgaccatcgacgaatcgcgccgcgggagttggaccgggacgggagggaagtgagcagcaaccgcggatacaaatactttggcgccgctaaagacttgcccggggtgcgcgaactgttccaacaggcggcggaagaggagggcgccgtgccgcgtcgttcgcgtgccgatttaatgcaatttgttgacgcggattattacgggtacatggacgatgacgacggactgctgattcctctagagaagacggaggagcaggtggccatcgcgaagatcaacgaggaatgggttaaacgtggacc

SEQ ID NO: 49254 - DNA, 623 bp, Heterodera glycines
  SCN-specific regions: Sequence locations=1-623
ggagtccgtcatttttatttgtttgttatttatttgctgacatggctcaattagctgttgcagctcctctgccgccaacgacaaatgcaacagcggccactgctacaccggcggcaccgtcttacccaatggcttcgctttacgtcggcgaccttcaccctgaagtcactgaatcgttgctcttcgagaagttcagcgtcgtcggtcccgtcctctcaatccgcgtttgtcgtgatgctatcagtcgtcgttcgctcggctatgcttatgtgaacttccagcagacatcggatgccgagaaagccttgaattcgatgaattttgactgtgttttgggcaaacaaatccgcataatgtggtcgcagcgtgacccgagcattcgtcggtcgggatccggcaatatttttatcaaaaacttggacaaggacatcgacactaagaacttcttcagcactttttcggcctttggtcgaattttgagttgcaaagttgccacagactccgacggcaaaagcaaagggtacggcttcatacattatgcgagtgaggacgacgcaaataaagcaattgagaagattaacggaatccatgttgacggaaagacagtgtttgccgggaaattt

SEQ ID NO: 49255 - DNA, 348 bp, Heterodera glycines
  misc_feature (326)..(327): n is a, c, g, or t
  SCN-specific regions: Sequence locations=1-52,84-101,128-272,294-327
gagccaccaaaatgccgtcgaacaagaccttcaagatcaagcgtgtgctcggcaagaagcagcgccagaaccgccccatcccccagtggatccgtctgcgcacggacaacaccatccgctacaacgccaagcgccgcaactggcgccgcaccaagctcaacatctaagtcgtcccaccggaatgtcggtgtttgtggtgatggcgccgttggcgtgattggccgagatttgtcgtccccgtcatgcctgcttcgtttgttgcttcttcgccgtcggttggatatcttgttgttggtggtattgccataaaagaaccctttctttcnnaaaaaaaaaaaaaaaaaaaaa

SEQ ID NO: 49256 - DNA, 621 bp, Heterodera glycines
  SCN-specific regions: Sequence locations=1-621
aagctttttttgcgccagaaccactgagagactttcggtgtgaccagtgccgggagactaattgtgtgactcggtccagcagattcactcagcttcccgaattgctcattgttcagcttaaccgttatgttctagcaagcaatggaaaccttcgcaaattacaaaacgccgtgcattacccacgccttttgaccgaacttggaggcgagggaatcccggactatgagctgtgtgctgtgatgattcatgaagggaagagcactaattcaggacattactacgacgtcattcgtgacccggtcatcgaccgttggtttacctacaatgacgaaacggtgaatcaaaagcgcacagctcccggctatttgggcagactgactcagaaaccacgtgcgagtgctgacacgacggggtgttatgcgctgatctaccgaagggtgggcagtggcttgagggggccggtgcaattgccgccagagaatattgtgacggaagcaaagaaaaggatggaggcggaattcgcacaacaagacaaggaggacgacttggcatttaaaaagtggaaaaagcatatcaacgaaaggaatcatttgttgcagcaactctggaaggagcttgagg

SEQ ID NO: 49257 - DNA, 362 bp, Heterodera glycines
  SCN-specific regions: Sequence locations=1-362
gtccaattaagaattgagtatgacatttggtaattcaccgactcaagggagaaaattaggcgaacaggagacgcaatttgatgagactattacgcggactgggattgcgtgtgatcggatacgacaacaattgaagaagtgcattaaagaatctgattgcatacagatcaagcggaagaaggccagggagtgtcacgaagaattggacctgcctcagcattgcattcatttgatgtattcactggccgagtgcaaacgaaacaacattgatcctcgagcccgttttcgtggacggaagggcgatttgtgattgaatactgcatacttttcatcgctgttttagaataataaagtttttctcg

SEQ ID NO: 49258 - DNA, 338 bp, Heterodera glycines
  SCN-specific regions: Sequence locations=1-240,263-263,285-313
aaagattgtgaaagaatggctgcgcacaaaacatttatcatcaaacgaaagttggccaaggctgccaaacaaaatcgtccgcttccccactgggctcgaatgaagacgggcaatcgcattcgctacaacgcaaagcgtcgtcactggcgcagaaccaaactgaagttgtgagcgatggacgccgagaaaggaaaagcgaaaacatcggaagacggcggacggacgatgattttcgactttttgttgtttgttcatggagttaattttcatacatttttgtgtggactattgttggtaaaattgttgaatttgtaaaaaaaaaaaaaaaaaaaaaaaaa

SEQ ID NO: 49259 - DNA, 631 bp, Heterodera glycines
  SCN-specific regions: Sequence locations=1-631
cggaaaccacaagagcagcggatttatggcggaattgcctaaccgcagatggggggcgcctaacattttttacatgggatacgcatcggtcggccgctttgctggactaccaattggcggattctctggcatttttaagcctggggatttcaacacaatgccatttcaaacggccgcccttccgtgaggcgggctacgatcgtctccaccttaccacctacgttcggtggacatttttcggtaacgccatctgacagatggacctccgttggacattttcttttcgcacgaatggaccggggggataacctagtttagctattgggaaactctctcgcgcattaaggcccattttacggaggatgtgcgaaacatccgaatgggctgaccgataacgatggatctcctccaccagctgacacccacccattgattggacccccatttgcatgtccatttcaccgtcgtagtgccccattcctccgcttcccccaccgcttcggtgacgcgctttttggcattggacataccaggcgaaaacccacggagacggtgcatccaattccttcacattccaattgctgaagacgcccctttggaccattgctatgacccccaatggttggcgatt

SEQ ID NO: 49260 - DNA, 595 bp, Heterodera glycines
  SCN-specific regions: Sequence locations=1-595
gtccttggactgcctcatcacggtccacgccaaattcttcttgcatgaggagttttctgatgacagttggcactgcatctatgggtcacgacaaagagcaaatatgactactggaagtatctggctgtccgcctggaagttcttcggtcacttagtgccggaccagggtttgaagaccatccatgacgcccggatctacaccatctcgggcgagtattctaataacttcattcacaacggaaagccattggttgtccggtttaccgtcgaacgcgaacataacatcgactgtcgcggcggctatctgcagctcatggcttctgactgctgccgagacaacttccgcgtgcagacgccgttccatctgatgtacagtcaggacatttgcgggccccgcactaattaagtgcacgtgatcctcggctacgaaggcaaaaactcgctactcaattcggacctttcctgccaggacgacgatctcagtcatctgttcacactgatgttgttccctgacaacacttacaaagtgcttattgacggccatcaggtcgagagcggacaattgaaggccgattgggaccctgtgccggcaaga

SEQ ID NO: 49261 - DNA, 556 bp, Heterodera glycines
  SCN-specific regions: Sequence locations=1-115,138-556
caagagatttcggccagttcacgacctgaccacttggagtttagtttggagcacggcatgatgcgcgattgacggaaaacaaatcatattgcaaatttgggactctgcaggccaggaatcctttcgctccatcacccgttcctattaccggggcgcggctggcgctctgactcgtttacgacatcactcgacgccacacgttcaaccatttgacctcgtggctgggaaacgctcagtcaacactcctattccaacaaggtgataatgctgcattggcaacaaaagtgatctcgaaacgaggcgtgcggtcaaaaaggaggagggggagcagttcgctcgctcgagtggacttgtctttatggaaacgtccgcaaaaacggctgcctatgtggaggaggcattcattgatacagccaaggaaatttacaggaagatccaggacggcgtgtttgacatttacaatgaggcaaacggtttcaaactcggtcctctacacccgaccagttcgccaagctctcccggtggtgcgccgttaggacgtgcgagcaactgttgc

SEQ ID NO: 49262 - DNA, 607 bp, Heterodera glycines
  SCN-specific regions: Sequence locations=1-30,68-464,488-607
attttattgttatacatagaatagaagaatttgcttttttaattttgtctttggattcttagttcttacaatttgagaaatgtctacgagaccaaaggtttttttcgatgttatggttggcggaaaatcgacaggtcgaattgtgatggaattgtttagtgacatcgttccgaagactgccgaaaattttagggctctgtgtactggcgagaaagggatgggcaaaagtggcaaaccgttgcactacaaagggtcgaagttccaccgcgtcattccgagtttcatgcttcagggtggcgattttactcgaggcaatgggaccggcggcgagtcgatctatggcaagtgttcggacgaaatgcgaatgaatcggtcctttaggcgagaaattccccgacgagaatttcaaagagaagcataccgtcccgggactattgtcgatggccaatgccggccccaacactaacggctcgcagtttttcatcaccacagtgaaaacggaggttggacgaaaggcgtatttagccattttcgagattcatttttaacacaaattaatctagcgaattcaagaaatactggaaaatgcctatacttggaaaattct

SEQ ID NO: 49263 - DNA, 298 bp, Heterodera glycines
  SCN-specific regions: Sequence locations=1-106,128-298
gggcaaaattcactactgcaagcgtccggacaacagcacaaagtcgtgcaaagctcgtggttcagatcttcgtgtccatttcaagaacacacatgagacggcgcgtgccatcaaacatatgccgttgaagcgtgccatccgctttctggagaatgtacgggaagaagaagagaatgtgccgtttcgccactttcaacggcgcgtgggaagcaaagcgcaagcccaagcttggggcacaacacagggaccgtgggcgaaaaaatccgcccagtttcctcttcaaacttccaaaaatgcg

SEQ ID NO: 49264 - DNA, 169 bp, Heterodera glycines
  SCN-specific regions: Sequence locations=1-169
acagtcttatcccaaatgtcggttttgacgcggtggccccgacccaaagattctcttatatgacgggggtacgacacgcacaactgttgacgaatttccgtgctgagtgcacatgctatcgaatggcaaggaacatttgtcgtctgaggctctccaagctgctcgaatt

SEQ ID NO: 49265 - DNA, 445 bp, Heterodera glycines
  SCN-specific regions: Sequence locations=1-445
agaagagagagaggcggagaggaaacgatacattttcaaggcacgcattaaaattcaaaatgagtagccaaacaagtccatctctctgcaagggatcggtcgttactacaaaacgaaagctgaagacaatagcggatctggaaccagacaaagccaatctttgccatttacacggcacaaccaatggacaaccaattctcttccgcttgcgactgcgttgtcttacatcagtcagtaccattcgccttccgtttatggcaaatcggatgaactgttgctactgcacattgagatgaacatgacctccgaaaaaacgaccaaattcaagacagattcacctcaattggttgaccttccgcatccttttcaacactctgaatagcgtaccattctggcatttgccggcaccaaagaagcgcaacaggaagtgatgctaaacggagcg

SEQ ID NO: 49266 - DNA, 576 bp, Heterodera glycines
  SCN-specific regions: Sequence locations=1-138,166-576
caaaccccctcaattgcctccccaattcaacatacctccgccctccgtcccctctcatcagtttcaaatgcaacctcctccattggtgccaggccaatttcaccacggatttccatccatgggcatggctccgccttcgctactgcaacagcagcagcaacagacgccttttacacaacaaaagccgacacccatcgctcctttggcagtgcctccggcagcgaccgctccgcaacagcagcaggctgttagtccgcctccgcttagccaacaaacacagcaaagtaacagcgacaatttggacgaggagcagcaggcgcaaatgcttatccgcgtgctgcaactcaccgatgagcaaattcgtatgttaccacccactgaacgtgcccaagttatcgaattgcgtaaccaactgagaagtgcggatgcaaatgcgtgaccatatcaaatcgcactgacagaggtcgaaaagccaactgatctcttctttctccatcaacctatttttatataatgtttgatttttttgttgttgaaaatcaagatttaatgaaaaaatttttactaggttacaaa

SEQ ID NO: 49267 - DNA, 598 bp, Heterodera glycines
  SCN-specific regions: Sequence locations=1-1,46-366,395-442,469-598
gtccaattaaggttttttccaatttttccccatttcaaaaatggccgactccatgttcaagtatgaccaggaggagcagcggatgatacgcaatgtgaagccatgggagcaggatccgcactatttcaaggaagtcaaaatttcggccttggcccttgtcaaaatggtgatgcacgcgcgcagcggggggaacatcgaaattatgggtttgatgcagggccgggtggacgccaacacaattattgtgctggacgcttttgcgctgccggtcgaaggcaccgaaacgcgggtgaacgcgcaggcccaggcctacgaatttatgaccaacttcagcgaaagttgcgaggcggttggccgtttggaaaaggtggtcggctggtaccactcccacccgggctacggctgctggctgagcggcattgacgtgaacacgcagtccatcaaccagcaattccaggagccctttgttgccattgtgattgacccgattcggaccgtcagtgcaggaaaagtggacattggcgcgtttcgcacttacccaaaaggttataagccgcccgatgagccgccctccgagtatcagacaattccgctgaac

SEQ ID NO: 49268 - DNA, 625 bp, Heterodera glycines
  SCN-specific regions: Sequence locations=1-172,198-240,280-438,461-625
tacggttcggagaccaagtcctcccttcccctccctgccgtcttcaaggcgcccatccgctccgatgtggtcaaggccgtctacaagaacgttgccaagaacaagcgtcaggcttacgccgtgtcggtgaaggctggtcaccagacctctgccgagtcgtggggtaccggtcgcgctgttgcccgtatcccccgtgttggcggttcgggtacccaccgtgccggccaagccgctttcggtaacatgtgccgtggcggtcgcatgttcgcccccaccaaggtctggcgccgctggcatgtgcgcaccaacgtcaacgagaagcgttttgccgttgtgtctgccctcgctgcctcggccatccccgctctcgtcatggcccgcggtcaccgcatcaaccgcattgctgaggtgcccctcgtcattgacgactcggccgagtcgttcaccaagaccaaggaggccgtcactttgctccgcaagctcaaggcttacgatgacgtcaagaaggtgatccactccaggaagctccgcgccggcaagggcaagctccgcaaccgccgccacacccagcgtcgcggtccccttgtggtgtacgccaacgacaacggtatcgtccgtgccttcc

SEQ ID NO: 49269 - DNA, 632 bp, Heterodera glycines
  SCN-specific regions: Sequence locations=1-13,44-148,170-632
caattaaggagccatttaaaagtgaaatgagcaaaggaaaggaaggcgttgttttcgtttcaatgggcaccatcattcgctcatcggaccttccggccaaatttcggcggaaccttctcgaaacttttgcaaaattctccgattatcacttcataatgaggatagaaaagggggacaattattcagcggaaattgcagcgaaattcggaaacatttttttgacgccgtgggcgccgcagccggccattctcgctgacccacgtctgaaactgttcatcacccacggcggctacaacagtcttttggaggcgacgcgcggcggagtgccggtgctggcgatgggtttttttgcggaccaacaccgcaacgcacgagcagcggaacggaacgggtgggcacgctcatttgacaagttgaagctggtcgaaggcacggcgcagttcgaggcgctgcttggcgaaatgctcaataacgaaaaatacgctgtgggggcaaaaagaattcaaaatttaatgagcactaaaccattcccggccgaagaacgactcaccaaaagcatccgatttctcgaacaaaatgggggaaaactgccggaattgctgagcgaatcgagaaatatgggcacaatttcg

SEQ ID NO: 49270 - DNA, 547 bp, Heterodera glycines
  SCN-specific regions: Sequence locations=1-126,148-168,193-263,306-547
gtttgagccaaattaataaatatttcttcgatatttttttagtaagaatgtcttcatcagaaacaaaattggatgaaaaatcaaacgaaattagcaacaatgaattggtgggagaaaacaatgccaaggatggaaatgtgaaagaagcaaataactcaactgacaaatcagctgaagcagaagttcacacagacgaagcccagctgggaattgctgcagttgacccaaaaccaacggacttttcggaaaaaccaactgatattcaaaagggtgggaagccagaggaacaacagcaacaacagcaggaggacaaaggacaatcgacgcttaaaagccttccgactcgtcaatatttggacatgaccattgtgccaattttacttcaagctttgagtgcacttgcaaaagaacgaccatcggacccaatcgaatttgtcgcgaattatcttttgaaggaaaagccacgttttaacggtgcagcgaatgcatcatcaaccaatgaacattgattttatttgattgtttaacagtttagccacttgaaaaa

SEQ ID NO: 49271 - DNA, 626 bp, Heterodera glycines
  SCN-specific regions: Sequence locations=1-74,97-176,218-393,416-626
gaacagagtattttttgtgttttatgaattaaagaagcgctgtttagtaaatggatgcttcctttgaccaattcggtggtggaggatggggtgaccaaggcgaacaagaatttgcagcttcacaattccaaaaaaatatttatgacaaagttcctgtccccgttgcaatcgatgtccttatttccatgactggtgatgaagaaaaatatgttcttggaaatttttcttttaacacggttcaattgatgggaaaagttgccaatgtgtcggaagttgaccaatgtacgacttacgagttatgcgatgccatggccacggatattcgtgtggcaaagagatttactgtcattcgttatattacggctgacttgcaacccgttaaagacgaggttttcacaattggccaattggtccaagtaattggaaagctgcggctgtataacactcggctgagtgccgtctgcttcaatatccgtgaagttgaaattgatgagattgctattcacaaattggaatgcaaacttgccaaaatctactttgagaagaatttgactgaattttcacttgggattgttgagaatgacaccattttccatggcaaaatgtccaacccacgggcctggctc

SEQ ID NO: 49272 - DNA, 628 bp, Heterodera glycines
  SCN-specific regions: Sequence locations=1-628
cttttgtccgatattcgacgggacctcaacgaattgttgtccatttgtcatggggatcagaagcagaacaatcacagccgtgaattaatagctgcattggtcaagagaaaacgtgtgccagacaattggctccaattttccgtgccaaaagacgtaacagcacttgaatggatgcgagactttgtgcaaaggatggaacaactaaagcgcttgtcactttcggaaaatctgagatatgaggaagtctggctgggtgggatgttctttcctgaagcgtatataacggctacgcgtcagctgatagcccaaacgaatggctggtcgctcgaacagatgtacatgcatatcacaaaaacggaggaaggacaattaaaatcaacggcattcacattgacagaccttcgcgcaattggcgttctttgtgaggccgacgaaatgaagctgacagatgaagtgcatgttggagtgccacggcttcagttcacgtggaccttggaaggacattctccagcgagtgttgtggtgcctgtttatctgtactccaacagggccaaatttttgttcggacttaatttgttaccaattggatttgatcattctatgctaagccagcgaggggtcgcctttg

SEQ ID NO: 49273 - DNA, 634 bp, Heterodera glycines
  SCN-specific regions: Sequence locations=1-276,298-501,536-634
ttaagattaattccttgaagctattaattcgatgtctcaagcggatgccggacgtatcattcacattgggaagcggcgagagcgtgccaaagaggacattgagagccaacgacaaaggcttgaggaagagcggcgaaatttggcggcgagcatcaaagcgaaattcactacaaatattgacgaacaagaagagaaattcaaagaacgaacggttggattggtaacacttgacgaagtgaaggagagacagaacgaaatattttacagtgggccatctttaaaattttcaaacgaagaccgacccaaatttgagaaagccattcaaaaaagagtgctttcgtttggcgcttttgacgacgacgacgacgaggaggacgaggcactgattccaatcaccaaaaagagacacggaatggacccaacggtggacacttcttttctgcctgaccgcgaaagggacgaacaattgcaacgtgagcgcgaacggatcgctaaagaatggcaagaaatgcaggagagggaaaagaatgaggagataaccgtggcattttgctattgggacgggtccagccatcggaaggactcaaaaacaaagaaagggacgacaattgctcaatttctgcagaaggcattg

SEQ ID NO: 49274 - DNA, 328 bp, Heterodera glycines
  SCN-specific regions: Sequence locations=1-328
caaaagctacccaaaatgtgctccaaaccgacgaatgttttcctcttcaaacgccttgtcagccccgtccaaatttgctgccgttcaataaaaggcggcggtttggtccatccggtgaccggcaaagagccgccaacgcttgaggaattcgaccctttgaaccccggcgagtggcagttaggggcctatggtaaaattttgcctcgtctcccggagggcacgcgttgtggcggtttggtgatgggcaaatacggcctgtacaatccgaaggtgcgcgcgctgcaggaggaatgctatccaaaaatgaatggccggcgtgccgacggag

SEQ ID NO: 49275 - DNA, 466 bp, Heterodera glycines
  SCN-specific regions: Sequence locations=1-76,99-466
gtccagtgaccttgcccagaaaaaggaaacgaaccccaatgagactgatgaccaaaccaagaaataaaatcccttgacgaggatggaaattgccccacttagaaattacaacctgggaccggacgccgatcatttgaagcaggcccagaaggacattgatgaaattcagaagcgcataaacactctttgcggagtgaaagagagtgacaccgggctggcgcctcccattctttgggacattgcggccgacaaaatggccatgtccaatgagccccctttgcagatggctcgccgcaccttaatcgtcaaagaacagggcaaagacacgcgttacctgatcgatgtgaagcatttcgccaagttcgtcgagggcctgcacgaaaatgtggcgcccactgacattgaggagggaatgcgcgcgggggtggaccgtcacatttacgacattgcacttgcccttgccgga

SEQ ID NO: 49276 - DNA, 238 bp, Heterodera glycines
  SCN-specific regions: Sequence locations=1-238
cctgcaaacgaaagcacaagtggatgaagtcctcggcataatgaacgggaacgttaagaaagtgttggagcgtgaccataaactgtccccattggatgatcgtgctgatgctcttcaagaaagtgcgtcatggttccagaaatctgccgcgacgctgaatcgcaaatattgctggaagaacataaatatgatcgtgatcatgtgcgcaattgtcttcctgctgatcatcatcatcgtc

SEQ ID NO: 49277 - DNA, 645 bp, Heterodera glycines
  SCN-specific regions: Sequence locations=1-98,120-645
taaaaaagttactgtccaaggaacgcatcaattatcgtgacctcaccgacaaatgggtggacaaggagggaaaagtgcgatatgttccacttccttcgtatgaaaatattttccaaagtttttccgaacacgcaaaaggtcacaaaacatctggcgatctttttaacagttcttcgcagaatattaatgaaatgtccgatccaaaactcattagcgaatcggaatttgcttatttcgaaggctcgttgattaacattaaacagagtattgagcgacaatacgcactggaaaaagagcgacaagaaacagtggaccaaaacgagaagctgaccctccaacttaacaacattaatgagcagcgagaacatctggaaaagaaaaagcgacgactcgaagatgacgttgatcgttacaaaaagaaattatacgacagtgaaaagctgctgaagaaggagcaggaggacaattcgtccatgaagacttctttattggattgtaagcgctacggggagagaatggtcgccgttgttgagaaagtattgcccccgccatcgaaaaaggaagaaaaagaaaagtcgtcgggatcggacaaaaatggaacgagcggaaaagaaaggacaacgaagttgcgaatttgaataccga

SEQ ID NO: 49278 - DNA, 600 bp, Heterodera glycines
  SCN-specific regions: Sequence locations=1-600
gctgctcccgtgagctaattgttgagaaggaggcaatgctttcggcaaaagaaacgaaggaaatgtgctgtgcactgatggaccacagtttcatcactgttcggcaactcgcgcgcaccaacgatttcgcgcccgcccgcacatttttcctctacaccgtgtccatggtgcaggtgctgaacgcgatgatcagcttctgcacccaggcgttgaacaacgtgatcagacgacgcatgttggagagggaaaagcacgaggctttgttggatcgccaactgaaaatggaggtgatcctcagcaacatcgccaacgacccgacctttgatgacgagtcgcgcactcagcagatggccgacgtggagcagtcctacatgaccgaggcggaccgccgggcgttggagcgctttcggcgcgctgaacggcgcctgttttccaccgagattgagctggacaaggtgctgttcaccttccaacagtacgacatgctcagacgccgctgggccatggagcaggcacggcaaatgccgcacggcagacggaaaaggcaacaagcggcggcggcagctgtggcggcgacaacggcacagtcaccaaacgtga

SEQ ID NO: 49279 - DNA, 592 bp, Heterodera glycines
  SCN-specific regions: Sequence locations=1-592
gcacagtgacggcgagtttggcctacgcaattgccaatttgcaggaaggagcgaagccgttcaaagtggccgtgttggacgtcgacatttgcgggccttcccaagctcggatgttcggctgtgaggagaacagcgtacaaaacagtgatcagggatggacacccatttttgtgcagaacaatctgttcgtgatgagtattgcctttttattggacactcgcgacgaagcgataatttggcggtggccccgaaagaatgcgctcataaaacagtttttgcgggacgtcgactggggcgagttggactttctgatcattgacaccccgccgggcacttcggacgaacacatttccatcgtccaaatgctgctccaagcttcttgcctggacggcgctgtcattgtgaccactccgcaggaaatttcgctgttggatgtgcgcaaagaggtcaatttctgcgtgaagaccaaagtgcccgttttgggtgtcgttgagaatatgtgccaatttgtgtgtccgtgctgttccaccgcctcccaactgttccccaacaccaccggcggggccaagaaaatgtgtgccgatttgagcct

SEQ ID NO: 49280 - DNA, 379 bp, Heterodera glycines
  SCN-specific regions: Sequence locations=1-379
aatatggcaaattacaccgcaaaaattgtgcaaaatgctgacttgtgtctttttttttccgaatacacttatgcgctctcctcgtgaaaaaccctttccctaacggaaagaaccaactaactgggagaatttcgccagggctaaagggataacaaacaagaaagacagcaaagtctgggacaaaacgactcacgaatgcaagccgaaatacggatactgacgaggcgagaaccaatcgaaggaaaggatcattgaaattcccgacccagaagacccatagctagatcattttgctgagaaggcagaggaaaagcggtgaaagaataacaagcacgagttgccacggctgacgaacatttcccgcgactctaacacatca

SEQ ID NO: 49281 - DNA, 310 bp, Heterodera glycines
  SCN-specific regions: Sequence locations=1-310
cttcgagaaaaagcctgtctccgcgaatatatttggcgtttggctgcgaatcaattctggtattgtatacctgaacatggaccggtagtatggcgatgattgggcagcgtttggtgcaactcagtgctatggcgacttgcaccctctgcggagccgtctaactgatcgtatgagaatcatccaagtgcaaccagtgcacgtgggagtatggattcgatcccgagtgaatcactgtcacaactctcagatctaatttccgcttcctcactttgtggattgcaagcgacgcatcatgactgctctcacgaca

SEQ ID NO: 49282 - DNA, 417 bp, Heterodera glycines
  SCN-specific regions: Sequence locations=1-417
atttgttgaccctcactgtatttgacaccttttccacgcactaaaaaagaaacggcaagcactcgaagaaaaggaccaactcgagttgtacgcttccgccttggacgaagacttagagcgtctttccaccgactccgaagatgagcaggagacgcggaaagcacggccaaatatcgtttctcggcgccgaagtcgctcgcgcagccgtggccgaagtcggagcaaatcgagagaacggagacgccgatcactttccacggatgaccgtcggggaggacgaagtgccgcgaaagacaccgaaagagaaattgaggagaataacgcactgagaaagaaattgggattggcaccattggagcgttaaattgtttttgtgtaaaaattcagaattggcattaaaaagcaccaagtttcaaa

SEQ ID NO: 49283 - DNA, 136 bp, Heterodera glycines
  SCN-specific regions: Sequence locations=1-136
taatctcgcccgctttgagatgaaattgtcccatgagtctgtgaccatcgagctgaagaacagtacacgaatgagcggtgctattcagggcgtccacgtgtccatgaacattcatttgcgctcggtaaaaatgaca

SEQ ID NO: 49284 - DNA, 307 bp, Heterodera glycines
  SCN-specific regions: Sequence locations=1-307
gactgctgcctcagatagctcgcggacagactttctatgaactaaggagcgaatccaatcggggaatttcttcatggatgttctcgacaaggtattggcaatcaacccggatgagtacactctgcttcacatgcgcagcaggctcgtcctctcggtggcttctctgtcttggattgatcgcaaggaggccaccgcccttttcggcccgccgcctgaagtttcactcttctaggcgatcatagacttctcggcggtgttggagttcgcttcgcattgggtggagaacagtctcctcttggccaaggcg

SEQ ID NO: 49285 - DNA, 635 bp, Heterodera glycines
  SCN-specific regions: Sequence locations=1-110,139-635
cttatcaataatggagagcaacagggaattaatcttgtatcgtgccaaactagcggatcaagccgttcgttactacgacatgggacagttgatgaagaaggtggttgagttggacaacgtcttgaacgaagaggagcggaacatgctgtcgattgcgtacaaagctgtcatccgtccgcttcgcttcgcgttacgggagatctctccgatcgaatggacgcaggatgggacggaaaagcagctgcttatgctcaagcgatatcgcgaaaagttggtcaaggagttgcacgacacatgcaacgagctcgtggagttattggacaagttgatctcgagggccgacgaccccgaagtgaaggtgttctacctaaagatgaaggctgacgtctaccgttacatggcggcggaggcaattggaggtgttgttgacaagtctcgccaagcataccaagaggcgttcgacatagccaaggacaaactacggccagcaaatgctacacggcttgggctcggactgaacttctgcatcttctactacgacaatttggacatggaagaaaccgcaatcgatttcgccaaaaaggttcttgaggacgcaaattctgatcaacatggtggcgcatgcaatgaatctg

SEQ ID NO: 49286 - DNA, 532 bp, Heterodera glycines
  SCN-specific regions: Sequence locations=1-311,475-511
aatcaatgaaggccgaatctgttgacgacaagcccaagcagcagtttacattctcaaactttcgtttcgtccttcacgaggataagtgcgaaacgcgacgggacaaacgcaacaaattcaccggccgcgactttcgccgactgttagaaaaggcggagaagcgcgggcaacggatggaacgcattcggacgcaaaacccacaaaaagcgcaatgcgtcgagaaaaacgtcgcgtgggaacgcgcgtttcggcgagcggcgggacaaaaagttaaggacaatgttgacctgctgaaaaagggagtggtcagaaaggcgaaaaacaaacagcgaaagaagcgaaaatgggaggaacggaagcaaacggtggaaacagtgaaggagaggagggcggagaagaagcgagagaatgtggagaagagaaagagacagcagacggaaaagaacagagggaagagaaagagaaagtgagagacacagacaaaccaaccgaattgagtcgaattcttttttatgtttataaaagtgttaaa

SEQ ID NO: 49287 - DNA, 528 bp, Heterodera glycines
  SCN-specific regions: Sequence locations=1-292,317-370,392-528
ttagcaaagatgagcaggattattgcgtcaaattcagcaacaatcttcgcagcactgtggccactgggaatcagcagaacaaaggcggcggcaaattgccatcggccacgaatatgttggagttggcatataacgagacaattggccaaactgcgcaagcgtgggcagatttttgttaattttcgcattccaacacggcagggctgggcgagaacatttactggtccacgaaggaggggatcagcaacaccgaagcgttaaacaaagcattcgttttttggtggaacgaagcggtgacaattggcatcccggaaaatttggtggtcgacgccaacaattttgagccgattgggcactttactcagatggcatggcacagtacgacagacattggctgtggcgtggccaaatgccaacacgcgcaatggaaactgtttgtggtctgcaattattggcccccgggcaatgttttgggccaaatgacttatggcccgggtgactcgtgcagtgcgtgtgaatcggggtggg

SEQ ID NO: 49288 - DNA, 232 bp, Heterodera glycines
  SCN-specific regions: Sequence locations=1-140,163-232
gatcagactgttggccaccgaatggaccaatctcgagaataacatagatccccagtggctcatagtgtacatccacctgccgatcaaagtctccaagaatgtgctcttccccagtttccgtcctccaaagtttaattttgtgggcaaagttcttggaccttaacgcacgactttgcagaatatccccacatcattcaaatgtctcgtgatcattttggggctgggcagcact

SEQ ID NO: 49289 - DNA, 600 bp, Heterodera glycines
  SCN-specific regions: Sequence locations=1-414,436-600
gtccaattaagctaatcactgaaaatgccaaagaaaaagaatggcaccaccgacgaaaagggttgccttctgatcacaaattatttcccaattcgtaggagcaagcgcataacaacgaaggaacttgaggacatcaaattgaaggagctcaaggagttgatcgacacagggttcaacgaggaccatttggaggtgtttcggtgttcggtgaaggggcgaagtgtccgtgcgtcgaaatgctttcaaaggggcgaatttgttgtggagtacaaaggcgacttaatcagtgtgaagacggcccaactccgcgaacaacggtatgccaaagatgagaacgtgggctccttcatgtactactttcggcaccgggacaatgtgttttgtatcgacgcgaccgatgaaacgccgtacaaaggccgactgatcaaccacagctatttgaagcccaacctcaagacgagggtggccgacttcggctgtgacggcttccatttggtgctcgtcgccatgcgcgacattgacaacggcgaggagttgttgtacgactacggggagcggcggccctccgtgctggcgggtaacccgtggattttgggctca

SEQ ID NO: 49290 - DNA, 268 bp, Heterodera glycines
  SCN-specific regions: Sequence locations=1-268
gtcaaatcggtgcttttgcaattacagcccgacggtgtgcgacatggaggacacttggataacatacacttcggctgccagttttcaagcgattgtgctggagtttaattctggcacgagtgccatcgaacgccgtcacttttttggttgtgctccgctcgaaagaggcacagacgcatcgcatcttacgtgcgacgcgtggcgatactcccactcaaacggccgaaccgtcgcgtgctgttaccagggcaatttttgcagtccgaat

SEQ ID NO: 49291 - DNA, 421 bp, Heterodera glycines
  SCN-specific regions: Sequence locations=1-345,367-421
gagtgtcatgatgaaaagcacttctattaaagtaactttaatctgcacaagtggagacatcggccaaccgctcggattacttttgaagaaaaacccttccattgcacacttggcactttactatcttgtcggcacccccggagttgcggacgacctttcccatatcaacacccaggcaaaagtgactggccatttgggaccagaacaacttgctgcagcgttggacggcgctgacgttgacattattcctgccggtgtgccacgcaagcccggtatgactcgtgacgactttttcaacacaaatgccggcattgggcgggacatggccgaagcaaccgctaaaacttgtcacaaagccttcatggacattataaccaatccggtgaactcgacccttcccatcgactgcgaaatcacgaaa

SEQ ID NO: 49292 - DNA, 613 bp, Heterodera glycines
  SCN-specific regions: Sequence locations=1-6,28-60,91-304,326-385,415- 613
tccaaaatggtgtccctcaagctccaaaagcggctcgccgcctccgtcctcaactgcggtaagcgcaagatctggctcgaccccaacgagtcatcggacattggcaacgccaactcgcgcgccaacatccgcaagctcatcaaggatggctacattgtgcgcaagcccgagaacgccccctcgcgtttccgcgtgcgcgagcgtcttgccgccaagcgcaagggtcgccacactggcaccggtaagcgccgtggtacctccgaggcccgcatgcccactgccgtcctctggatgcgccgccagcgtgtcctccgtcgcctcctccgcaagtaccgtgaggctggcaagattgaccgccacatgtacgccgaactctacctcaagtccaagggtaacgtgttcaagaacaagcgtgtgttgatggagtacatcttcaaggtcaaggccgagaaggcccgtaccaaggccctcgaggaccaagccgccgctcaccgtctcaagaacaaggctgcccgcgaacgcaaggcgcagcgcgctgccgagaagaaggctgctctccttggcgacaagcaataagttgctttgcacttgttctccttggtgtttttcatcc

SEQ ID NO: 49293 - DNA, 618 bp, Heterodera glycines
  SCN-specific regions: Sequence locations=1-62,85-618
catatttgcaattatcagcagaaaacaaacacaataaaaattaaaacaagggaaagagcaattttcaacaaagacaaaagaggaaacgccagacagacaaaagaacagcgaaaaaagtgaaggaaagaaaaaatggcggaccgacaaacgcagtacaaaaacatcggaaaggacgtggaggcgttgcgcaagaaccgcacggagcaggtggtgtccatccggaaggagaagcgggatgacattttgtttaaacggcgcaacattccgaccgaagacgccactgaggacgcttcgacaagcaatgtcactggcgttgcggtgccttacgatcgtaccaatttgcaggagattgtggtccaagcgcaaagtgctgacccggaagtgcagatgctggccgttacccaggctcgaaaattgctctcctccgaccgcaatccgcccatagacgacctcatctccagtggcattctgcccatcctcgtcaactgtttggagtcgccaaatgccacgcttcaatttgaggccgcctgggccctgacaaacatcgccagcggcacttcagaccaaacacgcgctgtcgttcaggctggagctgtgccacactttttgaagctgctt

SEQ ID NO: 49294 - DNA, 492 bp, Heterodera glycines
  SCN-specific regions: Sequence locations=1-431,453-492
aaagtcgcgccaacaagaggcggagtgtatgcgccgcttggccttcttcggtgttgcgctctccaccgtggcaacattgatcactgtgctgtccgtgccgatggtgtacaactatgtgcagcacgtcaactctcaaatggtgtccgagctggacttttgcaagtcgcgctccggcaacatttggcgcgaggtgacccgcactcaggctcttcacagcaacaagcagcgtgtggcccgtcaagcggactacggatacggcggcggtgcctgctgtggctgtggcgtgtcggcgcgtggcccacaaggacctcctggccagcccggtgtgcccggtgacgacggtgctcagggcaacaacggtgcgcccggtattccggcatttgtgagcctgccacgaatggtaacccaggcgaacagggacctgctggttcgccaggggagccaggcaagcctggtgcacctggttacccgggccagaatgggccacgtgga

SEQ ID NO: 49295 - DNA, 623 bp, Heterodera glycines
  SCN-specific regions: Sequence locations=1-50,72-85,108-160,183 -271,294-623
atttttttgtttttgtcacgccaaaacgcagcaatttggtgaaccgttcgacagaaaaggcataagcaaatgacagaatataagttggtcgtcgtcggtgacggcggtgttggcaaatcggcgctgaccatccaattaatccagggccaattcattgaggagtacgacccgaccattgaagactcgtatcgaaaacaggtacttattgacggtgagacttgtttgctggacattttggacaccgcaggacaggaagagtattcagcgatgcgggatcagtacatgcgcacgggtgagggctttctgctggtcttcgcgctgaacgagtacaaatccttcgagaacatccatgcctaccgtgaacagatcagacgggtcaaggacagtgacgaagtgccgatggtgttggtgggcaacaaatgtgacttggcacagcgcgccatggaccagcgctccatccaggagttggcccgctcatttggcattccgttcattgaaacgagcgcaaaaacgcgacggcacgttgacgaggcattccatgcattggtgcgcgaaattcgtaaacacaaggacaaacaccgggagaagccgaaacggagaaagcgctgtgccgtcctctgacg

SEQ ID NO: 49296 - DNA, 611 bp, Heterodera glycines
  SCN-specific regions: Sequence locations=1-234,271-455,478-611
atttgttgaagaatctcatttgccaagttccatttagacgatgctacggcacattgattcaaccaacaccttttatttgcgaaagaatgcaacatgatccaaaattgaaagaaaaagtggaaagagtccagaaagaatatgaggtgtacgattatttctccgaatttattcctaaatcatttgacgataaagaatgggttcgaacaatggaatgttcaagtgttgtcgaacgcgttaattattgggcttttttggcactttctcagcatcgaaaagacttggacgaaatgaaacataatcaaagtgtagaacatacggatagttttttcaaagaacagttgcgactttataatgctggaggcatgggatacagtgaagacgcgtactgtttgtatttaaattcctatcaaggcagaaattacgcatcgagaaaatatcgcacaattgaagaatcaaagaaattggcccagcaattaacacttggagaatcaccgcggattctcttcgattgtcaatttttacctcaaatgacacaacgaatttacggcaaagtagcaaaatcggcagttcatgcatattttaaaaatcttcaccttccttcgccttttcct

SEQ ID NO: 49297 - DNA, 631 bp, Heterodera glycines
  SCN-specific regions: Sequence locations=1-631
gagattatgcttaactccaaagggtacaccaaatccatcgatgtttggtcagtcggatgcattctcgcggaaatgctcaacaaccgcccgttgttccccggcaaacattaccttgaccagctgaacctcattctcgccgttgtcggctccccgtcgcaggaggatttgcagtgcatagtcaatgacaaggcccgtgcttatttgctgtcgttgcaacagaaaattaagcagccctgggtcagactttacccgaacgccgacccaagagcattggatttgctcgacaaaatgctcacattcaaccccaacaaacgaattggcattgaggaggccttggcccatccgtacttggagcagtattacgatcccagcgacgaaccgatttgcgagaggccatttacatttgagatggaatttgatgatttgccacgtgaaaagttaaaggaactgatctttcaagagacggaggaattccatcgacgtgccacagaagcggcggcagcaagccgaagtgagacgacgatgaatgagggcacttaagaggaagtgacacacaaaagatggaaggaagcctatgccattttcgaaaaccaatcagaatttaaatcctttatttgctgacagtttgggc

SEQ ID NO: 49298 - DNA, 579 bp, Heterodera glycines
  SCN-specific regions: Sequence locations=1-404,426-579
gttttttaatcagatttgaaaatgtctaaagaatcgacgaaaaccggtaaacaacaactgagcggagggaccgattttaaaatgatgagttcggaactattcattctcagctatggtgcacttgtggtcgacttggtaaacgacttggagtccccggaggaagtaaacaagcatctggacaaaattggatttaatatgggtttaagaatggctgatgattttcttgcaaaaaacccaaggattggacgttgttcggacatgcagcaaatcatggaaattattgcaaagagtgctttaaaggcatatttgggcattactgctcaatttgttgcgattggcaccgaaggaaacgaattctcgctgacattggactcaaatccgttggtggaatttgtggaggtgccggaagaaatgaagggcctttgctattcccaggtgatttgcggttgcattcgtggcgcgttggaggcactgcacatggaagtgcaagcagtgttggtcagcgacgttccggagccccccgaactgcgcatcaaagtgcaccgggtgttgcaagagtccatcccggggggggaagaa

SEQ ID NO: 49299 - DNA, 630 bp, Heterodera glycines
  SCN-specific regions: Sequence locations=1-348,370-630
cgtcgcaaatgagaacaccgaagcgggaaaaggtggagcggaaagagaagcagcaaagggaggagaaaaaggatcacatcaaaaagccaatgaacgcgtttatgctatttatgaaggcaaatcggcacaaatatttggaagaatcggtggacaaacggaaacagtcggcggaattgaacaaagagttgggccaaatttggcagcagatgaaccgcgaagcgcaacagccgtattatgaaatggcacagaaagcgaaggaggaacacgcgcggatgcacccgcaatggtcggcccgggagaattacgccattcacaaaagggcaaagaaaaaaagagtccgggaaaagtcagtcgataacaacgaacagaaaaagtgcagggcccgatttggagtggacaatctgacgaaatggtgcaaacattgtcgacgcaagaaacgctgcttaaatgtgctgagggactctgattctccagtgcaggtgtcgtcctccaccaacccttccaccacccctttgtctatcggagtcccttcgtccgctcacttcggaagccttcttaattctgcacaccatcagcgcctctgcagtcctcactcccgaaaggacagagaagggcacggggcaccgacta

SEQ ID NO: 49300 - DNA, 202 bp, Heterodera glycines
  SCN-specific regions: Sequence locations=1-202
gacacatggattggctgatgtgatgaaatccttccccgagaatgaaaaaggaattatcggcttggcaggaaacgtttcaccgattggcggggacagtcatattcctgccatttgtgaagaaaaggggcttccttatgatttctctccgtctcgagaacaccttggtatttgtgctgggtataaacgccccgcatttgtcctt

SEQ ID NO: 49301 - DNA, 618 bp, Heterodera glycines
  SCN-specific regions: Sequence locations=1-618
ggtcaatgtctgatagtcaacaaagcgaccagcggactgaacgtgttactcgccgatcgctgtttggttctgggcgaccaaatgacacggatgaatggctgaaaagcctggaaaataacgcaatggaggagaaagtgcgaaaatggagcttcgatttccgaattggatgtccattgaaaaaggcgggtgccgagtcgccatcatcaagccatgtttacgaagcaatcgacgaacgcgaggtccccgagttctaccgcacgaagactcttcgctccgttccgaagcgccgtccgtcgtcaatccgttctccgctgaaatcgcccctgaaggcgtccgagtcccttaaaagcgagtcgaatttggcgtcggcgacgaaagaggcggcgaatgttttggaaactccgcgcaaaagcaaaaggctgcgaaaggcaaattcgacggagagcacgccgcagaagaaaaagcgaaacgaatgaatgaaagcggaggaaagacggaagagtatttgaagccactcacatttgacgactcactgccaacgattgcatattcaattccgcatttccttcagcccactcccgcccttttctcctgtacagcattttattaacttttacc

SEQ ID NO: 49302 - DNA, 611 bp, Heterodera glycines
  SCN-specific regions: Sequence locations=1-83,109-117,139-611
gttaattgctctattaatctttggcccggccaattcgcccttttccgttccgctgaatgagatcgctgctctctgtgctcctctgtccccttctcctttccctcctccgtccttcttccacttgtttgctttgtccgttgcatattccggcccggcccaaaccgcttgatcagttccgattgccctccattcagaaaatagtgcacacagccgacactttcgaatggctctgtcagaatgggtcaaagttggccacggtgtccgctcaatgccgtgccgatgtgtcccatttgttctgttccctgacccgactggtccaatccttgaaaacggaatgcccgggagctgacgagggaatggcacaatgtgccgagtgccgtaggaaaacggacattctctaccgggagaacaaatgggtgctgacatggatcgactcgttggggaagatgccctcgggcataagtgatggcaattaccattggcttggcgactatgagcagtgccttcgattgcgggacgacggtctcttcaatggccaatactgtctgctcgagttccgcgttcccgacggagtgttgctgaactcggaacattgtgaggacggctcggag

SEQ ID NO: 49303 - DNA, 546 bp, Heterodera glycines
  SCN-specific regions: Sequence locations=1-546
attttttctaattaactatattaattgttgctattaaccgtttattctaatggagaatggcaatggaattgaaaagcgaggattggtcgttgaggacggtgacggacaccccctttcgctttttgccgtgccgaattgttattgtgcggacttggattcggtgctcattccaaacggaatgattcacgacagaattcgacgaatggccgacgaaattcaaagcgcaattggcgacagagtttcttttaaaccaaatttgaattttgcgcctttttggcgttttgttcagcctctgactttggtctgtttgctaaagggcgcctaccgatttttcaccgctttggccgactgtttggcccaacttcggctctgttgcgcatctccgatgcagatcgaattcattcgggcgcaaagctatttggaccaatcgtccacaggccaattgcgcagcgacggtccttcgtccattgacggaccgttgcggggggcggaagtgttgcttgttgacgacattctcgacactggccttacaatgactcggattgc

SEQ ID NO: 49304 - DNA, 587 bp, Heterodera glycines
  SCN-specific regions: Sequence locations=1-319,346-543,567-587
atcacctctcttggccccagcccaccacctcgcccccgccgttgccggtgacaccacacccatcaagggcgtcacacctaccaccaagctgacgggcacgcttgagaatctcgagatggactctgtcaagaaggcggccgtctccggatcactcacggcttcgggttccgccgcagcccgtgacgacgggtcgtcggttggccgtcccgctcgtacactcctgtcggatttggagttgagtgagtccatcttgaccgagaacaagaaccggtttgtcttgttccccatcaaataccaagatatctggcaaatgtacaaaaaggccgaggcctccttctggacggccgaggaagtggacctgtccaaggacttccacgactgggagaaccgtcttaacgacgacgagcgccacttcatctcgcacgtgcttgccttctttgccgcctcggacggcattgtcaacgaaaatctcgttgagcgcttctcgcaagaggtccaagtccccgaggctcgctgcttttacgggttccaatcatgattgagaacattcactccgaaatgtactcgctgctcatcgatacctacat

SEQ ID NO: 49305 - DNA, 619 bp, Heterodera glycines
  SCN-specific regions: Sequence locations=1-423,446-451,474-486,508 -593,615-619
tctcggtcgatttcctcaagcgctataagatcgatttcattgcacacgatgcacttccctactcggcaaaggacgaggaggacttgtacgagaaattccgtcgcgcggatatgtttgtggaaactcagcgcaccgagggcgtgtcgaccagtgacgtcattacgcgcattgtccgcgactaccatgattatgtccgtcgaaatctgcagcgtggctacacccctgaggaactgaacattggtcttttgcaggcctcaaaataccagctgcagaacaaatttgccgcgatcagacagaagggagccaaaatgctgaaggaatggacggaccgatcggacgaatttattcgaaacttcaccagcacgttcaacagcgacggaccgattggccgttttctgagcagtcgcagtccgacgccggcattggaggagcaggaagaagcggcggcatcggacgacgacgaagacgaagaacacaacgaagcttaattgattcaccaacaaaaaagggtgcttaatcgatcatatcaactaaccaaagaggatgagaaatgaatgatattatattatgttatcatattgtccttttgtgattttcttacaatgattgtgccttggct

SEQ ID NO: 49306 - DNA, 520 bp, Heterodera glycines
  SCN-specific regions: Sequence locations=1-520
ggtttcgctcggggattctacgcgcacgggggagcaacgagcgtccggtctacaatggccgattatgcttttgactggccatgagggcgaaatctacgccgcccaattcagtcccgatgggacatgtcgcgcttctgccggctacgaccagagaattttcttttggaatgattatggggagtgtgagaacttctccactctctccggtcaccaaggcgccattatggacgtacatttcagcaccgatggaagtttccgtttctcctgctcaaccgactaaacagtgcgcgtgtgggacatggaaagtgggaaatgctgacgccggttccgtacacacaccgatttcgtcaacggctgacaccccgcccggcgggggccatcgcttgtcgtctccggctgtgagggcggcaaaattattgtgcacgatgttcgtcggcggtgccctgagagcacttttgattctgtgagcgattaccagaggacctctgtgacattcaacgagccagcccgaacaattatc

SEQ ID NO: 49307 - DNA, 400 bp, Heterodera glycines
  SCN-specific regions: Sequence locations=1-29,51-400
tcgaacaaaacaaacggtacgcaagtctactggtgggaaggggccacgaaaaccattggctactaaagctgttcccaagtatgcccctcccatggggggggtgaaaatgcctcaactataccggccagtgaccatcgcactgctggaaatcagccgctactcactaagcaactagctgctcatccgcgaattgcccttccaacgattggtgcgcaaaattggccacgactacaaaacagacttgggattacaatcggctgccatcggcgctgtgccagaagcttctgaggcttatgtggtcgatctttttgaggacaccaatcattgtgttatccatgcaaagcgcgtctccatcatgccgaaagacatttaattgggccgtcggatccgtgtagaccgt

SEQ ID NO: 49308 - DNA, 253 bp, Heterodera glycines
  SCN-specific regions: Sequence locations=1-253
tggaattgcacttacatgttcccacattctcactcatttcctacatgcaactggcaaaactggttcttcttgctttcgctgctttgaaaaaattgacccttccaaagaatacatccgagcgatgatactcgttccgactcgggagcttgccttactgccatctctgatttgcgtataactcaccaaacgcttgtacattaacattatggtgacgactggctcaccagatcttcgcgacaatattttgcgtctc

SEQ ID NO: 49309 - DNA, 622 bp, Heterodera glycines
  SCN-specific regions: Sequence locations=1-51,73-177,199-622
ctttgctttgttgaatttctttctctcaaaaatgtccagtgaccttgtcgagaaaaaggaaacaaaacccaatgagacggatgacaaaaccaaagaaataaaatcgcttgacgaggatgaaattgccgcacttagtaattacaacatgggaccgtacgcggatcagttgaagcaggcggagaaggacattgatgaaattcagaagcgcataaacactctttgcggagtgaaagagagtgacacggggctggcgccgcccattctttgggacattgcggccgacaaaatggccaagtcgaatgagccgcctttgcgggtggctcggtgcacaaaaatcgtcaaagaagagggcaaagagacgcgttacatgatcaatgtgaagcatttcgccaagttcgtcgtgggcctgcacgaaaatgtggcgcccactgacattgaggagggaatgcgcgtgggggtggaccgtcacaattacaagattcacttgcccttgccggacaaaatcgacgcgtccgttacgatgatgcaagtggaggacaagcccgacgtcacctacgcggacatgggcggctgtgaagaggagatcaaaaaggtgcgcgaagtggtcgagtttccgctgctt

SEQ ID NO: 49310 - DNA, 597 bp, Heterodera glycines
  SCN-specific regions: Sequence locations=1-597
gcgcaacgacggacgaagcccaacggactaccggcccatggcgctggagacgggcgttctgctgggctccaacgggtccgcccggcttcaactcggcgccaccgatgtgctcgtcgcggtcaaggccgacctgcagctggtggagccgtccaccgaagccggggacatccaacgcgtccatttctttgtcgatatttccgcaaatgcgtcgccacgctttgcgggacggggcggcaacgaccatgctgaggaatgggccaagtcgcttgcgggtgcgttcgccaacaccgccccgtcagcaatgcccgacatggccaagctgatgctggcacccacccagctgtggtgcttgtacgtcgacgttgtcgtcctccaatttgacggcaacgcaatggacgcaatttcgttggcggtcaaagcggcgttggcggacaccgaaatttgcaatgtcgtcgtgcggccggccgacgaaggcaaagtgcacattgatttgccggaagtgatcagcacatggcgaatggacatggcgggggcgcccctggtggttggagtcaacaaaattggtgaccaatgcgtgttggacgccgatttgatgga

SEQ ID NO: 49311 - DNA, 640 bp, Heterodera glycines
  SCN-specific regions: Sequence locations=1-95,117-523,545-640
tttgctttttgttgattgccttggcctattttttgcaaaaatgcctcgctatgatgcaaccgatgacttgtcaggagcggaatatttggccagcatttacggcacagaaaaggacaaagtgaattgctccttcttcttcaagattggcgcatgtcggcacggggacaactgtttgcgggcccatcacagaccgaccttttcaaacagttctgctcaagaatttctaccagagtcccattgtgaacccggcacaggcgaacgctttcgacaaggtcggtaaaaaggatgagcttgagcagcgccattttgatgagttttacgaggaagtattcaccgaacttcaacgcacttatggtcccgtggaagaattgaacgtaaattgggaacgaattttcgcttaatttacgaaattttacacttttaggtttgtgaaaacattggcgaacacatgattggcaatgtgtacgtgaaatttgtttatgaggaggacgcagaaaaaactgcacaaggcttggagaatcgatggttcaacgggcagcccatctacgccgagctgtcccccgtgtccgactttcgcgaggcgcgctgtcgccagcacgaaatttccacctgctcaaagggcggattttgcaatttcatg

SEQ ID NO: 49312 - DNA, 584 bp, Heterodera glycines
  SCN-specific regions: Sequence locations=1-5,30-584
ccaattaagggaaaaaagtcctccaaaaatgaattcttacaacttttgctgctggtgacataaaccaccaaatttactctttgaagaagtgacgccgtggggagagaaagtgcggacgaacggacaaagcgaaggcaatgaacgcggaaaagacagtcttcggcaaatgctccccaaaatttgccaacgttgaaaaagcattcaggcgacactttgcggacggatgggagcgggagggggcgtcgttggccatttactggaagggtcaattggtggtggatttgtgcgatggatacgccgacaaagcgtcgcatgaacggtggggcgaggagaccctgacggcttgtgttctcagggatgaaaggcactcgctgcacatcattgcttatatgctcatctgcacgggtcacgtcggttattccaaaagcatcagagtgttctgacgcgatgtccaccatgtcgggacggagaatgtcacactagaagaacgacttgtggacgaagagggctcgccactgtctatgaacagtgacgatgaagcggcacagcacacatccaatggacaggacttgaacgcaacccaa

SEQ ID NO: 49313 - DNA, 427 bp, Heterodera glycines
  SCN-specific regions: Sequence locations=1-427
gatgggtgtttgtgctgacaaaacggttgctgaatttggcttcacccgtgagcagcaggacgcgtatgcactcacctcctatgctcttgcgactcgcgcgtgggcgggcggctcattaggggcgcaaattgtgccggtgaaacacaaaaaccggaagggcaccgagttaatggtggcataggacgacgaggagcggcgactagtgcccgacaaagtgccttcactgcagccggcgtctgtcaaggacggcactggtaccatgaccggggctaacgccagctcattggatgacggaacgacatcacttgtgatcgcatcaggccgatttgcaggggcagaaacgatggctatagttatcgcctactccgaggctggcggaacggccgacaacttctcagtggctgccgatgacccggccaaatcattg

SEQ ID NO: 49314 - DNA, 391 bp, Heterodera glycines
  SCN-specific regions: Sequence locations=1-101,123-391
cgggaaagagcattgcgccaacggaacgaaatggattctcaatgtgtgcgaagattgtgccgaaactcctatgaaaatgtgcggtttttgggtcggataggtgcccttgttcttgcggctgatacctgtgtttcctgagctgaacgatgactttctgaactaacgctgtgaaggcctttccatcttctttctgatgttatgggtgatcggtgacagttgcaacatgatcggagctgatgtcacccatcgacagcctctgcaacagatcatcggcgtgtattacattttgccagacttggctttgcttggtcaggtcatctactacactcggctgtactcggcaacactacgacgcgaaatggtcaacggaacgacagtgattgtgccagtg

SEQ ID NO: 49315 - DNA, 622 bp, Heterodera glycines
  SCN-specific regions: Sequence locations=1-317,340-622
gctcatcggactctatctgacggccacctgagtgcaaaaagaacacacgcggagaggcgcgcaaaacggagcgtttgggcgctcattaggagcccgactgatgggcgctggcatcgcgaatgtcagcattggcaagggcattcatacaactctcgaccacacgaagcatgaggcgctggaccgcgggctgaagcaaatcaccgcccaagtggacgggcagctcaagcgcaagaaaatcagcgccacggaacactccatctgtttgtcagagctgaacccggtgggtgactactatgaccaattgcatgactccgatgtggtgattgaagctgtgttcgatgacattggacttatgcacttgatcgtcctcattcttgagaaggtggtgccagaccattgcgtcatcaccgcaaacacttcggcactgcccatccgcgacatcgcatcggacgcacaacgacccgagcgggtcatcggcatgcactatttttctccggtggacaaaatgcaactgttggaaatcattgtttccgaaaagacctccaaggaggcactcgccgtggacgccaaactcggtctggaccataagaagctgattgtcgtggtcaaggatggccctggc

SEQ ID NO: 49316 - DNA, 319 bp, Heterodera glycines
  SCN-specific regions: Sequence locations=1-319
tacaacgggatggtcagcgaatgggaacaggactgcccttaatgcgctgttgtcccagaacaactacttccaccttaaacggactatcaatctgcatccgctcactaattatacgtttggaagcaacgaacctctatcgaagcgagaccattccgtacaggcgcgtttccagcgattgcgcaacgaatacaagaaaacggcgatgcgccgaatcgcggacggactgctgctggcgcacgaggattcgctggctcacgagctgctgcttcatgtcggaaccactttcttgcgattgcctggaggagaactgaaccatggc

SEQ ID NO: 49317 - DNA, 280 bp, Heterodera glycines
  SCN-specific regions: Sequence locations=24-162,184-280
gaaatggggcgaagaaattgataaacatcctgcatttgcacgcgatttgaaaccgaccgaagacggacaatattcaatggaaatgcaagcaatacaagcaatgaaatacgacgaggacgacccaacggaatgcgccaatgcgtacaaagaggagggaaatcggcactttgagaagagaaattatcggtgggcgattgatgcgtacacaaagggtatcaaattgcgttggtccgatgttcgtcttaactctgttcttttcgctaatcgttccgctgcccac

SEQ ID NO: 49318 - DNA, 555 bp, Heterodera glycines
  SCN-specific regions: Sequence locations=1-41,63-410,432-555
atcaaaaaactgactgacaaccaaacgtccacaatgatcaaggcaactgctcgatctgctccggaacgtgaaaaagaaatttccgagctagtccgacgcgccgaattcatcaatgaccccttcgctcatgagtttgggatttcaatcactccggtcatgacggaatttaaaggccgtgtgttgactgccccaaaattgctttacggaggacggaatcgggcaacggcactgcccaaccaaggggtgtgggacatgcgggccaaacagtttcacactggtatagaagtgaaaacgtgggcaatcgcttgttttgcaccgcaacaatccgtcaaagagaacgatctcaggaattttaccgtgcaactccaacgaatctccgctgatgctggcatgccgattcagggtcagccctgtttctgcaaatatgcgcttggagcggaccaagtggagccaatgctcaaatacctcaagcagaatttccccggcctccaactcgtctgcgtcattcttcccggaaagacgccggtttatgccgaagttaaacgcgtgggtgac

SEQ ID NO: 49319 - DNA, 616 bp, Heterodera glycines
  misc_feature (541)..(541): n is a, c, g, or t
  SCN-specific regions: Sequence locations=1-616
acgaattgcgaaggcaccagcggagcgagctcgtctgtacttcattatttgctggttccatgccattgtgcaagaacggctccgctatcagccactcgggtgggccaattcgtacgagttcaccgacgcagacttccgagtcgcgtgtgatactctcgattccactgttgacatggtcgcacagaacagggcgaatgttaagccggataaattaccatggctggctctccggactctgctctctctgtgcatttacggaggaaaaatcgacaatgattttgatcaggtgcttctcgatactcttctcgacaaactgttcacatcaaattcatttgacgctgactttattctcattgataacatcggagtgaacgccttgaacatgccagacgaaactaactcaaaggatggcttgatcaactgggttattaacatcaaagccttacaaaagcctaattggattggacttccaaacaacgcagaaaaagtgcttatcgccgaaagagggcaagaatttatacggaagatgatcaaaatgtcngacgatgaacttgcatacgaagcggatgatttggaacgtaacaagcaagcccctacctggatgggtcaattttct

SEQ ID NO: 49320 - DNA, 412 bp, Heterodera glycines
  SCN-specific regions: Sequence locations=1-250,287-298,330-346,368-412
cgacgaataacctgctgctctcatggcggacaatgggtccggaatgttcaaggccgttttcatgtatgatgactcgcccctctcggcgtttccgtccattgtgggccgcccccgtcatctcgacgtcatggtcggcatgggacacaatgactcgcacttgagatactaagtgcactccccgcggggtattctgactctgaaaaacactattgtattcgatatcgtcacccactgggactacatggataacatctggttcctcaccttctacaacgagctgcgtgtcacccccgaggaccacccggtgctgctcacagaggccccgctgatcccggagggcaccagagaaaagatgaccccaatcatgatcgagacgctcaacactccggccatgtactagaccatccaggct

SEQ ID NO: 49321 - DNA, 654 bp, Heterodera glycines
  SCN-specific regions: Sequence locations=1-624,647-654
cagaattttccctcattccctgtttttgttatggcttcaactcataatcattgttacattgaaagcctcaggacgaggcagacagcttcgctcaagcaacttctgaacctcaaccagcccctgaacgtttctctggcggttgaacccgtgtggaaattgctgatttttgaccgctactgtcaggacatcatttctccgctgctcagtgtcaaacagttgcgcgaactcggcgtcacactgcacttatcggtcgactcgccgcgtgagattctccccgatgttcccgcagtttattttgtgtcgccaaccgaacaaaatgtgcagacaatttgtgcggatttgaagcgtgccatgtatgacagcttctacttgaacatggtcaggcccatcccacgccctttgcttgaacaattggcggaaagcgcagtggccggtggcgcaacacaacaagtgcagaagttgactgatcagttcctctccttcatttcgcttgaagatgacctcttcatgctcagccgttacacaaaaagcagcccattctctttttacgcaattaatgacccgtcgataaccacccgatcaattgacgcggtggtcgccgacattgccaatggactggtcgccgtctgtgtgacccttggtggtgtgccggtg

SEQ ID NO: 49322 - DNA, 553 bp, Heterodera glycines
  SCN-specific regions: Sequence locations=1-1,23-208,230-553
caccactgtggtggaatgtctgaaggatgccgacatttccatcaaaaagagggctcttgaactttgctttgcccttatgaaccaaacgaacatcgcgagcatgtccaaggagattataattttcctcgaaactgccgactccgatttcaaagctgagtgttcttctaaaatgtacgttgcgacggagcgcttctccccgagtcttgtttggcatttggacacaatgataaacgtgctgcaattggcagctaaccatgtacctgatgaagttgtcagtgcgatgattcagctcatctcttcccagcaggaactgcagcattacgcaaccgtccaattgtttcatgcctccaaacgggaacacatagtaaatgctcagcccttaatgcaaatcgcattttggagcattggcgaattcggtgatttgcttgtcgctccgggaaatacggaggaggcaaatataaaagtgagcgaggatgaagtggtggaattgttccaacttttgatgcctcatccacggctcactgtgccaacccgtggagtatggactaactgc

SEQ ID NO: 49323 - DNA, 193 bp, Heterodera glycines
  SCN-specific regions: Sequence locations=1-167,190-193
ggccggtttcgcgggctatgacacaatccgagcgttgtttccgtccattgcgggccgaacccctcatcaaggcttcatggacagcatgggactcaaggactcgcacgtgtgatattaggcgcagtccaagcgtggtattctgacgctgaagtactcgactgagcaccgcatcgtgaccaactgggacgatatg

SEQ ID NO: 49324 - DNA, 406 bp, Heterodera glycines
  SCN-specific regions: Sequence locations=1-46,88-136,158-188,211 -216,286-340,362-406
gtgcgacgaagaagtcgctgctctcgtggtggacaatgggtccggaatgtgcaaggccggtttcgcgggcgatgacgcgccccgcgcggtgtttccgtccattgtgggccgcccccgtcatcaaggcgtcatggtcggcatgggacagaaggactcccacgtgggagacgaggctcttttcaagcgaggcattctgacgctgaagtacccgactgtgcacggcatcgacaccaactgggacgacatggaaacaatctggcaccacaccttctacaacgagctgcctgtccccccccaaggagcacaccagagctgctccaagaggacccgacggaaccgaatggccaccacaaaaaacgtgacccaaatctcgtatcgagacgttcaatcacgccgggccatgtac

SEQ ID NO: 49325 - DNA, 504 bp, Heterodera glycines
  SCN-specific regions: Sequence locations=1-57,79-221,243-386,408-504
cttcatcgagataattcaaaaattaatcgccaaagaaacacgagcaatgaacaggcttagaagggatcaaaaagaaaaggtccaacagtttgtgtccttaacgcaggcaaacgaacagacggcaattacatgtttgacggcctccaactgggacttggagatggcctgtgacatgttctaccaaaatccgtcatacaccaaccagcaagtgggcgccaccggtggggcggacagtcggaaaattgagcacttgttcaacaaatatgcttgcgatccaaaggacaaatctcagaaaattggacccgatcggatcggtcccaatgggatggttcgtttcttgcgcgacttgaacatcgagccaacgagtcgggcagttatggttttggcgtggaaaatgggtgctcagaaacagtgcgaattcacactgcaggagttccgcgacggaatttccacactgattcccaccggtacggtggaaataaatggtctgcgcaaagctttgct

SEQ ID NO: 49326 - DNA, 610 bp, Heterodera glycines
  SCN-specific regions: Sequence locations=1-207,261-312,336-610
attcgatagccctaattgttctttgtttgtctactgaatttctttaaaaaacttacgacaaaaaaaaatttaaaaaacgtgttttcccgaacacttggccttgacttttttttaaacgggtgtcgaaaacccgaaaaacgattccattcaaaaaaaaatttttaatgattattccaggtcgactccaaaacggtgaaagcgcaaatttgggacacggcgggccaggagcgctaccgggccatcacttccgcgtactaccggggcgccgtcggtgcactgctcgtctacgacattgccaagcatgtgacctacgagaatgtggagcggtggctgaaaggtgtttgtgtgtgccggacggaaaaaaatggggaaatttacggcggaaatttttggtttaccagaaattttctgtgtgccaaaatccgacattttgaaaaacttggacatggattttctgggtaaaaatcccattccttgtagagacctggacccaggaaaaaaaccaggggcctgttgctcgtctccgggtttagtaaacccgggttaacgattaaacccgggtttcgtaaacccgggttaaaaatttttgaaaataacgttgctcgtcttt

SEQ ID NO: 49327 - DNA, 322 bp, Heterodera glycines
  SCN-specific regions: Sequence locations=1-151,173-322
tgctgggcttgacttggaagtctatgctgatgatgtccctacgagacctgaacccagtttgtactacactgtgtgcctcaccacactccaggtcccgggtccggaggctgctgtctctgcatatggagctcttgttcccacgggctccaatgattgatctcttaatactctggatggcgatccgatcctttccaggattgacgtgactctgaatgagtccggccgcgacgcccatctaccggtcattcagaccctttatgaccacctcgatgtgactactaaaactctttaccatcaatcgttggtctttttgctaagtagt

SEQ ID NO: 49328 - DNA, 370 bp, Heterodera glycines
  SCN-specific regions: Sequence locations=1-370
ccattggaaatatgagcgtgactactcctatgacctgaggtattcaaacccgatctacaattactccaggtttaccaggttcattacgctcaccgcaacaggtcaccaacaattgtgggcacttttcccccttctgatgctttcgtcatctctcgcgacaggaattgcgtttcatcgccttgacaagatcgaaggttgggttgaccgaagcacatcacctcctccgtgagattgcgcgcgagtacgtgacacatattggttatttccgacagatctctatgacccgaccggggttactcatgttccactccgcccgatgtatatacttcacgacgacctgcttgaagctgctaaagaacgcggcacccgc

SEQ ID NO: 49329 - DNA, 570 bp, Heterodera glycines
  SCN-specific regions: Sequence locations=1-570
gagaaaatgcagagacttgctaaacgggccaatactggcggacttttaattcctttgtctggtaccgttcagacaatttcgacgaggggcgttcttcgtattccgcactgggagaatcacatccgtttcgacccccgatttggacgcaagcgaccgtgtcaagatgtattggaccgattcgcaaggctgaacaatggtttgtgggtgcgatcgcgacaaggcagaaacaaacaagtttatcagaaggactagatttttcgaaaagtcaatatgcagtgggacacgtgcaccaaaagagaatgtgcaatgcttgacaagcttatgactccgttttggcttcgtcccaagcattacgtcggtgatccaatggagccttatcacacgcgttatggaatcacttcgccacgtgtcgatgatcaaaaacgtcttgtgcgagaaaggcccaaactcctgcttgacgatttgacatctgaccgattctttgaccggatttcacccgctcagtccaaatcagagcttcttttgcaggggcagtcctccatcctgccgaaactacttcaaaaggcgatg

SEQ ID NO: 49330 - DNA, 630 bp, Heterodera glycines
  SCN-specific regions: Sequence locations=1-630
aagaagtgacgccgcggggagagaaagtgcggacgaacggacaaagcgaaggcaatgaacgcggaaaagacagtcttcggcaaatgctccccaaaatttgccaacgttgaaaaagcattcaggcgacactttgcggacggatgggagcgggagggggcgtcgttggccatttactggaagggccaattggtggtggatttgtgcgggggatacgccgacaaagcgtcgctgaagcggtggggcgattatacgcggacggttctgttctcagtgacgaaggcagtcgctgccctcgcggttcaaatgctcatcgaccgtggccacatcgcttattccgacaaaatcagcgtgttctggcccgagttcgcccgcaacggcaaggagaacatcacgctggaggacgtccttctgcaccgggctgggctcgccgctttggatgagacggtgacgatgaaagcggcacgggaccacgtccgaatggcacaaatccttgaagcgcaaacgccaaattggccactcggcacaactcggagtgggtaccatgccgtcacttttggctggctgatcgatcagatcatccgtcgggtggacccgcagaagcgcggcattagtcaatttgtgcgcgaagaa

SEQ ID NO: 49331 - DNA, 193 bp, Heterodera glycines
  SCN-specific regions: Sequence locations=1-66,88-193
gactaaagccgatatatctccgcaaaaaaaggagaagaagttgggaagccctatgagagatttaaaaagaccaaaactctgtctcaagatttgcatcggtgagtcgggtgacccgatcactcgtgctgcgaatggattaaaacgattgactggtcagagtccgggtctttcacaggctgagtacactgtgaag

SEQ ID NO: 49332 - DNA, 646 bp, Heterodera glycines
  SCN-specific regions: Sequence locations=1-570,592-646
ggaaatatggcatagaaaaatcagtgcagaatctttgtgtcgaatggatgacaaaagtcccgccgcaatttttgctcgagaatttgagcatcgtcaagcgcgcgatgtcgacgagttgcgcaggatattccacaggcacattgaagaggaaagtcgaagtgacgagcagcaaaggcacgagaaaacggcggcgccgatgctaacgacggcaccagcgatggcggcggcacttcccagtgcgcgcattgttcggacgccacacattggcacaaatgtccgcgagaatggcaccgcctcattgtccgccatcactccaatcgctgccgcctttcggtggtgcactccgctggccaacacaccaactatttctgtccatgtcaatcctggtcatttcttcgtccaattgccctcccatccgacattttcgtcgcttgcgctgctcaaccaatatatgctccccgtatacacgcacaatcagccgggcgttggggcaccaggcttggccaagccgtacgatgtcggcgtgctttgcgctgccccggcgtacaacggatgggtccgcgcccatactttgggattccaccaggaccaggaggagatgttggtccgtttcccccaatacggggggttccccccgttggcccgg

SEQ ID NO: 49333 - DNA, 319 bp, Heterodera glycines
  SCN-specific regions: Sequence locations=1-319
ccaatgcaactcgtgcaatacgacgagtgttctgttcaaggtcatcagccaactaagcctcggattgtcgaccaacaccgacgacctgacgctcaaggactgcctggatgcgcacttttcatcaccaacgctcgaggataaatgggattgtccgaagcgcagaagtaaacatccggcgacacggatcacacaaatttgggagatcccgaaggtgctgatcgtccatttgaagagattttcgttgaatgatggacactacgtcaaaaataacgtcgaagtaacgtttgatgtgggcgaaatagacctggcgccctttctc

SEQ ID NO: 49334 - DNA, 598 bp, Heterodera glycines
  SCN-specific regions: Sequence locations=49-50,109-465,487-598
catctctgtactcggagatgagccaaatgaacagcaaagtgcgcgacggagttgaggccttccgcgtcaacaccgactcggcctggactgacttgatggacgtgcaagtggtcgtgacgccgccgtcgaagccccgtgataaccccttcaactccatcttccgtgccaaacgtcaactgcccggacactgccagtgcgctggcctccaacagccaagctgtccccctggtccgcccggcccgtccggaccgcctggacagcccggacagcctggaggcgcaggacagcccggacagcctggacagcctggccaacccgctcctccttgcccgccccagaacggaaaccccggaagccaaggtcagccaggacagccaggaggccaaggaccgcccggacctcctggcgcgcccggtcagcccggccagcctggaaactctggccagcctggacagcccggagcaccgggacagcccggcaaggacagcggctactgtccgtgcccgccccgctcttccgtgttggcagtcaaaaagaagatggcggcagccaagaaagcataagcgacaagcgcagggagaagagaaccgaaagacaa

SEQ ID NO: 49335 - DNA, 641 bp, Heterodera glycines
  SCN-specific regions: Sequence locations=22-641
gcacgagggttacatttaattaatttttggttcggatggtttctatggtcgctgggagagtgcatcttttgccgcgcgccgcctcttttggcaaatcgtttctttcatcggatgcgactaaaaagcctgataagacttcctttggcaatttgaacgactctgatcggattttcactaatctttacggtcgacatgactatcgcctcaaaggcgctttggcgaggggcgattggttcaaaacaaaggatattattctgaagggtcccaaatggattctcggcgaaattagcacttccgggctgcgcgggcgaggcggggccggctttcccagcggaatgaagtggggcttcatgggtaaaccgttcgacggtcggcccaaatatttggtggtaatgcagacgagggcgagcccggcacatgcaaagatagagagataatgagacacgaccctcacaaattgatcgaaggttgtcttatcgcgggcgttgcaatgggcgcgagagccgcttacatttacatccgaggcgaattttacaacgaggcgtgcattctgcaagaatcaattcacgaggcttacaaagcgggttacattggaaaggactgtcttggcaccggctacaacttcgacattttcgtccatc

SEQ ID NO: 49336 - DNA, 654 bp, Heterodera glycines
  SCN-specific regions: Sequence locations=1-492,529-654
gtttttttgcgcacatataacattggtaggtaacactattaacaacggacaatgtctctgctgaatggaaagaatgccactggccattgtcaatctgacggcgattcatcgatcgctatgaagcggggcgccgaagaattcgacttcggtgggagcgaagccgacggggcaattggccaaggtggaaacgcaccgccggcagccaaatttcaaagggttcagcagttctcgtgctatgccgtttatagcatatcggcccagcccaaatcgaacgccattcgagggcaaattcaggattttaaacatgaattgcattacgttttgacgaccattttcgatgaaaaggctgctgaaaacttgaaaagtctcagcttggtccaactcatcaaaaaggctattattccccaattccgcaactttttacgcacaaaaagtgtccaacttgaaaaactctttggcgtcttaaccgaactgtcctcgaactcgtcggttttttctctgtcctcctcctgccttttgtatttgttggctcgcgaccaaaagagtattccgccctctgaaaattgttttcgactcatttctgaacttctccggcaagactctcagcgtgccaaaatggacgaggaacacaaaaagcacacggaaacgatttgg

SEQ ID NO: 49337 - DNA, 467 bp, Heterodera glycines
  SCN-specific regions: Sequence locations=1-427,449-467
tagaccgctaaccatcacacaacccaaaccgcttgttgagttcgccaacaaaccgatggtggtccaccaaatcgaggcattggccgccgtcggcgtggacaccgtcgttttggcagtcaccgctcgcattgaggaccttttggccggagaaatgcgaaaggaggagcaacgcattggcatcaggattgttttttctgtagaggatgagccgatgggcaccgccggtcctttggctttggccagcgatttgttgggcgatacggagccctttttttgtgcttaactcggacgtcatctgcacatttccgttcgccgaaatgatgcactatcacagaaaacatgggcgacagggcacaattgcagtcacaaaagttgacgagccgagtaaatacggcgttgtcgtcttcgaagagaccaacggacgcattgaccgttttgtggaaaagccccaggaatatgtgggcaac

SEQ ID NO: 49338 - DNA, 637 bp, Heterodera glycines
  SCN-specific regions: Sequence locations=1-150,173-637
cggaagcgccacctgatgatggccggcggatttggcggatttgtggcggcggacgcggaaggagcaggcaaaaactttgtagttcccgagaaaagcgagaagggcgcacagcagggaatgccgggacagacgagcaaaccgcgaggactgagcaaagagcagcaggaggaggccaaacgcaattacatgtccattgtgaaccgaccggtggacgtgtcgaacatgttgcccaatgacatcaaggcaaatatcaagcagttgcacgcgcgcattgtcaaattggagggtgaaaagtacgacttggagaagcgaaaagatcgccaggaatacgatctgaaagagctcagcgagcgtcagaagcagcacgcgcgcgccaaggccctggagacgggcgcggaccccaccgaagtggaatcgtccggcaatttcccgccaaaggtccgcgtggcttcaagattcgaccgtcagacggacctccgcggatatggtcagagacgcgacttgttcgaacacccggcagaaacaccggagccaaaaattgtgcacggcagcggacgaccgccaccggaatggggccgcaaagaatttgaggaattggagaacatccggaagaatttagaaccaccaaagtacgtgg

SEQ ID NO: 49339 - DNA, 367 bp, Heterodera glycines
  SCN-specific regions: Sequence locations=1-64,86-127,160-228,269-367
gtgcgacgaagaagtggatgctctcgtggggggaaatgggtccggaatgagcaaggccggattcgcgggcgatgacgcgccccgggcggagagaccgacaattgggggacgaccccgaaataagggcgtcatggtcggaatgggacagaaggactcgtacgtgggagttgaggcggagtggaagcggggtagtctgaggctgaagaaatcgaacgagcacgggagcgagacaaacagggacgacagggagaagatctggcagcacaccggcaacaacgaggggggagtcgcccccgaggagcaaccggagcagctcaaagagggccgggggaagccgaaggcgaagagagaaaagaggacccaaatg

SEQ ID NO: 49340 - DNA, 642 bp, Heterodera glycines
  SCN-specific regions: Sequence locations=1-107,129-260,289-289,318 -337,359-371,410-410,446-446,482-482,518-601,638-642
gttcgttcaaacagtgcccggtattcgttggtcagaaaaggcgagtcgtaatcttcaacgccaaccatttgctgaaataatggaagtttggcatttatttccgaaacaatgacattatggaagaacacaatttgatttgattaaacttacgctccacattggtggggcgcattgatcgatcgtcagaatgcctcggaaagccttttgtttgccggttaaactgtgccgataccacgtttctgggttattggcggaaaggacatgattgacgggcacgtggatgagagtgcaaagacagcgagtgccatctttgagcctgaactattgaaagtttgcattcagaatatcaaagtggaagaacggaccactgaagagtcatgccaattttgcgaccaatcagaccaattcgcttggaagcttcaaacgaatattgattttgggtacaatccggcggattcgaaacgccgggaatcaaatggaacgtttcgtagggggagagagacaatttgcgtgaatgtacaaaagaatcgctgctcaattcctgctcgatcagtgccctgaaaccgccgaaacaattagagagttaagcccgtagaacagaccgatccggcttataaagctggtcatgaatggggttgaact

SEQ ID NO: 49341 - DNA, 633 bp, Heterodera glycines
  SCN-specific regions: Sequence locations=1-305,328-383,405-633
gttcaattgctatttttgaagggttaacattttatcaattgcgcctttgtgaagcagttgatggcatctcttacaaatatgatcacaaactcgtacattgtgaacacgccgagtggccaatacacaattcagcaacagcccgggatgacccttcagcaccaaccgcaacagatcattcaccacgtcattccgcagcaccgacagcaaagttcaatgcacggcatccaacaacaccacagcgagaggccactcgtgcggggaaagacgtcgccctatgggtttttcgtcaaaatgtgttatgaggaacacaagaagaagtacccaaacgaatgtgttcaggtcaccgaaatctccaagaaatgctcccagaaatggaagacaatgaccgacgacgagaagaagcgtttctttgagttggcacaaaaggacgccgagcggtaccaagcggaagtggcggcgtatgggggcgaagacgttttgaagcgaaaaaaacgggccaaaaaggacccaaatgcgcccaaaagagcgctgtcggccttcttctttttctctaatgagaagcgtcaggaagtgtccggagagcatcccgaatggaaagtcgggcaaattgcgcaggaactcggcgttcgttgg

SEQ ID NO: 49342 - DNA, 565 bp, Heterodera glycines
  SCN-specific regions: Sequence locations=1-215,238-565
cggcactcaccgatcgcccgtttttgcgactattcatcaacaaacggccaaattcatcagcaaattctcagaggcaaaacggcgtttcttcaatgaacgaattgacactgagccgtggcagccgaatcgaattccctacgtttaccagagaattgtcgacaaattccgactaagcggtgcattgagtgacgtggaggaaaatgtggaggatgagcacgaggacgatgatgacgagagagaagggaaccgcgactatttggtccttggcggcagcaaacgcttcatcgttgtcggctctgcgacttcgcttctccgcgtgttggcccagtacagcgacttgctttttctgttcccccaatgttccatggaactgactatggacattgtccaaattttgaaggcgtttaacagtcgcacttgccaattgattttgggcgcgggtgcgcgtcaattggtcggactgaaaatgatcagtgtgaagcatttggcattggcattgcgttcgctgcaattcatcgcccaattcatcccagcacttcgccaaacatttctgaatcaattgcca

SEQ ID NO: 49343 - DNA, 637 bp, Heterodera glycines
  SCN-specific regions: Sequence locations=1-62,143-378,400-457,479 -524,546-607,629-637
atttcaaatttaaatatatttattgagcaaaccacaggcacattagtgctcttatgtggcgcataaaaaaaaatcaaaataaataatgtcaaaaaatacaacaatatgaaatgtaaagtaaaataaaataaaatggaatgaatgtcaatgcaaatgtcaataaatcccttagaactcatacatagcttttagcaatgccctgaattgatttgccttatctgcctgaattggaacaattggtaatttgtttcaattcttggctatacggttaaaaaaattattcttactttttgtggttgtgcgccgcattctcaaaagtaatggcctacgagtgggtcgatcagaaaaagtaaaaagtttactagcatcaagactcgtaaaacccttcataattttaaaagcggtagttaagtcagcaatatttcttcgcttggttaattctataagctgacaaatttcaagtctttctgaatatgatctatgtaaaagtccgcattttttaaaggcttttctcgtgaaaaatttctggactttttctattctttctatatctttttttaagttagggttccaaatttcaacagcatattctaattgaggtctgacataagtcttatacattcttataatagttttt

SEQ ID NO: 49344 - DNA, 660 bp, Heterodera glycines
  SCN-specific regions: Sequence locations=1-105,147-216,238-259
cttcttctcatcgccttcgccttcaaaacttagaagcaccaatcccaaccagaaaaaatgtgcgacgaagaagttgctgctctcgtggtggacaatgggtccggaatgtgcaaggccggtttcgcgggcgatgacgcgccccgcgcggtgtttccgtccattgtgggccgcccccgtcatcagggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgcgtgtcgcccccgaggagcacccggtgctgctcacagaggccccgctgaacccgaaggccaacagagaaaagatgacccaaatcatgttcgagacgttcaacacgccggccatgtacgtggccatccaggccgtgctgtccctgtacgcctccggcgatggtgtcacccacaccgtgcccatctacgagggttacgccctgccccacgccatcctccgtttggacttggccggccgtgacctcactgactacctgatgaagatcctcactgagcgtggttactccttcgtgaccaccgccgagcgtgagatcgtccgt

SEQ ID NO: 49345 - DNA, 582 bp, Heterodera glycines
  SCN-specific regions: Sequence locations=1-200,226-227,286-296,439 -487,533-582
gtgcgacgaaaaagttgctgctctcgaggtggacaatgggtccggaatgtgcaaggccggtttctcgggcgatgacacgccccgcgcggtgtttccgtccattgtgggccgcccccgtcatcacggcgtcatggtcggcatgggacagaacgactcgtacgtgggagacgaggcgcactccaagtatgttattctgacgctgaagtacccgattgagcacggcatcttcaccgactgggacgacatggagaagatctggcaccacaccttctacaacgagctgcatgtcgccccccaggagcacccggtgctgctcacagaggcccccctgaacccgaaggccaacagagaaaagatgaccctgatcatgttcgagacgttcaacacgccggccatgtacatggccatccaagccgtgctgtccctgtacacctccggccataccaccagactcatgttggactccggcgatggagtcacccacaccgtgaccatctacgaaggttacgccctgacccacgccatcctccgtttggacttgaacagccgtgacctcactgaatacctgatgaagattctcac

SEQ ID NO: 49346 - DNA, 331 bp, Heterodera glycines
  SCN-specific regions: Sequence locations=1-105,127-247,269-331
gacggacgatgcacgcctgaaatttttggtgtgcgaatcgaacatcggcaccaaaaatatggactaccaaatggagcattatgtgtggaagcatctatcagacggcattcacatcatccacattcacaaaaccagttataaactgatgctcgccgcccgtgccatcgctgccattgaaaatccgtccgatgtttttgttgtctctactcatcccaactcccaacgcgatgtgctccagttcgccgctcacatctctgccactccaatcgttggccgttttacgcccggctctttaaccgaccacatctaaaacaatttcaaagaaccacga

SEQ ID NO: 49347 - DNA, 650 bp, Heterodera glycines
  SCN-specific regions: Sequence locations=1-96,118-580,603-650
ttgagatgttttttggcgaagagattactaaaattccgcgggaagtcggcaaagaggacgtgtgtaaagcaatttctcatcaaattgaggccattgacatagatcagtgcaatttgaatatgtatttgaagcctgacacgggagtgatttcacttgaccaattccaagcgatgggttccaaaagattgacaatgctaaggaaactcgaaatgcttaaagaaaaatttggaaatgccaattcgcaggatgagtacaaaaaggcatttcgagaggacatcggtgctctgatgccattggtaaccaatttatgcgtaaatgccggactcaatgaagcaagaagagaggaccgcatttcgcattttatacttcgtcttgctttttgccatattccagaacaatccgattggtttgttcggttggaaaccgaactttttcgcatgcgctttcaaaacgagacgaaaaaaaatatggcactttttgtggcatcgatcggcatacaattgaaccaagttgacacttctgagagagagcagttagttgacgaactttgccaagcgctgtcactgagtgctgaagagatggaaggggcagatttgtacaaagttgatttcgttgatgttttggaattgctttcctcacatcgaattctg

SEQ ID NO: 49348 - DNA, 616 bp, Heterodera glycines
  SCN-specific regions: Sequence locations=1-616
gctgtccattatgatgagtgcgaaattttttacgcatttgattaattcggtatcgggacgacccatctccacttcatgctgcagaaaataattgcgtgaattgtggaaattggacaaacggaacccttttcaagaaattcccgaagcatgggtcacttccctggacgatattgagacgaaaaattgtggactcattcaactccatccagacattttccgcgtcaaaccgggcttggatttgcttcatcgaaacatcacatggcaatccaattaccggaatttgacgctcctcaaaatgttgtcccacgacgaaatgccgggcggtgggcggaagccgtggtctcagaaaaagatgggccgtcaccatgcaggaagcattccctcaccgcatttcattcgcggcgggtttgcgcacggcgttcgcggcccgtgcacccaattttacatgctgcccaacactgtccgaattcacgggctccgcaccgcgttgaccctcatacatgcgcaggacgacttggtcattgtggacagctacgacacgctgaacagcgcggaaccacaatttttgaacgatttggccgacgcacgcaattgggggctattccgtgctggttgc

SEQ ID NO: 49349 - DNA, 337 bp, Heterodera glycines
  SCN-specific regions: Sequence locations=1-41,82-96,163-227,249 -260,299-337
gccctccttcatcagtatggagtcggtcggcatccacgaatccacctacaactctatcatgaagtgcgacatcgacatccggaacgacctgtacgacaacaatgtgctgtccggcggcaccaccatgtacccaggcattgctgaccgcatgcaaaatgagatgaccgcgctgggcccgtccaccatggagaacccaatcatcgctccctcggagcgcaagtactacctctggatcagaggctccatactcacctccctgtgaaccttccaacagatgtggatcagcaagcaagagtactactagtccggaccgtccattgcccaccgctagtgcttc

SEQ ID NO: 49350 - DNA, 629 bp, Heterodera glycines
  SCN-specific regions: Sequence locations=1-65,90-507,542-557,596-629
gttcattcgttcatttgtccgtcattttctttccatccattcaaagagtcattctcccatcacccaaataaataattaattaattaattgactgctcgttgattctcttaattgaccacaatgtttctgctaattgctctactgctcgtcgtttttcctctcttttgcggtgccatccccgcgctgcccaactcagccgcggcactaactcaacagcagcagcgcatgatgcaaattgatgctttttctgcggcggatgacgcacagcgaaaggacagcgacgccgcgggcggtgcggcgcccttcgctttcgaaccctccgagcaaaaggcattcgtactgaaagggttgcgtcgcgtgaagaatccgtcgccgccggcggtcgttccgaaactgacggcagatgccaaaatcatttcattgaacgcggacgacgacgagtggcgagaaatgggacaacaacagaaacaacagcacttccaacagatcggcgcccaaatgcagaacgaagtggacttctgcaaaatgcgctccggcaacatgtggcgcgaggtcaaccgcacccaggcctactccaaggtgtcgcacgacagccgtcacaagcgtcaggcaggcggttgctgtggctg

SEQ ID NO: 49351 - DNA, 579 bp, Heterodera glycines
  SCN-specific regions: Sequence locations=1-197,219-579
tactttcttctttcgtccattgactaagccatctttggtcgaagcaataaaaaggcaggcgactcttttgatggataaaggcgcagtgattacgaaattggaaagcctcggctaccgcgacttgccctattcgcgattggacagattcgcgaagaaaaacgtccattatgcaaactccattctgatgaattcgtcgatgtcagtgaaaacaatgaatgatgcgagaacattgttttcgaatgacaaagaattgctttggtttggcatcgtcaacacaaatagtttgcctgatacgcccgacaaatgcgacttggagcagtttctgcaaccgcccgcttatcggcagtcagtggaggaattgcgcaagaatcagaaattgccattctttacgagtttcaaaatttacaagaggacagaaactgaataccacaatatacccaagtcgtacttcgtggcaccacacaaacgttgaacggacgacggaacgcggaaaacgactcgtttttggagaatcgctttgtgttgttcgatttgtttttgatcatttcaagatgactgtattttatttaaaaatattct

SEQ ID NO: 49352 - DNA, 217 bp, Heterodera glycines
  SCN-specific regions: Sequence locations=1-217
gggacgtcggccctctcgtggctatcgctacattatgaacaagccttatcccaagtgctcgcattttgtcccggggtccctgaccccaaaattcgcatgtttgactcggggaagaaacacgacaactgttgacgaggctccatgctgtgtgcacatgatatcgaatgaaagggaacatttgacgactgaggctctcgaagctgatcgcaatttatgc

SEQ ID NO: 49353 - DNA, 556 bp, Heterodera glycines
  SCN-specific regions: Sequence locations=1-68,90-556
atttgatagtgcagtcggagggcgccagccataattacgacaccacttttgtacaaaagttattcagcgaagagggcaagggagagttcagcactcggatcaacattcttggccaccctcaacagggaggcaagccaactccattcgaccgcaacatgggcacaaagttaggcgcccgtgcgttgaaccatcttatcacacagatcaacgctaacttcgacaaaactacggaaagatgcaacgcggacaaacccgatactgccactttgctcggtctgatcggtcgtgaagtcgtcttctctccgctggaagagctcgccgctgagaccgattttgagcatcgtttgcccctcaaacaatggtggctgaaattccgtcctctcctgcgcattttggcaaagcatcgcgcttcttacgtccaagaagcaacttaaaagccagcggagagaatgagaaggaagcgaattagctgagatttgctgagcttttggacattaattaggaattatccggtaacgaatgaaagtgcttgtgcatttatcaggaaattaatctc

SEQ ID NO: 49354 - DNA, 634 bp, Heterodera glycines
  SCN-specific regions: Sequence locations=1-43,94-171,193-216,238 -274,297-634
gacactttcactcccttaccaatttgattgtttttgaaaaatcttcatccatccacccattcgtcgcattcttcatccaattcattcattcatcgtgaaaaacaaaatgaccaccggttcaccgcaacagtcgccacaagcgcagcaaacggaggccacggcacagcagcagacggcggcggcggctgccaacgccggcagcgcgggcggaacgccaaagagtcagacgaagaaagcggcgaccaaagcgcccaaggcacccaaagcgaaggcgccaaaggcggccaagaaagcgcacgcaccggccaaccatccgccctacattcatatgatcaagaaggcgcttggcgagttgaaggagaagaagggggccagcaaaggtgccattctgaagtacatcatgtccaactttgacgtcggcggcaaccaacttcgcgccaatatgcagctgaagcaggcactgaagcggggcgtttcgtccggcgacctgaaacaggtcagaggcatcggcgcgtccggctccttcaaattgggcgacggcacgcagccaacgttggccaaggcgtcgccagcgaagaagaaaagtccgatcaaaaaggcgaagaaagcggcgcctccagcgcccgcggcggtg

SEQ ID NO: 49355 - DNA, 217 bp, Heterodera glycines
  SCN-specific regions: Sequence locations=1-64,88-217
gtgcgacgaataagttgctgcactcggggtggacaatgggaccggaatgcgcaatgacggttgcgcgggcgatgacgcgccccgcgcggaggttccgtccattgggggccgcccccgacatcacggcgtcatgggcggcatgggacagaaggactcgcacgcgggatactatgcggagcccaagggtgacattctgacgctgcaatagccgattgat

SEQ ID NO: 49356 - DNA, 352 bp, Heterodera glycines
  SCN-specific regions: Sequence locations=1-46,71-352
gagcgacgaataagttgctgctctcgtgggggacaatgggtccggaatgtgcaagggcggcttcacgggctatgaagccccccaagtggggtatccgcccgttgagggccacccccgtcatgagggcgccatgggacgcatgggacagaaggtctttttcttgggacactatgatcaaacccaggggggaagtcagacactgaaatgccctatagaacaccgtttccatgcctgctgggactacgtggagaagaactggcactgcacctgctacgacgagctgcgtgtatgcccccatgaatacccgagagtggctgaaagaggacccgcggaaccggaagggcgacagaga

SEQ ID NO: 49357 - DNA, 635 bp, Heterodera glycines
  SCN-specific regions: Sequence locations=1-635
attatactcatcagaaactctgaatgactcataaaagccgattttggtgtgtgtattttagcgtttgtgcagaatttttataattttgtttcacctttggtttgccctaattttctgctcaagcgatgagaatcaagaaaaagtttgcgagtggcactgcccgggtattcgtctcgcggaagaaggcgctgaagaagttgcagttgaatttgagggatttccgtcggctgtgcattttgaagggcatttacccgcgcgagccgagcagtgcgaagagggcgaacaaagggggcagcagcgagcacaaaatcttctaccacctcaaggacatcaactttttggcccaggaaccgttactcgaaaagttcagggagtacaaagcctttctgaagaaagtcacccgggcacgagccaagcgtgagcatttgaagttggagggactgctccgtgccaagcccaccttcagctatgaccatttggtgcgcgaaaggtatccgacttttgcgtccgctttgcgcgacttggacgacgcgctgtgcctttgttttgccttctccgcactgacacagtcaaaaattgcgcggccgcgaacaattggccaatgccggcgggcggtcaccgaattcatgcatttt

SEQ ID NO: 49358 - DNA, 625 bp, Heterodera glycines
  SCN-specific regions: Sequence locations=1-169,192-625
gatgcacatttggccagtcagaaacccccgcccgaccgccgaaaaattaacggccaatttccctctcctctgtgggcaacgagtgttggacgcactcttcccaagggtccagggcggcacaacggcaattcctggtgcctttggctgcggcaaaactgtcatttcgcagacggtgtccaaatattccaactccgatgccattatatactggggctgaggcaaacgtggcaacaaaatgtccgaaatgttgcgcgactttcccgaactgacgatggaaatggatggagtgaccacatccatcatggagaggacggcgctggtggacaacacttctaatatgcccgtggcagcacgtgaagcatccatatacacggcaattactctggacgaatacttccgcaacatggatctgaacgtggccatgatggccgactcgacctcccgatgggacgaggcgcttcttgagaattcggagcgtgtcagtgaaatgccagatgactcgaaggtaccccgcctatttggccgaacagctcgcttactactacaaaagggcgctaaaaatgagatgatgtgtgtcacctgaacggaaagggtccgacataatgtcagcgcagtgacaccccct

SEQ ID NO: 49359 - DNA, 415 bp, Heterodera glycines
  misc_feature (401)..(401): n is a, c, g, or t
  SCN-specific regions: Sequence locations=1-75,98-173,227-415
tgatcagccgaagatgccggaaagcgaaaacgacttcgatgaggaggcgccctacgccaccatggagaccttagtggcgggcggcggcgcggcgcccaaccgcgtcaggcgctggacgttggcacagctgcgccagacggacggcatcatcccgtcccatgtcgggtggaaccagggagactcgcagaagttgatgaccaactttggtacgccgcgtaacaccaccgcctgagtcaatgtggagaatcgggccgagattccggaggacattttgctgataagccacggggaggtgcgtctgctgtccggtaccaaccggctcgcctcccataagggctgtgtttctatcggtaccgtacgtgatgtgcgacgctgaggagtgaatgtgaactttgtgccgngcgacttgaagccg

SEQ ID NO: 49360 - DNA, 640 bp, Heterodera glycines
  SCN-specific regions: Sequence locations=1-596,618-640
gccagatgtggcaaagagaatttttgatttgggattaaaaagccacggcagtgacccggactatgctttggcttacgtggagtttttgtcgcatttaaatgaggacaacaacactcgcgttgtgttcgaacgcttgctaaattcggagaatgcactgcccccggaaaaatctttagaaatttgggacaaatatttggaatttgaatcgcaggttggcgacttgacaagtgttttgaaggtggaccagcgaatgaaaactgcttgtctcgagggggaggaccgacaagccctttggctgatcgatcgctataaatttctaaatttggctccgtgtaccactgatcagctgaagttgatgggttattcaccacagaaatttgccagaccgtcggcttctgtcccttttcaaaatggggctttcccagtttcttcggcctctgttcagccaaacgtgcttcaaagtggacgttcccagcagttcctcacatctgcagctgcattgaacattgagctcggggggtacgctcgggccgacacttcgcaaatgcttccattcaaaccgaagcttcccccggcttcctatcacccggtgccccgggggtgtttttcctcccaccgccttttgtctccccattgcttc

SEQ ID NO: 49361 - DNA, 649 bp, Heterodera glycines
  SCN-specific regions: Sequence locations=22-649
acgtgctttggacaccctgaactttgacctgaccctgaacaagccaattcgcattatgtggccgcaacgtgacccaagcattcctggctcgggcgtggggaacctcttcatcaacaacttggacaaggaaatccacacgacagccatctacgacacttttaccatggtaggaagcattctgagctgcaagagtgccactgacatggagggaggaagcaaaggggatgggatcatccgttaagatactgaggaaacggcgaacagagcaattgctaaagtgaacgggatgcttatggatgggaaaaaactgatagatggaaaatatgtgccacgaactgctcgagagaagcaacatggtgacccgacaagtcactacaacaaagcgtatgagaaaaattttgacgaggcaatggagtctaacaagctgatcgaactgtactcacaacatggcgaaatcatcagtgctaaagtgatgaaggatgacagcggaaaatccaaggggctcagctgtgtcgcctaacaggaccatgaaagtgctgcgacggcggaggagaagatgaacgaaggttcagagcccggaagagagaaaggctagccaaagttacggtgtgccgagcgcaaaaaaaaacaagcccaggctcagctgaag

SEQ ID NO: 49362 - DNA, 499 bp, Heterodera glycines
  misc_feature (252)..(256): n is a, c, g, or t
  misc_feature (258)..(259): n is a, c, g, or t
  misc_feature (263)..(263): n is a, c, g, or t
  misc_feature (266)..(266): n is a, c, g, or t
  misc_feature (268)..(269): n is a, c, g, or t
  misc_feature (279)..(279): n is a, c, g, or t
  misc_feature (287)..(287): n is a, c, g, or t
  misc_feature (295)..(297): n is a, c, g, or t
  misc_feature (299)..(299): n is a, c, g, or t
  misc_feature (302)..(302): n is a, c, g, or t
  misc_feature (305)..(305): n is a, c, g, or t
  SCN-specific regions: Sequence locations=1-181,203-499
ccccatctcaccttcctttgtaaatattccctccctttgaccacaatgaatgtgtgcaatttatggttccggcgccattgtaaaaggccatcataataatgcgacgggacaaaaggggcggcgaaacgcgtgccgaaggggcgggggggggcgatggtcccgcggcacacctcgggattaccccacgcttcttacctttacccccaaaatgtggtgggccttttgcgggcgaagggactccctggggggttnnnnntnntttnttnannactacctctnctttttanaaaatttnnncnccntcntaatacacattttccaagtcatgtctggcaccatcttccacaacattttgttaacgtactctgtggaggacgctaagaaacacgcggcggactctttcgaccagctgaaggaggcggagaagaagcaaaaggaagcgtatgccaaggaggagcgcaataagttctaggaggaagacaaaaccggaaggaagaag

SEQ ID NO: 49363 - DNA, 553 bp, Heterodera glycines
  SCN-specific regions: Sequence locations=1-46,88-200,286-292,388 -388,416-447,486-505,533-553
gtgcgacgaagaagttgctgctctcgtggtggacaatgggtccggaatgtgcaaggccggtttcgcgggcgatgacgcgccccgcgcggagtttccgtccattgtgggccgcccccgtcatcatggcgtcatggtcggcatgggacaaaaagactcgcacgtgagatatgaggcgcactgccagagtggtattctgacgctgaagtacccgattgagcacggcatcctcaccaactgggactacatggagaatatctggcaccacaccttctacgacgagctgcgtgtcgcccccgaagagcacccggtgctgctcacagaggccccgctgaacccgaaagccaacagagaaaagatgacccaaatcatgttctagacgttcaacacgccggacatgtacgtggccatccatggcgtgctgtccctgtactcctccggacgtaccaccggtctcgtgttggactccggtgatggagtcacccacaccgtggccatctacgatggatacgccctgccccacaccatcctccgtgtggacttgagcggtcgagac

SEQ ID NO: 49364 - DNA, 334 bp, Heterodera glycines
  SCN-specific regions: Sequence locations=1-334
tgatcaggcgatcatgtcggatagtcaagacgacttcaatgacgaggcgccccacgcctccatggagaccaaagtggggggaggtgtgtcggatccaagccggggaccccgctggacgtcgttcccgctgtttccgacggactggatcttcccggttaaagccgggtggagctacggagactcattgaagtttatgaccgactttgtcacggcgcgatccaccaccacctgatgcgaagtggctaatctggccgagatcaccgaggacaatttgctgcgaaccgcttggcatgtgcgcctgcagtccgggagcgacaggattgccaggggactg

SEQ ID NO: 49365 - DNA, 238 bp, Heterodera glycines
  SCN-specific regions: Sequence locations=1-238
gaacagttacgaggtgcgcaaattgggggacaaagtgcaggggtacgtgatgaacttcacggaaacggagcaaaaggtgcgggaggcgacgaacgaggacccgtggggaccgttgtgtttgcaaatgcaggaaatcgccagcttcacattccattacgaactttacacagaagttatgggaatgctatggaagcgaatgtttcaggagaataaattggcatggcgacgcgtctacaaa

SEQ ID NO: 49366 - DNA, 328 bp, Heterodera glycines
  SCN-specific regions: Sequence locations=1-328
cacagcaatgaattattatgccggaagtcgccttgtgggcgtgtgggcgccgttgctcgtcgcttctgtgctatgtatcgcaattggaacaaccatctccatgatttacgggattcggcatgagcagccgcaaatgttgtggccacaaatttactttctgaaggtggagatctgcttactaatggcgggcgcagtcttctcaatttcgtgcatgtgcatgggaattgaagcgaccaatttgatcttttcgcattttatcagtgtgccgcagatggagctcaactttggccccatttggcccttcaaattggccattgcttgccttttc

SEQ ID NO: 49367 - DNA, 250 bp, Heterodera glycines
  SCN-specific regions: Sequence locations=1-250
aaaggagttgcgtgaattgaggaaattggaccaacggaacccttttcgagaaattcccgaggcatgggtcacttctctggatgatgttgagcacaaaaattgtggactcattcaactccatccggacattttccgtgtcacaccgcgcctggagttgtttcttttcaacagcacatggcaatcccagtaccggaatttgaggctcctcaaaatgttgttccgcgccgaaatgccgggcggtgggcgaaag

SEQ ID NO: 49368 - DNA, 619 bp, Heterodera glycines
  SCN-specific regions: Sequence locations=1-130,155-619
ttaattaagtgctaatgagacggattaattgattggcagtgagctctgctgaaattgggttttcattttgacttccgtcgttcgacatcgtggggaattgtccatccacgagaagtatcggtacgatctcagccgtgcccagctgaaggcttcttcgcggacttccgctctgcttgccggcttcgccatgatcgctctcgtcgagctgcagtaccaagagtcgacccccaagccgttgctgatcatgctcggcgtggtcacttctctgctcgtctccgtccacctgctcgctctgatgatgtccacctgtctgttgccgtacatcgaggcaaacggatgcactcaagactcccctcacataaaactgcgcttttacatcgaactttcctggctgttttccacgtgcattggccttcttctctttctgttggaaatcggtgtcatttttttcgtcaaattcaattcaattggctacacttttgccgcttacattacgacgggaatgttggttcccgtggtcattgtgttcatcatcatttcttatttgattcatcgcaatcgattcacacattccctcgatcgagtgaacgaaaaagtggccgacttgcagaagtacctt

SEQ ID NO: 49369 - DNA, 657 bp, Heterodera glycines
  SCN-specific regions: Sequence locations=1-144,166-557,579-657
ctcggggagcaaaagtcgaaatggcacgacgagggggaaaagattgaggctggttccattgtttacgagtgccgtggggcgaaaatggtgccaatcggatgtttggacgaatttggccaacaaattcgacttaatgagacgaccgtggcgaagggccttctgatgcgatgctcactttcgcgttgggcgaccgatttgcaattgaaaatcattggctgtgtgccgaagggaaaagcgaacgaaaccattttggtaggagaaatggacagagaaagagagtcagacgtggtgggaatgcgcggcggagggaacgaccgtcagagcacggcttggcggatgtgtggacgagccgagtcggagccgacttcgcatcggcgaaagcgtcgaccgaggacacaccactttcgaatgccaatccaagggggccgatgcggctgaaatggtcgcggttggctgtgtgacgaacggcggagagcatcgacgaattggccaccaatggcaggacggcgattttctcttttactgcaaaaggaaagccgcgggactttgcgagaagagctgtttgggctgtttgctgcagggccgccgtttgtacgacggcgaccgtttcgccacgggcgcaccgttttcaatgcgaaatcggccaaagcggcacgc

SEQ ID NO: 49370 - DNA, 545 bp, Heterodera glycines
  SCN-specific regions: Sequence locations=1-545
gacgccagtgacaaactgagcaagttgatgttccgcatcggctgcttctctttggtttacgttcttccgatggccgtcggcattttctgcgcgttttatcagactgaaaacattggccattggctgaccaattggtattccacgcgctgtctgcacgttctgcggagtgcctttggctttacccatccgcgcgcccaatgccccgtcggcgacggcgtgcagctgagcagacagcctgaccccgtgctgttcttcctcaagtacttgtcccacttttccattggcatcgcatgcgtggtgtggacactgaacggcaaaacagtggccagctacggcgactttttggcgcgacttttctcttcgcgcggtcaccgccggggaaggccaattcgggtgccaactcggccacactgacggaagcgaaaacggacggcaaacagtgccctcttttgtgcagtcaaatcggtcgcccattggccgctttcctccaatttttgacgttgacaaatcccagcaatcgctccgttctttttgccgttttgcaa

SEQ ID NO: 49371 - DNA, 598 bp, Heterodera glycines
  SCN-specific regions: Sequence locations=1-598
aggtcctaccaccaacccagtgggtattccattcatggtggacaatgacaggaaaatttaacgcagtctacgacatttattcgaggctgctcaaagatcgcatcttttgcatcatgcaaccccattgatggactttgttgctgtctcagcgatcacacatctgctaaatctgcaaaacgaaagtggcaaatcttctatttacatgtacatcaactgtacatctggcaatgtgactactggtctcagcatttaccacacattgcgtcaaatgtcggtccctgtcgcaacttgatgcattgatcagacaagttcaatgcccactcttttgttgacaaaaccgtgccaaaggaatgagcgcttacttgctcaatgctcgcattatggtccatcattggagcggaggtgcttacagcactaaagcggaattgtgatcggagcccacgatatcaacctagatggaaaacggctcaaagagatctatgcaatgcacgcaggacagacagaggagactattctaccagccttggacatggatcgtttcctcagcgcactgcaagcccaacaagttcggttgttcgaccggtacgggacgcgttcg

SEQ ID NO: 49372 - DNA, 528 bp, Heterodera glycines
  SCN-specific regions: Sequence locations=1-88,110-487,509-528
gaagaaagcaaaccatgcccaacaagtaaaaaaaattgttgtccataaaattggcagacagaaaaacggatgccagaggaaagtgctcaagaaaaaggagcccaagcttttgctactagtgcccagtgttcaaatcaagaacaaaaacaagccgaaaaaagttcagttgcccgaatcgatttcccccggaaccgttctgatcatattggctggccgtcaccgtgggaagctcgttatctttataaagcaattgccaaaatcgggtcttcttcttgacacaggcccactgaagttgaacgcgacaccgttgcgtcgcatcgcacaagctttagtcctaccgaccaaaacgaaactggacatttcgaccattaatgtgccggaacatttggacgacacatattttaaaggacaaagtggcaaagtggcggacacatcgaacggtgagatttttgctgagggagcaaatcagcagtacgctgtgaccgaccagcgcaagggagaccagaaaactgttgacatccaagttat

SEQ ID NO: 49373 - DNA, 565 bp, Heterodera glycines
  SCN-specific regions: Sequence locations=1-46,68-101,123-410,432 -513,536-565
ggacgccgccatgcagtccaaacaaatgggcaatcgggtgaacaaattcttctccatggacgggcggatcatcttctatgtgcttcaactggtccttcgcgagtacaaattgcacagttacactcttagcaatgactgctattttttcctgggcgagcacaaggaggacgtttcctacactttcatccccctacttcagaatggctccaacatggacagacggaggctgactttggattgcatgaaggacgcctttttgccgctgcgtctgctggacatacttatgctggtgatcaattacattgagatggcccgtgtcaccggctgtgcgctgaatttcctcttctcccgtggacaacaatgcaaaattttgtacatgctgatgagaaacactctatagcactttttggtccttcccgactccaaaatgggcgatggctccgactgcgacgacgtccgctacgacggagcgactgtcattgacccattgcgcgtcttctactaaagaccctgcgccacgctggacttcacctctttgtacccggacattatgatcgcccacaac

SEQ ID NO: 49374 - DNA, 536 bp, Heterodera glycines
  SCN-specific regions: Sequence locations=1-221,247-536
attacccctacaaacaggagatttcattggcggttacgctggccatggcaatttgtctgatcagttttgtgtaccacagcacttgggtcacttctgaggcgtacagcagtccttccattgtcctttccgcgcgttcgggcgatggcggacgcataattttcgacgatttccgcgaggcttattactggttacgaaaaaacacgcccgatgatgcgaaagtgatgtcctggtgggattatggctaccgaatttcgggaatggccaaccgaacgacaatcgtggacaacaatacgtggaacaacacacacctttcgcgtgtaggacaagcgatggcatcgaatgaatcgcatgcatacgaaataatgcacgaattggacgtcgactatgtgctggtcctttttggagggataacccgctattcatctgacgacattcaacaattcctgtggatggtccgaatcggcggttccacaccggaggggggaccattttcgaaatgattctaccccaagaatggagagtatcccattgacagg

SEQ ID NO: 49375 - DNA, 599 bp, Heterodera glycines
  SCN-specific regions: Sequence locations=1-337,360-599
gtccaattaagattttgtccagcattgataatggttaatctaaagctttttgtcgactcttacgaagttgagtatccgacgttagtccgcgagattttagctgacgcgcaaaaaaaggcggtgatttcggctaccgtcaccccatttggcaaatgtgcgctgatttgtggaaattccatttacgtttggtcttacagttcaaaggagtcggcaattccgcacgccacgcgaatgaatttgcccgcgagcggactcaaatattcaacgcaactcatcagcatcttttcgagaggccagtcccacaagtcgggcgtgtgtttgttggctgtttccccggaagggaatgtccgcttttggagcgaacttgggaagccgtacagggacgagagctgtttgctgaacaacgaagtggcgcactccgtgcagttgatttccatcaatggcactcccttctgttcatttttccaccgcaccatcgatgcccacaaagactacaaaaaggtgcgcattagcggtgaggtggaattgaccgggatggaagtgagtctgtgctgggaaagtgttggaggagtgtccaattgctgcaaatatccggaggg

SEQ ID NO: 49376 - DNA, 628 bp, Heterodera glycines
  SCN-specific regions: Sequence locations=1-51,74-628
ccgcaacttcaattgttcgtcctcgcggcatttttcgctcgcttctgttttatttcagcagcaaaaattctctgctgttgcatcatcgcccaataaaaatttgaatgctgtgcttatcgatgctgtacgtactccctttctccaatcgaatacaactttccgtgagctgttggctgttgatcttcaaagacacgctcttaaagcattggttgagcgaacaaaaataccttttgatgaaatcggacacattatctgtggacaagtcgttcaggaatgcaaaacgagcaatatcgcccgtgaggctgcgatcaccgccggtttccctgattcgatcccttgcaatacggtcactctcgcgtgtatttcttccggcgtttcaattcaaaatattagcctaatgatttccactggctatttaaaggcgggcatcgctggaggagtcgagttactctctgactttccaattcgttacaacagaaaggttcgactttctctcatcgatttgcagaaggccaaaagttttggagagagatttaagcacctgaaaacagtcgcctccaattggttctctcccgagttgccggccgtaagcgaattcacaaccggcgaagtgatgggcaattccggg

SEQ ID NO: 49377 - DNA, 571 bp, Heterodera glycines
  SCN-specific regions: Sequence locations=1-13,35-64,101-185,208 -225,248-571
cactttgccatcgctgtactcggagatgagccaactgaacaacaaagtgcgcgacggcgttcaagccttccgcgtcaacaccgactcggcctggactgacctgatggatgtgcaagtcgtcgtgtcaccggcttcaaaggaccgtggcaaccccttcagctccatcttccgggccaagcgtcaattgcctgggcactgctattgcggtcccccacaacggccaaactgccctcctggcccacctgggccggccggaccgcctggccaacccggacagccgggaggcgcaggactgcaaggacagtcggtagcacctggacaacctgctcctccgtgctcgccccagaacatcccggtcccacgctgcccggctggcccacccggtagccccggaggacaaggaccgcccggacagcaagtagccaccggtcagcctggtgcgcccgctccaggcggaggacatggaccgcctgccgcgtccggaccctaagttgcgcctgggtagactggacgcaccgtaacacccgtttcacccgtacagcctggaaataagcctgttatttgcaaacca

SEQ ID NO: 49378 - DNA, 626 bp, Heterodera glycines
  SCN-specific regions: Sequence locations=1-33,58-626
tactttaaataattaccgcttgtttgaagtgaacccaaaaataaaaacaaatggcaagaaccaagcaaattgcgaagaagagaatgagtgaaaagaaagcgactgaacaggatgctttggtttctaagcaaaatttgcccacccaagcagtcaaaaaagcgggatctgacatgggccatcgtgctaagcgacaattggcaacgaaaagtgccccgaatcgccgcccacggtaccaagcatcgcatttgctaccaccacccgaagaaccattacaacaaaaacgctttaaaaagcgtggagcgctcgctctccaggagatccgcaaattccaagaaagcgtcaatctgcttataccgcgcagcacgttctttcgtgttgtccgcgaggtgaccatgaagttcgccgatggaatgcgctggcagggcaaggccctattggcactgcagaccatgaccgagtgccatctcgttaatatgttcgaggatgtcaatatgtgcgccctgcatgccgggcgagtcacgataatgccaaaagacatcgccttggttcgaaaaatacgcggcgaaaccacactcgctccgtcgtccggtttgcgccagactaaccgtcgtcgttgaactgctctg

SEQ ID NO: 49379 - DNA, 484 bp, Heterodera glycines
  SCN-specific regions: Sequence locations=1-20,43-456,478-484
cgatcggaacgtcgcacatcgggacattaagctggagaacattctgtgcagctccaacgcagaggaaaagtgcaccttcaaattggccgactttggcttcgccaaacgcacggaaaagggccgactgatggagtcgccgtgctgcaccccggcgtatgtgtgccccgagattctgaaccgcaaccattacgactagggatgcgacatttgggctttgggagtggccaattacattcttttgtgcggatacccacccatttattccatgcagggacttccattctctccggggatgcgcaaacggatcatggagggaatgttcgccttcccctaggacgaatgggggacgatttatcactcatctagaaatatcatcgctgctatgcttaagacggaccccacggagtgaattaccattgaacgactgatggcttcatctttggcacgtactccagcccatctttctaatgcttttccgcttccc

SEQ ID NO: 49380 - DNA, 642 bp, Heterodera glycines
  SCN-specific regions: Sequence locations=1-642
ccaagtttgagcttcagcaaaatgacctcgcaaggagttgaaaattatttaaaggaccaaacgatctctgacattccgacgatcgcggaaggctttcaaaacttgatgaatctttacatcaacaagctttggaaccaactctccgccgaggccagtcagctcgtacgtaacaaattgtttgtgtcgacagcgaatcttttccaattttacgaggaatttgtcagagacttcgagcggcgcattgagccattgcaattaattgagctgattacgccaattgccgaggacatttttgaaagggacagacaatcggcctacacttttctggacaacttcgataaagtgatcaagcaggacaaaagggccatcgttcggctggaggacagcaaaattcagctccgtctcagagacaaaccgacggccgaggcgaaatgttgcaatgacccggcattggttcggaaaatgttggaagaagcgaagacaatggtcgaccaactcgtcgaagtcggctcggtccacgccgcttactacggatgttcggcggagtaccaattccaaatgggcgaccacgaccgttactatgaagaggcccttcattatctcggctgtgaagacattaacgtcaaattgagcacggaacag

SEQ ID NO: 49381 - DNA, 556 bp, Heterodera glycines
  SCN-specific regions: Sequence locations=1-402,425-556
ctgtaccggcttcacacttcgaccggtggccggccttctacgttcccgcgattttctggacgggctggcattctcggtgttccattccaccctgtacattctggattcgtccaagacccagtacacacctgaggccgagatttgtcacgaactgatgggccgttgtccactgcttgcggaccccgattttgcccagttttcccaagaatttggactcgcatcgcttggcgcctccgatgaaatggtggagaagttggctacgctctattggttcaccgtggagttcggcatttgcattcaaaatggggcaaaaaaggcggacggtgcgggactgatgagctcatttggcgaattggaatatgcgctcagcggacagcccgaattggctgcgttcaacccgccggagacgtgccaaaacaaatacccgatcactagctaccaacccacatatgttgtggccgaatcgttcgccgatggccaaaacaaactccctactgggtcaacgagcatacccagacaggtcccagtcaactacaacccatttccacaacgcatc

SEQ ID NO: 49382 - DNA, 630 bp, Heterodera glycines
  SCN-specific regions: Sequence locations=1-13,35-38,64-260,295-630
ttaaggacttttatatttataaaatgctttataacggcaaatttttaaataagaaaaattatacaattacctttgaattagcaggaagttttgtggagaatcatcgtgggactgtttattccgtgtctttcaatccttttactcactcggaagcgcccatttattttgccactgtagggaaaaatagggtgtctgtgtacctttgtccacccgaaaagggctttcaattggtgcggcaattcgaagaccaagacgcggtcgggtggactttcttttgttttggagttttgctttgtttcacacattttctcagaaggacgagttttattacacggtcacttgggcttataaccttgaaaaagcacaacatgtgttggtcgtcggcggatttcgcggaatcatccgtgtgattagcccactcaatgggcgacttcattgcgcattaatcggtcacggcgactccatcaacgaattgtgcacttctcccgtctctccgatgattgtcgcttcagcgagtaaggatctgacagtgcgaatttggaacgtcacttactcgcaatgtttggccatcctcggggggaccaacggacaccgtgaccaagtgatttctctggatttcaattcgcccgg

SEQ ID NO: 49383 - DNA, 624 bp, Heterodera glycines
  SCN-specific regions: Sequence locations=1-535,557-624
ggttggtctcgagctgactcttccaatttgcttggcgaacaacaaaattccttcgccttttcttcgatgggcaataaagcgaccaataacattttcaccgattttgtcgacccgttctttgtcgatgaagtgatcacttcagttttggatgttgggcgtgccgaaattcgctattacaaaaatggtcaaccacttggcgcggcattcaccgacattcggtaccaaaccggtgatatttatttcccccatgttgctaccaaaaattgcaaagttatggttaactttggcaccgaaattcctgaatcgattgaagcggccaaagacgagtccggtctttgcttgtggagtatgcccgccgatgaagtgcccgaagagaccgaatgggtcggcaacgtggaccggaaacagatggcaccgagcagaaggccgatgatcgacaaagcacactgcacaatcattgcgatggttggactgcccggcgttggaaaaacgacttgggttcgccaatacctcaaagagcacccgaatgaaaattggattctgctcaacacggacaccatcctcgaggcaatgacggtcgacggaatgccaaggcatcgagtgcaccagggcagatgggacatg

SEQ ID NO: 49384 - DNA, 637 bp, Heterodera glycines
  SCN-specific regions: Sequence locations=1-559,581-583,606-637
agaatttatttttaaatagcttcattttaaaaaatggcttcttaccatgttgccattgctgctgatgaacgccaaaaatatcgctctttttgggaccaattttcgggaagagcagacaattcggcaatgatgctaaatgctaatgcagatcaaattgagtcattggacagagaaaatattctcgccctgttaccatcggtcaaaggcaaatttgtggtggacattggtgccggcattggccgtttcaccacagtgtttgcccagtcggaagcatcaaaagtggtggccactgattttgtggcctcatttgtggacaaaaatcggcagcgaaacggcgcatatgcaaatgttgttgagtggcgggtgggcgatgccaccggacttcagtttgacgagggcagtgttgatttggttttcactaattggttgttgatgtacttggctgatcaggaagcggtacaatttgttgccaatgctcttcaatggcttcggcctgacggttatctccatttgcgcgagtcgtgctcagaaccttcgacaaaaaaatctgctgatcactcaaccaccacaaccactaccagcacttcatcatcctcatcctcgtcgttgcacaacaattcgaagccaaatccgaccc

SEQ ID NO: 49385 - DNA, 646 bp, Heterodera glycines
  SCN-specific regions: Sequence locations=1-591,613-646
taaaaggtaattatggcgcgaaacaataaattaatatgatatcgtccaatgaaggatcgccctgacgaatctatactgatctcatgactattagctgcacatggagatgacagtaagacccgtcagagaaactcttccattaagtaggcggaatgcacgcgaattccttgtgtggattagcccatttaagcaagaaaaaggttaccaggggaactgcctctcgctcccaaaactccacataatcaattcccttggaacgtcgcgtctttgtgtcggtaatcactcgaacatctctaacgtgtccaacacttgaaaaaaattcctccaagtcacgaggacgcgtttgacgagcaagcttaatcagaagaatttttcaataatcagcaaatgaagagccaacctggagaataaaaactggtcgctcatctctttcttcggaagccctatccattcgagcctcacgcggcgggggatctcgagggcgtaatgggcataccttaagaatcaaggcctggaataggctacatgggcaccgggtgggtggagcgacgccccccctaaccggcgacgtgccgggggccgggccccgggtcacccaccccaccgccgcgcgacgggcgcttgcgcgggagggggatgggggacg

SEQ ID NO: 49386 - DNA, 583 bp, Heterodera glycines
  SCN-specific regions: Sequence locations=1-208,230-583
ggcaacaacatcgccaatttggaacaacaacacgttgccaattcgcctttggctgagaacggaggtgacaatttgcctctgttggatggagcccaaattgaagttggtgctgatccgcaaactccgcttgtcgacgccactgcattttcgccgccgcaaatggagaaacggcagagcgcacgacgatcgcgagcacatgagcgcgaggaagaaaacgaggacgaggaagtgttcactcgtcggacttttaacgttttgcagtcaatcgcgacaaaattgcgcgcggcaaatacaaacaaaattgtcttcgaagatcttttcaccaaagggtcgacgcgtcgcactgcggcacagaaattctacgcacttttggagctgaaaaaatggcaagccattgaagtggaacagcgcgatgctttcgacaccattgaaatttcggccggtgcgctaatgaatgagacaattaaattggcaatttgattgaagattatgggagggttccttccgtactaataatgatttttccttggatctcaattcgtatcttaatggccatgaaaacaacaaaaggctctgtttgatg

SEQ ID NO: 49387 - DNA, 563 bp, Heterodera glycines
  SCN-specific regions: Sequence locations=1-514,537-563
acctatatttcccttcttcaattcaataaagcttcctttattccgttcatggaaaatggctcagaatcatgtaccgagtcggtgattttgtctattttgagactttttcggcggctccttaccaaatacgaagaatcgaagagctgaacaaaacagctaatggcgcagttgagaccaaagtgacttgcttcttccggcgccgggatttgcccaactctctgctgaaaatcgctgaccaagcggggcgtcagagtaaaattgcatcaaagccgcggaaaacactgctaggaaaggccgagccgacctcttccacgagcaacgcaaatggcgaggagggaccaagcgaaaacggggcggacgcaatggaaagtggcgggggctcgtcgacggacgcggagaactcgcgacgcgaaaacgacgagacggctgacgacggtcgggcggaatctgttggtttcgccggtctccccgccggtgcagaacgactcgacgcagcggagctaagcagacttcgtcagcatgaacttttcctctcgcgcattgtcgaaaccctaccagccaca

SEQ ID NO: 49388 - DNA, 523 bp, Heterodera glycines
  SCN-specific regions: Sequence locations=1-237,259-271,294-523
acacaagaagagcgggggattcaacacaaagaagtttttgttggacctcgcatacggcggaactgctgctgccgtctcgaaaaccgctgttgcacccatcgagcgtgtcaagctgttgttgcacgtgcaagatgcttccattcacatcaccgcgaacgaccgctacaaaagcatcatcgacgtcctcgtccgtgttcccattgagcagggctttctgtcgttgtggcgtggtaacctggccaacgtcatccgttactttccgactcgggcgctgaacttcgccttcaaggacacttataatcgagtcttcacgcaaggagtggacaaggataagcacttcttgaagctcttcaccatgaatttggcttcaggcggtgccgctggcgccacttcgctgtgttatgtgtaccctttgcactttgcccgaacgccgttggtatcgcatgttgcaaaggacgatgacccggagttcagaggctgggcggactgcatcatgaagatccccaaatcggaccggcccatc

SEQ ID NO: 49389 - DNA, 596 bp, Heterodera glycines
  SCN-specific regions: Sequence locations=1-88,110-311,333-499,521-596
cagtggcagcagctcgcatttctgccacctgcacaactgctcgctcctcaactacaatgctgtcgtctgttgatgcaatgcgtggccgtttactcaaatttaaattcttttcaagttaaagcgccaaatattcatttaccaaaaccaaaaggacgccgattttgagcgaattttggcgagaaggaagcgaattgagctgtacaaagagaccaatgagcaagtgaagcgggaaaaattgcagaaggaacttgcacaggcgaacaaacaggaggaacagcgcagaagggaggagttgaagaagttgcaggaggagaacaaagagaacgagcggaggcgcaaactgaacgaacaggaggagattcagcgaaagttgcaatccgagaagttgaagaagtaccaggcgcaccctttcttccaacagttggtcaaagagcatggggaggcgatattcgacaaagttgaccctgacaaactcatcagagagaagcgaattcgttttgacgctgagcgacccgagcagcagaccaaattgcaaaacttggagaaaaaatatgaccacccccgtccgggcatttcatttggaagaaatggcactg

SEQ ID NO: 49390 - DNA, 623 bp, Heterodera glycines
  SCN-specific regions: Sequence locations=1-623
gacgaccgactcgacctcgacagaccgaccaattggagggtcttcaacattttggccgtcttccacaatctttcgtttgaggaggcgaacacggcccttatgggcgaaagtcacgcgcttgtcaggtttttgctgctttgctccaaatgtcggtggcatttgctgcgtaaaattgcctatgatacactgagtaacatcgcaagaaatataaaattggtcgacaaattgtccaccgttttgctgaacaccgtccaaaagggtctccactcggacgacaaatgcaaagtgatgcgatccatggaaattgtggccggtttatgcgcaacgccaaccaacgagtcaattgtttgtgaattcttcgaagaatcgcaaatcataccgcggattttcgctcttttgtcactcaaggatattttgatgtgtatgtgtgccatggagtccgtgttggccatttccgagttgggacgggtcgcgtgcgaagccgtcgcccgctgtgaccgcgccgttgaaatgcttgtcggctttttgaccaccgatgccttttcttttggcaccgtcggtttggcggggatgcacgtggttgaggtgcacggacacccaaccagaccttatgttgcgccaaa

SEQ ID NO: 49391 - DNA, 461 bp, Heterodera glycines
  misc_feature (56)..(56): n is a, c, g, or t
  misc_feature (90)..(90): n is a, c, g, or t
  misc_feature (93)..(93): n is a, c, g, or t
  misc_feature (147)..(147): n is a, c, g, or t
  misc_feature (407)..(407): n is a, c, g, or t
  SCN-specific regions: Sequence locations=1-425,452-461
acagcacacacagccgaaaagcgcttcttctcatcgccttcgccttcaaaacttanaagcaccaatcccaaccagaaaaaatgtgcgacnaanaagttgctgctctcgtggtggacaatgggtccggaatgtgcaaggccggtttcncgggcgatgacgccccccccgcggtgtttccttcattgtgggccccccccctcttcaagccttcatgctcgcatggaaacaaaggactctatttggtaaccagggccaatcaaccgggttttcctacccttaattccccttttaacccggtttcccccccctgggacacattggaaaaaatttggccaccctcttttaaaaaaattttttttccccccaaaaaaaaccccgggttttttaaaaaccccctttttcccccnggcgccaaaaaaaaaaaacccccccttttttttaaaaataaacacccccccccc

SEQ ID NO: 49392 - DNA, 650 bp, Heterodera glycines
  SCN-specific regions: Sequence locations=1-539,563-650
gcgggaccacttgtgatgactttctgagggagaatttggattggatttcgaaagcgactaattggaataaatttaatgccgtggcatccctcggactcattcacaagggacatgaacgagatgcgaaaaagcttttggagccataccttccaaagggggagcaggaccaattctgtttcaaagaaggcggatctctttttgcctatggtctgatacatgccaatcacgggagctccgcgattgattatctgtctgaccaactcagccgtgcttcgacgagtgccgttcgtcacggcgcatgtctgggacttggattggccgcactgggcacacgtaatgaacgtgtttacgaacacttgagggatgtgctgtaccagaacgaagcggtgtcaggagaagcagctggaactgccatgggcttaatcatggctggatcgatgaaccaaatggccttcgacgaaatgtaccagtacattcttgacactcaccacgacaaaatccaacggggacttcgcacgggaatttctatgttagcttatggagttgcagaaagagctgaagattggattcggttgctttataacagtccttacgcaattattcggcagacgggtgtttgcatgattgctttggcttacgcgggtacggga

SEQ ID NO: 49393 - DNA, 370 bp, Heterodera glycines
  SCN-specific regions: Sequence locations=1-46,88-253,289-370
gtgcgacgaagaagttgctgctctcgtggtggacaatgggtccggaatgtgcaaggccggtttcgcgggcgatgacgcgccccgcgcggtgtttccgtccattgtgggccgcccccgccatccagacggcatggtcggcatgggacacaaggacacgaaggtggtttttttttttcagaccaaccggggtattctgacgctgaagtagcttattgcgcgcggcatcgtaacgaagtggagaaacatggagaatatctggcacaacaccttctacaacgagctgcgggtcgccccccagaagaacagtttgctgcacacgtatgcccgactgacaccgaatgccaagtgagtgaagatggaacagcgtctc

SEQ ID NO: 49394 - DNA, 593 bp, Heterodera glycines
  SCN-specific regions: Sequence locations=1-593
gccgttataaaaatggcaacgaattcggcatttgaacggttggatgattacatttggggtcgcgctgacgagggcgaatttcttcggggagtggtcgcagatgagcgattagacaccgagaaactgttgtcgcgagtgcaaaacattcaacgggaaatgaactcgcgtcttcgccaaggggtggaagagaattacccaagtctattggagcaggtcagcaccatcgaacagttggacagtgcccattttcacgtccaacgcgaaatggacgcggtggtgaggcgggccgacgcattggccaaaacgatggaggaacaggtgggtaaaatccgtaaggatgtgcgtgcaatcgcttctctgacccaactgagtcggatgcaaggcgatgcgatcaggtgcgaagaattggtggacgcatggcgcgcggagacggatttgatcagacggacggaacacatcacagaagtgaacgcaattgtgaaggccaacgacaaactcagacatttgaaatggctccagtaccgttgtctgttcagtctttccgagatgaactcgcgcactcgtcaggatttggtcgttcagttgcgttccgc

SEQ ID NO: 49395 - DNA, 637 bp, Heterodera glycines
  SCN-specific regions: Sequence locations=1-637
ttatcacttcggcatcgaccatttgccaactactcgcaccactgaactgttcaaatgtctcacaatgcatgaaaaaaaatttggcgaacgattgcaaattgagggagtcattttctcaaaacgccgtcaccaatacgaagagcaagtcaaggagaacccattcaattacgacgcgtggttcaattatgtgcgactgttgatggcggaggacgccgaccgggcctaagtggaggaatgttttgataggaccatttccaatgtgccgccttatgtggaaaaacggttttggcgtcattacatttgactgtgggagtattacgccatttacgaatagctcgatgttgacgacctgagaaagtgtcctgaagagtggcgtgcctgtttagacatcctcccccacaagcatttcaccttcgccttcacttggctgatgttcgcccaatttgagctcagacaactcaatttaagctccgctcgtaagattttgtgcacggcaattggaaaatgtccaaagaagaaacttttccgcgagtacattgagatgtagctgcacctgatggagctcgaccgatgtcgatgactctactaaaaattccgcgagttctcacctgacaacagtgtcagctggatgaaatat

SEQ ID NO: 49396 - DNA, 652 bp, Heterodera glycines
  SCN-specific regions: Sequence locations=1-425,449-652
ctttctccgcgctgtccttgctgtgcataacaacgacttcgacaaggcatactcctgcataaataaggtcagagatatgtttgactcggaattgaccgcaatggcagcagagagttatgagcgcgcttacggagcaatggttttgctgcaagaactgaccgagctcgaggaggccatcgagtacaaaatgatccccgagcgcgaaatgcgtatcgctcttttgtggagccgacggttgcaaggatgcttactaaatgttgaacattggaggcgcattttgatggtcaggtcgatcgtcttttctcaaactgagttgcgccctctttggataaaatttgcggcactttgtcgttatgaggggaggcaggtgaccgtatctcgcaatgtcatccgttctttgttggaagtgccgccggacactccgttggagaaagtgccaatcccattgccattagagaaaacacagttggcactggcactttgcaaacaattatgggttgacagccaccgtcgaacggctttagttcaattggaacagctcacgcagactttgcatcgatgtattgagcgcaatcgcacaatgctcacccgcgaacagcttgaaacacacgcaagactgaccgcgaaatgctaccttaagttgggtgaatgg

SEQ ID NO: 49397 - DNA, 547 bp, Heterodera glycines
  SCN-specific regions: Sequence locations=1-118,160-188,226-230,295 -298,337-364,401-401,480-547
gtgcgacgaagaagttgctgctctcgtggtggacaatgggaccggaatgtgcaaggccggtttctcgggcgatggcgcgccccgcgcggagtttccgtccattgtgggccgcccccttcatcagggcgtcatggtcggtatgggacagaaggactcttacgggggagacgaggcgcattcccatcgtggcattctgacgctgaagtacccgattgagcacggcataccttccaactgggacgacatggaaaatatctggcaccacaccttctacaacgagctgcgtgtcgcccccgatgagcacccggtgctgctcacagaggccccgctgaacccgaaggtcaacagagaaaagatgacccttatcatgttcgagacgttcaacacaccggccatgtacttggccatccaagccgtgctgtccctgtacgcctccggtcgtaccaccggtctcgtgttggactccggcgatggtgtcagccacaccgcggccatctacgaaggttactcgcgtgcacacgccatcatgcagtttggacttggtcgg

SEQ ID NO: 49398 - DNA, 645 bp, Heterodera glycines
  SCN-specific regions: Sequence locations=1-164,186-567,589-645
aacagaaaatcgttcagttgtccaaaaactaaaagcgaccttctaaccggcacttcgacggcaaatttaagtcccgaggacattggcattatcgcatcaatgggcgactcattggccaccggtgccgggctttggccgcggacggacatcgaattccgcggtgccgcctttcccattgggggtgatgcgacaattgatggtctcgtcaccgtccccaacattctgcgcgagtttatcgactccaatttgctcttcggagtttctcacggaatgggccaacgcgaccaattgcccgaaaaccaactgaatgtggcagtcagtggggcgagcagttcttcgatgcctggacaggccgtcgaattggtgagacggatgaagcgacttcgggaattggatgtgttcaacacttgggctttgattattgtcaccattggaaccgaagaggtctgcaaaaattgcacgggtccaaatacaaaggcactcgtccaggcattggacattttgaaccgtgggattcacaaagcactggtgattttgttgggcccaattcacgtcacttcgctgtaccaacaaaagttcaatttgctcaagacgcgttgtttatgctctcaaaataaagacgacaaatttatgagtgcactgagc

SEQ ID NO: 49399 - DNA, 645 bp, Heterodera glycines
  SCN-specific regions: Sequence locations=1-645
aaacatttcaccaacaaaagcagcagaagaattaccaaacggaagagcagagaaatgccgtcccaaggagaactcaaagaaatcttcaacctttacgatgaggaattggagggcaaaatcgacgccacgcaaattggcgacgtggcacgcgcgtgtgggctgaagccgaccaatgcgatggtttggaaagcggcgggcgaagaatacaaacgcaagggcgagaagaaattggcattcgaagaatggctgcccatcttcgaacagttgcagaaggagaaggaagtgggcacttacgccgacttcgtcgagggtctgaaagtgttcgacaaagacgagagtggcaaaatcatggcagccgagctcaggcacgtgctgctggcgctgggcgaacggctgagcgcggaggaagcggacgaacttttgctgggcgcccaggacggcgagggaatgatcaattacgaccgtaagcgattattaatgaaattaaccgtgtcgagagtcccgacaaatgaccgttcccccttggtatttcagagttcatcaaaaaggtgttggccgggccctaccccgaggattgaaagacgcaacgcaaattagacaaaacacaaaatgagagatgggaaaagtccacccgaatgacgaaag

SEQ ID NO: 49400 - DNA, 586 bp, Heterodera glycines
  SCN-specific regions: Sequence locations=1-94,126-137,160-187,220 -244,268-322,344-368,391-403,439-522,544-586
gggccaccaaaaaattgctgctctcctggtggaccatgggtcccgaatgggcaagggccgtttcccgggcgatgaccccccccccgcggtggttccctccattgggggccgcccccctcctccaggcgtcatggtccgcatgggacaaaaagactcctacctgggaaaccaagcgcaatcccagcgtggtattctgaccctgaaataccccattgaacaccgcatcctcacccactgggaccacctggaaaagatctggcaccaccccctctaccaccaactgcgtgtccccccccaagaacaccccgtgcttctccccaaagccccccttaaccccaagggccaccgaaaaaagatgaccccaatcctgttccaaaacttccacacccccgccatttacctggccctcccagccctgctgtccctgtacgccttcgggccgaccaccggtctcctgttggacttccgcgatggtggtacccacaccgggcccctttaccaagggtacccccttgcccacgccctcctccggttggacttgggcggccctgacctcactgactaccctgagaaaatcccccctgag

SEQ ID NO: 49401 - DNA, 647 bp, Heterodera glycines
  SCN-specific regions: Sequence locations=1-647
gacgatacggcgccgagtgtgactggtggtcgttgggcatttgcatgtacgagatgatttttggcgagacgcccttctatgccgagagtttggtggacacgtacggcaaaatcatgaaccacgaggagatgttcgagttcccggaggacatcgacatcagcgacgaggcaaaggacctaatctcgcggctgatttgtgcccgcgagacacggctcggcaaaaatgggctggccgacttccgggattatccgttcttcgccgacatcgactgggagaacatccgaagcgctgaggcgccctacaagccggaggtgtccagccccaccgacacgtccaactttgactccagcgtggtggccaacgacttcaccccgtgcgaaacgcaaccgcccaaagtgaccgcgccgttcaccgggctccatttgccgttcatcggcttcaccttcaccagcggaagtgccttctccgatgccacctctctgctccaaaccatccaagccaacagcggtggtggtgccgtcggcgtcgtgccattgtcctccccagcggtggacagtgccggcgcaaaatcggcgattctgcagcaacaacaacaggcgcaggcggcgtccgtgccggcgcaggcgcaggacgacgaggagcgcgag

SEQ ID NO: 49402 - DNA, 295 bp, Heterodera glycines
  SCN-specific regions: Sequence locations=1-295
tggtgtttattccaatggttatgatggttccttaaattcttgccaccgttttcccctttttcacacagtgatcatagccaatcactttacgagaaaagatccgaatcaatccgattccctgactgacgaggacattaagccatccccgaattggcaaaacttccgcaatagctccacaatttttttgcggggcccgcccacatttttgggcccggccaaatggaaacaggcaattgtttttttttttttcggcggggaaaaaaaaaatcccccggaaagccccccctcccggggg

SEQ ID NO: 49403 - DNA, 530 bp, Heterodera glycines
  SCN-specific regions: Sequence locations=1-478,500-530
aaaccgccgcctccacttttttgcattgaccgccatggccgtttcaacgctggaaatgcgtgtacggtgcgtctggatgactatttgatcttccactatacaaatcccagattgcttgagcatttcctttaccccggcactgatacagcccctgcccataattcaaaccggactttgtcaagaacaatactgcaatttgcaagcccaacttcatcgaggacaaagagcacggtacgtttattttcaacgtgcccttccggcacttcaattatggtcaatggtatccaaaagatgcgaatgcattaataagcagtgatttggaggacgaccaaccgagcagagacttgacaaacgtcgaatacatttatccgaatcctcaaatcgcatttgaaacacacaaccgggacaaacacaatgcttgggatgaatggtggatgagacaagaaagattcattaaaagactcaaataatcgcacatttgttactattgtctgtttgttgcattcacttcgaaaaatatttcaacgcga

SEQ ID NO: 49404 - DNA, 596 bp, Heterodera glycines
  SCN-specific regions: Sequence locations=1-106,128-217,239-403,425-596
gtccaggcgcgacaagcacaaatccgtttctggcaagaatacatggagcccattgaatcaatgcatcattccactgctactttggctgagtccaatgccactattgtcgctggagggggtggtgggatgaatggcactaccaatgacttggattcgtcgccacttttgttgccgccggagaaagggattttagaggagaattgcggtgtcattctcatcgcagcaatcaacaaaagcgacatgcactctgacctaagcgcagaacagctcgaccggctccaataccatgtgcgcaagttttgtcttcaacatggcgccgcattgatttacacttcggctaacgacgacctgaacacacaacttttgcacaaatacattgctcaccgcattttctcactaccattcactgctcccgcttatattgtggaaagagaccgcattttcgttccgactggatgggactctgagcagaagctgtccatcatcaaggaagcgttggtcggttctgatcttttggatgtgccgatgttggcccagcagtccagcgatgcgtcacccttctccaattatcgggcgactggcgaaatggaagttga

SEQ ID NO: 49405 - DNA, 208 bp, Heterodera glycines
  SCN-specific regions: Sequence locations=1-96,124-175,197-208
gatccaggcaccagacttgatcacggacgtccaagccgtgatgctcctgtacacctcccgccacaccaacgatctcgtgttggactcgcgcgatgttgtcacccacaccgtgcccatctaccatgcttatcacacgacccgcgccattctccaaaaggacttgcccagacgcgacctcactgactaactgatgaagctcctctctcag

SEQ ID NO: 49406 - DNA, 577 bp, Heterodera glycines
  SCN-specific regions: Sequence locations=1-62,84-577
gaataaccatcatccaactgtaaatggaaatggctttggcttgaccaatgggacacatttcgctgatgaattttctgagtccattaaagacgttggtattattggcatcgaactttactttccaaaatcctacgtgaaccaagaagaccttgaaaaatttgacaatgttacatcaaataaatacgtgctgggacttggccaacaagaaatgtgcttttgccatgataatgaagatgtttgttcactttcgctgactgttgcagctgcactgatggacaattacaaagtcaatccaaaggacattggctttctcgcggttggtaccgaaacttggttcgacaaaacaaaaggggaaagccgtggttatggaattgtttgccgattccggcaactggacttggaaggcccccgacgaaaaaaccccgggttcggggggacccaagcgttggttattgccccccaatgggtgggacccgaattacccaacaaaaaaaacccctgcccccccgttgccggggcgaattgggcaaattttaccaggtggggccccccccaattgacgggggggtcggcgggg

SEQ ID NO: 49407 - DNA, 217 bp, Heterodera glycines
  SCN-specific regions: Sequence locations=1-43,85-217
cgacgaagaagttgctgctctcgtggtggacaatgggtccggaatgtgcaaggccggtttcgcgggcgatgacgcgccccgcgcggtgtttccgtccgttgggggccgcccccatcatcgggggggcatgcacggcatgggacagaaagactcgtacacggaatatttttttttgtccaagcgtgggattctgacactgaaataccctattaagcac

SEQ ID NO: 49408 - DNA, 495 bp, Heterodera glycines
  SCN-specific regions: Sequence locations=1-34,56-126,168-291,360 -366,408-420,443-495
agcacacacagccgaaaagcgcttcttctcatcgccttctttttcaccacttagaagcaccaatcccaaccagaaaaaatgtgcgacgaagaagttgctgctctcgtggtggacaatgggtccggaatgtgcaaggccggtttcgcgggcgatgacgcgccccgcgcggtgtttccgtccattgtgggccgcccccgtcatcagggcgtcatggtcggcatgggacagaaggactcgtacgtttgatattaggcgcagtccaagcgtggtattctgacgctgaagtactcgattgagcacgggatcgtcaccaactgggacgacttggagaaaatctggcaccacaccttctataacgacctgcgtgtcgcccccgaggagcaccccgtgctgctcaccgaggcctcgctgatcccccaggccaacagagaaaatatgacccccatcctgctccagacgttccacacgcccgccacgcacgtgggccttccaggt

SEQ ID NO: 49409 - DNA, 659 bp, Heterodera glycines
  SCN-specific regions: Sequence locations=1-348,370-659
atgttcccatgttttccggtgccactgaattcatagctaaccaagcgttcacaagtgcactttggaacattgccgaatccggggtacaacgagcagaatatttggtgcacaattacctgctatcaccgacagcagagaacggcatggacacacaaaaacagtcgccttcatctaaaaagatttattatgtctcattcaaccaagactgcaccattcttgtggtcggacacgacgacgggtacagcttctacaatttgcgctcattggaacgactggagaaaatttcggactcgcgagtgcctgaacgcgcatgcattgttgagaagctgtacagcagttcattgacctgtgttgtgtcgatgaaaagcacgcgaaaacttcaggtcttccattcgaagaatgagaatgaaatctgttcccacacctatgccagttcgattattgctgtccgtatgaatcggaagagagtggttgtctgtctggaggacaccatccacattcacaacatcagggacatgaaaataatgcacatgctgaaagacacaccgccaaatccgaacggaatcgtcgacctgtccatcgcggaaagcaactgatttctcgctttttccgtgttcgtccgcaccggccctgggcatatattcgacgctgagaatttg

SEQ ID NO: 49410 - DNA, 223 bp, Heterodera glycines
  SCN-specific regions: Sequence locations=1-223
gcgctggacgttgtctcaggtgcgccagacagacggaatcatctctgcccaagccggttggaacaagggaaactcgaacaaaatgatgaccatctctggtatgccgagtcacaccaccatcaaatttcatgtggagaatccggtccatattccggatgacattttgttgaaaaacacggctgaggtgcttatgctggccagtccgacctggttctctaaccaa

SEQ ID NO: 49411 - DNA, 682 bp, Heterodera glycines
  SCN-specific regions: Sequence locations=1-5,28-454,479-682
catgatcggaggtctttttgtttataaccacaagggtgaggtgcttatttcaagaatttatcgcgacgacgtgaatcggaatgccgttgacgcctttagagtttcagttatacatgcaaggcaacagattcgttcaccagtgacaaatattgcaaggacttccttttttcacatcaaaaggggaaacgtttggatgtgcgctgttagcagacgaaacattaatgcatcgatggtcttcgaatttctcaatcgttttgcagacacaatgcaatcttattttggaaaactgaacgaggaaaatgtgaaaaacaatttcgtcctcatttacgaaattcttgatgagatccttgattttggttacccccagaataccgacccaggagtattgaaaacatttataacacaacaaggcgtccgaacagcgagtaaagaagaacaggcacaaatcacttctcaagtaacaggacaaattggttggcgccgagaaggcataaaatacagacgcaatgaactctttttggatgtcattgaatatgttaacctcctcatgtcgcagcagggtcaggtgctttcatctcatgttgcgggaaaggtggccatgaagtcttatctcagcggaatgccagaatgtaaatttgggaataatgacaaattgacgatcgaaagccaaggcaggactggc

SEQ ID NO: 49412 - DNA, 654 bp, Heterodera glycines
  SCN-specific regions: Sequence locations=1-87,110-654
gtcacctttcttcacacgctgttagaggccgaccatttaaaaccacagcttttgcgagtccaattatccactgccggctcgcaggagccccaatcgcttctctcccacttaagtcgtatgttgtgcaattgtgggcctcgtaaattgcaaattcgttgtggccttttgatgcttttgtctgtgtggacaaataattgtacgcctgcgattgaattattcttgtcgcctttttgcacaaattctgcttccgacgatcacaatgtcgtgcattaccttgtctcccaattggttgaccaaaacactgagataacggaggcggaaaatcacctcgtcaaaggattggtcgcatttctcgtcggcatttgtctccacagttgggaagtgccggaaggaaaggcggacaaaaagaatcaactgacacatttaatcgaacgaagagtcggtcgtgaacgaatggccgagtacattgaaggcatttccaaatcagaattttacatacgagcggcccaacgccctcagccgttggcaaaaggcccttccgatttgttgttggattatcaattcaccaaattcttcaaattaatggaggggcatttgcttaagtttttccgtccaaacggtgaactttcttcttctgtaatacacagcttgaag

SEQ ID NO: 49413 - DNA, 421 bp, Heterodera glycines
  SCN-specific regions: Sequence locations=1-421
tacagataatcatcgcttttccgacccagaggattttgtagacgatgttgaggatgatgaattgatcagagatttgctttacgaagagccaagggaatcgcaataccaagaatgctgtattatggtgttcaatattcctatcatttcctcggatcgattgccaaaactgcgcaatgtttcttcctgtgtcttctccgttcgaaacacttacaaatataacgacaattctccgctggacggtgaaggacataccaaaggcttttgctttttggagtaacaaacaaaggaggcggccaacgcagttttggccatttgcgatggacatcgccttgacaaataccacacatttgccgcgtatccattcaccgctattccaagcatgaacgaaccggaaaaggactggcagaaaccggaaagacac

SEQ ID NO: 49414 - DNA, 403 bp, Heterodera glycines
  SCN-specific regions: Sequence locations=1-403
cggccaactcgtttacaatggacaaattctgttgcccgattcatgactcgaccctttgatgggttccaacctttgggacccgacgctcttctaattgactaatggccggcctggccttcaaaggcgcacccatgccagagtgtttttttttctggcggaaaaacggcagtgctatttaccttactggatgatggttcaactcgatcggaaggagggggacatcatcagcgagcagtactaatagatcccgattgccgcttaccccaaggaccagccgatgctgaccgactattaccacatttaaaatccccgcgccatgcacgaggtcgaactgcgcaagttttccaggctgaccacaggcgatatcatcgcggtgcaccacgacgagcagtgtatcgacttc

SEQ ID NO: 49415 - DNA, 493 bp, Heterodera glycines
  SCN-specific regions: Sequence locations=1-144,166-254,283-493
gtgcaacaaaaaatttgctgttctctggggggacaaggggtccggaatgggcaaggccgttttcccgggcaataacccccccccccgggtgtttccgtcattggggggcggcccccgccatcaggcggtctgggccggcttggaacaaaagaattcttattttgaaaacaaggcgcattccaacgtgggaattctgacgttaaagaccccaatggagcacggaatcgccaccaatgggaacacactgaaaaaaatttggccccccaccttctacaacaagttgttggtcccccccaagaagaaccgggggttgctcacaaaggccccgctaaccctaaaggccaccgaaaaaaagaggacccaaatcatgttggaaacgttcaccaggccggccatgaccgtgccaatccaggccgggctgacctggaacccctcgggccgtaccaccggtctcttgttgaattccagggagggggcccccccaccgggccca

SEQ ID NO: 49416 - DNA, 607 bp, Heterodera glycines
  SCN-specific regions: Sequence locations=1-164,202-262,294-607
aaagaaaaaaagcggtggattcaacactaagaagattttgttggacctctgatccggcggaactgctgctgcagtctccaaaaccgctgctgcacccatcaagcgtgtcaaggtgttgctgcaggtgcaatatgcttccattctcatcaccgcggacaagcgctacaaaggcatcatcgacttcctcatccttgttctccacgatcagggctttctgttggagtggcgtggtaaactggccaacgtaatcagatactttccgactcaagcactgaacttcgccttcaaggacacttataagccagtcttcacgccaggagtggacaaggagaaacacttcttgaagatcatcgccatgaatttggcttcgggaggagccgctggagccacttcgctgtgttctgtgcaacctttggactttgcgcgaacgcgtttgagcacgcatgttggacagggccatgcccgtcagtgcaaaggcctgccagagtgcatcattaatatcctcaagtcggacggatccatcggtctctaccgcggcttcttcgtctccgaccaggggatcgtcatttaccgcacaagttacttcggatgcttctacaccacaaaa

SEQ ID NO: 49417 - DNA, 661 bp, Heterodera glycines
  SCN-specific regions: Sequence locations=1-55,81-661
acgtggcaaacgcggcagcagtgaaccgtcgatggccgaagaaatggcattggcaccttcctcctcgtcctccaccgctccgccctccacaactgctggtggcatcgcttcctcttcctcatccgtctcctcctcatccgtcgttggcacctgttcctcatcatccggtggcattgtgccgtccatcaaaatgatttttccgggcgaagtttggtgccaaagtggtggcacggcgatgatcatcggcgaacagttccacgagggcatgcaagtgatggtcggcggcacgctcacttggcccgagatggtcactgcccacgcgatcaaagtgaatgtgccggcccgggcaagtcccggcgccgtggacgtggtcgtctgctccccgaaggggcaaccaaaagtgcgctccaatgccatccgattctcatacgtttcgctgaccgagccgagcattgactacggatttcaacgactgcagaaattgttgccaaaatatccaaatgatccggaacgattgcccaaggaagtgattttgagaagagcggccgaactggcagaagcattgtacaaccggtacagcagcccggcggagcagttgagccactatgcatacagcttcgactcggatttggttgcggattacgcccgcgtgcacacatcg

SEQ ID NO: 49418 - DNA, 490 bp, Heterodera glycines
  SCN-specific regions: Sequence locations=1-490
aagacttgacgtcttcaaactgacggactatgacgcaatgaaattcttggtgagccaatctgacatcgctaccagaaagagggactaccaaatggagcattatgcgcggaatcgcccatcagacggcattcacatcatcaacattcgcaaaacgtgggagaaactgttgttcgccgcccgagccatcgcggtcattgaaaatcctgccgatgttgcggccggctctgctcatccgtacgcccaacgcgctgagctccagctcgctgctcccatcggtgccactccaatctgtggccggtttacgaccgggtctttgaccaaccatcttctgaagaattgcttggaacctcggctgctcgcggggtccgaccctgaggtgcaccaacaggagggacgcgacgcgtcctacgagaacactcctgggattgctccgaccaacacagactcgacgttgagatttgtggacattgccgtcccggcaaacaacaag

SEQ ID NO: 49419 - DNA, 630 bp, Heterodera glycines
  SCN-specific regions: Sequence locations=1-630
ggattgacgtgactctgagtgagtccggccccgacgcccatcacccggtcattcggaccctttatgaccacctcgatgtgacaacaaaaacactttacgaagaatcgttggtctttttgctaggaagtcacttgcgttgctttccatccccgcgagtccgtcctcctttcgggcagcaacgattttacgctgaaaatgttcgattattcaaaaactgcggttaaaagggcaatgaaaacgatcacggaggtcgagccgatcactgcggtcagttttcatccgagcggagagttttttctatgcgcaactcggcatccgaccttgcgtctttatagtgccgaaacacagcaatgctttgtttctacaataccgaaggaccaacattctgattccattacggatgtgtgctattcggaaaatgcgcgaatgtttgtcacgggaagtcgtgatgggaatgtaaaagtttgggacggagtttccaatcgatgcattgagacttttacccgcgcgcatgacggagccccgatttgcagtgctcagttcactcgtaatggaaagtacgttctcacagtaggaatggacagtgtgcccaaattatgggaattgtccaccaatcgctgtttgatcgct

SEQ ID NO: 49420 - DNA, 534 bp, Heterodera glycines
  SCN-specific regions: Sequence locations=1-326,349-508,530-534
gttttcgccaagtgttctttagacataacgaatttacactgtcactaaaaatgcacatttcctttgtttctcgacaagcgactgcctttttgggtgttgccagtagaaatgcattgccacgagtcgccgcagaagcaccgcctgctccgcttacatatcttagcgaggacgaagtcgcacttaagcaatcggttaaacagttttctgagagtgtcatacgaccgcttgtgaaagaaatggatctgaaatcggagatggacaggcgagtgatcgaaggcgtatttgcaaatgggcttatgggcatcgaaatagcagagaagtttggcggttccgagtccagcttcttcaatgtggctttaaccgtagaagaattggcaaaagtcgacccatcggttgcggttttggtcgatgttcaaaatactttagttgcaccattgattatagaaaatggaacggaagagcaaaaacagaagtatttgacactaattgtgaaagattggattggtgccttttgcctttctgaagctgggagtg

SEQ ID NO: 49421 - DNA, 202 bp, Heterodera glycines
  SCN-specific regions: Sequence locations=1-46,88-136,159-202
gtgcgacgaagaagttgctgctctcggggtggacaatgggcccggaatgtgcaaggccggtttcgcgggcgatgacgcgccccgcgcggtgtttccgatcattgcgggccggccccggcatctcggcgtcatggacggtatgggacagaatgactccttcctgcgagactatgcgcgatccaatagtggtattctgatcctg

SEQ ID NO: 49422 - DNA, 573 bp, Heterodera glycines
  SCN-specific regions: Sequence locations=1-303,325-346,563-573
gtcctgatgcgcgtcttgacgtacaaagtttgatcgcattgatcaactcgggtaaatattgatcataggccccaaactcaaaaatgcttaaaaacagtcagaatcgatgtaaaaaggtttgaaatgggttggaaaaatagaattaggggcgcgcttgccctttttcaggatgaaaagtgccgaaaatggagtgccaaactcagctgggactcaagtgaccgtgctatataaagcactcaaaagttcattgtgggccgcccccgtcatcagggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgcgtgtcgcccccgaggagcacccggtgctgctcacagaggccccgctgaacccgaaggccaacagagaaaagatgacccaaatcatgttcgagacgttcaacacgccggccatgtacgtgggcatccaggccggggtgcccctg

SEQ ID NO: 49423 - DNA, 229 bp, Heterodera glycines
  SCN-specific regions: Sequence locations=1-229
aagcatttacaactcgaacaaatgctaccggcaaccgtcggacgcggaacgcgtccaaaaacgaacttcgatgcctctttatgatttcgacaactatttgtttgaccatttgccagagacttgacattggcgcgatgatgacgcaatcaactacgcgtccactgatcgcaaccaacacattcctcaatattgtgcctcatgctggccaatgcgtgtcacttcttcactg

SEQ ID NO: 49424 - DNA, 504 bp, Heterodera glycines
  SCN-specific regions: Sequence locations=1-20,42-280,305-504
ggttgtttcaattattgttaatttaaaaaatcaaaagaaagttccaacatgaaagacgtgctcattctgcacaacattaatcagattgttcaagtggtggacgatgatcggactttttgtttattgggtgatcaaatggggaaaatcaaaataatggaatcagatggccacgaattggccattctttgcatcgaaggacgaattgagcaaattggcatttttgaagagatttcttcccgattcatctctaaagaattgaccgatgtgacgagggtggactgtgggggagggagtgttctgccgggcatggcggacgcccattcccacccggtgttctctggcgatcgggtgcatgaatttgcgatgaaactcgctggcgccacttatatggaagtgcaagcagccgggggcggaattcccttcacagcggaaaagacgcgcgaaagcaccgaagagcaattgctggaggactttttggacattgctcgggaaatgctcccgtcc

SEQ ID NO: 49425 - DNA, 539 bp, Heterodera glycines
  SCN-specific regions: Sequence locations=1-186,208-539
cccgcgtcagcgtcactcattaccatccgatgtggccacccactgacccggccgttcaatgccccaagcactggttggaaaatgtgctgttcatcaacagtttgacagacaacaggtgccttccgtggacatggtatatcggcactgaattcatcttctacttgctctcccccgtgtttctactcgcccttcgccattctgctctttacggcctttctctggtgggcctcgtctccgccgcgtcggcgcttgccaatttgatcataatgctccaatataatttccctcccactcaaatgttgtggaaacagccgtcaaatttttctcccgactttatcaaacaccatttggtcatttacatcaagccatggtaccgcattggtccttacttggtcggcctcgtgcttggctatgttttggcggtgcattccgtgtccccacagcgaaagcgttcggacggaacgcactccgcccgttttgtttgggtcggatgggcaactgcgggctgtgccggcttttggtcggtgttcgggctatac

SEQ ID NO: 49426 - DNA, 364 bp, Heterodera glycines
  SCN-specific regions: Sequence locations=1-364
accaaaaccatccggcatgcgggcgacgaaagcggggaagacccccaaagaggcgcgaacgggcgacaggaaaaggagtaaggctcgcaaggagtcgtactccgagtacatctaccgcatgctgaagtgggttcacccggacaccggcatctcctccgaggcgatggccgtcatgtactcgttcgtcaacgacgctgtcgagcgcgttgtcgcgggagcctctcgactggtccactacaacaagcgatccaccatctcttagtgcgaaatccaaacggccgtccgtctgattctgcctggcgagttggacagggactccgcgtccgacgggaccatagcagcgacgaagtaccgcccgtcaaag

SEQ ID NO: 49427 - DNA, 334 bp, Heterodera glycines
  SCN-specific regions: Sequence locations=1-334
accatcttatccgttggcttctctctatgtcggcgatcttcatccggatgtcactgaggccatgctctttgagcgggtcagcaatgctggtcctgtgctctccattcgtgtttgacgtgatgcaattactcagctcggttcgacttggatatgcctatgttgaattttcaacaaccgcgcggatgctgaacgtgccttttggacaaccaatgaacttttgacctgaatcctggaacaaagcccaatttcgcctttatggggataggcacggcggaatactaagcaatccctgcccattggggggggcctggggaaaaacctttttttcaaaaaa

SEQ ID NO: 49428 - DNA, 262 bp, Heterodera glycines
  SCN-specific regions: Sequence locations=32-162,239-262
tgatcagccaaagatgccggaaagcgaacaccacttccatgaggaggcgcccaacgcctccatggagaccaaagtggcgggcggtggcgcggtgccgaagcgagtcgggtgctggacgttgtcatggctgcgccagatggttagcatcatcacgtcccaggacggttggaacaagggagactcgcagaagttgatgaccaactttggtacgccgcgtaacaccaccaccaaagtcaaagtggagaatctggccgagattcca

SEQ ID NO: 49429 - DNA, 412 bp, Heterodera glycines
  SCN-specific regions: Sequence locations=1-412
taccacggacaagacggtgtttgtggtgtcattacgaattgacaacaatctgtgccactttcgcctgaaacgagaaggccgtctgtttatggtcgctcagcgaaccttcgaaacgctgtgccatttggaggacttttacgcgtccactccgttcgtccgtggcgtttccctaaaatttccggtcaatgagcaaacgatcagccaatacactgatcagaatgatggccaactgcacttggactgtttttacattgacttgaacaacctggacaaagagcttctcgttgaaacaatcgaatccttcgatggcatcatcgacgattgccaaatgtcgaaaaatgatcagctgaaagtgtttcctccgctcagttttcctatcggtacccaaatcactttgctgtccatggaccaa

SEQ ID NO: 49430 - DNA, 649 bp, Heterodera glycines
  SCN-specific regions: Sequence locations=1-166,210-649
agtttgagatggacttcgaagtgtgttcaacatcgagtggtgatgaatttgtggatcttgatctggaattttcgtccgctgatgaatcgatccatgattttggtgatagtagcatggacaaaaaaccactggagagacttttgagggaaattgaatcggagagtcaaaaggaagtcgaagatgctgacaaagtggcctatcggagggttgggcttcccaacgtcgggccaactgcgcaaccgaagacactttttcccgtttgggtgactgagtcgaaaagattttcggcccaaattggtggtgatactgacaatgagcaaaaaggcattggcttgcgactggacaacctcagaccggaatttttacacgtccttcaaaagtccataagcttttggttccctgttcaacgatttgttcttccgactctgcttcaaatggccaattccgtcctgcccccacgcgatttggtcatttgctcaccaaccggcagtggaaagactctttgctatgtgctgcccattttaaatgctttgcgaatttgccccttttcgacttcgtcagtttttgctttggttgttgctcccgtcaggaatttggctgaacaaatatttaaagaatttgaaaaactgaatctcttcggtgctgccat

SEQ ID NO: 49431 - DNA, 656 bp, Heterodera glycines
  SCN-specific regions: Sequence locations=1-276,298-401,423-656
ttgagatatgagtcgtcaacagagggacagcagtagttcaaggtctagtgactcatggtcaaggaaatcaagatcgagatccagagcaagctcaccttctcgttctagcagttctccgcacgaccgtgattggaggtttagaagcaggagtggagaaaggaataaacggcgatgcagacacagccgacagtcaccacctcctagaaaaagggaacgaagccgaactccgttctcacgccgacgtttttctaacgaaactaagccttcaaataaagttatcttgacctcgttgccaaattatgctgacaaagatgcgttgaacattttgctggcaaagcagggatttcatcccatcgatattagagttgttaggcgtaacaccgacagcggctccgttcgaatttttggttttgttgaattttcggatgttgaaacagcggaggattggatacgtcataaccaaggctttctcaaaatggacgatggttttcaagtacgcttggagtattcacgtgaagagttgaaccgagaaaggccgatttataatcccctaacatcggattggacatgttccaagtgcactatcaacaacttcaaccggcgcacaaattgttttaaatgcggtacatctagaaaggactcagaagcgcttgatg

SEQ ID NO: 49432 - DNA, 650 bp, Heterodera glycines
  SCN-specific regions: Sequence locations=1-298,337-650
atttatttaaaatgtcttcgcataatacttcagttattgatgaaaatcgacgatggagtgacttacgctgtttaacagatagggcgtctacatttgccaattcaggattcgtccctggaatcaagaatttgaaagaagttcataaaatgccggtgctagttgttggtgctggtgggcttggctgtgaaatccttaaagacttggctttatctggtttccatgacattcatattattgatatggacattaatcgatctctcaaatttaaaccgacaatttctctttcggttttgatctctattattattattattgtgtgtatttattattattattgtgtgtattttttttagtgaaaatgacattggacgctcaaaagctgaggtggcggctgcctttatcgagaaaagggtgtttggctgtaaagttactccgtatgattgtttttatcttttctaatttgaacctggactaattttaaaccagtattgcttgaccaaatccaggttgccgaaaaatggctagctggacctgtatgaaaaattcagccataattgcaaaatccaggacaaatctctcgaattttatcgtaaatttttcattattatttgcggacttgactccattgaagctcgccgttggcttaatgc

SEQ ID NO: 49433 - DNA, 645 bp, Heterodera glycines
  SCN-specific regions: Sequence locations=1-228,250-303,325-600,622-645
attttattttttcccacgaattgttcattctcagaattccgaaagtaagtaaaaatatatgtattcatttagggaaattcgtcagcacatcaccaagcgacagtgaatagtgtggggacagtggcgagtggacaaatgaagccatccgtgaaggatctactggaccgggtgttggacgagtacaaccatttgcagcagcaattgcacaatgttcgggttgagctggagaagagccaacaggagagggacacgctgcaccgatactcactgatgtactccgaaacgtttttcactctcaacttcgaaatgctaaaacatggtgaaattgttaaacgtctcagcggcatcctttcgcatgtcatccctctccttccccaagaacaccaagcaccggcagttcaggcgattgagcgtgccaagaccatcaaccaacaagatgttacttcgattgtcaacggccaagtacagcagcagcagcaatttgcttcgattctgcccgggcttggttccatgatgaatccgacggcatttgggaatccgatgggggcgatgatgggcatcaaaccggaagacgcgatacaggcggcggctatgttcaacaatttgttaaaaaacccaatgcttggtgccaccgcggctggactt

SEQ ID NO: 49434 - DNA, 625 bp, Heterodera glycines
  SCN-specific regions: Sequence locations=1-625
gccaaattatatggaaatcaagacaactttcgtgtgaaaaaagttctaattgcggccaaattgtccgggaaggatattaaggcgattcctcagcttcctccaacaaatctcttcccattgggacaagcacccgctttcgatgatggaaaagtgtgtcttttcggtgccgaggcaatttccaaatatcttttgggcactggttcaatttatttgccacagaacccggaattggaccaatggattgggtaattgctttgtgtttttgccttctttttttaccatttttacttttagttggactgcttcttctttgcaaccaaatgtcctttcctatgttttgccttgcgtttccgctgccaaaattgaccaaaatgctttagagacggcaaagaatgaattgcttgcccaactttctctcttcgaccaaattctccttcccaaaacttttctcgttggcgagcgtttgtcccttgcggacatttccgttgcgattgatcttctgccggcttatcaatacgttttgggagaagaagctcgcaaaggccttgtgaatgttaaccgatggtttcaaacggtggtcagtcaaccaggaatcagagaagtgctcggggagttcagcttcatc

SEQ ID NO: 49435 - DNA, 659 bp, Heterodera glycines
  SCN-specific regions: Sequence locations=1-629,654-659
agggaagcaatgtcttcaacattggaaatgctctcgcggccttttctggcgcagttcaaggccccgtttcgcgtggacgtgttcagcaagtcaaagtgcccaagaaaatgtccttcaagccattgtctcgcgcactcgccgagcccgactttatgatttgggactttgccaagttcgacgaacctgcacaacttcacgccctttggcaggctttgtacagttttgaggagatgaaaaactacagccctttgccccgttccgatgccgacgcaaaattgttaaaggaaatgctgccaaaagatgcgcccgaaatgccggactcactgctcttaaacttctcttaccaggcgtgcggaaatctccaacccatcgcttcgctcatcagcggtttggtggcccaagaggcgatgaaggcagtgacgcaccacacgactcccctcaagcagtttctgtacaccgattctcttgaggcgttgccgggcgcagattcgacctttgacgccgccaagttggagaagaacgattgtgcaccgcgcaacaatcgctacgacggacaggcggcagttttcgggtgggcctttcaagaggcgctgcagcaacagaaatggttcattgttggcgccggagcgattggctgtgagctgctgaagaacatggcg

SEQ ID NO: 49436 - DNA, 661 bp, Heterodera glycines
  SCN-specific regions: Sequence locations=1-30,54-114,147-237,270 -491,548-661
gaaccggtgcctcctccgagcgaatgagtgagctgaaagccttgcagacagtcgcacccctccgcctccttccgcacaacgtccaacacattgtccaccaattcggctccctcggtgtaatggcccttggcccagttgttgcccgctccgctttgtccgaacacgaagttgtcgggacggaaaagctgaccgtaaggtccggcacggattgagtccattgtgcccggctcgaggtccacaagcacagcgcggggcacgtacttgccacctaaattcgaagaaaaaagtatgcattacaaaataacattataattagtaaccataggcctcgttatagtagacattaatccgttcaagttggaggtccgtgtcgcctttgtaagttccgtccggttgaattccatgctcatcagaaatcacttcccagaactgaagtctgttgtgtgaaagacaatttccaaaacaataaattaacctttgaaccgacctgatttccacattgaccagcttgaatatggacaatttcacgcatttttaaaataatttgtatttattctaaagacaaatgtggaagtaatatgagaactcaaaaaataaaaaggaagaacgcaggatatgaaatatttggaggaaggaaccaggaaacaatatttatcatttt

SEQ ID NO: 49437 - DNA, 646 bp, Heterodera glycines
  SCN-specific regions: Sequence locations=1-392,414-646
cattggccaattatggtcaattagcagcctaatttcacaatgattaggtgtataaaacggcaccgccgcgctttcattgtgaggcgggcacaattgaaatgccaagggaaatccccgcaagcggcgaaatggtgctgacgctgaggacggacgcatgtacgggttcaacaacggaagtgaactttttggagcatgtgcaggccatcgtgtcgctgaacagctcgcgtcgggtagacacgacgctgtgggggagggaacggtcaaaggcaccgcttggacaaatgctttaggtacctcatctcgcccgccggcactccttcgatgattctctcgagaaggcctaaggacgacgatgccaaagacggattcaccaattggccatttatgacaactcacacgtggggagagaaccctcgcgggcgttggcgtttggtggtgcgcttccaaccaggcaaatcgacgccgaagggccataaataccgagggacgctgaaaaagttcacgctgatgctgcacggcacaaaggagccgccttatcgcggcattgagcccctgcagggacacgccaattccaagctgagtgtggtgcaaagtgcgcacaaacggatggcaaacaggcgatgatggcacgacagacgaatggacg

SEQ ID NO: 49438 - DNA, 208 bp, Heterodera glycines
  SCN-specific regions: Sequence locations=1-63,85-169,191-208
aaacaagaagagcggtggattcaacactaagaactttttgttggacctcatatccttcggaactgctgctgcaatctcaaaaaccgctgttgcacccatctagtgtgtccagctgttgatgcacgtgcaagatgcttgcattcacatctccgacgactggccctacaaaagcatcctccatatcctcatacgggtctcccaggagcac

SEQ ID NO: 49439 - DNA, 541 bp, Heterodera glycines
  SCN-specific regions: Sequence locations=1-103,127-541
atttaattattcttcccggttatttttagtaatccaatttttaaaattgtataagctttttaagatggcccgtcgctatgatactcgtacgacaatcttctctccagaaggccgtctctaccaagttgaatatgcaatggaagcaattggtcaggctgggacttgtcttggaattcgagctcccgatggcattttcattgctgcacaaaaactaacggcaaacaaattgcttgatgatcgagtgttaaatacaagtcatttgaagcagatcattgcaacagttgctttaaaattttactgaaatccaagcgggaggcgcctttttagtttacagaattttttgtcacaataagtcaaaatttattttcggtaattccgtggtctctttatcaccttccattatttttgaacgaaattaaaaaaaaaactgcaactagtggcgcgaattttaattataattatactttgtattttcagatcatgagcgagaaaatctaccaggtgtcggcgaacatcttctgcacggtggcggggatcacca

SEQ ID NO: 49440 - DNA, 648 bp, Heterodera glycines
  SCN-specific regions: Sequence locations=1-409,431-648
gttattaagctgcactcatcccgaatttccatacaaacaacaggatataactgcatattcttcgacattgccaaacgtgctttacgcgggtgttgatccaacagctgacagccttcaccttgggaatctcctcgtgctcaattccctgattagagcttccttttttggttgttctcctattttattaattggaaaagcaacagcttccgtcggagatccgagcgggcacaaaagagacaggatattgttattacatgaatttatctatgcgaattcaaaggcgttgcaaatacaggtggagaaaataaaggcgaatgtttcatcattgtatggggaagacatttctctcgaaattcgaaataatgcagaatggtataaagaggtgagtttggctcgtgggtctcttaattttcagctttttattagatgcggattttggactttttcgaatcaacaaaaagatttcgcatgagtgacatgctgaagagtgggccgatcaagtctcgtttagacgactgtgaaacattgtcctacgctgaattttcctaccaaactttacaagcaattgactggctaaaactttacgaagaaagaggctgtctttgtcaaattggcggaactgatcaatttggaaatatgagagccggt

SEQ ID NO: 49441 - DNA, 433 bp, Heterodera glycines
  SCN-specific regions: Sequence locations=1-433
gataccctccgccatcccattacgttcaattagtacgacttgtaccgcgcgtaatagcatctcacaatcccactctggaaccggaggaaccgcaactttctctatttgcattcttccacgcctccataacaatgcacccgatgtcccaggacttctaatagcacccactcattatttaggcgcacatatacgacttgatattgatgcacttggcgagtgaccgccgatcaagtatcacgctcgcatcttggcgacgagtgagcccgactaccaacgcaccttggagcgcaccgatcccgtgatcaacggaactccgggactagacgatgaattgatcctcctcggagccctcttgaattactatatagtcatgtttgtgcttgactaggctcacgagatgtcctaccacgaggtcaatcacaaactctacgac

SEQ ID NO: 49442 - DNA, 523 bp, Heterodera glycines
  SCN-specific regions: Sequence locations=1-523
gttctctgtccactactgattcgaggcgacgctccagtacaaaacgctgacatttgactggctgcacctcggcgttgacgagctgaaaatggccagctgcgacaaggagaacatccggacggagtccttcgacctggtgctgaccaacgcgcactcgaaacgcgaatgtgcagtgggcgaattggagccgcgctattcggctgtggttgtgccgccaattccgcgccttgatgcgcaaaaattgcccaaagtgcgtgatacctttactaacggaattggctgaagacacttgtcgacctaccagctgaacagcgcccactgctacattaacccggaggactttgccggaatgagcgaagaacatctgctggtacgcatcacaagagtgtctccggataactacagctcgacaaattatcacgcgacgcaccggctgtataatgacgggcccctccgccagtcacgtacgtgatgctaccgttgcggccagtccgggcgttggtacaaaggctgtacactgcta

SEQ ID NO: 49443 - DNA, 509 bp, Heterodera glycines
  SCN-specific regions: Sequence locations=1-509
gaaatggcccactgatgatggaattggccacttaccggtactacggtcactccatgtcggaccccgggacgagttaccgtactcgggatgagatacaggaagtgcggaagagcagggaccccatcaccagcttcaaagatcgcattgtcacggcgggacttgtcactgtttgaggaattaaaggacattgacaagaaagtgcgtcaggaggtggacgaggcggtcaaagtcgcactttcagacgaagttttacctccggaagcgctcttctccgatttgtatgccaacactccgccgcttgcggtgcgcgggacgactgccgacgcaaccgtcacacagccatttgtgagcacggcggaagtgttgagaaaaatggggagggagccgaagaattattgagagaacgaatagccaaagacgcattgatagttaggagaagcacagaataattaattgtttcattatatttattcgaagcaaactctcagaggaagaaagagattcctttt

SEQ ID NO: 49444 - DNA, 590 bp, Heterodera glycines
  SCN-specific regions: Sequence locations=1-590
tgctgatcaacgtcatccgcacattgaccacgacggtatcaaatgatcagcgccaattggagaagcagcgaattgagcacggctacaaacagtcggaacagaacattgacaaactgctgaaagaacaccgatcggatgctctccattgtctgaacactttccaatcggtgtccaaggagttgacgagttgtcgagaacaaatccggaacatcaagagttccctgtccctttgcaagtcttttcttcagtgtcgccgcgacgatttgaacaaattttggctcgaaaatgctcaacagaaaaaggtgtgcgacattctgcagcaaattcagcaaataaaagaaactgagaaaaacatcgatgtccaattggccagcggagaatacaaagaagtgattcgagtgcttaaggatgccgatgttttgctgaaaggaccatttgagaaaatggatggcatcagtcaactgaaatttgtcgtctccgaaaatctgcagaaagtttttggccaaattgtcaccgaccttctccaatgtacttttgatgaaccctttgaaattcagactttggaagcggtgaaaagtggaaaattgatc

SEQ ID NO: 49445 - DNA, 663 bp, Heterodera glycines
  SCN-specific regions: Sequence locations=1-228,263-279,303-456,487 -540,563-663
ctgcgatccaacgaagtgaacacgtcgacgactttgcaagagcttggttttggaccggacgaggacgacgatttgcacaatgccagtcacttttcacaaccgactccggcgaatgcgatggctgccagtgccagcgcgggttacgatattccgcagcgtttgaaaacgctccacaatttggtcattcaatacgctgcccaggggcgttacgaagttgccgttccgttgtgcaagcaggccctggaggacctggagaagaacaacggccacgaccaccccgacgttgccaccatgctgaacattctcgcattggtttatcgtgaccagcgcaagtacaaagaggctgccgccctcctcaacgaggccttggccattcgcgagcgatgcctcggcgaggaccacccggcggttgccgcaactctgaacaatttggccgtcctttatgggaagaggggcaagtacaaagaggcggagccactttgcaagagagcgttggaaatccgagagaaagttttgggcaacgaccatcccgacgtggccaaacagctgaacaacctggccttgatttgtcaaaaccaggggatgtacgatgaagttgaaaaatattatcgtcgagcgctggaaatttacgagtcgaaattgggaccggacgattcgaatgtg

SEQ ID NO: 49446 - DNA, 654 bp, Heterodera glycines
  SCN-specific regions: Sequence locations=1-654
ctcgcattttgtgccgagcggaagcccgagagagccggttctacttcgaagtgtctgaagtcgcctttccttggctattatcagaagcattgccaagttctgaacgcctgtgacacggaggctgctggcgcggagtgtgtggagactctgcgcacttccaaggcgagcgtttgcgaatgcatcgacgaggcacgcgacgacctgaagcgacggatcgccggcatcgcggaggccattcaggaagcggtgcagggcgggtcgcgggcggcgccatccatcgggtcgaactcgaaagtggaccaatgcgtggccaacatcaagaaacagctcataactccaacaaatgattgggcttccaccattgacaatgcactgaacaattgcatcaagaataagccgagctcccaaaacttaggcatcgattcgttgcttaatgtcggctgtcgaaagattatcgccgattcctccggcgccgctcaagcacagatcaaaaccggattcgagttcgtcaacaacttgatcgacgcgatggtggaacggtcgcgtcgcttttgcggaggcgcccattgcggcaattaattgggcggatgagttggaagggaagaagatggatgggaaggcgcactccactccttcagagaatggaagaaagag

SEQ ID NO: 49447 - DNA, 302 bp, Heterodera glycines
  SCN-specific regions: Sequence locations=1-32,56-302
atgtctttggtgtggcgcacatttttgcgtctttcaatgacacttttgttcatgtgaccgatttgtctggacgtgaaaccattgtcaaaatcaccggtggaatgcgtgttaaggccgaccgagacgaggcaagtccgtacgctgctatgctccccgcgcaggatgttgctttaccgttgtagcagggttgcattaatgctcttcatgtccaattgcgtgcaaccggtgggaacaaaaaccaaaacgcgcgggcctggtggtcaagcagcgcctgcctgcccctccttcgttcgggtttgaag

SEQ ID NO: 49448 - DNA, 639 bp, Heterodera glycines
  SCN-specific regions: Sequence locations=1-447,469-639
cgatgctgaagcgtccgctgatcaatctcaatcttgagaaatggaaaacttacgtacagtcgtcgccacgcaattattcgatgattgtcatgttcactgtgctttctgcgagcatgaattgccccatttgcaagccagcttatgaagagtatctgatactggccaattcctaccgttacacctttctcaactcgaaatcgctttattttgcactggtcgattatgaggaagcgccgcaggttttcaatttgctcaatttgaacacggctcctgcaatttatcattttccagcaaagggagcgcgacgcaatcaggatacaatggacttccaacggatgggcattgacgcggacgcaatggccaagtttgttcaggacagaacggacatccaaattcgagtccttcgtcctccgaattatgctgcgcctgtggttgtgctgctgctcgtcatgttggtgctcggcctcctctacatgcgtcgtaataacctcgagtttctcttcaatcgcactttttgggccttggtttgcgtgggcatcgtattcgcgttcatgagtggtcagatgtggaaccacatccgtggcccgccctttgtgatgactcacccccaaacgcgtgaaacttcgctggtccacggca

SEQ ID NO: 49449 - DNA, 657 bp, Heterodera glycines
  SCN-specific regions: Sequence locations=1-250,273-426,448-544,569 -599,621-657
gaaaagtgccacggttgcacgacaaagcagtgcttgtcaaaagtggcaccaaatttgtggacggtcggaagcaggagttcgttgtgggcaaagagattggacagggcggattcggacggatatacgagggcgttcagagcggttctcgtcatgccgtggccatcaaaatggagccgccgtccaatgggccgttgttcaccgaaatgcacgtgtacatgcgcgtgctgaagcctgaacacttggacaaatggaagaaggacaaagggcttaaattcctcggcttgccccacttcatcagcaacggctccttcacttacgaaggccaacaaattcgctacttggtcatcccaaagttcgccctttccttggaatccgtccgcgcggcgcgcactccgtcggcggtgctcagttggaccgaagtgtccgccgtggccaaaacggtggtgcacgcgttggcgtacctccacgaccagaattatgtgcacggcgatgtgaaggcggccaatctgatgatggagtccaaaagtgatttttcccgggtcgtgctcatcgacttcggcctggccaggcgattgcccgacgcactggtggagaaagagaacaaaaagcaagctcacaacggcactccgctgttcacttcctgcgacgcccaccgcg

SEQ ID NO: 49450 - DNA, 331 bp, Heterodera glycines
  SCN-specific regions: Sequence locations=1-331
aatgactggggggaagcgaatccccgcttccggagtccctatgttcgaaatgggaccgccggttacccatactaacattggtcctaaccacattcatttggtccgtcgcctcgacggcgacattacatgtaccgaacttcttcttgataccggagactttacttcgccttctaaacgctgcgctcacaccacgcgcttcatcttccctatctacaacgcttccaacagacacttggtgcgcaccggaacttctaaccagggcatgatcctctcaatcgatggcactcccttccgcccatggtatcaagcgcagtacgcactgccattgagc

SEQ ID NO: 49451 - DNA, 648 bp, Heterodera glycines
  SCN-specific regions: Sequence locations=1-465,487-505,527-648
atcaattccatctccacttcgtcgccatggtatccccaaggaggaaaaagtggcgccgttttttcccgcactgacgacgaacgctttgtgctgaaaacgttaaaccgtttcgagttggacgcgttcaaacaaagcgcactcaaatacatcgattacatttcgatggcactgatggagggcaaactgaccgcgctttgcaaaatttttggtgctttttccgtaaattgcactaataaacagacgggccattcggtgaagagtgatctgatcgtcatggaatttctgttctacaggaaggacatcaaacagatttgggacctcaaagggtcactaaggaatcggctcgcctccacaaaaaatgacaacaacggcgcctcttccgtgctattggacgagaactacattcagaacatgtggcggaaccaaatttatattacaactcattcgaagacggcactgagtcaggcgatcatcaacgacagccacttcctggccgaccagggcatcatggactacagtctgttggccggaatatgtcggggggaggaggacgaagtgatcgtcggcatcgtggactatatgaggacattcacttttgacaaaaaagtcgaaagtgccatcaaaaatgccattcctctaaccaattcg

SEQ ID NO: 49452 - DNA, 586 bp, Heterodera glycines
  SCN-specific regions: Sequence locations=1-113,136-160,182-281,323-586
ggctgactttgacaaacacgctgcccaacgcgaggcagagtctctccgcactttggccttcttcggagtgtgcctgtccaccgtggccacggctatcaatgtgatttccgtgacgttcgcctaccagcacttccagcagcttggcacccaaatgcagaacgaagtggacttctgcaaaatgtgctccggcaacatgtggtgtgaggtcaccctcacccagacatactccaaggtgtggcccgacagcagtcacaagcgtcaggcaagaggttgctgtggctgcagagtgtctccgccgggcccgcccggaccccctggcccatcaggacaacccggctgaaaccgacaacccggaggctcatgacagcccggatcaccaggccaggaatctcctctcccgtacccgcccagcggaagacgcgtgccgcactgtgaggccgcccagccgggactccccggcccgccaggaccacccggaccctatggagacaacggccaacccggacagtttggaccggatagatctcctgaaaggcaaagggcccagggagctccaggacacgatggacagactgctcaccccgga

SEQ ID NO: 49453 - DNA, 502 bp, Heterodera glycines
  misc_feature (390)..(390): n is a, c, g, or t
  SCN-specific regions: Sequence locations=1-502
caaaccactgcagattgaggaatatgataccagcgacgaacaggatttacgcaacacaaatggcaatattccggtacaatggtacaacgactacgaccatgatggatacacatcaagtggcgataaaaacgaaaaacaggccagtatattttacgaaagcgacgcgtctttaccaaaagaggaagactcttactatcgccgtaaggtcctcgaccgacagtcaggacagcaaatggcactcactgaccaacaggtggaaaaactgaatgccatcgcgcacaaccggttcccggaaataaggtacaatacctaccctcctatattggacattttcccctccgaacgcgagattcgcccaatttccaacacgaccccccgagaaacactctntcggtccctaggggcgatgaacgtcggaatgacggccgaatggtccccggcattaaaatggggctgggtaaaaaaagaaagaaacccccccaaacggtcaaagaaccaggaa

SEQ ID NO: 49454 - DNA, 331 bp, Heterodera glycines
  SCN-specific regions: Sequence locations=1-331
gcctcccccaccgatggccaaaccggggcgtattcggatgttccgctcgcttaagcaattcgtgccgaccaaggctggtgagttaaaattgtacggggaggacattgtctatgtgaaggaagcgcctgacgggactacaagttgcgaatccaaaagtgccacggggtacaccgaatgaattctgcctaagcaattcgttgaacaacacatggaactcatcgaatttccattacacggggcggcgatggccggagatttgagctttttgagggagtgtatggactacaagatgtgcgtctatgggttggacaggtccagctccaccgcgttg

SEQ ID NO: 49455 - DNA, 652 bp, Heterodera glycines
  SCN-specific regions: Sequence locations=1-165,189-404,427-652
ctgattcccatttattataacttaattaaagtcaatttgttgtaaattactgattttcaaaacactgatatgagcaccactttgcaaccataccttgatgcggttcgtcggtccctggaggcggcactctgtcttcagcagtttggttcacaagttgttgaacggcacaacaaaccagaggttgaagttcggaccagcaaagagctgctgttgacgccggtgatggtgtgtcgcaataaacaggaagccgttctgattgagccgtccataaattcggtccggatgagcatcagagtcaaacaggcggatgaaattgagaaaattctgtgcaacaaattcacgaggtttatgtgccaacgcgctgacaatttcatcattttgaggcgcaaaccaatgcccggctttgacatcagttttctgatcaccgcaacacatacccaagtcatgtacaagcacaagttgatcgactttctcatccattttatgcaagagattgacaaggaaattagcgaaatgaaattggcactgaacgccagggcgcgaacatcggctgaggagttcctgaagcggttcaactaaattattcagcttgaaataatatgcatgatagtatgagggtagccgggctctgtttttcaactggttaggcttc

SEQ ID NO: 49456 - DNA, 650 bp, Heterodera glycines
  SCN-specific regions: Sequence locations=1-296,321-650
ctcatttgccctgcatttacctctgcgagttttgtttgacctatctcaagagtcagtcggcactcgccagacacgttaaaaaatgcaacttatattacccgcctggaaacgaaatttaccggaaagattcaatttcattttatgagattgacggtcggaaaaataagatttatgctcaaaatttgtgtctgctggcaaagctttttttggaccacaaaacactttattacgacacggaccctttcctgttttacgtgttgaccgaatacgaccagaagggctttcatatcgtaggatacttctccaaggaaaaagagtctgccgaggagtataacgtcgcctgcattttggtgttgccaccctatcaaaaacgcgggtacggccgtttgttgattgaattcagttacgaactttcgaagattgagggcaggacaggatctccagaaaagcctctttctgacctcggattgctttcttaccgctcttattgattccaaacaatccttgagacaatgcctaaaattgtgagccaacaaggacggcccatttcgtcccagggcgaggacggcaaggaggaagaagacacgccagtgtcaccggccatcatcgacctttgggaagtgaccagcattcgcaaggaggacgttttg

SEQ ID NO: 49457 - DNA, 208 bp, Heterodera glycines
  SCN-specific regions: Sequence locations=1-208
aacacagctctcccgacaacagctgagctcatccgaggggttgggcgaatactccgcacggcaattgttggagcaacgggaaaagttggaacgggccgaacagaatatggacaccgttcaccacaccactcagcacacacagcgcatcctgaatagctagaagtcgtggttaggtgggctggtcacaaacaaactttcaccatcgccg

SEQ ID NO: 49458 - DNA, 166 bp, Heterodera glycines
  SCN-specific regions: Sequence locations=1-166
agcttactaccttttgtacaaacttctgttgatcggccactgcggaatgggcaaaacttgggttttgtacagattcctcgacgatgcctttaacacatcatttatttccaccattggaattgacttcaaaatcggcacgattgatctgagatggaacaaaatgaaa

SEQ ID NO: 49459 - DNA, 532 bp, Heterodera glycines
  SCN-specific regions: Sequence locations=1-532
agggttggcaagtgtgacattgcgccggatggacaccgtccgctcgcggctggcagccgccggttcactcgtccaattccgtaagcatttgcgccaggcgctgcgccaacgcttggaccgtctgtacagtgacaaaatggcacgcgcagacgtggcatttgacaccgatgccgcggcaagggaaggcattgacgaagtgttgcgcaattacatggatgctcaatattatggtgacatttctattggctctccaccgcaaaacttcaccgtgattttcgacaccggttcctcaaatctttgggtgccgtccaaaaaatgctcatttttcgacctcgcatgccgctaccatagtaaatatgaccacaaaaaatcgtccacctatcagccggacggacgcgaagtggcaattgaatacggtaccggatcaatgaaaggcttcgtctccaaagacacggtttgcattatggacggtatgtgtgtggaaggtcaggaattcgcggaggcgacaagtgaaccaggcgacacttttgta

SEQ ID NO: 49460 - DNA, 561 bp, Heterodera glycines
  SCN-specific regions: Sequence locations=1-561
ctaaaggttcctattgataacccaaatgaacttgaagaaatttacgattcgatcacttacgcaaaatcaaattcaatcattcggatgctcttcaatcatttgggcgaagcgactttccaaaaggccattcgcgattacttgaaaaagcaccaatacgcaaatgcagagaccaacgacctgtggaagagtttgtccgacgcttctgggattgatgtcaaagcactgatgtcaaggcgcttcgcacacgacggaggaggaagggaaactttcctccgccaacttcggctcctgctcgccgccttccaactccgtgatggaatgctcaacaacgacggagcaacggccgggcaccagcgaacacattgacaacgacgaccactgctcatcgccgcccgttaaaccgttgacttatgcgcaagcagcggccaatagaccgagaagaaatactgcgagcaatttggatacaaaatccttccctttttccaacgtcaaatgattgaatttccctataatttctgattttttccatcactgattgctgattgtgagataaacaaatcg

SEQ ID NO: 49461 - DNA, 528 bp, Heterodera glycines
  SCN-specific regions: Sequence locations=1-528
gttctgaccccgccttggaccccgtacttcgcgaacttgacagtctccccgcttttcagtacagacatcagctgaccaaattctacaaaccggagaaggccctgagaaatgtttcgaatttgtcgttgttttgccatttacaattctcagactctccgatcacttggctcctccggcaaagtcgaacagattgaacacgtggtggcccgtctttattttgccatgaaatctgacgaagtgcactgggctctgagcactctttcggcgttgtattggcgggtgaagggcgacccggtgaatgccattaaatgccttcggcactctctgcacaaatcgccaaatatattcaaagtgccatttccaaattttgttcgcaccattttgccttatctaaggacgtccctctgatttcgctggccaacatttaccatcaagctggcttccttcacagtgccctaatcgtcggacgaaaagcattggaagcgggcgtcgacgtggtcgctttgcacttcactttggccaacattt

SEQ ID NO: 49462 - DNA, 225 bp, Heterodera glycines
  SCN-specific regions: Sequence locations=1-123,145-225
catccactcgataccgaacggagactgtgcttcgcgcaaccaaccattgattgggcccctggtgataacccttgcgaagatctggcgtcctgcacgtttttgctgcgctccttgtggagcattccttgaaaatcggaattttttcgagcggctacgaaaggcgtactgtgacagctattacaacgctttcttttcacctcggagttccaactgtaacgggcccat

SEQ ID NO: 49463 - DNA, 651 bp, Heterodera glycines
  SCN-specific regions: Sequence locations=1-255,281-651
gtcgccgcatggctgatgcggcggtcgcctcgggcaattacaaagaggcgcagagggtactcggcgaatcgctgaagattctgcagcgtccgttgccctccggcggaagtgtagacgaatggatgtcgctgaccttttcggtcattcgccacttccttaacggtctttggattggccgatggttcgcgcgccgtcgtcgtccctccgttacgcatcaatcggtgtgccgaagtcatgcggagactgcgctggtttaccaccaactccaccagctgcaccttttggatgtggacggaattagattgagttcacgcggtgcgcttaatttggcactgttggccaccaatttggccgagtcggcgggctccccagccattccccactcattccgtgccgaaatttacctttgtgccgcgctccgttccgtcctgtgcatgcccaagtgtttgcgtcgggtggtcgccgcttatttcttccgccgggcaaagcgtcacctacgaaagagtgccgccctcgagggctgtcgcgtgccgaactccgtccaatgggtgttccatccgctcgcccggcatttcctttcgtgccccgtgcgcgtcggcacaattctctcacaaagcggcgtgcaaaagacgccgaactttcccttctccg

SEQ ID NO: 49464 - DNA, 217 bp, Heterodera glycines
  SCN-specific regions: Sequence locations=1-217
ggccggtatcccaccaggaagactgacggaggagcggatagcctggcgcacagaccacccattcggtttcgtcgcacgacagtgcaaaaaggaggacagcacattggacctgaacaattggatctgtgccattcccgggacctagtcgaccatttgggagggtggcctagtaaaattgcgcatgatcttcgaggacgacttcccatccactccgcca

SEQ ID NO: 49465 - DNA, 635 bp, Heterodera glycines
  SCN-specific regions: Sequence locations=1-635
ttcgcttccgctttattttcttctattttaattttgatgcttcgaaaaaatcaatttgccgaattaaatattcgccacagaggaaattccgagcgaacacttgccacagtgcgacgagcagttcgaatgggatacgaatctgttgcaattaatgttgacataggaaaattcggcaaggaatcggacataatttggtcagacgaagaggacgaagtcgtatcgaagaagagaaaacgtaagaaacagaaaaagttgcacgatcgaaagagtggcgatggcaacgaaaggaccagcgaaagtgaaattgtgcctgatccgtttcttgtagacgagtccaagttggatctatcggcttttgcagttaatgggaagcgatttcgtcagtttagtcgtttgacggtttcaattgatgcggattctattcaccatctccaacacaataaaaaagtaaagctttacgatattattgcggttcgtgtccccgatgaacagattttgatgacattgcaaagaaagggtgacttcgttgacctcgtctcattggatgccacggcgatggaaaagggccgtctgtcgtggctatttaaacaaaaaattgtgcaaagttgcatcgccgccggtctcacttttgagct

SEQ ID NO: 49466 - DNA, 623 bp, Heterodera glycines
  SCN-specific regions: Sequence locations=1-623
caagtttgagatttttacaaaaatacacatttaattgaattggcaaatgtcccttcgcttcttcggtttccacgattcggtcagcgaagggaaatttctgtgggagattctcacgcaactgagagggctcggagttggacggtgtgtgaccaaaagcgaatggatgcgcagatggcctgaccaaccgtcctacatgagaatagtcaaggctcgtccgacgatggaccgttggctgcaggagggaagcctttgggccgattggaccttccgcggcaaacatttgggcgtgtacgaattcggcacggacctgaacaggtccgactgggtgctgatccataagcacgaggagaagaagttcacggagaacaggcagcagatgggcacgctgaacattcccagcactttccctgtgcctcctttgcagcaattgctgtccaaaaaatgggccgagaaatgcggcggctccgaggcggcggtgcaccacaaaaaaagggcgccactggacgtctgtctcgacccgaactttgaaatgtatcgcaaattcatcaaacgggtggagccaaagaaaatgtccgtctcaatttacgacgaaattgaccctggcgtcttcctcgacctgtacg

SEQ ID NO: 49467 - DNA, 647 bp, Heterodera glycines
  SCN-specific regions: Sequence locations=1-647
cgacgacacgtgcaggacaaaacaaggcttttttgtggttacggctccaaagtttttccgggaagtcagccggtttcattggaaggaccgcaggggaacaataacattgagtttctggcccaagagccttatatggtctcgtggaaagccgacggtgtcagatatttggtgttgattgacgggaaataccaagtgtacgcatttgacagggacaacaaccccttcttgatacggagcatggcctttattcgacgcccaagacaaaaaccgctagaagacgatgattttgtccacgacacgcttgttgatgctgaaatggttatcgaccagaatgaaggccaacagatacctcgtctcctaatttacgacctcgtccgatttcaaggagaagatttacgtcaaaagcctttcaatgtgcggtttgagatgatcgaaaatgagctgattcgaccacgaacggaggccttcaaagctggacttttaaaacgggaggaagagccaatcggagtgcggaggaaaggcttttggaacattgagtccacgcggagactcctcgaaccgggctttttgagttgtcacgaagttgacggattagtttttcagccagtgaacggaggttatgtgtctgggagatgtgacaaattatt

SEQ ID NO: 49468 - DNA, 636 bp, Heterodera glycines
  SCN-specific regions: Sequence locations=1-290,315-405,428-601,623-636
actccgccgagggatttgcactcgcatggtctccgattcgtctcggcacacttgcttcaggggacctccacaacagaatatttctttggagaatgtcggagggcggccaatggttggtcgaccaacgtcctttggcagaacaccaaagttctgtcgaagatttggcttggtctccaactgaagaagcacttttaatgtcctgttcggcggaccacacattgcgcctttgggatgtccgagcctcccacaaagattcgtgcgtttgtacggtcaaagaagcgcacaatggcgatgtgaatgtgatcagctggaacagcggcggcgagcctttgatcgtttcggggggagatgacgccaaactcaacatttggtctttgaagacaattcaatacaaccaaccagtggcacaatttcaacaccaccaaaagccgatcagttcggttgaatggaacccgcacgatgggacagtgttcatggcatctggggaagatgaccaaataacactatgggatttagcacttgaagatgacgaattgcatggggaagtcgaggggggagaggagaagacggccccaaatgtcccttctcaactgctatttattcacatgggtcagaaagaagtgaaggaagttcatt

SEQ ID NO: 49469 - DNA, 442 bp, Heterodera glycines
  SCN-specific regions: Sequence locations=1-42,65-442
accaacgagtaaaaaaacgcgaaaggctgtcgaaaaggctgtggacgccaagaagaagctggccaaaggccagcacattgtgcgcaaaacaaacatgcgcacgtatgtgcactttttccggccccggacgctgaagctggctcgttctccgaagtctccacgcatatcgctgccgaaacaaaacaaattgcattcgttttcgatcatcaaacactcattgaccacatatttttttatgaagaaaattgaggacacaaactccttggtgttcatcgtggacgtgagagccaacgaacatcagatcaaaagtgcggtcaacaagctctacaatatcgaagaccagaaggtcaacactttggtcacacccgatcatacaaagcaggcgtatgttcgcttagccgccgattatgatgctttggacgtggccaagcacattggtatt

SEQ ID NO: 49470 - DNA, 466 bp, Heterodera glycines
  SCN-specific regions: Sequence locations=1-33,55-55,128-128,185 -217,317-466
gcaagctgaacgaggccgaggacaatatgaattgtcagatgagtgatgtgacggtaactcttcgcgatggtcgcacccaaacattggataatgtgtttatacgaggctcacagatccgttttttggtccttccggatatgcttaagaacgctccgatgtttaaaaacatcggtcgtgcgcaacgtggtgcccaaggcatgggacagggcggtgcgcctcgcggacgcggcagtgcttttcgtggtggtggtcggggcggcggacgaggccgtggcggatttggacgcggtggtaggggaggcggtggtggcggcggaatgcaattccaaggctgaaagcggacaaatccattgaatcgttggagtgtttgtgctgtccgtttcgatcatttttatttgttttgcacacactttttgttgtttggtctcactgcgattgaatttttttataattaagtgctgacaaa

SEQ ID NO: 49471 - DNA, 640 bp, Heterodera glycines
  SCN-specific regions: Sequence locations=1-232,254-423,445-640
gtttcgcctccagcggatgctccgccgatcgaaattttgcggcattttcaaattcgttgccaatgggtggtcaaagtgagcagcagcattttggagaattggaagtgaaaacggcggagaagacgagcagagacggagaggaaggcaagcggaggacggaggacagacaacaaaaagtgcagagagagcacagggaaaacagagagcagagagagtacagagagcacgcgcttccctttaagggaatggtgggcaacgacccgagctttgagcagatgcgtcaaattgtgtgcgttcagaaactccgtccaccgatggaaacccaatggaatgacggcgccaatcccataatgcattcgctttacgttctgatgacggagtgttggagcgaacattcgctgagcagacacacggcactgaaagtgaaaaaggaattgggggcactgagcgaacaaggcggggacggacgggggaaagagacaaattagcaccgaataaaagtgacaaggaacagcagcagaaagaagaagaaagaagcagaaacagaagagacttttgaaaaaggaaatacccatctttggccttcgagatggcttattcatatgcttctgataaagatttgcgatttaaaaaaaaaaaa

SEQ ID NO: 49472 - DNA, 653 bp, Heterodera glycines
  SCN-specific regions: Sequence locations=1-653
taattatgaatgaagaacaaatttctgctgatgatgctattgtttctgccacaagtgatgacaaattagagtccttttcgaaggaaatggctggtttaataatttctccgcatgatggagtaaaaatacaaccaaaacataaatatgcgattgtttgcggaaagtacgcttattaccattatgggcaacagaatgttgatgacattggttggggttgtgcatatcggtcttttcaaactgtttgttcatggctaaaatttcaaagttacattgatgcgacaaaagcaattccatctcatcaacaaattcagaagtgtctcgttgacatcggtgacaagccgtcaaattttgttggcagtaaaaaatggattggatcattggaattgagcttttgcttggagacaatgttcggcatcaatgccaaaattctttcgtccaaaagtggtgctgatttggcagaacatgcccgggctctcatttatcattttgagaatggcggagcccctgtgatgattggcggtggtcaattggcacacacaattctcggtgttgattataatgtgcggcttggcgattgccaatttttggttttggatccgcattacacgggaacagaaaatttatcggaaatactgaacggaggctggtgtgct

SEQ ID NO: 49473 - DNA, 628 bp, Heterodera glycines
  SCN-specific regions: Sequence locations=1-446,468-569,597-628
gtccaattaagtaggaaatgagttattattatcaacaacagttaaagagacaggcattagccaaaaacgacagaaatccatccatttcacctgagaatcaccaacagcaacaattcatcaacggagacgtgtcagcgaacacgccgaatagttatgtgacgatgacttacaagccgtacttgttaagggaggacggggagcaaaaaataccgctatttctgatcaaactttggaatattgtcgaggacccgtcgcattgggaagtgatccgctgggacgagagtgggctgagcttccacattatgaaaccatatgtgttttgcagcgacattttgccgtattattttaaacacaaaaacatgaacagcctcgtgcgtcaattgaacatgtacggattccggaagaacacacccatcgagcgttcaggtttggcccgtgctgaatcggaccaggaccatttggagttctttcacccgtttttccgtcgagaccaccctgaactgttggcaaacatacatcgcaaagtgccaaactccgccagacagcaagggcaccatccgcttcccacaccgcagcagcaacaacaacaactgcaatttgttgccaatgtttccgatgtcattggtag

SEQ ID NO: 49474 - DNA, 533 bp, Heterodera glycines
  SCN-specific regions: Sequence locations=1-288,310-533
tggaatggcttggctttgtcgaaaaatatgcaaatgtcccttctgtgtgcactttgaatgtatcttcgcttacggataattcctacaacaattggctccaacgcattttggtctccgctacgctttccatggacgtccattccctccacaaatggaacctccgatgtccaattctgttccaagctgagaaagagataaaagtcaaccaacaaactgagaattcggcggaacctgccgttcttctgccaaattcactcactcataaactcattgtttgtaagcaaaacttcaaaccattgcttctcttcagagagatcgacttaaattttgacaaatggaatagaatcattgtttttgtcaacaagaaacaaaccagtcgaaggctctcctctctcatggaaaccttgagcaaaaaaaagctaactgtagccgaattctctgccgatttgttcaaaagccgcagaaaaaaattgttgagagaatttcaaagcggtgcggtccgtgtgctgatcgcttgtgatgtcctttcacgg

SEQ ID NO: 49475 - DNA, 638 bp, Heterodera glycines
  SCN-specific regions: Sequence locations=1-5,39-310,345-443,465 -585,609-638
tcgagtttttttttttttttttttttttttttttttttcattcgctttcctttactcatcaaacaatcaattaaaacaatggacataactttgtctgctcggaaattgctgtcccaggaatctgtcccagccgtccttccatctcttcaaatgtcctcatcatcgtccgggagttcagcgcttgctgcctcggccacttcttgctcgtatttggcagccaaagcgggatccatttgtacttcgggtggagcgagtgccggcatccccacaaattcgaggttggggtcgccgatcagctttcgtgccaaataaaggaagggcttctcgaaattgtagttgctctttgcggaaatgtcgtaatactggagatttttcttgcggtgaaaagtgatgcttttcgccttgactttcctatctttgacatccactttgttccccaccagcacaattgggatgttctcacaaactcggaccaaatcgcggtgccaattcggcacatttttgtatgtgactctggcggtcacgtcgaacatgacaatagcacattggccttggatgtaatacccatcacgaagtccaccaaacttctcctggccgggtgtgtcccaaagttgaatcggatttgacctccgcgaatg

SEQ ID NO: 49476 - DNA, 205 bp, Heterodera glycines
  SCN-specific regions: Sequence locations=1-14,37-205
aagaccacaggcctctgtctctgctacgggtggcggatcatcgacgggcttctgtcgagttgtgatggaattgtttaatgacttcgttcccaagactgccgacatttttccggctgtgtgtcctgtcaatttagggatggacaacagcggcaacccctttctctacgaagggtcgaacttccaccacgtcattcctagtctcttg

SEQ ID NO: 49477 - DNA, 490 bp, Heterodera glycines
  misc_feature (360)..(360): n is a, c, g, or t
  SCN-specific regions: Sequence locations=1-490
ggcattggctctacgcaatgtttgggcacacattttggacgacgaatttcccccactgtccgacctcctcaactactatcctttcctggtcatggacacagaatacccatgcgtgattttgtccccggcgggccatttctgcattttggaggacttcacttctcaacgcctgtggctcgatgtggactgcttgaacctcatcctggacagcttcactttgatgaatgagaagggtcagttgccgcccgcccgtgattttttccacttctctttgcacttaaatacagaccccgattctttcgcgcactattcgttggaactgatcttaactgctggttttgacttctgcatgcacctccnagatggcttcttgttggaggactttggtgagctgctgaccacttccgggctggttgttgagccgcgcatcacctgggtgacctttcacagctgtttcgacttcggctacctcatcagagccattatgctg

SEQ ID NO: 49478 - DNA, 640 bp, Heterodera glycines
  SCN-specific regions: Sequence locations=1-640
gtttgagcctttgcatttttaaatggtattcaatcgtatcaaccccattttccttgcggccggcacttcttcggcagtcgcatttttcatcggttctcaatgctcaaccaaagaatggttgaatttggttgggatcaaaagtgcccatgccgattcttccgttgttgttgcgcctcccattccgtccagtgctgctggacccaaaacgccttacccattgagagtcaatgaggatgatgcgcttggcgctgatgtttggctgaagccgtcccgtgcatcggaaattatgcgctttggctacccgggctttgacaacatacgcgcatacgaagattttgtggtcagctatgaccagcgtaatcgtacagcgcattgggtgatggagcatttgagccccgcgcggatggcatacaacgcggaggtaaaccgaggcaacagcattttcaaggaggacgagtccatccatccgtacttccggtccaagaacgaggattataagcggagtggctacgaccgtggacatttggcggccgcggccaaccatcggaccacacaattggccatggaccagacctttttgctaacaaatatgtcgcctcaagtggggaagggtttcaaccgggacaaatggaacgatttg

SEQ ID NO: 49479 - DNA, 631 bp, Heterodera glycines
  SCN-specific regions: Sequence locations=1-631
attcctattaatcaaattttcctacatttttgggccttccatttgtccacaatgaatgtgcatgaggaagacatcgtggaaatctcacgcaaattgaccaaaatgaccgatggttcgaaatcgatggacgacgccgttgaattggtcactgccctggagaacatgcgggtgaacatcgacctgctcagtaaaactcgcattggcgctgttttgaacgaattccgcaagaaaatcaaagacgaaaaactagcaaaacgttgcaaggcattgatcaagcgttggaaatcgttgctggacgagaagttgagccagcgctccaagtcgccggacgaccgtcagcgttcgtcccaagaaaagtcggcaactccgccgccgacggcgaacgccggcaccaaacagtcgacgatgaacaatggccaaggccaacaatcgaacagaatggcaaccaccacaactgcgataccatcccagcatcaccaacagaccatgacaatgtccaacaacagagcgacggcgggggccggcggcaacgacgttcggggcaaaagtgtgcaaatgttggccaatgcgcttacaagtggtggaatgcctcaaggcgctcttgacgcgacagaagttgccggacgagtgg

SEQ ID NO: 49480 - DNA, 625 bp, Heterodera glycines
  SCN-specific regions: Sequence locations=1-625
gtttaaagggtcacatgctcgatgccacagacgttgactcccaaaaattgcgcatcatcgaatggcaacacttggacttgctcaagttttatccgatggctttggccacttcgtgcgcagtgcgcggctttctctacccgttaaatgttgtcaaagcacggctacaactccagaaacagaacaatgtctattctgggatgagacatgcgtttgtcgacattgttcgaaacgagggaatggtggcactgttcagaggcttttgggtaacaatgcctcaacttggcgtcagtttcatctactccaccatttacgagaaattccgaaatgttcttcatgttaatgccaatattcaatccgcgcccgttgtctctgctttggccggcggattttctagcattttcactcaaataatattcgtccctaccgacatcataagtcagcatatgatgatctacaataatcccgcaaaatttttgggctctgctaaaaatgttgccgttttggacttcctgcgaatggatggaaagtcgggccgtttgacctttgggcttcgaattgttcgagcggtttatcacatcgatggtattcgtggattttaccgtggctttttctcctcacagatgct

SEQ ID NO: 49481 - DNA, 226 bp, Heterodera glycines
  SCN-specific regions: Sequence locations=1-226
cgtgcatggacaccacgcagtctattatgggccgccgattacctatgactaccctcctataccatctcaaccttataaaagagtctataaggaactgaagtacaacttcatcatgcatttgccgatgagcttcgtctttatcatgttttgctgttacgatggctattccactgatgtgctgggacactccgcttggaaacttccgggcagctaccgtaacagaaaa

SEQ ID NO: 49482 - DNA, 418 bp, Heterodera glycines
  SCN-specific regions: Sequence locations=1-346,368-418
atttttcgccgtttcgttgcccccgcacccgttgcgcatcattctcttcgagctcggtgccttcttttggctctgttctctgctcttgtccgccggcgttatcaccatgtaccgccaacatctgttgctggtcgcccttttcttctccattctgttccaaaaagtggcacgagcactcttctatctgttgctgtacaacacccacagcaatttggcccgactgatggccgccgacacgtaccccaccggatcagtgtccaccatgcgcttgctgtactcggcacggctcattttggccattgtcggtggcctcgggatgggcaccgctgccgcactgtatcatctggccaacttgttggccgcctataggaacaacggcattgtgggcctgcctggcgctgtgacagcaaatcgtatc

SEQ ID NO: 49483 - DNA, 370 bp, Heterodera glycines
  SCN-specific regions: Sequence locations=1-240,262-343,365-370
cctggaacgcttcatcaacgacacaacgccgcgctccgtgcaggacctgtgcagcgaattcaccaaactcaacgcagcgccacgaccggagccatcgcctgagtttacacggaacttggaatgcaaccgctaccgagatgtgatctgcacggaaatcaaccgggtgcgactccacagaggacgctacatccacgccaactggatcacgaccttcgacgagaaccgcttcatatgcactcaaggcccgctcgagacgacctgcgacgacttctggacaatgatcgtgcaggagaacatcgaaggcattgtgatgctctgcgacaccatcgaacaaaatcggatcaagtgtcatcagtactggccgaccgtg

SEQ ID NO: 49484 - DNA, 363 bp, Heterodera glycines
  SCN-specific regions: Sequence locations=1-112,136-363
cgtgcttcatgtccgctcgccaacagccaatacgcaacagtccgagaagagaacggcgtgtgtttcctttttatgaaagtggccgaacggagtcatttcccgggcaaactttgggagaaggtgaagctgcacaggaatttggccaaggccgttgaacagatcagcacgcatttgctgcattggagtgaatacgtccgcaaaaagtgcaaagcgcggcttatgcgccaccaccaatgtgtgaacagaatgcggaagatggagctgaggggacgcactgcgaaagtcatcccattgcacaggaaagtcgaagggggggaacgccgcatggaggaagaagcagtggccgcggctaaattggaacaa

SEQ ID NO: 49485 - DNA, 529 bp, Heterodera glycines
  SCN-specific regions: Sequence locations=1-317,339-461,483-529
ccatgaagctaaatacttggaaatgtgtccaccccctatgctgcagacacaggacgaatgtggctccacccatttctcccagaattactacggctagaccaatttcctatctcgagcttctcaactgaagctccaaacgagcatggactctttgggacattgatattgcatttcccatccttaccggaatgatcagacatgcatacgtggccctttagccaaatattcgcatttggatgctgattatcaatctctccccttctcagatatgaaggggcactgtggagaaacgacttgtgacagagacaacaaatcgtggccccatccgacaaaccaacatcttatccatgagcaacgattttcggaatcccaatatgatgtcctccctcccgaacgaccttctcttcggatgactgatgcgaaggcaattgaatggcttcaaaataatgaagtgatcaactaacaggggaaacccttccaattccgatacgatattccctaatgacccgaacgagttatcacccacaca

SEQ ID NO: 49486 - DNA, 386 bp, Heterodera glycines
  SCN-specific regions: Sequence locations=1-48,70-386
ataagttatgatgaagaagactttgccgattaatgatgaaatgatttcggaaagaatagaagcggaaagggaacgacttcagcaggacaaattgcgaaaacgctatgcatatgaagcaatttgtgctttgaccgacactgtgaacgaatcggaactgcaacgacatctgtccgttttggatccaacttcctggtgtgaagtggtcgaggaacgttttctgggccgtttgtgcggttttcccctttgtgccaaaacaatcactgtcgacttccgcaaaaagcatacaattgtgaggcggttgaatgaatccacaagaaaggaacacaaaatgattgtgcccactgaatcggagcccgtgaaattctgttctgatcgatgcatgggaa

SEQ ID NO: 49487 - DNA, 274 bp, Heterodera glycines
  SCN-specific regions: Sequence locations=1-274
gttgaaaccaaacgttggcatcaacggttttggacgaattggacgcttggcattgtgtgcgacgattgaaaaggaccctgtccctatggtggatgtcgattacccgttcttctgactcgactacatggagtacttgatcaactacaactccacccatggctgattctatggcaaaatttcctctaacgccggccatttggtgatggagaaggaggggaagaatgcgctcaccttctattagatcaccctctttgacccggacgacattttatgg

SEQ ID NO: 49488 - DNA, 421 bp, Heterodera glycines
  SCN-specific regions: Sequence locations=1-421
gggcaagccgactagtgtgaaggacgttgaccaacatgatattgtccagtcggtggccacctttctgaagaagagtggcaagatcaagttgcccgactgggtggacttggtgaagttgggcaaaaacatagagttggcaccgatcaatcccgactggtactacgtgcgcgtggcatccctcgctcgacgtctggacatccgttcaccggcaggtgtcagctcgttccggaacgggtatggtggaaaaagtcggcgcggtgttgcacccagacacttctccaaagcgtccggggcagcgattcctaacgtattgcaatcgttggaggaaatcagatgggcggataaagaccgaagtactggtggacgcaaactgaccaaacagggccggaaggatctggaccgtattgcgtcacagctgcga

SEQ ID NO: 49489 - DNA, 340 bp, Heterodera glycines
  SCN-specific regions: Sequence locations=1-340
gtccccagacgaatttgttgcacctgtgggagacgtgcatgcgtccgtggtcaaatgtatgcaaaaagtgagcacttacggggagcacgccgcgcaattaccggaaattttgttggatgccgacatcggacctcattacagccatggcactaaccgcctatgcatttacattgaggacgtccccactggcggaaaaggctacggagaacagaatgcgttcaagaaaaatgaagctaccccttgggtggacggctgctatctgcttgacaccgacgtcaggaatttcagcactgaaatggccatgaagtcggtactaagagcacataatactgctgggtgg

SEQ ID NO: 49490 - DNA, 634 bp, Heterodera glycines
  SCN-specific regions: Sequence locations=1-333,355-634
cctcgtgccgcgagaatctcgaggattggacttcggaatcgcccaacaaattgcactttatccgacagcctcagaagtgggccctcttcaggcatccacagcactttctgatcgctgatcggaatcgaaacaacgaatttccgccggtggagagcattggcgaatgggatacggaacagaaacagcggttgctgaacgcgttcctcagggaggacggaggaacgcgagtgcccgaattggaggggtggctgatgctgaaggcggacggcaagaagtcatggcgacgacacttttttgtactccgttcctcggggttgtattacgtgccgaaggcggggaagccccgggggcccgccagggatttgaactgtctgatgagcgtgttcaacaaccaagtgtacatgtgcacggactggcgcaaaaagtacaaagcgcccaccgaattcggatttgcaatcaaacatccgcgcatccaactgaaaacctccaagtacatcaagtacatttgctgtgatgacgagttcactttccgccaatggctgacggcgcttcgaataacaaaaaatggctgtcccgcgctgtacaaggacttccgtgccgctcagtcgcgcgagcgtccgctcgtcggccccgc

SEQ ID NO: 49491 - DNA, 616 bp, Heterodera glycines
  SCN-specific regions: Sequence locations=1-224,246-328,350-616
cattgccaagaagttggaagcaaatgagaacaccaacaatttgaatacgtccacttcatgtccgacgagtcccgcttccaaattggaacagcagacgaagaaacaaatgatgagggtcaaatcggacaatgcagtgaattcgttggctgattttgaccaagtttgcgcatttcgtaagggactcgctcctctagcaaaattcggccacaaacagcaggtgaatgtgcttttttcttgtgtccagcccacttccagttgtgtgaaacggtctcgtcgttacgttgcgaaggatcccgagagaatgttggatgcgccagatttattagacgatttttattcgaatttgattgattggagcaagactaattgtgtcgccgttggcttaggatcaaaaatttttcaatggaacgcggggaccggtgccgtggatgagataaaagatttctctgaaacgcattcgcatccaactctcgtcaaatggtcttgcgaaggacaatatcttgccgttggattcaatgacggacaattaaagttgttggacagcgccaccaaaaaagtgctgagaacaattcacacgacggcaaacatgcgattggcatgtgccacatggacacac

SEQ ID NO: 49492 - DNA, 560 bp, Heterodera glycines
  SCN-specific regions: Sequence locations=1-560
aggacagccattctttgccggatttggcaatcgcgaaacggacgttaaatcgtatcttgcggtccaaattcccccggaaaggatcatgattattgacccgcaagggtcgctcagaagggcggacaacaaagcgggtggttacgtgtccgattacccaaccttggccatggacagtgtcgactacgtgttcccgcctcgggtggacatggacggcatcgacattaggacgaaagaggacggcattttgagtgaattcgtcgcatggcgaactgacgctgaacaattcgatgcgctggtggacgcggaattggaacagtacgaagaaaggagcaaacgagcgaaagcaattgtcgcggggacgacggatggacgaggggcggacggaaagaagaaaatgtataggaacggaagacgggcaaagtgatcagagcaaaattatggatgattaattgacgaccataataggcggaatgcgggagaccaaccactcttttgtttggtttatgtaattaactagcctttgtgtcaactgttcaaatggatttgtctcatatcattaa

SEQ ID NO: 49493 - DNA, 641 bp, Heterodera glycines
  SCN-specific regions: Sequence locations=1-420,442-641
cttcctttccctctattattacgctgcacactcgtcgtccaattgtgctgccatcagtttcattgccccccatggctgatgatgttgctcctcccgctccttccgttgccgtcgatgactttgcgcagcgcaccggccaattcttcgacttcatccgccagggaaacatcgaccgattgcgtgcgctgatcgattcgctgagcgtcgatgagctgaacaccttgctgcagatgagatacaacgaacaacaatttgcgctgctggtcgcagttatggaaggacaccccgaaattgctgcacttttgttggacaaaggcgcggacgtgcatcagaccactgttggccgagtgaacaatgtgaccatggccgttatgcccctgtggattgctgtcaatatgcgccacttggagatgtgccgtgtgctgatcgctcatggtgccgacgtggacttgggaagcgattcctcctttacaccgctactgctcgcatgtgccaaaggcagcacagcaatcgtcactcttctcgtggagagtggcgccaacgtcaatctcggggacagcgaaggagtaacgccgataatgatcacttctcgtttttgaaggggcgaacctgtgcacttcttactttctcacggtgcaaac

SEQ ID NO: 49494 - DNA, 641 bp, Heterodera glycines
  SCN-specific regions: Sequence locations=1-641
tgatgaagcgctgaatttgaatgatttggatgaaaaagaggttcttggtgatgacgaggaggaccaacaccaaaatcaacacacaacaaaagaagaagtggaagacctttacgacgaagccatggctccgtccggtgcactctctgaaaagcgcgagtcggctgaagttatttcgtcgttgccaagttcgattcagcacaaatcgtcgtttgccatgcctatgatgatcaaatctgagcccggcattgctggcgggtcgcaaagtggcaaacgctactgctgctacattggcaatatgacttggtggaccacagacgatcaactccagaaactgattcaaaccctcggcgtcgacgatatgattgacgtgaaattctacgagaatcgcaacaacggacagagcaaaggttttgcgctggcagtgttcgccagtgaaccgtcggtgaaagcggtgatggagaaattgccaagcaaaaagctgcacgaacaatcgctggcggtgttgccgtacactaagcagtcgttggccaagttggaggaggccaccaaacgctacgaccagaaaagtcagaaggacgataaagtggtcaacattggcacagtgcgcattggcaccaatggcgcgcccgttcctcagttga

SEQ ID NO: 49495 - DNA, 337 bp, Heterodera glycines
  SCN-specific regions: Sequence locations=1-227,289-337
gtgcgacgaagaagttgctgctctcttggcggacaatggatcctgaatgtgcaatgccggtttcccggtcgatgacgcaccccgcgcggtgtttccgtccattgtgggccgcccccgtcatcagggcgtcatggtccgtatgggacataaggactcatacgtgggacacgaggcacaatccaaccgcggtattctgactctgaactacccgattgaccactgcatcctcacccactgggacgacatggagaatatctggcaccacaccttctaccacgagctgcgtgtcgcccccgaggagcaaccagtgctgctcacatgaggccccactgaaccc

SEQ ID NO: 49496 - DNA, 626 bp, Heterodera glycines
  SCN-specific regions: Sequence locations=1-210,233-258,281-626
gcgttcagtgatcgacgcggatgagagggaacgcgtggtgggcgcggtggcgcggacattcgtcgaaatgttggacctgcgcgaaattcaaaatcggccccacccttacgcttcatccctcgcccgtttcaacccaattcggctgatgaatggccatttggtctgttccctgtatttgttcaccaaagtgtgctattccgtcaacattatgctccaatttgctcttctcaatgccgcactgacctcaaaagaccattttctgtttgggtttcaagttctgtccgacctttacgagggaaaaccgtggacaaagtcgggccattttccacgagtgactctctgtgacttcgaagtgcgttatttggccaatttgaacagatacactgtacaatgcgctctgatcattaacattatcaacgaaaaggtgttcgctttcttttggctttggtactgtctgcttttatgtgccacaacctgttccgccctgttttggctcagcaacattctgttgcacatcgcccgggtggactacgtgctgaagtttatgcaaattgctgaacacagtgaacaacagcgaagcagcggcagaacgccaaaactatcgcaacaaaagtgggcgatggtgg

SEQ ID NO: 49497 - DNA, 653 bp, Heterodera glycines
  SCN-specific regions: Sequence locations=1-653
ctttgccggagaacacgcacaaaattgttattttggacgaagcggacagcatgaccgaaggtgcacagcaagcattgcgtcgaataatggaggtattcagttccacaactcgttttgcgttcgcgtgtaatcagtcggacaaaattattgaaccccttcagtcccgctgtgccttcataaaatacggaaaattgacagaccaacaaatattggaaagacttgtttgcgtctgcaaaaaagagagtgtccaatataacgcggagggcctcaatgcgatactttacacagcacaaggggacatgcgacaggcactcaacaatctccaatgcaccgctgcgggctatggaactatcacaaaagactatgtgtacagagtgtgcgacgaaccacaccccgagaaaatgtgtaatattttcgactgttgcatcaacggtcgtacccaagaggcgttcgatttaattgacgagctttgctgtttggggtattctgtcgatgaccttgttggcgttatgttcaaaacggcgaaaatagcggatattcccgaaattttgcgtttggaattcattacggaaattgggaaatgtcatgccttggtggtgcagggggtggccactcgactgcaactcgccgggttattagcgcgtttgtcacaa

SEQ ID NO: 49498 - DNA, 624 bp, Heterodera glycines
  SCN-specific regions: Sequence locations=1-624
ctcgtggtcacttcagtggcggaagagggtgtcaacatcgccgcttgtaatctgatcatcaagtacaacaacgtcggcagcgaacggcaaatgatccaacgaagaggccgtgcccggcagaagcacagcctgtccattctgttggcgctggacaccggcattgagcagcaggagttcagcaacatgcgcaaggaggccatgatgatgcgctgcattgaggacatgcaggagcaagatgagcagacactgcgcaaatcgattgaggaaaaggccttcgaattggccgaacttcgcaacgacgagaaaatgaaggtggagagcaaacgggcccagctgatgggcaaacgtttcgatttgaaatgcgcctgcggcactgtgatttgctgcagtgaccgcgtccgatcggtgatgggcactctgtttgtgtgctgtgaccccaaagtgtggaggcgatcgaagcacacgctgacacgcgccccaacgaaagagaaattctacacaaactgtgcccgttgggagtgcgcaaattgtggcgaacattggggccaaattgtcaaattttccaacgtgtttttgcccgaaattcgcgtccgcgcattcatattggagcgagtggatgaacaa

SEQ ID NO: 49499 - DNA, 632 bp, Heterodera glycines
  SCN-specific regions: Sequence locations=1-171,193-632
gcctcgtcctggccggaagtgctgattttaagaatgaactcgcccagtccgacatgtttgaccaacgattacaggcaaaaataatcaaaactgtcgacatatcatacggcggtgaaaacgggttcaaccaagcgatagatttggcagccgatgctttggcggatgttaaattcatcaaggagaagaaactgatcagcgcctttttcgacgagatttcccaagacactaacaaggcaatttacggggtaaaagaaacactgacagcattggaaatgggcgccatcgaaactctgatttgttgggagaatttggatctgataagatacgcattccgaacaaccaatggtgaaaaagtcgttaatctgaagcccgacgagaaggaccggtcgaactttgtggacccggagactggaactgactacgagattgagtccagcacgccattattggaatggctcgctaacaattacaaacgattcggtgcggcacttgaaattgtcaccgacaaatcgcaggaaggagcgcagtttgtacgcggttttggaggactcggaggtgtccttcgttattcggtggacattccgcagttggatgagctcgagaacggagtagacgagatcgacctcagcgag

SEQ ID NO: 49500 - DNA, 292 bp, Heterodera glycines
  SCN-specific regions: Sequence locations=1-292
tgttggggaattgtccatgccctagacaaatcgggacgatctcgcccgagccgatctgaaggcttcttctcggacttccactctgcttgccggcttctccatgatcgatctcatggagctgcggtaccatgagtcgaccccccagtcgccgctgatcatgctcgtggaggtcacttatctgatcctctgcgttcacctgctcgctcagatgatgaccacctggcagttgccgtacatctagggagagggatggacacaagactcccctcaactacaattgcccttttacatc

SEQ ID NO: 49501 - DNA, 509 bp, Heterodera glycines
  SCN-specific regions: Sequence locations=1-172,194-509
gatttttgatcacaaatttgatcggctggaaaaatttttcttcatgccgacctgcacattctaattagtaccaaactaattaattggtactgcattaaatactacaactattatattcgcaatccgtaaaatttctaaaaaaatttttttttctgacgggacgacggggagccaattacatcagcggcggcaacggtggcatgtcaccgtttggtgcccaagtccgtgactcgcgggaccgggagaagaaggaactcagtgatctgaacgatcgattagccaattacattgaaaaggtccgtttcctcgaagcacagaaccgcaagttgaaggcggacctggacatgccgcaaggacgccgcggcaaggacaccatcaccatcaagacgatgtacgagagcgagattcagacggccaaaaagttgatcgaagacacgggccgatcaaagcacgagttggagcaggacgtggccaaactgcaacgtgacttggacgaacagcgccgcaaa

SEQ ID NO: 49502 - DNA, 562 bp, Heterodera glycines
  SCN-specific regions: Sequence locations=1-319,346-562
ggcgaaaccaaaggttggcatcaacagtattggacgtattgtacgcttgccattgcttgcagcgattgaaaaggacactgtacaagtggtggcggccaacgaccccttcatcgaactcgactacgtggtgtacatgttcaactacgactccacccatggccgtttctagggcaaaatttccacaaacaccggcaatttggtggcggagaaagacgggaatatcgcacacaccatccaagagcccaacctctaagacccgggcgaaatcagatggcgcgaatcatccacggaatatgtgatctaatccacccgagtgtttaccaccattgagaaggcctctgctcatcttaaatgtcgtgtcaagaaggtggtcatctccactccttctgcggatgcgccgatgtacgtgatgtgcctctacgaggacaagtacgaccctgctcatgacaacgtgatctcctatgcgtcgtgcacaaccaactgcttagctccgttggccaaagtgatcaactacgagcttggcatcatccaacgtctgatgaccactgtgcatgggctgacc

SEQ ID NO: 49503 - DNA, 428 bp, Heterodera glycines
  SCN-specific regions: Sequence locations=1-116,164-428
gaattttcctcttccgcctcgtccctccggcaaagtaaaaattacgagcggtacgtacggtgccgaggacgacggcaaagcttcaaatgccatcgccaccgcctttgctccaattgcaccatcatcaccaacatcaccaccaccttcagcatcaacaacaccaacaagagcaacaccaacgagcactgtcttcggagagcgcacttcggcttggcattatgccgccgggaaacgatccgtcgatggcaatgcatcagccgatgcgaccgggctcagaaatgagagcgcaaattgaagtgatcccatgcaaagtttgcggcgaccaatccttcggcggtcattaccgcgtcatcacttgccaaagattgaaaggctttttcccgcgttctcaaaatgcccccggtgaattacaatgcccgccgcaaaaa

SEQ ID NO: 49504 - DNA, 606 bp, Heterodera glycines
  SCN-specific regions: Sequence locations=1-62,86-606
cgggtgatcagtcccacccaagtgcacatccaccagaacatccacattctgcaggaaattgttggcatttcttccctctcctggagtcaggacagtcgctacttggcggtgaccagcactgagcaggccaacggagtcgggtgtttcatttacttcgtgccaagaggtcgtctcgtcaaggagtacgtccattacaccggcgatgcctttaccaccgtcgcctttttcaaagacggctcccacaaattggcatgtgccggcgaaaaaggccattttcatgtttatgacatccatcggcccgaggacagtgccaaaatgttcgaaggttttcgaattcgttgtttatacgcgtgcatggacgggaaaactgttttggcagcggacactcacaacagaataagggcctacgatttcgaaacgatgcacgagcaaacgctgattcaagaggccagccaaatcatcactttttgcgttgaccgaaaagagaagtattgtctggtgactaccaaaaccgagggcattcggttgtgggacttgcggacaaatgacctcgtccgctcttttttcggctcaaacacaacgaatttgtgatcacttcttctttcg

SEQ ID NO: 49505 - DNA, 181 bp, Heterodera glycines
  SCN-specific regions: Sequence locations=1-181
taacaaaatgaagaaactgcaacaaaatgctgaacatgcgcccactggtggaaacggtactgctagaaggaataacaaagtcatgcacatcactactgccatggacgacgaacagctacttacgaatctgaccaagctttcccagactaacattcctggcatcgatgacgtcgatatgatc

SEQ ID NO: 49506 - DNA, 616 bp, Heterodera glycines
  SCN-specific regions: Sequence locations=1-370,392-396,418-616
taaagtggtcgaattgcttgccgatgcgttgctgaaccaaaactttgacgcgtccaaaattgaggagcaacgcgccgaggcattggatcgactgcataaggccgagaagggcgacattcgcgggtcagtgctcgacaatttgcacgccaccgccttccaaggaacaccgctcagactgtcaccacttggcacaacaaaagcattgaactcattgaccaaagaatccgtgtccgaatttgctgacgacattttgaaggccagcggaatggtgctgacggctgttggtggagtggaccatgagaaaatgagcgatttggccgaaaaacactttggccaccttggcaattcgtacaatcgcgaagtgcctccacatgtggcgtcagtgaacaacattggacacgaacaaatccgtccaaagggttatcggttcactgccggcgagttcctctaccgggacgaccattacccgctgatgcatggcgcaattgcggaggagggcattggcagaaaccaccttgactacatcgccatgctggtaggaaatgcctatgttgggacatgggatcgttcctttgccgcatcgctgaacgctccgaagtccacggtgcagaagatg

SEQ ID NO: 49507 - DNA, 157 bp, Heterodera glycines
  misc_feature (30)..(30): n is a, c, g, or t
  SCN-specific regions: Sequence locations=1-157
cgcgcacgacaagagccgcaaccaggcgcngaccgacccggcccagagggagagagggaaagagcgcagcaacaaaagcgcgccgaacaaagccgacaagacactgaccaacaacgacaccggcaccggcaagaccaaagcggaccccgccaacaac

SEQ ID NO: 49508 - DNA, 585 bp, Heterodera glycines
  SCN-specific regions: Sequence locations=1-217,239-321,343-585
caaaaggccacttcggctggtgatactgttgagaaccatgtcattcctacaccacaagtgtcaacgattagtgatgatgactacaatggaatataccaagacagacaacttcccaaggggaaacgactcatcacattcgatgatcacgtgtccttcttcctcttgcaaggatcttataatgcagactccgaagatgaggaatggatgtccatcaaccgaaatgtcaacattgatgattttgagcatatcatcgaaaggctcgaaaatgcttcacgcactgacataatccatctcagaaatgccagggcacttttgcaacggtttgaccctggattggtggacgatgtctacgactattggttacaaaagcggaagcttgccgcctctcggaagagcaaatgtacggctctcattcccatattatgcactgaacaacgccgtgacgaaaaaacgctggtcaatccgtacatcgcattccgaagacgtctggacaaagtccagacgcggaagaagttgaaaacggacgtgctgacatacgagaaaatgctgcagttgaacttggcgcttaagcggtccattgttttg

SEQ ID NO: 49509 - DNA, 582 bp, Heterodera glycines
  SCN-specific regions: Sequence locations=1-377,399-582
ggaaatttctacgagtcgctcattaattccggtctgttagacaactttttgagtgaaggaaaaaaggtaaaaaacattttattcagttaccgattcatttttttgatttagcatgtttttttgagcaacatcgataatttgggcgctaccgttgacccaaacattctcaattacatggtggccagaaaggcggaattcataatggaagtaaccgacaaaacgcgggccgacgtcaaaggagggacactgattgaatacgaggggaaactgatgctgttggagatcgcccaagttccgcctgactatgtggacgagtttaaaagtattagcaaattcaggtaatgcagggaaaaagagtggattttagtgttttttgaaaatcttaagaatttttaacactaacaatttgtgggccgaattggaagcgatcaagcgggtggtactgaacaaagagctgaacatggaagtgatcgtgaaccccaagcatttggatcgcggtgccaatgtgattcagctggaaacggcggctggcgcggcttgcaaatgctttcgtggggcctgtggtaaaattcattcatatgg

SEQ ID NO: 49510 - DNA, 608 bp, Heterodera glycines
  SCN-specific regions: Sequence locations=1-45,85-103,138-138,181 -243,266-322,347-608
cttcttcggcgtgtgcctgtccaccgtggccacggttatcgctgtgctttccgtgccgttcgcctaccagcacttccaacagatcggcgcccaaatgcagaacgaagtggacttctgcaaaatgcgctccggcaacatgtggcgcgaggtcacccgcacccaggcctactccaaggtgtctcacgacagccgtcacaagcgtcaggcaggcggttgctgtggctgcggagtgtcgcccccgggcccgcccggaccccctggcccatcgggacaacccggccaacccggacagtcggcaccacccgcgtctcctggccgccccgggccccagggacctcctggacccgatggacagcccggcaaccccgggagagtctgggcaacccgggccagcccgggaaactcacccagggaccgcgccgtcagtggaccagcggggccccatagagaacccctggggcagtctgggacggacctgggaaaaagggcacatcccggcgcgatccggggagaagccgcgcgccgcgagggaatactccgagaggaatgatcgtgaagacccccagcacaaagagcaagtagattttgaacaggaaacaatagtcaag

SEQ ID NO: 49511 - DNA, 526 bp, Heterodera glycines
  SCN-specific regions: Sequence locations=1-526
cgccaatctgatcctggccaaggtgtcgattctacgcatcaaatttatcgggactttccaccacatgacggatgacctgaacgtaaacaactcggtggccattcggaacacgcatttgatgtggtactacagctcttttgactggcgtgtccggccgttggtgatggaggttaaagaacgggcaaagcgacacggaatcaacgactcaggctgctcctccttcacatcgcactcgctggagctgatgggcatccactatttgcagtgcggcgcgcaggcaccggtgctgcccaatctgcaggaaatgtacccgaaacggttcaacgtacgtgcggatgtgcggactctgaacgagtcgttgccgctcaagccaattccaagcgagatgggctgggatgtcaaggacgacgcgacgctcaacgagttgctgctcggcttcctccgctactacgccttccaattcgactttgacgcggacgcgataagcattccaatgggaaaaaagggcaacagggcacatgtggca

SEQ ID NO: 49512 - DNA, 562 bp, Heterodera glycines
  SCN-specific regions: Sequence locations=1-474,496-562
aaaagcatcgacatcgagcggaatgggaatgacaccagtgggcagcgaaggcacaaatcccaccggcaacaacggcacgcaacccttccgattccatcggcgcgacctccgcgtcttccgcatcgaacggctcttctgcagtcccaacggccaccgcttcattttcggctattactacgcgcgaccgcacgaaaccttttgcgattcgtcacgcaccttttatcgtaacgaattgttctggactccgttgttcgacacacttccgctcgattcggtggacgaacgatgtttggttttggagccccaaatttgggcgatgggaaggccaaaatcaccacgttatttggaggacgatgtgttcgtgtgcgaatatcagatcgatcggaaccagcgcagctttgagaaaatccccccgaagaatcgctactacatcaacactgagccatttgtgttcaactttttcgagaagaaattgacgatgaaaagggattttacgcctttcaaaatcaccgcttcttccacccgaaaacaaacttcgtcctcatcaactgctagcagggac

SEQ ID NO: 49513 - DNA, 618 bp, Heterodera glycines
  SCN-specific regions: Sequence locations=33-112,135-618
cctcgtgccgaattcggcacgagggacatttttaccatgggaatgacacggccaatgttggtttctgccgcaatggatgccaccattcggatttgggacgtggcatcgcagaaacagttggaggcactcccctacaaagaatcccaggtgaacaacatttgcattacgcccgacggtgcccaactgctcgtcggcgcatggcaaaacattcgtttttacgatttgcaatgtccaaccgcgcaaggactacacacattttctgtccatgagaaaaatgtgacttcggtcggcttccaagtggacggtgcgtggatgtacacgggaggggaggattgcatggccaaaatttgggatatgcgcaacaatcagctgaattgccagaggatattccaagtgaacacgccggtgcactccgttgtgctgcatcccaaccaagtggagctgatcgttgccgactccaccggcgccatttatttgtgggatttgcgctccgatcgggacgattcgctgatcaccgaagtggacatgtccgaatttgttgttcacgttgacattgaccaagtggggcgacagtgtgcggcggtgacaaaccggggcaatttgtttctgtgggacgtc

SEQ ID NO: 49514 - DNA, 642 bp, Heterodera glycines
  SCN-specific regions: Sequence locations=1-213,240-480,503-523,545-642
agcaaccgccccctttggatttgtcctcgaaaagtgacgggggaagcgccgctgagcacgcgcacgagcgacaccatcaaaaccataacctacagcagcagcagcgacacccgccgatctcatcctcacaactgttcgacccgccgcaactccaccaaactttggcaccgcctctcttctcgcccccgttcgtgcccttctcccttggccctccctgctcctcctcttcctcctcctccgatttgctttgtgtccgtccaatgccaaacttcgacatgaaaccaaattgcgcttcaccacagacgacgcaacagaacgaagaggacgattgggaggcgatgatggaaataagcaacacggacgagcaagagaaaattcgcgagttggccggcgaaaacgcattgccaacgacggacccaaatcaatgcattatctgtcggagggtattgagctgcaaaagcgcattgcaaatgcattaccggactcatacaggcgaaagaccgttcaaatgccgaatttgtcagagggcattcaccacaaagggcaatttgaaaacgcacatgggcgtgcaccgttccaaagcgccgctgcgtcatcagatgcaccatttgctgaacaacggcatgccgaaggcggaaaatg

SEQ ID NO: 49515 - DNA, 499 bp, Heterodera glycines
  SCN-specific regions: Sequence locations=1-68,98-256,288-377,403-499
gtgtcgcgaggaggaaattgctgctctcgtggtggacgatgggttcggaatgtgcaacgccggcctcgcgggggatgacgccccccgggcggggcttccgcccattgtgggccggccccgtcttcaaggcgacgtgtccggcatgggacacaaggactcgtacgtgggagacaatgcgcagcccaagcgcgcgattgtgaccctgaactacccgattgggcacggcatcgacaccatctgggaccacatgtagaacatctggcaccacgccttctacaacgagctgcctgtggtccccgaggaggacccggtgctgctcacagacgccccactgaacacgaccgccaacatagaagagacgacccaaatcatggtcaagaccgtcaacaccccggccatgtagtggctcaaccacgccgggctgtccctgggcgtccccgggcataccgacggacgtgtcgtggactccggggatggcgtcaacgacaccgtgctcatc

SEQ ID NO: 49516 - DNA, 638 bp, Heterodera glycines
  SCN-specific regions: Sequence locations=1-638
gaaaaaatgaaatgacaaacggtttaaatagtggtgtcactgctaatcgatcgatttttgtctaacatcaccaaagagtcacattctcccatcaccaccagcattattcctccgacaggtactggttgattgaatttgatactcaccgctgtggtcccattctttatcaggtcaaacagtgccgcttggtcatccccgctgtttgtcagattgaacacgtaaatgcaatgagtttttccgtattgagcaaaagttatcccattgctctccgatgaattggcgaagcccaccgcttcgttcatgtcattgaagggccgaacatattttccgtttctgtaatccaaatcatagggtgcttgcggatacgatcgtccatttgcaagaatggaaatttcgcgcacattaaatggttgaaaattgaatggactgcgcaaaattgtcccaacatagtcagtattagccaccagacccattgtcacacgacgaggaatttggtccatgaacatattggcagtaaactcatatcggccctgactgatgaacatcgatttcatcattgtcttccgcacagcataacggacaggtttcacctccagctttcgcgcaatgtctagcgccaacccatccatcagagacac

SEQ ID NO: 49517 - DNA, 655 bp, Heterodera glycines
  SCN-specific regions: Sequence locations=1-655
gttcaatattcctatcatttcctcggatcgtttgccaaaactgcgcaatgttctcgccggtgtcttctccattcaaaacacttacaaatataacgacaattatccgttggacggtgaaggaaatacaaaaggcttttgctttttggagtaccaaacaaaggaggcggccaacgcagttttggccatttgcgatggacatcgccttgacaaaaaccacacattttcagcgtatccattcaccgctattcgaagcatgaaggagccggaaaaggactggaagaaaccggagagacaaccttatgtcgatttgggtgacccatggtcttggctgcaaaaccccaagtgtttggatcagttcggtctcctctatgaatcgggccagggtggcactctccgtttggatgtgttttggaacgtcagaaatggcgagccaacgcccgtggacaatgcttctcgagaaaattggtccaatgaccttttcaaatggtctccccatgggacttatttggccacgatgaacaatgacaagcggaatcagcgactcggagccgtaatttggggcggcgaaaagttcgacagatttcaacgcttttcccacgagggcgtcaattaccttgacttttcgccaaatgagaaatttcttgttacttatgct

SEQ ID NO: 49518 - DNA, 599 bp, Heterodera glycines
  SCN-specific regions: Sequence locations=1-577
attggactggtgtccaatcagaattacattggccataatcagaagaatcccttctattttaatcaccacaacgtgagtggcaaatggcaactgcttgtgaatcagattattcaggtgcgggacattgagcttacggcctctggcaggacatatccccagtacccgtacaacctggactacaagaacaacaggtacgcaagggcatatcacgatgcccaagagcacctcggcatggcgtgcaaacggagagcaacggaatcagctacagcatgttcaagactgcctattgcctctatgtcttccaaatgaccaacgcgcaggaggactcgccaggatttgagctgatcaaagagggctgtactgcagtgaacatccgattcactgaagcagtacccaacgagggagttacattgattgcgtacggagaggcagacgggctcattcttattgatcgtaaccgttcgatcactagtgacctcacagtatgagtcagaattattactctgaaaacattctgatggacacgcctccgagggacgggataatgatgtgctttcccgatgttattgaaaagtcgccaataaactttctcttctgcc

SEQ ID NO: 49519 - DNA, 572 bp, Heterodera glycines
  SCN-specific regions: Sequence locations=1-376,400-572
aaacaggcattcgaattcaatcatttgaaatgggtattgcctctgccgttctttccgttccccggcattttttttgctcgttagggccattaaacatttaagccgaattgaatttcttgcagcacaatttgtgcgtttgcgcccgaaagtcggcgtgcccatcagatgcttttgtgcatgcaatcgatgcttccccatttggtccggcatatggaagaggagacaaatcagcgacaacagcaggcggccaacgcgctcgctgcgcttaaattggagctgtccgcttatgccacgctgagcgtggaacttcgtgctttggtcaacagttgcgacgtgctcgcgcgtgggccgacccggtcctttgatttggccgcgagcggcggaggcggtggaacggccggtggcgcttcgctggcgccatcctccgcaaatcgtccgcacgcgactgacccgcgtcgcggtcgttcgcttggcggtggtggggccgactctccgcaattctttgatccgccgacaattgtggaggacgaaatgagtcgccagcagcagtcgaccgcctcagcgaagactga

SEQ ID NO: 49520 - DNA, 582 bp, Heterodera glycines
  SCN-specific regions: Sequence locations=1-177,203-527,552-557,579-582
cttcgaatttggccgcgcgatattgcgggactgtggcaccaaatgtgcagatcagtctgcacaatttgatggttttggtgttccattctcgggttggtcgatcaacggaccgggactttcgctctcggcggcactttcgaattcatttccgaggcgccctttttgccgggatctccactccccgggggcccaaaagggtgtgcctttttgatagagccaaacggagccaacgacggcaccggtgtcattttgtcgcccacttaccccggcgtttatccaatcaatttgcaatgtttgtttctgctgcggggcctcgaccaccaacggatccgtttgttcttccgcaatttcgacgtgtatttcggcggcaaacactgtccctacgattcttctgacaatttacgacggcgcctcaacttccgatccgatcattcgaaaactctgtgggctccaacaacgacttgaactgttctcattcggacacgaactgttgctggagtttaacaccaccgaagtggaggggaaagtgggcgacaggggctttcacattgagtaccaattctcggataaattcgtggacat

SEQ ID NO: 49521 - DNA, 481 bp, Heterodera glycines
  SCN-specific regions: Sequence locations=1-481
tcagaagtgggaccgtatctgagagatttttgccacggagatgccctcgacgcttcacgttcaacgaagccttccggagagggattgccgtgtcaatttccttgaacaacacttttgcaagcaaatcgcttccattgcggcgacttccgatagtgaccgagatggcattcatcgcgcaaaatctgtaccttttgtgccctatgcctaccaaactaggatgccgcgctcgatggtcagacggcacccaattctagatgaataccacgagttgttggtcaatgacactgaattggagaacctgaccatacacgacacgagcatcttggacgcaccacttttgtaggatgatcgaccccaccgacaagtgctggacgcctgtgctgtcccgggtggcaaaaccatgcaaataattgagctgatgcacgagcactgtcgctaccccaaatgcttagcgctgggcaatgactcacactacaaacag

SEQ ID NO: 49522 - DNA, 253 bp, Heterodera glycines
  misc_feature (6)..(7): n is a, c, g, or t
  misc_feature (27)..(27): n is a, c, g, or t
  misc_feature (33)..(33): n is a, c, g, or t
  misc_feature (51)..(51): n is a, c, g, or t
  misc_feature (109)..(109): n is a, c, g, or t
  misc_feature (114)..(114): n is a, c, g, or t
  misc_feature (150)..(150): n is a, c, g, or t
  misc_feature (178)..(178): n is a, c, g, or t
  misc_feature (181)..(181): n is a, c, g, or t
  SCN-specific regions: Sequence locations=1-66,92-190,213-253
gatttnncccggaaagaggaggacccncgaagnggaggcgagcgacaccancgagaaggcgaaggcgaagagggaggacaaggaggggagacaaccggaacaaaagagncgcancggagcaggaaaggagcgggaggagggacgaaaccnagcggacaacaacaggcagaaggaggcnacnaaacaaccggggcaggggaaagggggatttttgaagatctttgagaggactctgagcggaaagatgattacc

SEQ ID NO: 49523 - DNA, 385 bp, Heterodera glycines
  SCN-specific regions: Sequence locations=1-385
tatggacctcgacgaacacagtgagatcagaaaccaggatctgaaaggactgaacgccacactcgcaaacgtggcgatggactcccctgtggacaacttgctcgaggaagaccctgggacactcgatgacgccgactttcataccctgctcgcacaacaactgtgtggacctgaccccgatgccacatatatcgaggcctatactgtgcccgacaaatctgactgcgagcgcatcgcagaaaagatgttcgaggtggttctgcacacccgacggagggaccccttgacagtggacgaactgaaacgcatgttcaagagggaccctctcattaacgcaggcaatgcggactacgatggcttcgcgcgttttatctccacaggcgca

SEQ ID NO: 49524 - DNA, 642 bp, Heterodera glycines
  SCN-specific regions: Sequence locations=1-152,175-642
gatcagtgagttggagatggtcgcgttcatttgccaggtggaccatgtcgctggggaaggagggacgaattttcggtatgcgaccggccgggatgtgatgggcagatgcagtcaggattgctgagcggaggcgtcgttcgccatgaacactacttcttccatcccaatgggccccgttcttccgtgcattggccaaaacaataaaaagtatgaagtgatgaaaaagaagaaggagaaaaatgacgagaaaatgaccttggaaacgaacaaaatggcgggtgaaaagcgaaaaaggccgccgagtttgtccgagaaaagttttccatacaacgccggactggaaaggaacaaattgtttgtgaagaaattggattggtcgtgtacgggcgaggaactcaaaaaatttttcgagaaattcggaactgtagtggacgcgcgaattgtcaccaaatgggacggtcgctccaagggttgtgcttacgttgattttgccgacgaacaaagcgcttccgccgctttgatgggggcggacggaacggagataaggggcagaaaaatttccatttttttgagcaatccgcctacaaaacggatgaaaaagaacagtgatgaaagtgataaactcaaactgggagcccaata

SEQ ID NO: 49525 - DNA, 367 bp, Heterodera glycines
  SCN-specific regions: Sequence locations=1-288,311-367
gtgcgcacaagaagatgctgctctctgggtggacaatggggccggaatgtgaatcgacctattctcgtgcgatgaggcgccccattcggcgcttccgacaaatgcgggccgtcccctgtatcagggcctcatgggcggtatgggacagaaggactcgggcatgagagacaaagctcatcccaagcatggcattctgacactgaatcacccgattgaagatggtctagtgaccacctgccactacctggaaaacatctggtatcccaccgtctacgaccagctgcgtgtcaccctggaagagcaccggttgctgttcgcaaatgtgccactgattccgaacgcccatcgagacaaaaggatgcgcatc

SEQ ID NO: 49526 - DNA, 136 bp, Heterodera glycines
  SCN-specific regions: Sequence locations=1-15,37-136
cgggaaaaaaaggggagaaatggaaaaaatctggcacggaaccatgtacaacgaactgcgtggaacccccgaaaagaacccagtggtgatcacacaagtcccgctgaacccgaaggcgaacatagagaagatgacc

SEQ ID NO: 49527 - DNA, 367 bp, Heterodera glycines
  SCN-specific regions: Sequence locations=1-367
atcggatgcgacgaaaaaggctgagaagatttcctttggcaatttgaacgactctgatcggattttcactaatctttacggacgatatgactatcgcctcaaaggcgctttggcgaggggcgattggttcaaaacaaaggaaattattctgattttttttaaatggattctcggtgaaattagcacttccgggttgcgcgggcgaggcggggccggctttcccagcggaaagaagtgggggttcatgggtaaaccgttcgatgggcggcccaaatatttgggggtcaatggaaacgagggcgagtccgggacatgcaaagatagagagatgatgagacgcgagcctcacaaaatgatcgaagggtgt

SEQ ID NO: 49528 - DNA, 552 bp, Heterodera glycines
  SCN-specific regions: Sequence locations=1-115,143-324,346-349,371 -429,455-552
cgggtcacattggtcgcgactgtcctaacagtggcgggggtggacgtggtggaggaggcgatagcgtctgctacaactgcaacgagccgggtcacttctcgcgcgaatgtccgcagggacgcggagggggcggcggcggatcgcgcggtggtggaggcgacatcgtctgctacaactgcttatgagtcggggcatttctcgcgtgactgtacgcagccgcgtggcggtggtggcggagggtcgcgcgggggaggcggtgacagtgtctgcttcaactgcaacaaaccgggacatttctctcgcgagtgtccgaacggtcgcagcggtggtggtggaggccgcggctcgcgtggtggcggtggcggcagtgtttgttacaactgcaacaagcctggtcacttctcgcgcgagtgcccggaggagctcgttagcggggaaggagaggaagagaaagcgatggcattggtggaattgttttgttgaccggagggagacacggccttttgactttttcatgcccatctcacttttccatctattgtttcaatcatc

SEQ ID NO: 49529 - DNA, 645 bp, Heterodera glycines
  SCN-specific regions: Sequence locations=1-593,615-645
ctcaaactcaaaaaaaaattgcctttgtttcctcgtcattttgcttcatatacaaaaaatttatacgcccttcgttctttcgtcaccaaaaacacatttaaccaaacaattatgacttgcgggttggctgtgaaacgtccgttggaccttggacaggacggcagtttggtggacgtcaagcggccgcgccatggcggcgcatcgccacagtgttcaccgtttcgaccacagctcggcattctggccacttcattgatgcaatccgtgccaccaaaggtgcctagtcctcctgctttcactggtactgcttccgccggcgttggccccatcggcaatccgtcctcaccatttgcggacgtgtccggccgttgtcgcttgtccagcacccagctggactcgtacttgcgtgccgaaatccaggcgctgaaacggcgccggctgatcccgcgccgtcagggcaattttccggaggaagggttcccgttgagcaccaccaacgttgtcgtcaatgccaacaaaggcactgccaccgctgtggcggcgcccaccggtggcattgttggcacgccggtgagcagcaccagtggcaacgcgtttcgcaaggcgacatctccgtcttcatcaaattcctccgactcggagggt

SEQ ID NO: 49530 - DNA, 651 bp, Heterodera glycines
  SCN-specific regions: Sequence locations=1-651
caattaagatcatcggcacacgaagcgatgatgaatggcgattttcttggcaaaaattttgcgctcgcctacccggaggagcgcgagtgttgcctggacagcaacggggcagcagcgacatgctgcaaattcaaccggtttggcactctgatcgcggtgggcagcacggacggccgcctgttcatctacgactttatcaccaaaagtgcggtcaagacatggaatgcccacgtgaagccggtggtttcgctgtgttggtcccgcaatgggaaacgtttgctgtcctccggcgtcgacgggtcggtcaaagtgtggacagtgctggacaccgcgcaacccgtgcaccatttccagttcggcatcggctgcaccgcgcaacaggcgctgttcaacccgaggaatgacaaccaattgctcgtttaccttgtgctcgtttcggccaacagttgctcaagcccaattgtcaaaagcctcgaggacggcaccgaggcacggctgcagctgaaccatggcaacattccggaggagtcggtgtccgccgccgcgtacgaccggcgcggcgagtacatcatcaccggcagcaaccggggtctgattgtggtgtactgtgcccgaacactgaagccggtgtcctactgtcggcagaacaca

SEQ ID NO: 49531 - DNA, 178 bp, Heterodera glycines
  SCN-specific regions: Sequence locations=1-178
ctcgaacggataccgtcccggcactcgttacatgttcctgcgcccgttcggcaaggaccgcgtttacccgctttctacattctaccgcgtgaacaatcggtgcgacattgtcaccatggacgggaacggcaccttcacgatcggcatgcccttcaaggtgtaccacggaaagaccggc

SEQ ID NO: 49532 - DNA, 298 bp, Heterodera glycines
  SCN-specific regions: Sequence locations=1-238,260-277
cggtgctaacaaggacagctctatcgacagtgcttcagagctgttgggcctaatgcacataacttccaccgccgcttatggaattttggcccgatcttctttggaccaacaatctaatacagaccctttggacgatagcaaagctcctatgctttcgagggtgggcgaattgagagaacactattgcacatggattcaccaacactactactgactgcttccgcttttccaaacccaccttttggagcagatgactccgactgaatggcgacttattcccctcatttgccttcccatc

SEQ ID NO: 49533 - DNA, 629 bp, Heterodera glycines
  SCN-specific regions: Sequence locations=1-469,491-629
tccgcgttggtcattcactcgcgcacgcatactggtgatcgtcccttcaaatgcgaggagtgcgggcgcgcgttcacaacccgaggcaacttaaaagtgcacatggggactcattcggcccctcagaacccttcgaggcgtggccgtcgcattttcgacatggaggaggtgttgctgcccgccttccgctccatttcgtcctctgcccaccatttgcgcgattcgcccagcgacccgtccccgcacctttcccccgaatccccggacgcgtcgtgcgcccccgcctttctcgccaccgatccgtcggcgttggccgcccaaatcgcaatgttcggaccccaattgtttctgcagcaacttctcctccagtggggcgcccaattggcccccggggcgtcgacggcggaagaagcggcgcaattttccgcagagaatgccggaggggtgacggaagacgcggccgaatcaccggcagaggacgcgcgggagactgtcgcgagaatgacaacggccgcatgaaatgccaaggcacattcagtctgtcagctttaaccgggaactcagctcgagaaatattgaagcgatccgccaaatttgatcacaaaatttcatgcgaatttttgcttttt

SEQ ID NO: 49534 - DNA, 443 bp, Heterodera glycines
  misc_feature (219)..(219): n is a, c, g, or t
  SCN-specific regions: Sequence locations=1-443
gttaatataagcatagaaaatgccggaacgtttgacttacttttagaccgctttgctacaacacaaagtccaataaaacgaaagtggtgaagacgcccgggggacggaatgtgttccactaccgcaataagcttggttcaatcccaaaatgtggcgacaccggtgtgccgttgaaggggattaaagctgtgcgttcgcgtcaattggccaaaatgacanagcgtaagaagacggtctcgtgcgcttacggtggttgtctcagcggtgcgcgatgtccctgacgaatctctcccgcctctttgagggcaggggagtaaatgtgcgcgtcacaattgcatgggaggacatcgtccgctgcattatgaaagtgtcccattgcaaccattacaaggcgcgttcgatgactcttctttttttcgcttcgcttggccgtttgatattcg

SEQ ID NO: 49535 - DNA, 542 bp, Heterodera glycines
  SCN-specific regions: Sequence locations=1-114,136-542
agcagttcagcctcaaaagccgtgcccaatgcattgttgacggacgaaatgtggacacttttgacggctttgccttcaccgccccgctctcctccaattgcttttctgtgctggccaaacactgcagcagcccaatggaagaacagcatcagcagcagccccaatttgttgtgatgctgaagaaagtgccgggcaaacagaacgccaacaaatcggcacaaaaagcggacaaagtgctgaaagtgatcactgctgagcaacagatcgaatgtcagcccaaaacagcgcagggcaaaaagggacaaatgatttgcaaagtgaacggacagccgatcagcggggacgagcagtgtcaggacgagctgcagcaccagcagtgcgtgcagttcaacgacccacgccagacggacgtgaccattcgcacggggccaatcgcagtgcgattcaacggacgcaaggcgtggctgaaggtgtcccaggcgtacaagaacgcccagtgcggactgtgcggacactacgacgacgcggacgagcaggagcag

SEQ ID NO: 49536 - DNA, 409 bp, Heterodera glycines
  SCN-specific regions: Sequence locations=1-296,318-409
gaacggggcaaatccctccgcggaggaacttgtcgacggcactgaacaggcggtggaacccgccattgactttgtgctcaaccctctactacacgagatgaattgcttccagaacctcccaacctttttgggctacctccaggacttctgtgacaacatcattgcccacgtggataaggagccaacatcagctgactaatgtgctgccgtcattaatacgatcacccggctggcgctgcctcattgctggtccacacaccggttcctgaatctcgcattctttatcggggacaacctggccgatgtggagggcgaaagacacgcgtgcattgttgagtagcgtcccgtcaatggtgaggaacggaccactatgatgctgatggaagacgaactctttgtggacaagtgc

SEQ ID NO: 49537 - DNA, 406 bp, Heterodera glycines
  SCN-specific regions: Sequence locations=1-264,286-406
atccggaaaaactttaagaaaacacctcgatgttggacggaaactcccaactgacaatgacccaaatccgacgctgcatgaaaagatgatttgtgccagcaaccacctcgatgctaaggctcgcttctggtacttcactaccgtgttgcatcctgttaaaaaaacacacggagaaattatttcatgtcaagaggccttccataaaaagcctggctccgtgaaaaactttggcatttggctccactacaatgctcgtactggacaccacaacatgtaccgccagtatcgcgatgattgcgaagcgggtgctgatacgcagtgctatcacgacatgggcgctcgacaccgcgctctagcggatcgcattccgatcgtcatagtgcaaaccatcgacgcggcggactgc

SEQ ID NO: 49538 - DNA, 615 bp, Heterodera glycines
  SCN-specific regions: Sequence locations=1-5,27-329,351-615
aattcttattttctcattctcctaaatgtggcacacttgccccttcgtgcctattttgcttctgtaccttgtccttttccttgatgccctattctctcgtcgctactgaccccaacattctactttccgacttgggaagaaaccacgacactgacgacaaaattgcctgccccgacgcgaatgcacctgcaccggtgtgccccttctaatgtcccacggtataaacgcttgatcacacctccttcaacgggtgcgtgaggaggaattgacgacatgacgacttccccgtgaaggatacgagaccaccccttccatgtcactttcgtgctccagatgttgtcctgcgctggtgctgaccgtcttcagacgggaatgcgcggcgcctttgggaaaccccaagggttggtggcgcgtgtcggcatcggtgatatgctgatgtcggttcgtgtccgtgaccagcatcaagcccacgctcttgaagcattccgtcaagcaaagttcaaattccccggccgtcaatacatcgtcatttcgcgcaaatggggcttcaccccttttgaccgcgaagtttacgagaagcaccgcaaggaagggcgagtcattccggacggagtc

SEQ ID NO: 49539 - DNA, 607 bp, Heterodera glycines
  misc_feature (16)..(16): n is a, c, g, or t
  SCN-specific regions: Sequence locations=1-202,225-234,271-336,360 -525,558-607
gtgtaaaaatgtccantcggaaagaatgacgcgcctgagaaaggctcaggaaagcctgacaaatccaagaacattatgcgaattgtccgcattcgcaaattgtgtttaaacatctgtgttggagaatctggtgataggcttactcgagcagcgaaggtgctggaacaacttacaggacagcctcctgttttctccaaagcccgatacactgtcaggtcctttggtattcggcgtaacgaaaagatcgccgtccactgcaccgtccgtggacctaaagctgaagaaattttagaaagaggattaaaggtccgtgagtatgaattgaggaaagacaatttctcagacacaggaaactttggatttggtatccaagaacacatagatttaggtattaagtacgacccatctattggtatctacggtcttgatttcttcacagtcctaggacgaccaggttttaatgtatcgcaaaggaaacgaaagaaggccaaagtaggagctcctcatagattgactaaggaagacgcaatgaagtggttccaacagaagtatgatggtataattttacccagcaaaaagtgaggtgttggatttcattgttaatgtc

SEQ ID NO: 49540 - DNA, 169 bp, Heterodera glycines
  SCN-specific regions: Sequence locations=1-169
gaactgtgggatgtggctccgctacgattctcgtactggacaccacgacatgtaccgcgagtatcacgatgtatgtgaagcgggtgctgttacgcagcgctatcgcgacatgggcgctcatcaccgcgctcaagcggatcgcattctgatcgtctaagtgcaaaccatc

SEQ ID NO: 49541 - DNA, 544 bp, Heterodera glycines
  SCN-specific regions: Sequence locations=1-544
aaaaaatcgtccacctatcagaccggacggacgcgaagtggcaattgaatacggtaccggatcaatgaaaggcttcgtctccaaggacacggtttgcattatggacggtatgtgtgtggaaggtcaggagttcgcggaggcgacaagtgaaccaggcgacacttttgtaaacacaaaagctgacggaattctcggaatggcttacccgggaatttctgtgcagaaattgtcaactgttttcaacaatttggttgagcagaaagaagtggaggagccggtgtttgcattttggcttaatcgagacccttcgtacgaatttggtggccaaatgaccgtcggtggcatggacaaacgccggtttgtggaaccaattaattatgtgccggtcactcgccaaacttattggcagttcaaaatggactcggtcactggcggacaaaatggcaaaagcaaaattgcatgccgaaacgggtgccaagcaatcgctgacacgggcacttctctgatcactggacctcagaaggacgtggaagccatccacaaa

SEQ ID NO: 49542 - DNA, 618 bp, Heterodera glycines
  SCN-specific regions: Sequence locations=1-464,486-618
gtttgagccaaaaatgagcgtcgacattcatgaaagtgattgcctggacgacattaaggaagtggtcgatttctacgacacaaaaggagacggacgaatccgcgttgaccaattgggcacgtgtttgcgctgcttggacttgtgcccaactgaagcgcaaattgtgcagctcagtcagcaatggacggacccaagcaatcgcctgacggtggagaacattgcgcccattgtgaaggatctgcgcaaggagggcgtccgcgaccgatcggaggctgaactgtgcggctttttggagaacttcgactgggacaacagcggcttcgtcagcaccgccgacctgcgccaccttctcacgcgttgtggcgagccattgagtggcgagcagtacgagcagctgatcagagaggagcgagcggaggagggacgtgtgaacatcgcggaattggtgcggaccatctgcggaaaagcggaggagagagcgcacaaggaacagagacgggagggaggcgagtgaaagacagcggcggaagaccaaacgatcggaccgatcaatcggccgacagatcgatcgatgtgaaagggacaaaaagcgcgaaactaagcgattaatcaacaaca

SEQ ID NO: 49543 - DNA, 510 bp, Heterodera glycines
  SCN-specific regions: Sequence locations=1-388,410-510
gcacgacaacacattcctgagccggcaattttcacttatgcatccaaagatgccattctctacgccttaggaattggtgccaacactgccgaggatttgcactatgtttatgagggccatcccgactttcaagtgtttccaacctttgctgttgtgcctgggatggtggccgtttcattgtcggattggcctggcattcaatttgatctgagccgggtgcttcacggcgaacaatacattgaactgtacgcaccgtttccggccgacggtgcgcgactgcgctccgaaatccgagttgccgacctgttggacaagggggcgaacgcagtgatcatctccgaggtgacaacattcgacgatcagtctggcgaaaagctttgcattcaacagtttgccatttttcaaggcggcgccggcggctttggcggcattcgaacttcgccgtccgagcgcaaagtgccgccggtgccgcaggggcgtgagccggacgcggtgttggagcagcgtacg

SEQ ID NO: 49544 - DNA, 238 bp, Heterodera glycines
  SCN-specific regions: Sequence locations=1-146,170-238
gatgtttcgtgaagcgggagctggtactcaatgctatcttgacttgggcgctcgtcaccgcgctcaaacggatctcattctgatcatcttagtgcaaaccatcagtgtggcggactgcaagccagccggggtgaagcaatttcagaactccaagatcaagtttccgcttcctcaacgtgtgaattcctagccacgcaatgtgactccattcacgacacagggtccgacaactcatttt

SEQ ID NO: 49545 - DNA, 614 bp, Heterodera glycines
  SCN-specific regions: Sequence locations=1-380,406-614
atatgcttccattcgaagtccaacatttttccactggaactgcggacacagcgccgtccttccacgccgacactatccatcatgttgagttcgacttttacggccaacgcgttgcaacagtgtccagtgacaaaacggtttgcatttgggacaaggacacacagaacggcgcgtggaggaaaagcgcgtcatggaaaaaacacggtggtgccgtttggaaagtgcgttttgcgcatcccgagtatggccaagtgttggccacctgttccttcgacaacaccattcaaatcttcgacaaagacgctgccgatctgtccgaaatccgaccgatcaccggcgccgactcgtccaatgggtgggcatgtcggaccgttttacgacaaagcaatgccagcgccagcatcactgacattcaattcgcgccgcattatttgggccttcaattggccgcttgcacttcctctggtcgactgatcatttacgaagctgaggacattatggcactggacaattggaacgttctccacgactatgaagtgacaaagaatcggcttagttccctttcgtggagcacaaatcgatttgaccctcctcatattgttgtcgcgtccgat

SEQ ID NO: 49546 - DNA, 632 bp, Heterodera glycines
  SCN-specific regions: Sequence locations=1-198,220-502,545-632
cagaacacaaacggccaaaaattcaagttggaacgctttatgccttcccagggcgctttttgtgccactctttttgcccccgtcacttacccaccgacgaatgtcaccgttttccttgctcacaattcacaacccgcggaactcgtggcgtatggaattttactcaatgtcaaccccgaccgcatagttctgaaacggactgttttgtctgggcacccgtacaaagtgaacaagaggacagctgtggtacggtatatgttctacaacagagaagacatcgaatggttcaaaccagtggagctttacacgcacgaaggcaggcgaggccgaatcaaacagccactcggcactcacggactggtgaaatgtgtgtttgaccaaccgctgagtgtccaggactccgtgctgatgaatctgtacaagcgtgtgtttccaaaatgggactacgacgaccgattggaagggacaaatgcgacgaattcggacggaaggaattccaattttgaggaggaggaagaaaaagggggaaaaagagggggaaagacggtgactttcctggagaaatgataatcgaataagccattcgattgattgccaccatttttaaacatttatttttgttatttgttgaa

SEQ ID NO: 49547 - DNA, 250 bp, Heterodera glycines
  SCN-specific regions: Sequence locations=1-250
tcgtgagctgcagaataatatgatcgggtgtcctgtcatcttcattgcctagcgtaggattttgccaaaccctcggcttggtaaaaaccgtaagccattgggacagaagcgtcctcgttcgcgggcgctcactgctgtgcatgactcacttctcgcagacgttgtattcccagctgaagtggttggcaagcgaactcgagtcaagcttgacgggaaacaaatcatcaaagttcacttggacaaggcacaa

SEQ ID NO: 49548 - DNA, 634 bp, Heterodera glycines
  SCN-specific regions: Sequence locations=1-229,251-491,513-634
gtattcttttaacatcaattttggattccaacaataaaatgattggggaagagcttacggatgttgacaaggctcgcattgcgtcagacattctgcttcagtcgccgccgggcgagttcaacgaggtgttcaacgacgtgcgcactttgttgcagaacgacgcacttttggaaaagggcgtctgtctggaggcggtccggcgctacaacaaggcacagtttgtgccggtcaaccccgagccgggcgctgaacacccgactttgatcaccgaacacaacgaattgccggacggacgtttcgtggacccaaaaacgggccgtgttttcaaatacgaccatttgcgaaaggaggcggccgatgcgcagccgtcggggcccaaggaaattgacgaaaaattggagccatggcgaaaggcactgcaaaaagagttggacgagtacatttacgagcatttccatctgaccggcgtcgccactgttttcacgccgttgcagcaccaaaaagagccgaaactcattctatgcattgagtcccatcagttccagccaaaaaactattggaacggtcgttggcgttccgaatggcattttcccaactttgacggctcttcaaaaacggcggggactctccaaaa

SEQ ID NO: 49549 - DNA, 403 bp, Heterodera glycines
  SCN-specific regions: Sequence locations=1-403
ttccatcacatgttcgaccccaaaagctgacttggacccgtacgcgtccgcactagagattatcctcggccgtgctaaacggctttctgatgtgataaatacccaactccggccaatcgggactctaaaaatgcttggctcctgctcgggttaccttgatcttactgacgacgggcatgctttactccctgaaatgaaaatccaacgtccaactgcttcattgatcccctaggggtgcaccgcgttgaataacctccccggcgactggacctctttgaccattcatgctgattgcctaactgctcaaacagggcgcacaattacagtcagctgagggtagctccacccccatttggtctccccgggtttccagttggcccctgaccgtttgctcccactgttg

SEQ ID NO: 49550 - DNA, 301 bp, Heterodera glycines
  SCN-specific regions: Sequence locations=1-301
catcacgaccattgaacatacttcctaagttttggttgtatctgctcaactctatgcccaaagctgtatgctctatttcgccgctcacatcagtgccactccgatctggggccgctttacgcccggctctttgacctatcaaattctcaagaatttcctggaaccgcatctgctcatgattgccaacccacagttagaccacactggcgtccgtcaagcgtcctacatgaacacgccagtgatcgcagtggccaactcggactctccgacgaaaattgtggaccttgccattcccgttaac

SEQ ID NO: 49551 - DNA, 473 bp, Heterodera glycines
  SCN-specific regions: Sequence locations=1-257,297-396,421-447
tgctttttcaaaaatgccatctaaagctaatgcaattggtatttacctcggctcgacttattcctgtgttgtattcttccaccactcaaaggtgtacatcatcacgaaccaccaaggacaacctcaccactccgtcctatgtcccgttcaccgcacacccaacgtttgatcggcgatgcgaccaataaccaggatggcgatgaacccatccaacaccgtgttcgacgccaaacgtctcatcggacgcaagttcaacaacccggcggtgcagtcggacatgaagcactggccgttcaaagtggtgcagggagagggtgctcgtccgaaagtgatggtggaagtcaaaggcgaggacaaagcgttcttccctgaggaggtttcgtccatggtgcttatcaagatgaaggagacggccgaggccttccttggccagactgtcacggatgcggtggtcacagtgcccgcttacttca

SEQ ID NO: 49552 - DNA, 576 bp, Heterodera glycines
  SCN-specific regions: Sequence locations=1-469,494-544
ctcaaattcccccatctctaatggcatcactttttcgcccgtttgcattggcacagcgtttggctgtgcttggccgtcgttcgctgcacatttcggcatcattcaatgcgctggacgaagcggcacgcgctcggatcagcgaatgtgtaaattctgcgcctgtggtcgttttcatgaagggttctcagctggagccaaaatgcggattcagtcgaaatgtcaaattggtcctcgaccttcaccatgtgccatttcgggactttgacgttctcgaggacgaagcacttcgccacgacgtcaaggagttcagcgattggccgacaattccccaagtgtatgtgaacggcaaattcgttggcggctctgacattgttgtgcaaatgcacaaggacggcgagattgacaaattcttcgatgaggagggaatttcgtcacgtttttcgcaaaaatttaaacagcaaacagaagggggagaagaaggaggaggaggacagccggagaagagcaacaaatgattggatatatctaaaagatagaaaaagcacaaattaaatttgttttgtttttgaaatattt

SEQ ID NO: 49553 - DNA, 370 bp, Heterodera glycines
  SCN-specific regions: Sequence locations=1-370
gactgcttcacggatcgccaaggagtgaaccgcgcagaccaacggcaccggcgacgggaccacgacgaccgttcagctgattggcgaactgctcacacaggccgagaattacgacagcgagggtgaccacccccatttggtcaccgagggcatccaactggcccatgaccattggccccaacggtgggccgcctccaaaaagaccgtgccaatcgaccggccgctgctcatcgaagtgggcaggacgacgtggcgcacaaaatggaaccagaagtgggccgaccacggcacggaatgtcggggggacgccgttatgggaattcctcggggagaaaacgacgcggaggccgacttgcatatgagagaaaat

SEQ ID NO: 49554 - DNA, 286 bp, Heterodera glycines
  SCN-specific regions: Sequence locations=1-286
ggatggacgaacagccgatgaggcgatcgttgccactgtgagtaaagttggcgagaatattcaactcgcccgagcatcagtcatttcttcttcaccagcgaccaaacttttaggccaaacccatccaaaagaagaatttaacggcgttcaattgcgacgttttatttccctggtgtctttgggtcacaaatcagatgacagtgtttctgactttacaacagcgcaactaggccaagtgacatgtcaccacatcattggaatggcgccggaaagactgggtgaacca

SEQ ID NO: 49555 - DNA, 406 bp, Heterodera glycines
  SCN-specific regions: Sequence locations=1-406
aaatctgttcgtggggtttttcctcaaaaaagagatgccctttttgttggttggcgtggaccctgatgcacacacgaccgttgtgcacaaggttaaaacggtttaaactgtcaccactatggccacaattggtatcgaaatggatacagatgtgcaggcaaacatgttcaaaggcgcgtctgctacctctgtggacaggacaaaatttgatcggtatacaacccctcgttccatcaatacccttggactaattgtcgtcgtgcacagcaacgtccgctaccctgcgcactacgcgcgtgatgaaatgatgcaaatgtttgtagagaaccatctgcgcaactcggtgctgttgggctttgcgtacactccgaggtaaccaaaagctacgcacgaccaaataattgac

SEQ ID NO: 49556 - DNA, 241 bp, Heterodera glycines
  SCN-specific regions: Sequence locations=1-241
acggacacaagtggatgaagttgccggcgtaatgaacgcgaacgttggcaaactgatagatcgggaccagaagctgtcccaaaaggaggaccctgctgatgcacttaaacaacgtgcttttttttttaagaaaacgacaacgacgatcaagcgcaaatgttgggggaagaacataacgatgatcacggtcatgcgcgcaaaatccatcccggtgatgaggagcagggccatgagggctgga

SEQ ID NO: 49557 - DNA, 484 bp, Heterodera glycines
  SCN-specific regions: Sequence locations=1-484
ggcacagctgatccgccacttctacgcgttgggatggatgagagacaacggcgccggcatggcagcgcgctttcgctgtccgaagacgggagaaagtctgatttataactcgtcaaactcgttggccaaggagatattcgccgaaaatgagcattttgtgatgaaggccagcggtacagttgtaaaacgcccgtcagacccggacagaacgccgacggcaccgttttatttgctgcgcgataaccccgatttggtctgcatcattcacacgcacacaaaatgggccaatcttatcacacaactgatcagcggggatgaatttatgatttcgggccaagaaatgatccaaggctgcgagaatcgtcagaccaagcgcagaatggaaaacattgacactgtggttgtgccgatcatcgagacggaaatcagcgaattcgttctctgtcctcagctgatgaaagttctgcaaaagtaccccgagtcg

SEQ ID NO: 49558 - DNA, 314 bp, Heterodera glycines
  misc_feature (62)..(62): n is a, c, g, or t
  misc_feature (222)..(222): n is a, c, g, or t
  misc_feature (311)..(311): n is a, c, g, or t
  SCN-specific regions: Sequence locations=1-314
aaaataagtccgaaggtggtttctgccaagaagaagagcggtggattcaacacgaagaagtnaatgttggacctcgcatccggcggaactgctgctgcagtctcaaaaaccgctgttgcacccatcgagcgtgtcaagctgttgttgcaggtgcaagatgcttccattcacatcaccgcggacaaacgctacaaaggcatcatcgacgtcctcgtccgggtntttttttttttttggctttctgtcgttgtggcgtggtaacctgatcaacttcatccgttcctttccgactcaggcgctgaacttccccntca

SEQ ID NO: 49559 - DNA, 190 bp, Heterodera glycines
  SCN-specific regions: Sequence locations=1-190
ggccgacgacgacgctgagacaatcgatcttaggcgcgtacgtaacactgttctgcagatgtggcccaaccgagggtgtttggatacccgagacgagggggaccagacactcgaccgattcaaggaccaattcggacatcgacccggcaaacggtggcccggcatgggcgagctgacctttttggttggc

SEQ ID NO: 49560 - DNA, 223 bp, Heterodera glycines
  SCN-specific regions: Sequence locations=1-223
gatgcagatgtgccacgaccgacggcatttggttacgcaagatcatttggaccgatggctggctcaactcaagggccaattccgctatagacgcagcggacaaaggcccttcaggtgcgagctgagtattttggcgagacttaatgactaccctactgaccaaatgctcctgtgcttaccagacgagccgaaaagatgctgcaaaactatcaaacaaatgtgt

SEQ ID NO: 49561 - DNA, 579 bp, Heterodera glycines
  SCN-specific regions: Sequence locations=1-453,476-579
ctgcgcattccaatggcacacctcgtcaaccgcggataaattatctacaacttcacaattcaattccggatctctggcatggatgcacgggctcagcttgcaaagccatgcacaggtgccactaagttgctcacatagtcaaagacacgccggctaggtttctacagcagaaagggcatgcgaaaatggtgtttctccaaagcggcagctaaacagctaccccgattgatggccggtcctcactaggaacaaaaggagcatctccacacctaaggcattgattttgggtaccaaatgggtgacatttggcacaacgtaccatggtgtctggtggttggcgcttaaactatgagtcaggcaccatgttactgggcgcgtgctgacaacaattacggggataccaaacttttggattccatccaacgcgatggcatttcaacagcaatgctcggccaaccgatgggtgtttgtgctgagaaaacgggtgctgaatttggcttcacgcgtgagcagcaggacgcgtatgcactcgcctcctatgcacgtgcgactcgcgcgtgggcgggcggcgcatttggt

SEQ ID NO: 49562 - DNA, 331 bp, Heterodera glycines
  SCN-specific regions: Sequence locations=1-229,251-269,297-306
gaaacatcaaccgatggagggaatttcgacgatggaggaccgtgcgtttcaaaagaaatgcggcgaaaaataaattacgagattcggaagaacaaaggcattcgaaaggacaaagggcgaaggaaagctaaacagcggcattcgcgggtgatgaagcgaacgcaatacgaaaaagcactgatcaagcgcaaatcgcaggtcccaaacatgcgtcgggaaatggagagatatgatggtgaaaagcgtggaattcgtatttctacaatccgttccacaaaattttaattttgattaaattctttcttgaaaaaaaaaaaaaaaaaaaaaaaaa

SEQ ID NO: 49563 - DNA, 343 bp, Heterodera glycines
  misc_feature (15)..(15): n is a, c, g, or t
  misc_feature (180)..(180): n is a, c, g, or t
  SCN-specific regions: Sequence locations=1-63,85-343
gataacgaggaggtntaaagctgtgcaagacggaattttcaaggccgaattaaacaactttctcatgaaggagttggccgaggacggttattccggtgtcgaagtgcgtcgtgcaccttcccgtactgaagtgatcatcatggcgacgcgcacccaaagtgtgctcgttttttttttttngcgcatccgcgaactgaccgcactcgtgcagaagtcagttagctgttccgctggacagattgagctctatgccgagaaagtgtcctgccgtgggctgggcgcggtgggccaatgcgagtgctttgagttctactttggtcggtggggtgcgctcgtacgtcgt

SEQ ID NO: 49564 - DNA, 636 bp, Heterodera glycines
  SCN-specific regions: Sequence locations=1-274,296-452,474-636
gagaaatgtccaacaaaaaaattgagacggtcgactttgaccaggcgtttgatctgttggaggatgcacgcgaccaacagcaatccgtggaagaagaaccttttccctcaacatcgactgacccatcgacgattgatcttacgattcaaaagcatgtccattcaattgtggaagagcaatcagagcagatttatttgtctaaaactaattttgaaacggacaaaatggtatccgcctacgaatcggaagaaattgaagtgaaacgaagaaaaattgtggtggaggaggacgaatcggaagagagcatcccgacacttccgccaaagttggacgaggagagcgaattgtcgcgactgaaacttcagctgctgctatcgaacttttcgcaagaacaattggaccggtacgaagcaatgcgacgggcgagtttaccgaaatcgatcattcgacggttgatccatcagttcactggtgtgaccgtcaaccaaaatgttgtaattgcaattgccggtatggccaaagtgttcaccggcgaactcattgaagaggcattggacattcaaaaggcggagagagaggcgaacactgacaaaaacaatggcagcagagagaggcagaacggggcggcagaagatg

SEQ ID NO: 49565 - DNA, 648 bp, Heterodera glycines
  SCN-specific regions: Sequence locations=1-221,243-348,370-648
caaaaaaggcataataatgtcaacgtagaagcttcaaaccatttgattaatatattggaactaatgcgcagaaaaaaggcatatgcctcaaaatacgttctctaatgattagatttgtaaattcgaatgtcttcgctggctgattttgtaaatgaacagcggagtaaggcgaacagttcgtccggtcgacaagcctatttcaatgtggccactctcggctcaaaagtcagcaattcgttcacagatttcttcaaaccaagaaattcgaatggtatcgacgacgtacagcgactcactgaagacgccgacgcggcacaaaacggacaattgccgtccaacaaaaacagaaagtacagctggatgagcttttcgtccgtttctgcttcggtgtctcccgactcgaatccctgcggtttgacgcgttttcaacgaatcgctgcgtttttcctttgcatttttgctgctggcttttgcttcacaacggctatgatgctcatccccgtcctcgtcctccaaacgcgcaaattcgctgctctgaataccctcggatctgtctttttcattgtcagttttggctttctgtggggtcctttggcgtattgtcaatttctgttctccgagccccgtcgcgtggtcaccgccgtttat

SEQ ID NO: 49566 - DNA, 635 bp, Heterodera glycines
  SCN-specific regions: Sequence locations=1-518,540-635
gttcccccatttactacttgaacccctgcggctctttccatgtcggaggtcccaaaagtgacgctggccttacgggccgaaaaatcatagtggacacttacggaggatggggtgcccacgggggaggcgccttttcggggaaggaccccacaaaagtggaccggtcgggtgcgtacggggcgcgatgggtggccaagtcactggtcaaagcgggggtctgtcgtcgctgtttggtccaggtttcttacgcaattgccatttccaaacctttgtccatcacagtcatttcttatgggaccagcccactcactgagcaggaactgctccaaatcgtcaacgacaacttcgacctgcgcccaggcgtcatcatcgaggaactcggcttgaagcgcgccatttattcccgaaccgcggctaatggacactttggacacgccgatttcccatgggaaaaagcgaaaccgctcgaaattcgtcctgagctgatggaaaaactgatcgcctatagaaagtctgaacacattccgaatggctgcttcaaagggacgcacattcacgcgcaccactgaacaacaaattgttaaacgaaggaatggaccagtgacttatccgggggattgagcatttgtgtgggg

SEQ ID NO: 49567 - DNA, 160 bp, Heterodera glycines
  SCN-specific regions: Sequence locations=1-160
aaaggtctttgaacatcagccggctgttgctctgggtcctcaggttcaagaaggctaaaatgtctttggtgtggcacacattttttcgtccttcaatgacactttactgcatgtgaccgatttgtctggacgtgaaaccattatcaaaatcagaggaggc

SEQ ID NO: 49568 - DNA, 606 bp, Heterodera glycines
atccatggcggtgcttatgaaattggctcttcggcacgttacacaaagtacgaagtgatcggccaacgatttgtgacagacgcaaattcgcgaggcattgtttttgtgagcattcagtatcgattgggagtgatgggatttgccaccaccggagatgaggaacttcccggcaatttgggcatttgggaccaaatttcggcacttcaatttgtcaaggacaacatcgcggagtttggcggcgacccgagccgagtcactgtgtttgggtacagtgccggctcgggaagcacggctttgctgagcatttcgccgaaaagccgagatctcttccagcaagcgattcgcatgagcggcacaccgttttcggtgtccggcagcggcacttttgtggcggaagagaccaaaaagttggccaaagcgatgggatgcgcagcgaatcggacaaagcaatgcctaagcgagaaaagcgtggagcaaattttcgatgggatagacaaaattgggcctgctccgctttcggtttacattgctaagttcagtccacatcgcttggaccgggaactcttcccgcaggattatcccgaaatgatcgccactgcccctccc

SEQ ID NO: 49569 - DNA, 589 bp, Heterodera glycines
  SCN-specific regions: Sequence locations=1-589
acaggtggcggcctttgccgttgattcgacgagagtgctcttctacaatgcagttccagtgtgcggcttcatcttatgctgcttcaccatggattcgtccgtacagcttacctacgccaaaattgcttccgtcatttacgccttcataatgctggccgtccttatcgccaccacaaaccaaatcgtattggagacagtcttttcgcccacctccatgttcgtgttgggcatggtgctgatcttcttctttgcctcctgcatccacccgaaggaattcaccagcattatttatggttcgatcttcttcctgatgatcccttccacttatgtcttcctctcgctgtactcattgatcaatttgaacgtgattaattggggcactcgtgaagccgtatcaaaagcgacaggacaggcgacgttcagggagaatatagccaacagagtgctgcggcgagtggctaatctcaacgacgacgattccttcttgacgcgctttcttacgagagttcgcagtggtgaagaaccgagcgaagaaatacggacacttgaaaggaaattcgaacgcactgaacgattgttgatgagcatg

SEQ ID NO: 49570 - DNA, 241 bp, Heterodera glycines
  SCN-specific regions: Sequence locations=1-32,54-241
atggggcaaggacggttattcccgtgacattttgcgtcgtgcaccttcacttactgaagtgatcgtgatgaggacgcgcacccacagtgtgctgggggagctttttgttcacagccgcaaactgatcgctctacggcagaattactttggctattccgcaggacaaattgggcacaatgcggacaaagagtccaaccgtgggctttgcgcgatggcacattgcgagtacaagcgtatcaag

SEQ ID NO: 49571 - DNA, 214 bp, Heterodera glycines
  SCN-specific regions: Sequence locations=1-214
tgtgccgtgccgctttcactaagccgggctactctttgacattggcaagtacgaagcggccagcgccgagttggaggagctccgcgttttgtcgcccgacgaggcgcacgtgttcttcctgctgggccgggtcaaccgcaaattgggcaacatgcacatggcactgctgaatttcagttgggcagcatagattgacccgcgcggggagcagaac

SEQ ID NO: 49572 - DNA, 645 bp, Heterodera glycines
  SCN-specific regions: Sequence locations=1-166,188-645
aagattgccacttcttttgctgaccattgaaaatgagtgaaaaattccgccaggacatgccgccccagggaggctatccgagcttccacgttcatcgcacgttaccaaaatcgttcctttcacctggtcgcatcatgcttttcggcgtcgttctgcccactttctatggttatttcaaaaatttctaccacgaccaagcggcaattgggaatgatgccttcgaggagcaggacctcattaacgccttggagccatttttgatggcggaacgcgacagatcggtgttgcgcatcatgaaacgcaatcgggagctggagaacgaggtgatgaaggatgtgccgggatggaagaccggcacttggtacggcgagccggtctatttcacgttgggcgacaaatggattgaaccgaatgcaatggaggtcagtcctcatttgtccttccgagactcggccttcaaccactattatcgcctcaatacgttgcggcctcagcgcaaatgttaaggtggagaaaggaaggaaggctttgtgactctgagtccatttgaacaaattagggcgtttttttgcggtgtgtgcgccacaaattaattgtgttggcattgttttgcataaatgttttgtttgtacatcatcatcatca

SEQ ID NO: 49573 - DNA, 347 bp, Heterodera glycines
  SCN-specific regions: Sequence locations=1-347
gcactttgctattaaactacgatacagaggacggactgatggagttcagacaatactccataaagtcagtgcccgcgggcgtttctcgttcggccaaaaaactgatgcagagcaaagtgccatacctgtccaagtacaaagacatcagtgacttcatgctcaaaccggagcagttgagtgacagcgaatttgaaggcgaacagacggaattggagctcacgcatgattttggtggacggggcaaaaaacgaggacagcaaaccaaattgaggttgatggaaattggaccacggatgacattacgtttgatgaaaattgaggaaggcgtcgacgcgggcactgctctt

SEQ ID NO: 49574 - DNA, 630 bp, Heterodera glycines
  SCN-specific regions: Sequence locations=1-91,113-363,385-630
atcaagtcatgcagaattatttgcacaaaatgttctatgcaatcactcatcaacaggtgtcgagcgacaataattgtccgactaaactgttgaacaacaacagcagaacaactgcaattagtcctggcacagcttcagcaatggtggcgactgagaggggcaatgccgccacttcgtcctcccttctgccgccgccgtcggccattttcgcgcctcccaacagtgccaacaacggccatctcccgccacttcccgccaacggtcttttccccggcggaattccttttccggtgttcggcataaacatcgaccagattctcaaaacctgcgaacagcttgaagattcgaaaaattatgaccaattggcccactttctcaacaaaatgccgttggcagtgcaaatgaatgtcgcgatgcatgagactgtcctcagggcacgcgctctgataagctttcatacgggaaatttcaaagagatgtacgccattttggaaagccacaaattctcacaagacagccattcgatgctgcagaaaatatggtgggacgcacattatcaggaagcagagcgaatgcgggggaggacacttggcccagtggacaagtacagagtgcgcaagaagtacccgt

SEQ ID NO: 49575 - DNA, 638 bp, Heterodera glycines
  SCN-specific regions: Sequence locations=1-496,518-638
gttacgacctctcatcactgaaactgattatgaccggtgctgccccggtgggcaccgatctgttggacaaagtgaggagacggattccctcgctgaaacaaatctgccaagggtatggaatgacggagcagtcgatgtgttcgcatttgtcagtgttcggttcggacgattcgaaaaccgtcggtcgactaatttcgaattttgagatgaaagttgttgacatcgaaagcagaaagcctttgggggtcttacaaaagggcgaaatttgcacgcgaagcccaacgacaatgcttggctatttgaaccgggcggaagcgactgcggaaaccattgacgaggacggatggcttagaacaggtgacattggctttttcgacgaaaatggccgcactttcgtcgtcgatcgcctcaaagagctcatcaaagtgaagggttttcaggtcgctcccgctgaactcgaggatttgctgctgtcccacgcgggcatcaaagactgtgcggttgtgggggtggcggacaaactcgcgggggaagtgccgaaggcatttgtggtgagggcggatcagacactgaccgagtcggaattgaagcgatttgtgagggaaaaagtggcctcctacaaacagttgggctcggtc

SEQ ID NO: 49576 - DNA, 415 bp, Heterodera glycines
  SCN-specific regions: Sequence locations=1-415
ccttttgccccatttgctgctttacttttgttggttcttttgggacttcgccaccccttcgcgcggatgccatttctggccgttcttttacaaatcgcccgtttggcgccatttggcctcttattttccgatttcggtgattcaaactgctgatctttccgcggatcgtaattatttgttcagtgcccacccccacggcatcgtcggctcaagtagtttcattttcttcgctacaaatggtgcaaatttcgcctctcttttccccggcctccgaatgcattccgtcactttggacctcaacttttggtttcctttgcgcacagaaatgataatggcctcgggaatgattccgagtgacagcaaatccatcgaatgggttttgagtcgccccgggggcggatttgccgttggcatt

SEQ ID NO: 49577 - DNA, 475 bp, Heterodera glycines
  SCN-specific regions: Sequence locations=1-475
gaggatttggcctggcttcagttggccaatgagcgacggcaaaaaatcggagttccgccgattgatgacgacacattggagaaggccattgacatgctggagaaggagtcccactttcaattcacgcaagacgaacacggcactggcctagcttatttgacgatgattgacaacgatgcgccctgttgcatttgcaatgacggcgaggacagcaatgccaatcagatcattttttgcgatatttgcaacattgctgtgcatcaggaatgttatggcgtgccgtacattccggagggccaatggctttgccgtaagtgtcaaatgtcgccgtcaatccccgtcaattgtgccctctgtccgtgcagttcgggcgcattcaaacaaacatcggatggtcgctgggcacatgttttgtgtgccatttggcttaatgaagtctttttttgtgccattttttcgttcccataattttcac

SEQ ID NO: 49578 - DNA, 474 bp, Heterodera glycines
  misc_feature (445)..(445): n is a, c, g, or t
  misc_feature (447)..(448): n is a, c, g, or t
  SCN-specific regions: Sequence locations=1-14,36-388,411-438
ctcataaattgtcttgcagaagtatttaattaaaatgattgaaacactcgagacgagcgaagtgttgaagcgggtccttaagtctgcgctgattgtcgacggagtggcacggggtttaaacgaagcggcacagactttggacaagcgtgaagcgcacttttgtgtgctggccaaaagctgtgacgaggcgtcctttgagaaattggacaaagccgaactcggtcaaatggttggccagtgcaaatacgacaaagacggaaaagcgcgcaaaatcgtcggctgttcggtggcggtggtcaaagactacggacgggacgaagaggcgaagaatgacttgcaggaagtgctgaagaaaatcagcgactgatgaggttcctatgtcatcatattgttgtttttgtttggttgttaccgcggctataaaagactcttctgtttaaaaaanannaaaaaaaaaaaaaaaaaaaaaaaaaa

SEQ ID NO: 49579 - DNA, 645 bp, Heterodera glycines
  SCN-specific regions: Sequence locations=36-39,73-231,268-462,505 -516,538-585,612-645
cctcgtgccgaattcggcacgagggcgatttgtgctcgtggcgctgcgggatattattaaattgaaatgaagttgaacgtagccttccccgccaccggggctcagaagcttttcgaagttgtggacgagcacaaacttcgcatcttctatgaaaagcgcatgggagctgaagttgaagccgacctccttggagatgagtggaaaggttatgttgtccgcatcaccggaggaaatgacaagcaaggtttccccatgaagcagggtatcctctctaatgtccgtgtgcgacttctgttgtccaagggtcattcatgctaccgtccccgccgtgacggtgagaggaaaaggaagtctgtccgtggatgtattgtagactccaatcttagtgttctgtcccttgttgttgtacgcaaaggagagcaggaaattcccggcttgacagataaatctatccctcgtcgtcttggacccaagagggccagcaagatccgcaagcttttcaacttgaccaagcttgatgatgtccgacagtatgtcattaagagacctctgccccagaaggaaggcaagaaacagcggttcaaggcccccaagattcagcgtcttattacccctcttgctctccagcgcaagagacacatgctg

SEQ ID NO: 49580 - DNA, 631 bp, Heterodera glycines
  SCN-specific regions: Sequence locations=1-449,471-475,498-631
ctttcaacggttttgtgacagagaaagcgattatggcgaacccttttgatgacgacagtgacgaattcattcgcaaaatccgggccggccgtggaattgaaccgacaaaaagtttcacaacgcccgcagcttcgcaaaacattgaggaccaaattgccgctgatgagaaggccattgagcgttacttgcaggcgtcgttggacagcacacagcgctcccgacaacagctgagctcatccgaggggttggccgagtccaccgcacgggaattgttggagcaacgggaaaagttggaacgggccgaacagaatttggacaccattcaccacaccactcagcacacacagcgcagcctgaacagcttgaaatcgtggtttggtgggctggtcagaaacaaactttcacgagcgccaaaagggttgggcacggcaaatgtcaatgccaacaatcagcagcaacaacaggaacagaccgtgcagcagcaacatcagcagcgtccgctgcatgcccatttggtgcaatcgtctgctgacgaatttgccggggccatcggtggcggaggcggcggtgttcagcccccgcaacagcactcgctgaactcctcgtcacgcgcgtacattcagggcactcg

SEQ ID NO: 49581 - DNA, 632 bp, Heterodera glycines
  SCN-specific regions: Sequence locations=1-459,485-632
atgtacataaaatagagccggttttttggcttcctgcgatttacacgtccataaattcacaactgtcttatcattgtcatcctctttagtatacatatagcaatatttcaatgttgcataatagtgaacggaaccctctctacaaatactcataccaaattccgggccaggaacgttcatacacttattcggtaccggccgaagagtttcaacaaaaggagcatgacaaagtgacaaatgggtactttcccaccaacggaagtgctgaagcggtgcttcctcatcattttgaacacagcgttaaattggacgatttgatttgtgttcgctgcaacgaaggctttactctaaatgagcaaattgtcaattcgggaggccaagtgtggcacgccgaatgttttgtttgcgtccaatgctttcagccattttctgacggaatttattttgaattcgaaggacggaaatactgtgagcacgacttccatgtactgtatgcaccgtgctgcaataaatgcaacgaatttataatcggaagagtgatcaaagcgatgaacgccaattggcaccctgaatgcttcacttgtgaactgtgcaacaaacaattggcggacatcggctttttgcgaaatgct

SEQ ID NO: 49582 - DNA, 265 bp, Heterodera glycines
  SCN-specific regions: Sequence locations=1-241,263-265
atcccgaccatctatcaaccgacttcatgtgacactggttcacgtggatgaaatctgctgcatagtcatcgtgagcggtgaaatggtgtctgatcttgaccatgaactgtctccctttgatgatctcgctgatgctcatctggatagttcctcacaattcaaaaaatctgcctttactctgacgacccaatgttgctggaataactttacgattgtcgtgttcttgtgcgcaattgtcatcctgctgatcttgtcattgtcactt

SEQ ID NO: 49583 - DNA, 643 bp, Heterodera glycines
  misc_feature (637)..(637): n is a, c, g, or t
  SCN-specific regions: Sequence locations=1-40,62-108,130-523,558-643
tataaaacttcttggttgaaagtccttcagtcacatgcgcgataagcaaaaggcgaaggctgctgtgatcactgagcagcatcgaattccgacaaaagtgacagcgacggaggaggagacggaaaacggttcggacaatgacgaaacgactgcacttataaaggagccacaaacctcaaagaagaccgaacgcattcctcttcttggcaattctgtcaatgctcattcggaccgcgaaagttcgacttccgctcgtgtgacaacggattgtcagccatcagacgaagaaatgcatcgcattttcaacgaacagtacggaagcacaagcggagaagacttcgccgcctgtctcgtcgaggcaatccgagccatcaatcgagggattaaccccgaacgaattcctcagggctcttcgggctcatattttgtcaaaaacttacaaggggaagtgatcggtgtgttcaagccaaaaaatgaggagccttacgggtcattaaatccaaaatgggttaaatgggcgcacaaattgctctgtccctgctgttttggtcgttcgtgccttgtcccgaatcagggttatctctccgaggcgggtgcttcgctggtggaccaaaaattgggcctggacattgtgccnaggact

SEQ ID NO: 49584 - DNA, 526 bp, Heterodera glycines
  SCN-specific regions: Sequence locations=1-46,72-77,99-494,521-526
gtcaaccaattggacggattcgactcgcgcggggcaattaaggttttgatggccaccaaccgaccggacactctcgacccggcgctcgttcggcccggtcgcattgaccgacgcattgaattttcactgcctgacgtaaaggcgcgtaaaaacattctccaaattcacaccaaacggatgagcatcgagcgaaacattcgatacgaattgattgctcggctctgtccgaacacgacaggtgccgatttgcgcagtgtttgcactgaggcggggatgttcgctttgcgtgcacggcgtaaggttatcacggagcaagactttctcaaagctgttcagaaagttgtgaaaggctatgcaaaattcagttcgacgccgtcctatttgacgcacaattaattaaaggaattgaaagagggacattatagaaaggaaaattctgaattcatctaattaatgcgtcgatttgtttgttatatttattgtacaatgataggttttattttattttaaatttatttaactaaaa

SEQ ID NO: 49585 - DNA, 283 bp, Heterodera glycines
  SCN-specific regions: Sequence locations=1-61,84-142,164-283
tgtttcactggatcctcctgttcgacaaggcgaagatggctttggtgctccacacatgtatttacattctttcaatgacacttttgactctggcgatccatgtggccggcactgtaaaccgttgtctgaatcaccacgtggaatgcttgttctggtccaccgatacgacgcgagtccgtactctgctatgctcgccgcgcacgatgttgcagaacgttgttagcacgttggcattaatgctcgtcttgtcaaattgcgtgctacccgtgggaccaattcaaaa

SEQ ID NO: 49586 - DNA, 628 bp, Heterodera glycines
  SCN-specific regions: Sequence locations=1-628
caaaaatttttcttgtgtaaagaaaacaaaaaagatgtcgcaacaatttttctcgaattgcttaagagcattactgacaacgaaatggcgcccttttacgaatacgccgcccctcaactcggcgtgcccattgacaaggctaaactgcaaacactgaaggcacttaatgagcaaaaattggacgaatttgaccgaaaaataaaggacgccgaggaaaatttgggcgagagcgaagtgcgtcagtctcacttggccaaggccgagtatttgtgcaaaattggggacaaagaacgcgcattggccgccttccaactgacatttgacaaaaccgtgggcatcggttatcgcatcgatttggtgttcaatgtgatccggcttggcttcttcttcatggaccatcagatcatcacggaaaacattgaaaaggccaaatcgctgatggaaaagggtggcgattgggaccggaagaatcggctccgctcctacgaggctctctacaaaatggcaattcgcgaaatgcgcggggcggcgcttctctttttggaggccgtgcccacctttgacgcctatgagctgatgagctacgaagacctgaccttttacactgtgatttgctgcgtttatgctt

SEQ ID NO: 49587 - DNA, 526 bp, Heterodera glycines
  SCN-specific regions: Sequence locations=1-94,116-212,234-379,403-526
ttactgcaagcgtccggacaacagctcaaagtcgtgcaaaactcgtggttcagatcttcgtgtccatttcaagaacacacacgagacggcgcgtgccatcaaacatatgccgttgaaccgtgccatccgctttctggaaaatgtacgggagaataaggagattgtgcctttccgccacttcaactgcggcgtgggacgcaaagtgcaggcgcaagcgtggggcacaacacatggacgttggccgaaaaagtccgccgagttccttctccaacttctcaaaaatgctgatagcaatgccgaggtgaaaggcctggacgtccaccatttggtcattgaccacatcctcgtgcaagctcccgccgaaatgcgtcggcgcacttaccgcgcgcacgggcgcatcaatccgcacatgagttcgccatgtcacatccaagtgagtctgacccagaaaaaggacctcattgccaagccggccggcttattcctctaagtgaagaaagagtccaacaagaagctgcgacggcaa

SEQ ID NO: 49588 - DNA, 241 bp, Heterodera glycines
  SCN-specific regions: Sequence locations=1-241
ggagttgttcatccacgctggtcccgtgaccaacctggacctgccgaatgatcacatcaccgacgctcccggggcttccgctttgtggagcttcttgaccgaggaggacgctgattatgccctcacaatcttgaacctgatcaagctggtcatcaaacctatcagcctgaacatagcctctgcaaatgagaagaacatggacgtcgagacctgatttgtttgtgggcaattaggacccgag

SEQ ID NO: 49589 - DNA, 631 bp, Heterodera glycines
  SCN-specific regions: Sequence locations=1-283,306-610
gtctggactacccaaaccttcctttgattgcaatgaattcgagatttgccaatgagaagcgagtgaattactacccaatcgaggttttggacatcattgacaatcagcgagtcaccactcagcaacaaactccgacaatgattcagcagtcaatcaaaaagtgtgccattccaccattagtcttcaagcgtcaggttcacaacactgcgaagtctattcatctctgggacagtgaatatctagatgaggcagggattaaattgactaccgagccaattgccctcagagctcaccagctcaaccatcctgaagtcaaagctggcgacggtaacatgcagaggccgatggtggaaggttctgctgcttggcgaatcaacagtgtgctggtccctcaatcggtgtttgctgacggtacttacagttggatgttggcgtgctttgttcaacttggtggtcgcggtcttagcgagccagaccttcacaaatttatccaactgcttgaagaccaggcaaaaagacgaagccttaaacttccagcccttccaagggaccatttgcgactggtgaatttccgatcaaaagaagacatttcagcgctgttccaagaggcttctcaatcaggaattgcttt

SEQ ID NO: 49590 - DNA, 609 bp, Heterodera glycines
  SCN-specific regions: Sequence locations=1-209,232-377,399-433,459 -470,492-609
gttgttgctcgttgcgttgtgagcacatcaaattgcacgatgatatggacgacctgaagtatgttgtggaattcgacttcctcggcaaagactccatccgctattacaaccgtgtgccggtggaaaagcaagtgttcaaaaatctgaagctttttatggaggagaaagacccgggggacgatttgttcgaccgattggatacgagttcgttgaaccaatacctgaaggaactgatggacggactgaccgcgaaagtgtttcgtacgtataacgcgtcgatcactctccaagaacagctggacaaactgacaaatccttccgattccgtccacgagaaaatgctttcctacaatcgtgcaaatcgtcaggtggccatcctttgtaaccatcaaagggcagtgccaaaaacgcacgaaaagtcgatggaaaatttggagaataaaataaaagagaagaagcaggagtacaaggagttgaaggatcagctgaagaagagcaaatcggtggacgagaaaatggcaaaaaaatacgaaagattgaaggaacagatcgccaaactgaacacacagcgcacggacaaggatgaaaacaaacaaattgcactgggaa

SEQ ID NO: 49591 - DNA, 508 bp, Heterodera glycines
  SCN-specific regions: Sequence locations=1-508
tatgttatttcggtcgcttcccttcggccgctcctttcccccgtgtcttctgcgagggaatgcctcttcattcacaggccttacttcggaaaatttcatgaacagcccaaccaatgagtcggtgctcaaatatcgcaagggaagcgcggaaagcgacgctttggagaaggaactgcagaaactgtgggcagagcccatggaagtgccgttggccattggcggggagaagacatttcgcaaggaaaaagcaattatacagcccatggcgagtgcatttgaatagccctttgaccacaaccgtcccattgcgttgattaaccatgcaacaacggaagacattcaaaatgccattcaaattgggttggcagcgcgtcatcaatgggagcgacttccgcttataaagagggctgatatttttctgcatgcctccgacctcatggcaggaaaatataggatgttgataaacgcggccacaatgcttggccaagcgaagaacattcaacaagcc

SEQ ID NO: 49592 - DNA, 205 bp, Heterodera glycines
  SCN-specific regions: Sequence locations=1-205
agtgaacactttttccccggagggccacagtttccaagacgaatatgccatcgacactgtaaaggttggttacacaaggatccgaattcacaccaaagaaggcattcttttggctgcggaaaggccttcaatgagcaaattggtggtggacaactcactgatcgcatgttcagatgttgagaagcacattggcgtagacctcgcc

SEQ ID NO: 49593 - DNA, 475 bp, Heterodera glycines
  SCN-specific regions: Sequence locations=1-475
cggaaatgcatttgcacgtttggcctggcgaatttggtctgccatccgttgacatcgaatgtcttcaatttatggcggctgccaaattctgtgctgctccgatcgcttttcacgcgtcgactcagccgtggaaatcgccaaagggggagttgccatttttcaataacaacggggaggagcaaataacggactttggcgagttcgtggaatttctgcgcaacagtcgacaggacgtcgtgttggacaacgatttggtgccgagccaattgtgcgagttcgaggcgtacaattgcttactaaaacagaaactgctgcctgccctgaaccatttattttgggtcgacaaatgcaattacggcacaattgtgcaccctctctatgcccaacaggtcaccttcccatacaacatttattacatggaaaggagacggagacgaatggacacaacagtcagagcgatcaggaagaaccaaca

SEQ ID NO: 49594 - DNA, 631 bp, Heterodera glycines
  SCN-specific regions: Sequence locations=1-285,308-631
cattagctgtgttaagagatgccaaagaaacaaatgcacaacggaggaggaggagaagccgaaaagtgccgaagtgccgccggaagcacagcagacgacgacgacgagcagcagcagaagcagatggggcctgagaggcttcagctatacaaacgccgaattcccgaaacatgggctttttcctgtcttttctatggaaatgccaacaccgccgaccaacgcatcgcatcgcaaatcggcggaaggcatcggcaccaccctccaggcgggcatgggctatggcacgcagcaggcggaggcgggcgagctgccctacgaggatatgaagaagtcggaggcgatcatcccgtcccaggccggatggaacaagggcgactcgcagaagctgatgaccaactttggcacaccgcgtgacgtgaagggcaaacatttgaagcgcatttgggaattggagtacccggaggaagccgaagtgtcgctggaccgtctctgatcagcgacacggattgaattgtgctgctgatcagcacatgaacgccggaggaaggaggcgtaggacaaatgccatcgtcctcataaagttggagcagtacacacccaccacaccgtcatcctttgccgtccggagagt

SEQ ID NO: 49595 - DNA, 639 bp, Heterodera glycines
  SCN-specific regions: Sequence locations=1-16,38-639
ttaaaacactacttcattttgttttaaaaatctgtcaattttctccaaaaaatgggcgattttggcgagtggtatcgttccattccgttaatcaccagatattggttcaccggatcaacagtgatcccattgttgggccgactgggcattttccatccgtatttgatgttgctcagttgggagctgttcttctacaaattgcagttatggcgtcctctcagcgcactgttctactacccggtcaccccacagacgggcttccactggatgttgatgtgttatttcctgtacaattactctaaagatttggagaccagtcaatttgatggacggccagccgactttttgtttatgctgattttcaattggatttgttgcacgattgtatgtttcgttgccgaaatttacttcttgctcgaaccgatggtgctcagtgttctgtacgtgtggtgtcagttcaacaaggaccggactgttcagttttggttcggcatgcagttcaaggccatctatttgccatggattctggtcgcgttcagcatggtgttgcgtggtggcggaatcaacgaattggttggcattcttgtcggccacacctactacttcctggcattccaatacgcacttgactatggtggc

SEQ ID NO: 49596 - DNA, 486 bp, Heterodera glycines
  SCN-specific regions: Sequence locations=1-404,428-486
ataaatttaaaagcctcaatgctgataaaacgcgcattttcattctcttctcgtgcattgcaacagcacagtgtcgtcaggcctcccgtccaagtgacaggcattgagggaaaatacgcgtctgctctgtactcgtccgggattaaggaagaaaagcttgaaaacatcgagaaagaagtgcgtcaagtgaaagagttgtacgaccccaccaagagttaagtcctttcatgacaccccaatctgaaataagcaaaaaaaaaggaggcctttaagatgtgcttaaaaaacaggcgtctcaccacaggtttaaaaattctttcggccttttggccgaaaatgggcgaaatcacaaaatgaacccgtgttgtgagcccccttgaaaaataaaagcgaggcatcgcggagaaattctcctgaaaaattcaagtggcgaaccccctcgacaaaaaaaacaaaaaaacgctgaaacacccccttgtaaaaatt

SEQ ID NO: 49597 - DNA, 403 bp, Heterodera glycines
  SCN-specific regions: Sequence locations=1-403
acgatccgtcagggcaatgcaaatttctgacgatggcacttcattttatgcgaccatgtcgaacagggccgcctgtttgtatgacgttgagacggcgaagagagtgcgctgtattctcgaagggcacataaagtcgggccctagcgtcatggcactgctgccgggcgaaagaccgcattttgcaacaggtgccgaaaacggcgaaataaaagcatgagactttggacagcccaagccgaacgggcacacatttggcaagcaggcagacataatcaatgcgatgcacatttggcgcaaaaatatgctggccgcgagtggcaacagcactttggacggatacgacacgcacaaaggcaaagtgcgaattcagtccgagacaatgcacagagaattgctcagctta

SEQ ID NO: 49598 - DNA, 521 bp, Heterodera glycines
  SCN-specific regions: Sequence locations=1-124,146-469,491-521
tttcacgacaatgattgatcgaaactcgccattgcacatgttcgtttttgctaatcggttagcaacttttgagggccgatggaactacaaagaaggatgcaccgctgaaaaaatggccagggcaggtttcttctgcactgagaagcgaaagaagccctctgacgcagcgaaatgttacatttgcctgcacgaaatgtattgggacccggaggacgaaccgtggttatttcaggaagagcacaaaaagcaccgcccggactgtcctttggtgaccatcggcaaacaaaatgaggaggaattcactgtgcgcgaagtgctccttttgcttgcatatgaacacagcacgaaaatgtacccagttgcggatgcgtcaatgaaagaattggacgtgttgatgaagcaattgttggcggacacgcaaaaggcagtggaagggatttgaaagcgaatgccacggatctcaaacaacaattctctcatcacttttgtgtgacattatttacgaaaaagtttgacctcct

SEQ ID NO: 49599 - DNA, 460 bp, Heterodera glycines
  SCN-specific regions: Sequence locations=1-133,164-374,396-460
ctaaaatgcaacagactcacattattcttgggattgcctcggtgtgctctctttggctatcatcgccacagccgtcactctgccatctcagccctcggacatgagccaaatggacagcaaagtgcaccacggagttgaggccttccgcgtcaacaccgactcgacctgcactgacttgatggacgtacaagtggtcgtgaccccgccctccaagcccctggataaccccttcaactccatcttccgtgccaaacctcaactgcccggacactgccactgcgctggcctccaacagccaagctgtccccctggtccgcccggcccgtccggaccgcctggaacaggccggacagcctgaaggggcaggacagcccggacatgctgaacaggctggacaacccgctcctccttgcccgccccagaacatcccctggccaccctgccctgctgggccgcccgg

SEQ ID NO: 49600 - DNA, 441 bp, Heterodera glycines
  SCN-specific regions: Sequence locations=1-118,140-441
tgcaaactttgcacaatttgcgcaaagtattcgtgcaagacttggcacagcgcatgaaaaagacgccgaccggacccgagggcgacgaagaattcttgtcaagtccgatccaaaagcagaagatcatcttcctggagaacaacttggagcagttgaccagtgtgcacaaacagctcgtccgcgacaacgccgaactccgctgcgagttgccaaaattggagaagcgataccgtgcgagttcagaacgcatcaaaagcctggaggtcgccctccgagagaccaaagagaacgcgatgaaggaccgcaagaagtaccagtacgaaatggagcggatcaaagaggcggtccgacagaggaatttggccaggagggggctgcaaattgcgaaacccatccgtcctggtcagcactatggcactgctcgccctgtgaacgcttcta

SEQ ID NO: 49601 - DNA, 244 bp, Heterodera glycines
  SCN-specific regions: Sequence locations=1-244
gacggacgatgactcaatgaaatttttggtgtgcaaatctcgcatcatgaccaaaaagatgtactaccatatgcaacattatgtgtggaaacgtcgatcagacagtgttcacatcatcaacattcccaatacgagtaacaaactgatgttcgccgcccgcgccatcgcagccattgaaaatccgtccgatgattgggatgtctctgctcaaacggacgcccaaatggctgtgctcaagttcgcc

SEQ ID NO: 49602 - DNA, 589 bp, Heterodera glycines
  SCN-specific regions: Sequence locations=1-552,574-589
ggcacaacagcaagcgataaccaataagcgtaaagctgtgcaagacggaattttctaggccgaattaaacaactttctcatgaaggaattggccgaggacggttattccggtgtcaaatggcgtcgtgcaccttcccgtactgaagtgatcatcatggcgacgcacacccaaagtgtgctcagcgagcgcggcaagcgcatccgcgaactgaccgcactcgtgcagaagcggtttggctattccgctggacaaattgagctctatgccgagaaagtgtccagccgagggctttgcgcggtggcccaatgcgagacgttgcattacaaataggtcggtgggctcgctgtgcgtacagcgagctactgagcgctgcgcttcgtcatagaaagtaatgcccgggggtgctaaattgtggtcagcggaaagatgcgcggtcagcgtggcagcgctatgaagcttgtggacggagggttgatccattcgggtaacccggtcaccgagtacatccgagaggggggtcgccacctgcaaatgcgacatggcgttttggacatcaaagcgaagatcatgttgtcacacgaccccaag

SEQ ID NO: 49603 - DNA, 304 bp, Heterodera glycines
  SCN-specific regions: Sequence locations=1-304
tgacgctgacccggatgattacggttacttcccagacccttttgaacactcgtgcggcttggagaggaaaatgctcatcgctcgggtgaatggcgacgaccgctatgagccgaacgtgtctttctgttctgaacataccacccaggactatccgaatttgctgccggtcgctttgcaggacgaacacctcccgtggctttgcggagcggactcgcactacgcgaactattgcgcttttaagtaaagcctgatgaagcgaagctattgcggacattggttgaagggcgtgcaagccgaccctgac

SEQ ID NO: 49604 - DNA, 631 bp, Heterodera glycines
  SCN-specific regions: Sequence locations=1-48,71-220,242-631
gagatggaatcgtatgtgcaagttgaagatcaagattcgagggactccggcatttcgttggctcaatccaccacctcgcagcaaagctgttttgccaaaatttattttccaactttgttcgacttcgggttcaaggttcgggaattgtattcgcttgacaccgttgaacggccccaagttccgcacaaagccttccgcagcattaacgccgatacgatggccaaccttttggggtttttaacagaagaacagttccaacggcggttcattctgatcgattgtcgctatccttacgaatacgatgcgggccacatttggtactcactgaatttgtgggagaccacttccattgagaagctcttctacccagaagaggaagaacggttcggcgaaattattgtgcgaactcccatcttctactgcgagtactcgcagaaaaggggacccaaaatggctcttgcactgcgagaatttgaccgggtccggaacgagtcgcgttacccatacgtggactacaaggagatttaccttctggaccggggctaccgatacttcttcaaggaacgcaaatttggcaagtactgtactccacaagcgtacgtgcaaatgtgggattcggcgtacacagaac

SEQ ID NO: 49605 - DNA, 604 bp, Heterodera glycines
  misc_feature (215)..(215): n is a, c, g, or t
  misc_feature (319)..(319): n is a, c, g, or t
  SCN-specific regions: Sequence locations=1-371,393-510,533-604
aaaaattgctttgccggaggtggaggacgagtgggaagccagtacaacgcgctactctaagaaggatgcttcgactactcttcgaagtaatgagacaggtgttggtgaccacgtgatggccaatgtcaacgcaaagggcaacagattctacaaaattctcgtccgataaattcaaaggcctcaaatcggggacaaatttgcttcgcgtcttgggnaaaagggaacaatggtaatgatgtacacacaaaaggatatgcctttcacgtgcgagggtataacgtcggacattatcattaatacacacgctgtgccgagtcgnatgacaattggacatttgattgaatgcctccaaggaaagctttctgacaacaaaggcgaaaatggcgacgccacccctttcaacgacccagtcaatgtgcagaaaataagtgctttgcttgagggctacggctacccattgcgtggctatgaaataatgtaccacgaatttaccggggcaaaagttgagcaccccggggggttctgggggcccactttactaccaacgggcttaaggcaccatggtcgaaggacaaaaatattacttcgccgccgccctgagggg

SEQ ID NO: 49606 - DNA, 535 bp, Heterodera glycines
  SCN-specific regions: Sequence locations=1-374,397-535
ggacaagaagttgggaaaccccatgagcggcgtaaagattcgaaaactctgtctcaacatttgcgtccgagagtctggtgaccgtctcactcctgctgcaaaggtcttaccaacaattgacctggcacaacctccgcgttactttcaaaggctcgttacactgtgcgctcgcccggaattccatcgcaatgaactattctctgtctattgcacagttcgtgcaccagaacctgaggaaatcattgatcgtggactcaaagccaaggaatatgagctttaccgcgagaatttttcggacactggcaattttgggttcggcattcaagagcacatcaatctgggcataaagtacgacccgtcgattggaatctacagcatggacttttatgtggtgctcggtcgtgctggactgcgggtggcaaaacgaccacgaatccaaggacgaattgccgcctcgcctcctgtgcaaaacgaggaagcggtcaaatggatccaacaaaagtatgactgcgttattttgccacccaaaccgaat

SEQ ID NO: 49607 - DNA, 522 bp, Heterodera glycines
  SCN-specific regions: Sequence locations=1-522
ggttaatttcgtcttggcagagcgacaaaggctcttagagcaagtggaactgttgagggaggcggtggatgagacgggcgacgtgtcgtattcctgcgaaaccgcgggctatttcttccgctatacggtccaattgggaacagccgtttcctcctcccaattttattaataaagtttcattataaattcattcttaaaggagagagggaaacagcgaagagggtggttcatgcgaatgactcaatttgatatgcgagtgattgtctcaatttgtttaggtttgcaagacatgggaatattttatggagcaagtgcaaaccatgcaaaagcagcaccagcaaaatgcgttacccaaggaatttgtcgcggagcattttccgttttccaaattcttcgaaaatcgacgacatcaatccaatttactcccattgaaatttgaattacgtgactttgaagaagatttgacgattgcgttggacggatgggagcggataaaagacattttcaagaagttggaagagt

SEQ ID NO: 49608 - DNA, 277 bp, Heterodera glycines
  SCN-specific regions: Sequence locations=1-57,81-277
ctgtgcttcgcgcaaccaagcagtgattgggcccgtggtgatagcccatgcgaagatgtggcatcctgaacatttttgctgcactcattgcggagattccattgacaatcggaattttttccagcggcaacgcaaagcgtactgtgcaaacgattaccgcgatttgttgtcaactcactgctcctactgcacccagccccttaaagaacactgcgcaaccccacttggcgggaaagaattttcccgcgggagcattcttgattgcaccgaatgcgat

SEQ ID NO: 49609 - DNA, 373 bp, Heterodera glycines
  SCN-specific regions: Sequence locations=1-193,219-234,256-373
gaacactagcggtggattctccacaaataagtttttgttggacctcgaatcccgcggaactgctgctgcactctcaaaaaccgctgatgcacccatcgagtgtgtcaagatgttgttgcaggcgccagatgcttccattcacatcaccgcggacaagcgctacaaaggcatcatcgacgtcctcaaccgagatcccaaggagcacggctttctgtcgtcgtggcgtgggaacctggccaacgtcatccgttactttccgactcacgcgctgaacttcgccttccaggacacttataagcgagtcttctcgcaaggattggacaaggagaagcagttcttgaagttcttccccctgaatttggcttccggcggc

SEQ ID NO: 49610 - DNA, 349 bp, Heterodera glycines
  SCN-specific regions: Sequence locations=1-212,235-349
tctcctgtcggacagtgcgatgggaatgggctgtgccaggttcgcttcccatgacacgacccgccccgcgcttcctttccttgcggtgcgccccccccctcacgtcgtggtggcctggatgggatggaacgactcgaatctgacatacgagacgcagtccaagccaggcattctgaccctaaactacccgattgaattcagcatcgtctcctactgggatgacatgaaaaagatatgatatcgcaccttctactacaaaatgagttgcgccccccacgagaagaccgcgctgctctgataagacacgctcaactcaaacgccaagccaaaaaagatgacccgaatcatg

SEQ ID NO: 49611 - DNA, 565 bp, Heterodera glycines
  SCN-specific regions: Sequence locations=1-128,173-565
gcgcccaacgaccaccatggagaccaaagtggcgggctgcggcgcggtgccgaagctcgtccggtgctggacggtgtcactgctgcgccagacggacggcatcatcccgtcccacgccggttggaactagggagactcgcagaagttgatgaccaactttggtacgccgcgttttttcttcaccaaaggcaaagtggagaatctggccgagattccggaggacattttgctgaaaagtcacggggaggtgcgtctgcagtccggtaccaaccggttcgcctcccagaagggctttgtttccttctgtaccaaacgtgatgtgtgtcctgaaggtgtgaatgtgaacatcctgccggtcgacttgtagccgctgccggaggataatatccgcgccagtgaccgaattgtgcgtctgcaagccggtacgacccaattcgactcgcagaatggcatgaccctgttcggaacccgacgtcccgagaccaccacaatgagtgacaaccagaaccgggaggtctcgcacgagctccaatttgacaagacggagattccgcttcaaataggt

SEQ ID NO: 49612 - DNA, 337 bp, Heterodera glycines
  SCN-specific regions: Sequence locations=1-51,74-188,220-337
ggtggggcaaactgtgcggtagggaaagacttgtctgctcatttcctacactatcaacaaatttcccaaccaatatgtgccgacagtgatccacaattatgcggtgactgtaatgatccgtggtgagccttacactttgggactgttcgacacggagggacatgaagactatgacagactgagaccgatctcctacccacagacggatgtgttcctcatttagatttcacttgtcacaccggcatcatttgagaacataaaaaaaaagtgggtaccctaaataacgcagcattgttcaaagacaccgtttcttttgggtgagacaccaatggacttg

SEQ ID NO: 49613 - DNA, 297 bp, Heterodera glycines
  SCN-specific regions: Sequence locations=1-297
gataatgactgggtgctcaactaatgtgtccggccaaaatgagtcacaccaaatcgcgattaaatccgggatcccctaggccaggcaggcgtacactgtgaactaagagtgctcttccagtcttaaggcattgattttgtgtaaccaatcttggcagctgggacaacgttacatggttttggtggttggcgttgaaagtatgaatcaggcaccattttacttggcgcgtggtgatgacaattacagagatatcaaacttttggattctgtccgactgaatggcatttccgaacccaa

SEQ ID NO: 49614 - DNA, 476 bp, Heterodera glycines
  SCN-specific regions: Sequence locations=1-404,427-476
ggaatgggcagtgagcagaacgacgctgcaacgaaagacgagagagccgtttccctcgcggcctctcataatcagttcctcaactgccctcactgttcctttcaaactcgtcgtggtccgcttcatttgaagcgccatgaagcagtcgttcattcgaggaacgttctctacgtttgcaacgtttgtcagttcgaatgtcgttggaaccgcgagttctacgagcacatgcgtcggttgcactttcctgggcccccttacagctgcgactcgtgcacttacgacgttgaccgactcactgtgctgctgactcatcgtttaacgcacacggacgaaaagccattcaaatgttcggagtgcacattccgaacgcggaacagagccaatttggtcgttcaccatcgtctccacacaggcgaaaagcccttccaatgcgaaatttgtggaaaacgttttgtcttaaaacgaactttggaaca

SEQ ID NO: 49615 - DNA, 638 bp, Heterodera glycines
  misc_feature (542)..(542): n is a, c, g, or t
  SCN-specific regions: Sequence locations=1-27,80-87,112-302,326-638
gctcacaaatgacgcaacaattcatttatgatgaagagcatgacgaatttggtgatgagattgatgataatgatgatgaagcagcaacagcattgtcgtcgtcctcttcttttcgtccacaacaaattgtccatgtcgacatggatgtgttgcgcacaaattttgcacatcgttgtgaacagcagaggcgacagcggcgggagcacaacaatttgttgcggcaaagttgtggaggcaacgatgacggcggtacgcggttgcacgttgtcacaacttctgctggaataatgtcatctggaagtcaggaggaggagagggaggaagacaacgcgtcggtggaacaacgcttgtcaatgatgctgaacaaagcggattttgctcggatgcgtctgatcggccagttcaacaacgcgtttctcattgtccgtcttcgatcggacgtgttcatcattgatcaacatgcggcggatgagaaatacaattttgagcgtttgttggcacacaatgtgatcaaatcgcaaacactgatccgcccgaaacgnctacgccttggcaatgtcaacgcggcactgatgcgcgacaatttgcacgtgtttcctgcccacggattcgattttcaatcttacaacgggagcgac

SEQ ID NO: 49616 - DNA, 476 bp, Heterodera glycines
  SCN-specific regions: Sequence locations=1-424,446-476
catatgagttgtgctgcgatatgattgatgtaacaattgacatttcatccatttatgggcaccggaatgagcagaaaaacttccgaccgattggctttgatcaggattcgtccgccgttatcactctccggaccagacaagttatttttttgcgccaaataaatgtttatttggcattggtttgtgtgatcaaagaagacaatttcgaaaagcaaggacttatcgatttcaatttcaatgtgtttaaacagggagtggaagatgtgttcgaattaggcaaaagacggttgccttccctggctgttggatgacaccaaaactcagcttctaatttttccgtttattcactggcattgtcttttatttttgttgccgcatagaccaaatttctatcaaattattattcaaatgaaatttataaagacacattcaaaaatacattcctaaaaaatgggacatcagccgagcggaggagc

SEQ ID NO: 49617 - DNA, 652 bp, Heterodera glycines
  SCN-specific regions: Sequence locations=1-274,296-652
ctttgcttcatcacgaatcaaaacttaaagccggcttcgatttgttccgtcttttggtggctaccgctctttggtacactttcacgaattgttttgttaaattcgagcttcatactggaaaatgtcacggttctgtcgaatcggcgagggttaactgctatgaaaatggcgggaaatggataccaggttttgacatcagtggacacgccttcctgttgatctacagcattttgataatctgcgaggaatccacctcattccaaaattggccctcaaaacctcgtgttaccattcatcacgttccttcccgcaaggaatttgaactatttcaacggaataccaaaataatccagtggcttttcgtttctctaatgctccttcacttgctatgggatttgcaattgttgatcacttcactttattaccacgaattttggcaaaaactcattggggcaagcattggagtgttctcgtggttcgtgacctatcgcttttggttcgtcgtcggattcccttttttacccatccggcggcacatcaaaagtttctgacctgcgattatccgccgcttttgctcacttcatccgacccttttagaatgcctttgctaccgtaaattcctcaaacgattgaatagcttttgagaaaatgc

SEQ ID NO: 49618 - DNA, 426 bp, Heterodera glycines
  SCN-specific regions: Sequence locations=1-426
aacattaccaaatatgcggaaatggcgcggagttgtggcgatcaaatgcccaaaaacttggctataatggaacaccaacgccgttttcatcccaacgacaaaacagcaccacatggaggaataactgcatttcctggcgaaggtggcaaagtgctaggcttacgtaacaaacggctgttacgcgaatacaggcctaagaagcattggtacgaatttgaggatgttgtgtttgattacgacgtgaattgttcaaagggaatgccatgggacccggaagttgccaaacgaatggacagttatacggaagtgaaatttgtcaaggatcacctcaaaaaatattgattccctttaatttttgacatttgtatgttttaaattttgtttcgaaagtaaaattacaaattaccaaaaaaacaaaaatgaaaa

SEQ ID NO: 49619 - DNA, 443 bp, Heterodera glycines
  misc_feature (166)..(166): n is a, c, g, or t
  misc_feature (348)..(348): n is a, c, g, or t
  SCN-specific regions: Sequence locations=1-34,59-188,213-443
aaaacacgcccgatgatgcgaaagtgatgtcctgggtgggattatggctaccaaatttcggcaatggccaaccgaacgacaatcgtggacaacaatacgtggaacaacacacacatttcgcgtgtaggacaagcgatggcatcgaatgaatcgcatgcatacgaantaatgcacgaattggacgtcgactatgtgctggtcatttttggaggagtcaccggctattcatctgacgacatcaacaaattcctgtggatgggtccgaatcggcggttcgacgccggaggggcgacacattcacgaaaatgattactacacaaagaatgggagagtttcgcattgacaagnaggggttcctctacaatgctcaactgtttaatgtacaaattgtgctatcaccgcttcggcactgtgtacactgaacatggccgtgccaccggttt

SEQ ID NO: 49620 - DNA, 533 bp, Heterodera glycines
  SCN-specific regions: Sequence locations=1-140,208-210,232-431,453-533
gtccaattaagctaaatatttataaaaaatggcttattctcgttcaccaagtcccaatagagaacgttcccatcgctcaactcgaaaacgctcacgcgatcggagcaacgagaggcgacacaaagcgccacgctcatcacacaaagaaagacatcgagacagggaccggcgcggagatagggaccgagacagagaccgagaaagggagcgccattccagtggtggagataaaaatcgcgagcaccggagcaagaagaaagacaatgtagctcacgctacaaagtctaaccctattaatgaaattgtcgatgttgatgaggacatgatgcgaatgatgggtttttctaattttgacacaactaaaaataaacatgtcgagggaaatgcctctggtgagtcgaagatcaaccgggcgcgcaaatatcgtcaatatatgaacaggaggggaggctttaatcgtccattggattatgttgcctaactgtacacgttgttttatgtaattgtttcacttttatatttcttttttgtga

SEQ ID NO: 49621 - DNA, 620 bp, Heterodera glycines
  SCN-specific regions: Sequence locations=1-445,467-620
gtgaggagccgttggcacggctcgaacggcacgaggaccgcgtgccgagggtcgcctttcatcccagcgggcatttcctggccacggcatgttttgactcttcatggcgcctctttgacctggaaacgctgcaggaactgctctaccaggaggggcacagcaaatccgtctttgatctcgatttccatgccgatggctctctgatgttgaccgggggcctcgactgctacggccgcgtgtgggacttgcgcaccggccgatgcatcatgtttttggagggccatcagaagggcattcacacggtgtgctggcaccagaatgggttcctgatggtcaccggcagtgcggacaacacgtgcaaggtttgggatgttcgaatgcgccgtcagctgtacacaatgccggcccatcagaatttggtgtcccgcgttcggatggacccgtccggcgagttcctggtcaccggctcctatgacaacaccatgaaactgtggacatgccagggatggcagccgttgcgcgtgttcgacgcgcacaacatgaaggtcacatgtgtggacgtgtcgccggacgagaattggattgtcagcgcatgctatgaccgcacattcaaactgtgg

SEQ ID NO: 49622 - DNA, 639 bp, Heterodera glycines
  SCN-specific regions: Sequence locations=1-483,506-551,573-639
atgaacagaggcggtggcttccatattacgattcaagcaccagtgaacatcgcactgatcaaatattggggcaagaggaatgaggaactcgtccttccgctcaacgattccattgctatcacaattgatgagctgagcgccaccacacacatcacaattgggcccgatgtgagcacggactcggtgacattgaacggagtcggcattgacatcgccggcagttcgcggtttcgaaacgtttttcagcaaattcgtgaatactcaaacagaaagcgaaaactgaagggcgagcatgcttcaaagggttggcacaccaagattgagtcgagcacaaattttccgacctcggcaggactcgcttcatccgccgccggttttgccgccattgcgtttgggcttggcaaaattttccgcttgccggagcgagacattgtcagaatggcccgaatgggctcgggctccgcttgtcgcagcattcagggcggttttgttcactggaaggcgggcactcatcagcaaaacgactcggactgtctttgcgagaaactggcgcccaccgcccattggccccaactccgtgccctggtcatcgtcgtcagcagcgggcacaaaaaggtgggcagcagcgtgggcatgcgc

SEQ ID NO: 49623 - DNA, 424 bp, Heterodera glycines
  SCN-specific regions: Sequence locations=1-424
gatgttcccacaggacggcgaccgaccgcatctccagtcgctgagaccttgtcccgagtacacgggtgcaactcctatccatggagttggttcaatgtgccgtacggagggatactggcagacggttcacggagtacaggggctcgctgtcgggtcaatgcctgcccacgacctttacttcccggactaaatggagttcatgtcttcactgactggaaagcctcatggccatacgaatgcactgtcgtactcatcggccggaatggcggcgacagtggaccacgacatcgcgatgacctcggccgaggaggcccaatagcgcaagcaaatgctgtacgagtccgtcggaggctcattggaccgtgtgcgttccatctgtcagaaatagggaatgactgaatgtgataggtgctactgcacccaa

SEQ ID NO: 49624 - DNA, 349 bp, Heterodera glycines
  SCN-specific regions: Sequence locations=1-349
agtcaaacccgatcttgtccatcgcggattgggtgccaaaatcattaggcggttcaagcatcgtgggtacaaattggctgccctgagagtggcccaggcaactgtcccccattaggaggttctcttccgggacctcaaagacaaacctttcttcgccgggctcgtctaattcatggcatcagggccgattgtcactatggattgggaatgtttgtatgtggttaaacaaggtcgcggtttgctcggcgctacaaatccgatggtctttgttcttgggagtattcgagggaatttttgcattgagatgggacgtaacatttgccacgggtccgatttggtggcttctgga

SEQ ID NO: 49625 - DNA, 316 bp, Heterodera glycines
  SCN-specific regions: Sequence locations=1-316
gacactatttgccgggaaataatcgttcaacttgggcaaactgtgctccattgtcaaaaagtggcatacactcgttgagggcaacgtggcacagaacaccaccgacggattcttactccaactctttggcattggctttaccaaaccaaatgccgataaaatcaagaagacaacctatgcaaagacatctcaagaactgatgattcctgccaatgtggtggtaataatgaagaaagaggtctcttcccgtgacttgaaagacgcggtcaataagctgatcgcggactccatcggcaaagacattgagaaggagtgc

SEQ ID NO: 49626 - DNA, 584 bp, Heterodera glycines
  SCN-specific regions: Sequence locations=1-307,329-584
aagctcgtctttggaagtgcacagccgcttccgccagcggttccaccaaaacggaggagcgttggctgtttgtgttcaacgatttgctgctgttggccagtgatcggagcgctttcattcgcggcaccaccggtgccggaaagtgcaaattgcgcgcaatttttgccgcaaaacacacccaaatttgtgaaggtgacagcttggagcgtgagcattcattttatttgcggggctccgattcgccgcagggccctcagcgatgtgtggagttgtgttgtgcttctcaggcggaaaaggatgcactgtttgacattgtttggaaagtcattcaccaggaaacaaattcaaaaaattcggcggaaacattggccaaaaacacgaacaacaatagcagcaatacagaacagcaacaacagaataaaagttgtgcacattgtgacactgattttggatggtacacgcgcccgttggtgtgccaacgatgccaacaacggttttgcaagcgctgcttcggccaacggcgcaaggagcagaaaatgtgcttggactgcttaaggacagcggaaggctatcgctccttttcc

SEQ ID NO: 49627 - DNA, 346 bp, Heterodera glycines
  SCN-specific regions: Sequence locations=1-346
cacttatgtcaacatgatcacctctgacaacgagaagacccgccatgcccttgcgcacctggactttctggacattttccccctgcaaacgatgcatacaatttgcccgggcaccccacatctgtaactgcctctgttcgaccgcgatgagtaccaattgctctcaacccaccaggactgtttcatttacctgatggatctacatacttgcgacaccaaagacgacctgcatctgccggaaggcgaaattggtgaccaaatcatacaggcctactagaatgacgataaccgcattcctgtgtcgatggcgactgcgcgcctggatgacgccatactcctgtggaga

SEQ ID NO: 49628 - DNA, 301 bp, Heterodera glycines
  SCN-specific regions: Sequence locations=1-301
agtccgttttctgcagcgtttcgtcaacaacaatccgcgcaatttggaaagagtgcgcctccaggggaagcccagcgggtgggaatttgagaagaatcgagcgcaacataacttcatttacagggtcgacttttgtccgacgaaaaatgcaattgctgcccgagtcgtccattaccaagatggaattgtgatcgaagcgtcaactcgcgagaagactggacaaagtcaactatacagtcagacggatgtctccgccgcttataacattggtcggactgttggctcatcgatgcaaaatggc

SEQ ID NO: 49629 - DNA, 293 bp, Heterodera glycines
  SCN-specific regions: Sequence locations=1-166,188-293
gtttgagcaatcgctatgttttcatcctccaaaagtgccgcagttttgcgaatgcgcggcgccaccggcgcaatggcacggcggtggaagggcggtgacgagcagaaaaatgtgccggtgccgagccccaaagaaatggcccagcggccggcggagtttgacgagctgacgcacacgggacaggcctgggacattttttattggcgccgttctcgtttcgagtacatgccgaagcaagtgaacccgagcattgcggcccatttgatcgccgagctggcgcccgtgcccagcga

SEQ ID NO: 49630 - DNA, 427 bp, Heterodera glycines
  SCN-specific regions: Sequence locations=1-427
taaagctgtcttttgtttgtcacatacaaattccgtctccgtccaaaaatgcctgagttacttttcaagaccatcacgcagcaatcgttcacaattgaagttgaggaaactgcaacgatcggcgaagtcaaacgaaagatccaacaggtcaaaggcgcagaatacccagcggagaaccaaaagctgatcttctttgtgaggatgctcgaggatgccatgttggtctctgagctgaactttgcggcgccgaaattcattgtcatcatggtcatgcgaaaacccgcgcaggcatcgtcaactgttcggtcagcaacatcctccgcatcgccacaaaagaacacatcgacagcggacggacaggcgccgaagtcggcggagaacaaagcgacgggggcgacttccaacacatcggtggcccagccgggag

SEQ ID NO: 49631 - DNA, 415 bp, Heterodera glycines
  SCN-specific regions: Sequence locations=1-243,265-415
gcgcatggccaggacagccacggagtatggacatcgcgcattttcgacttcaggtgctgcacaagaactgagcagcgcgctggacgaggagatcaaagcggagaaggaactccttcaggacaaattgggaggcacttccgcgccttcagtgcccggcttctgaatcaccacgaaaggggccgaagtgcgactgagcaaaacgcacggaaaccaaaagattggagtcattctgaacgagaatcattcgatcgacatcgaagaggacgaggagtacgaagaccagccacaatgagaaatggagacagagtctgtgtccgtctcgttgccacgcttcgcccttaacatcacaaagaacaaccagagtatgctcttcgatcttgaaatggcgaagacggaggacggcggatttaacttc

SEQ ID NO: 49632 - DNA, 610 bp, Heterodera glycines
  SCN-specific regions: Sequence locations=1-610
aattactagtaattagccggcaaaaatgtcctcttccaacacaattttgttggactgcagcgacgacagtggcgtcgtcgtcggcttcgagcagtgcgccaccagcgaaggcggaggggcggcagaaccgcagcagaaactgactaagaatcagcagaagaagcgcgcacgcatggagcggttcaatgcggggaaagcggaatggagacggaagcaaagggagcggcataaggagcggaaacgcgcgcggaaagcggacggacagacggcgaagatgaacgagtccaaatgtcgcgttcgcgttgctgtcgacatggcctacgacgacttgatggacgaacggtcggtgcgcaaaacggtgtcccaacttcgccattgctacgcgtccaatcgccgggcggcggaccctctccaattttatgtggtcaatttggacgaaaaggccaaaaaggttttggacggcatcaccggctggcaacaatgggacgtccatttgttggcccaacccttggccaaactgtgggacgaccgcgaaattgtctatctgacagccgactcggaaaacgtactcagcgcattggacgagcagaaagtgtacgtaatcggcgga

SEQ ID NO: 49633 - DNA, 554 bp, Heterodera glycines
  SCN-specific regions: Sequence locations=1-8,32-359,381-554
taaaaatttgatttttcaataaaatgtttaaatttcgtgctgttctatccaatttgtctctgtgctgttcctcctctttgctccaaatccaacgacattttgtgactgcctccattttgcgaaaatgtccttcgtccactaaacaatttgcaaatgcacaccgttgcatcagcagaacacggagcctcttcatgttcatccaagttcaagagacgccaaacccgttgagtctcaaatttttgccaggccaaaaagtgttgtccgagccgggtcgcacttacgagttcacttcagcccgcgatgcggcaaaaagtagtccgttagccaggcaactgctccgaattgaaggtgtacgcagcgtgttttttggcgaagattttatcagcatccaaaagcaaagtgtagaagaggaatgggcactgctcaagccgcacatttttgccgccattatggaccatttgcaaagcggaaaaccggtggtggtggtgacgggggcggacgccgaggcggcggaagcgaacgcgcagccgacggacacaacaattcttccggag

SEQ ID NO: 49634 - DNA, 561 bp, Heterodera glycines
  SCN-specific regions: Sequence locations=1-426,449-561
acgaggattgactttgggaatttgacttgttacatggctgtggcgcggaacaaaggaatcgaaattgttgagaatgattactctttgcatgccacgccttcgtgcgtttcctttggacaattcgctcggatgatgggtctcggagccaagcagcagctgaacatcaattacgggaacagtgtcgtgaatttcaagcacatcctcggacgcactttcaatgacaaagtcgtgcagacatttcgtcagcacattccctgcggacttatggggaagttcaccgatgaccaaattgagataaaagtcactcatttgggaacgacgcgagtgctttccccggaacaggtggtcgcctgtctgttgacacatttgcgggttcagctcagctgttctctcgggacggatgtcactgaatgcgtcattaatgtcccgtttttctacgaggaaaaccaacgccgcgctttgctgaatgcgggtcgaattgctggcctttcacttcgcctgatcacggacccggccgcgttggcctattgttacggcatgtataacggggcaaatcttcct

SEQ ID NO: 49635 - DNA, 581 bp, Heterodera glycines
  SCN-specific regions: Sequence locations=1-363,385-581
acgaggtgaaaattaggctgcaaactgcgggagagatcatcaacggcccaaaagtgaatgttttcaccgttctgcgcgagttgggcttcggcggcctctacagaggtgcccaggcgtgctttctccgcgacattcctttctccgccatttatttccccgtttatgcgcatatgaaaatgaaaacagccgatgaacagggttacaatcgcccttggtctttgtttgtctccgcttttattgccggggcgcccgccgctgctttggtcacccccgctgatgtgatcaaaacgcggctgcaagtggccgctcggacgggccaaacgacgtacaacgggcttatcgactgctcaagaaagattcttagggaagagggaccttcggcattttggaagggcgcggcagctcgtgtttgtcggtccagtcctcaatttgcggtgactctcctcacttatgagctgttacaacgcattttttacgtcgattttggtggtactcggccaagcggttcggaagtttcgacccacaccacaatattggaccaagcatcggaaaacccccaccacatcggtggatacaaattg

SEQ ID NO: 49636 - DNA, 385 bp, Heterodera glycines
  SCN-specific regions: Sequence locations=1-385
gtcaacgagccggccgatgtttgcatatattctctacacggataaactcgactggctttcgttgaacgaagcgaaaagtgtcgggaccgtcggcatcacaaaccatgctcaaaaatctctgggacacgatgtttacgtgaaaatgccctaaatagtcaaaaaattgtacagtgacaacacaacgtgtgccatccacagtgtgatagccgcctcagaccttatagctccggttgccggctaagtattcggaacagaacatcatgaactggaagaccaaccagcgctgacccacaatgactgctacagaaaagaatggctgtacaagatgaaagttatcaacctgaaggaatcggaccagctgatgagcgagcctagatataataac

SEQ ID NO: 49637 - DNA, 618 bp, Heterodera glycines
  SCN-specific regions: Sequence locations=1-284,306-618
gtccgttcgatgccccctctctctccgcctcagctttttttccccgcttttctgctccttggccattttttgccgccgtttgcccatggccaattgccctcggcgatgcttcccgccccctccacgtcccaactccaagtcaaaatctcgaatctgcccgtccatgtggccactgcgcagcacttgccccaattggtgtggagggtcgtcggcagacaggcgacagaacgcgttttttgtgtcagcgaagcgccggtcagccaactgcgctttgtctgcgtggattgtgtgcagaagaacatcacggatttggtcgactatctgaacacggcgcaggactccaccagaattgccacatcgcccgccgtcgaattgcctccggtcgatgccaatccctcgtggaccggtgccacgatcatttgccaagccgcggtcaatggggggacaaaagactctccgccgtcggttgtcgacgtgcaatatttgaggggagtgcacgtggtcgactccaacgggcagggccccgtccacattccaaccagggcttccgattttatgtggaatgcgtgcgcgggaacgacggacagtgtcagcaaagtgccgcccgacggaagacgc

SEQ ID NO: 49638 - DNA, 576 bp, Heterodera glycines
  SCN-specific regions: Sequence locations=1-166,188-350,373-576
gattattcttgagcaaaacaatagggtaattgcggaacttttggaaatgaaatttaccaatgcccgaacgaacagcaaatttgataccgtctatgttgtgttcgccgattttgatggcattttataccatgcatcaaatccggatggaggcgacaaatcaaagcttatgctgagcatttcattgaaattttacaaagagcttcaagaacatggtgcagatgaactcattcgctcgatttatggcaaatttttgtgggaaagtccacatgctggctacagcgtgtctttggtctacgatgtggctgacattcctgaaaatttcactgcgctcgttgagcatgcgtcctatctgaaacgaaactgttttgcctcggtgtttgaaaagtattttcaattcctagaaagcggccaggagggcgagaatagagcggtcattcattaccgggaagacgaaacatgatttatcgaggcaaaatcggaccgggtgactgtcattttcagcacgttgatcgaagacccggacgatgtggtaatctgcaaagtgttccttcaggagttccgtgaggtgacaagggc

SEQ ID NO: 49639 - DNA, 280 bp, Heterodera glycines
  SCN-specific regions: Sequence locations=1-280
gcgtcgacgtgcgatgtcgcacaatgtgaagcgattgccccgcgcattgcgcccgatcgccgctcggcacacacagcgaacggcacagcgaaaaaaggcaccgagccgaaaatggcgacggaggccgacgcgaatgctcaaacgatgggtgcgcgaacaaaggaaaaacgtttggttggaaacgcacatttggcacgtcaaacgctttcacatgacggaactttggggctacaaattgccaatgaaaagctgtcagcgtggttttcgcccaaattaccgt

SEQ ID NO: 49640 - DNA, 352 bp, Heterodera glycines
  SCN-specific regions: Sequence locations=1-352
gcgaactattggtgggaaacgaaccccccttctcaagactcgaaatttcattgtgggcccgccgctaatgaaaactaagagttgccctaaacaaattcatttcgcgcgactgcacgacgcgaccattttacgtcacggactgcataatgataccggaaactttgctctgtcttccgagagatttcctcacccctctgccatcatcgccattatcaacaacgcttccaacgacgaactgctgcacaccctaaccttggtcatgggagtgctcgacgcactcgatctgattccggtccccccgtggggtgaagcgcattactcaatgccattggctcccccaatgggacaaaag

SEQ ID NO: 49641 - DNA, 541 bp, Heterodera glycines
  SCN-specific regions: Sequence locations=1-508,540-541
atttatgcttattaaaaatcgaaaaatcttgtgatgactcagcagccatattttgcaacttatatacaggacctagagcaggaccctttcgatgtgattgattttgtggagcgtttggcgtggcgaatgagcaccggcaaagactgtgtggacgcggcctacctgaagaacaaatttgaagaggaaattggaagtttacaactgctctctgaccaattccaaagcaaattgaacacactcgagcagcagcaaaacaaagacaaaaccgactatttggactctctgcagcgattgcatgacaaaaatggcgactctcttgaccaattgaaacaactcgacctcacaatgcaaacggtggccgcaagggtcgtccatttgggtgaccaactcgaaagtgtccatgagccgcgtgctcgcgcgtttgaagccttgcaactgatgcggcactttgatgaattcttggcggatcagccactgaattcggcgcttttcacagacccggacagagtcattaaaagaaacaaaacaaaaataacaattt

SEQ ID NO: 49642 - DNA, 534 bp, Heterodera glycines
  SCN-specific regions: Sequence locations=1-138,160-534
gcctcttcggcttttacatagtgatgaaagggcatagtgacgaagttactggcgaagccacccgtgccgttctgcacgcgtggaagcatttggcgatgggcatcaccgacgaggaagtggacgcggcgaaaaacgcactcaaggcccgcctgttcctgggactggagaacaactcgcaaattgccactcacatagcatcggaggtgttaagcagcggcaaaatcacgccctttgatcaattggagcgacgcattcatttcatcaacgcaaacgcagtgcgggaggccgtttcgcgacacgtctatgaccgggaaattgctgtggccgcaattgggcgaattgaagcgttcacgtcatacttcgagcttcgctacggaatgagttggtggcgtctgtgaaaagaaaaagagaagcgacctttcaatggaaatattcgaattatatgtgcatgaaataggctttgctcattatgtgtaattggtttatcttctgttattaaatattgcagactgtataaaaaagagttgatgaaaa

SEQ ID NO: 49643 - DNA, 304 bp, Heterodera glycines
  SCN-specific regions: Sequence locations=1-97,119-153,178-304
gaacgaacgccctgagcgagtctacgacacacagccgacggggacttgaacacaagtccaactcttgagatggaaagaaggcggccgacgaacatcgttattggaacaatttgggcttggctttacaactcccctcgaggctattgagggcatatacattgacaagaaatgccctctcactgaaaatgtgtcaatcccacgactgattctcatcggagtcagcatcgatgacaacatgcagcgaacgattgttatccgacgcgactatcttcatttcctgccgaagcaccctcggtatgaaaac

SEQ ID NO: 49644 - DNA, 478 bp, Heterodera glycines
  SCN-specific regions: Sequence locations=1-478
tcaattctatgccggaatgaccaaaattgctggcgaaacgtgccaaggcattctcaccggactgatctccgtctaggacaagcggcttgaagtcacgaattgtttctcgatctctcgtccggatgctctgcacaaaagtgaatagagtgccgctggccccgagacgtcccgttcggacgataacaaacagggctagattctcgacatgctgaagcgatttcgaatgatgaacatccattacgagtcggtcggctttaaccaggcgcacccattctgcacctggatcacccactaactgctcgggtcattgatgcactaccaatcggacatgtcacactccgttgtcattggttacgacgcggtcaatacccgtcagggatgtctgacccttcgcgcttatcgcctctccaaaaatgcgttggatttggtcatcacttgcgacgacagctggtctcctgaacaaaccacattggctggg

SEQ ID NO: 49645 - DNA, 397 bp, Heterodera glycines
  SCN-specific regions: Sequence locations=1-397
gtccgacaaatttgtcggcaaatggaatttggagtcgtcagaaaaattttactacttcgtgaaagaggtcggcgtcaactttctcacccgcaagggcgctggctgtgtcaaaccggtgctggaattcgaagtgttcaacgccggcgatcactggaagatgacgtccacgtcgacaatcaccacctgtaactgcgagttctacctgaacaaggagttcgaggggaagacagacgatggacgcacggtgaagaccattttcgcctacgaagacggtggctgaccgcataagcagtccaagctcaaggacgacgatcaggacagctactaccagcgctacatcgatgaaagcggcaaactctttattacgatggaagtcggctcggtgaacgccagacgc

SEQ ID NO: 49646 - DNA, 451 bp, Heterodera glycines
  SCN-specific regions: Sequence locations=1-41,75-136,163-240,262-451
gattgcctcagggtgctctctgttgggtatcatcaccacacccctcactctgccatctctgtactcggagatgacccacatgaacagccaagtgcactacggagatgaggccttccgcgtctacaccgactcgaggctggactgacttgatggacgtgcaagtggtcttgactccatcgtcaaacccccgagataaccccttccactccatcttccgtagcccacgtcatactgcgcggactctgccattgcgctggcctccaacagccaagctgtccccctggttcgaccacgaccgaccggaccgcctggacagaccggacaccctgcaggtgctagacaccccggacaggctggactgcctggccaacccactcctgattgttctgcggaaatgctccactgtccgcgattgcctgttagcccggcctgacgacacgaggggacaggg

SEQ ID NO: 49647 - DNA, 658 bp, Heterodera glycines
  SCN-specific regions: Sequence locations=1-658
gtcggtttgaaggaacagcttttggatgtcacagctgcgcttgaatctctcaccaaacaaatcctccaaaatttgttctccgatggcaaagcgaaagcgcaggataaaagctttgatgaacaattgaaggcactggtcgaatcgttcaacgacaaacaatccgagtttgttgttttgataagaaaagtgccctcccaccagcaaagacagcggcacattcatattttggaggaaaacgtcaaaaaacgggacgaaatcatcggaagactggccgaccaaataaaaaacatcaaaggcgcagtggtggaagggacatttcaggccgagaaaaagctgaagtcggtcaaacagtcggagatgaaccgcgtcttctccgaggaagtgattcgctttgcgcaccaaatcagcaaaaaccattcggtggccagttcagtctattggcagcagggcgacccgtcgcggccgtacccaacggaggcaaatttcgccgtgagcaatttgctgttgagcagaacacaaccgaatgttcccctgtcatttgccgcccaagcgactcccggcggaatgctcaaatcggtcttcaatgttcccggaatgccgcaaaaagcgttttcgccaagtcctcgctcggcaatgtttgtctccaatttgggcgctt

SEQ ID NO: 49648 - DNA, 541 bp, Heterodera glycines
  SCN-specific regions: Sequence locations=1-11,44-541
ctagtctcgagttttttttttttttttttttttttttttttttaacggaaaacaatttataaaaacagaaaatttaaaaaaatggaaattttcctaatgctttttaagctgtcgtcctcttctgttccgcttttttctttgccgccactttctttgccttcttctcttcttcttcgcgaattttttcctcttgcacctcaatgtcgatcagatcggtctccaaattgactgtgctttggccactctttttcgcctgttcaatttggtcctttagcacacgttttttggccacaaagtacaccaaacgcatgtcgtaatcccacagttcgtccacttcgtttggctccctgaaccatgcgacataaatcaacagaagagaaatgcttgcgaagattgaaacgcctcggatggcttcgaatcgtttactgtcgtaataactggcaatgtaaaatgggttggaaaatgcgtcctcgtcgctttcgccgcccgtcgtccgtccgccgctgccgcgcccgtgaaaagcgctcgtctcactgaaacg

SEQ ID NO: 49649 - DNA, 295 bp, Heterodera glycines
  misc_feature (63)..(64): n is a, c, g, or t
  misc_feature (82)..(82): n is a, c, g, or t
  misc_feature (91)..(91): n is a, c, g, or t
  misc_feature (121)..(121): n is a, c, g, or t
  misc_feature (152)..(152): n is a, c, g, or t
  SCN-specific regions: Sequence locations=1-259,281-295
gggagaccgacaaagggggggccggaagacgcacagacggaaaggggccgaagagaaagaaanngagaaggggcccaagganaggcggacnaaggaacgcgaaagccacaaagcgggcganaagggggaaaaggagatgaaaccgcgacaancggacgggcaaagggaaggcgaaggggggaaacaagggagagaagagatttttttttttaaagcgacgaatgggccacgatatgtggtcgtatgtggtcggagcattgagaaggagaaactgaaggagggcacaggtgtgggg

SEQ ID NO: 49650 - DNA, 481 bp, Heterodera glycines
  SCN-specific regions: Sequence locations=1-137,159-481
gtccaattaagccctgccattccaatgagtgccgtcgaaatcaatcagagggtcgtcctcaatgggtccaaaggcgtcgtccgatatttggggcccgtcgaaggcaccgccgggcaatgggtgggcgtcgattgggacgacccgacgaggggaaaacacgacgggaaaacgcgggacggacgccgctatttcaccgcgaccgccgcttcttcggcctctttcgtccgcgagcagtgcctgcacaccggcgacgaattgttcagcgcaatctgtgccaaatatgcgacggaaggcgacgacgacgacaaatgccaaaacgaaacaattgaagcgggcgacaaaaagcgctggcagttggtgaacatggacaaagtgcggcgtgcgcagcgcgacgtgttccgactgcggtgcattgtgctgagttggtccctcgtgtcccatttggatgtgtccaaattgggcgaccgcaccttcgccaatt

SEQ ID NO: 49651 - DNA, 652 bp, Heterodera glycines
  SCN-specific regions: Sequence locations=1-34,58-418,441-652
ttaccaaaaaagagggtttgaggtatatcaatagaattattttccaaaacattttcattgtccctcatttattcttgtgtccgtttcactttctcaatttggtatggaggctgttgctgaacacgattttaacgctggtgagcctgacgagctgagctttaagagaggtcaaattttgaaggttctcaacaaagacgaggacccgcattggtacaaagcggaaattaacggagttgagggattaatcccttcaaattatattttaatgatggaacactcttggtatctcggcagcatttcgagaagtgactcggagctccttctcttgaaaaatggcaacccagacggggcctttcttgttcggaggtcagagtcgacgcccggcgaattctcaatttccgttagatttgaaaatgctgtgcaacattttaaagtactaagggacaccaaagttggccaatattacctgtgggcaaaacggtttaacagtctgaatgaactcattaactatcacagggccaatagcatatcgaaaacgcacaacatcctcctccggtccatggactccggcttttccaataaacatggccttgttcaggccctcttccatttcacccctcaagaaccgggcgaactccggttttcacgtggg

SEQ ID NO: 49652 - DNA, 435 bp, Heterodera glycines
  SCN-specific regions: Sequence locations=1-414
gaacattgcttgcggtcttgtcggaggaccgggccttgtctctggaatgaatattggagaagaatatgccgtgtttgaaacaggcacacgaaacacgggaacctcattggctggcaaagacattgccaacccaactgccttcatcagagcttccatcgacatgctgcgttaccttgagctccacgattatgctgacaaactttctgatgccctttacaaagcattgacggagcagagaacgcatactcccgacattggaggcacgaatcatagtacagaagttgttcaagcagtcattaacaactacagcgagacaatcagtaacgcttgaaggaaacttctgatagtacgatatcaatcgagttttagtcttgtaaatgtttcattaaactgtcaaataaagagcaaaagtagaaaaaaaaaaaaaaaaaaaaa

SEQ ID NO: 49653 - DNA, 642 bp, Heterodera glycines
  SCN-specific regions: Sequence locations=1-346,368-642
aaaagttaaaagccgaccaacaaaagaatgccgtgaaggaaatgcgccgtattttcggcgttctcaaaaggtccgtgtaattatgcttgcgcgtcgtccgcttctgtgctgtgcattcatccgcccttttttcccctccgccatttgcttcttcctcaatgtcgtcccaccatttgtccggaagttcccttttgttaatgcgtgccgcatttcgcaaaatttggtcagcttcgacgtaacgcttttgagagacgagccaacggggactttcaggcacaacccttaaaagaaaaggaagatttggggaataaacaatgcttaatagagatggattaaaagacgcaccaccaataaaagaggaaaatggtggcaaaagcagcaattgaagcatgaaggtattgataattccgaataaaaaaagccaaaaggccgagtaaaacttggccaacagcaaagaaaacgccggtgaacagcgaagcgattttccttttgcttgggccaaccaattccattcctttgataaccgtaaattggggttaaaagaaacgaaaaaaaaaattaacaaccgatgatgactgcgatgacaaaaatacctaaatacattaattattttcgacatattaatttaaaataatggtaaat

SEQ ID NO: 49654 - DNA, 326 bp, Heterodera glycines
  misc_feature (305)..(305): n is a, c, g, or t
  SCN-specific regions: Sequence locations=1-272,296-303
atggagttcgggaattcatccagaaagattatgtggacctgaagcagaacaatcgggatttccccattcttgtaagagaatgctccggaattacgccacgaatttgggcaagatatgagcatggagttgagacaagcgtttcggttgagaatcagccgcgtcagaagataatggaagtgatcaaagaaatggcaacgaaaaaaattgattgatttgaatttgtttttggctgccgtttgtaaattctttgataggataaataattgtctcccattttatttatttaattaaaaatgtttccgtanaaaaaaaaaaaaaaaaaaaaa

SEQ ID NO: 49655 - DNA, 591 bp, Heterodera glycines
  SCN-specific regions: Sequence locations=32-333,365-591
cctcgtgccgaattcggcacgaggacaaaggagatgatgcagtaaacgatactgatttggaattggaattctctaataaacttgatgatttggaaaatgataataaagccgaggggatcatcggacacgaaaaaaatacagcagaaagcagaggtttggaaaatgcacctcattcgcaacaacaaattaatgggtttctgcaaatctcacaagaacagcgattatttcattacatttttagagaattcgaagctgttgctaaaaatccaatcgaaggaatatatgtcactccaggcgcagaatcattgttaggtgaaccctttaatcaacaacaaaaaaatattaaaagtattttttttaattacctatcataaggtttgttgtcggattgtttctgagcaaattaaaaattcagtatggtttggcttgctgattgatcgtactggtattttctatggtggcatcttccgcttcattttaacggtgcctgacaattttcccaattccgaatctcttccggtcgtccagtttgaagaacctcttttccatccacttgtaaattcaaagacaaattgtgttgacctaagtcgg

SEQ ID NO: 49656 - DNA, 427 bp, Heterodera glycines
  SCN-specific regions: Sequence locations=1-262,288-427
gaagctgaaccctttcgtctcctcctcagcgcgcaaatcgcgcaaacgctatttcaacgcgccctcgtacatccatcacctcattatgtccgcgccgctgtcgaaggatttgcgcagtaaacacagagtgtgttctacgcccattcccattgatgacgaggtgactgttgcccgaagccactactgaggcaatgccgggagtataatgcgtgtgtatcagaagaaatatgtactgcacgatgacaatacatgcactcaggacaaggccaacggaacaactgtccacggtggaattcatccttcaaatgtgcagatcacacagttgaagatggacaaggaccgacgttcattgctcgaaaggaaagcggtcggcacagcgcgagtgacgggcattttgaagggaaagcacacggaagataccattgaa

SEQ ID NO: 49657 - DNA, 511 bp, Heterodera glycines
  SCN-specific regions: Sequence locations=1-511
gaagctgattgaatccagcgaacgcggcgacttcccagactgtgacactttctcgctcaacaaacgtgttgtgactgtgaagggaccacgcggtacgctctagcgcgactttctgcacttaaacattgaaattatgcgagaaaacccgaagctgctccgtgtgctgaaatggtttggcatccgcaaatatttggcagccattcgcacagtgtgctcacacattgaaaacctgatcaaacgtgtgactgtaggatttctgcacaaaatgcgctcagactacgcgcattttccgattaacatcacgcttcaggagaacaacaccgtcgaccagattctaaaattcttgggcgagaaatttgtgcgccatgtctgactaccacaacgagtaaacgctgtaatgtctaccaaacagaaggacgacttgatcattgacggtaccaacatccaagaagtgtcccacgacgctgctcgcatccaacagtcgacgaccgtcaaaaacaatgacattcgc

SEQ ID NO: 49658 - DNA, 385 bp, Heterodera glycines
  SCN-specific regions: Sequence locations=1-232,254-385
cgtacgaattctgaaaaaacctcggcaggagcagcgttggaatgacaagcgtttcaaatgacctgtcttgctaactcgatggaaagacgatcctttctgtggaggatgtatggacaaaggaattggtctcgagaaaattggcgtcgaaccacaacagcctcattctgcgattcgaaaatgtgttcgcgtgtaacttatcgaaaataccaacaagatcactgcttttggtccaaactagggttgcttgaattttattgatgaacaccaccaagtgcttgtgtctgggttaggacaaagtggacatgcggctggacagattcctggagatcgtttcagggtactcaagggtgccaagacgatcgttgttcgcacttattgcgggaaa

SEQ ID NO: 49659 - DNA, 340 bp, Heterodera glycines
  SCN-specific regions: Sequence locations=1-44,67-139,161-340
cttattgggggcgaccgccacaattgcgagggcactgcttctgcacaatgatgaaataaaaaagtacaagtggcagtgcgggagagctcggctcccttcgctttcgcggatagtgaaccttccgatggaaaggattttctggcaaatcactttccttttccacattccgctgagagcactcaaaattgcagtgggatttttccgttatggccgtttaccgagtgtccactggaaatggccgcgtctctattcgctgtgcccacacttttacctttggctcggctctttggaattgatttttctggacgctctgtccgaggtccgcgagcgtgagttcatc

SEQ ID NO: 49660 - DNA, 292 bp, Heterodera glycines
  SCN-specific regions: Sequence locations=1-292
cgatgtcgcacccatctagctcgtcaacctgatggtccacgtgctaaatgcttccattcacgtcacctgtgaccaacgctacaaaggcttcaatcgacattcctcgtccgtgctccacaacgaacaggtctttctgccgactgggcgagttaacctgcccttcgtggtcccttactctcctactcatgcgctgaacttcgccttcatggacacttatacaccagacttcaccccatgactggacatggacaagactgtcttgaagctcttctccatgaatttggcttctggg

SEQ ID NO: 49661 - DNA, 133 bp, Heterodera glycines
  SCN-specific regions: Sequence locations=1-24,46-133
ctacaagaaaaagcctggctccgcgaagaactttggcatttggctccgctactattctcgtactggacaccacaacatgtaccggaagcatcgaaatgtttgtgaagagggagctgaaacgcagtgctatcac

SEQ ID NO: 49662 - DNA, 639 bp, Heterodera glycines
  SCN-specific regions: Sequence locations=1-639
aacaacccggtcaaattcggcctttacatcggcccaagcaaaaccgaggccatttgcatttcctcaaaaagttcggacagcggaaatggaccttctcttggcaccagccccacaatgtcattctcgccggtgcttacaattagcgaagagaatttggcctccgaattcgcaaaaggcaacgtaacaattgcggacagacgcccttcgaatgcaatggacttcgaactgtttgaggagaaggcaaaagagaagcggtcgttgcgtctctcccgtgaccaattggacctgttgaacttgaactacgggtcgaacgacgcgcggttcagcatcacaacaaaatatcagggaactgcttggtgttcttgtcacatttatttgctcaaatggtatgacaaattggtcatctcggatatcgacggcacaatcacaaagagcgacgtgcttggccatgtcattccagcaattggtggcacttgggcccattccggggttgcagagctgtatactggcatcaaaaagaacggatatcaaatggtttatttgtcttcgcgtgccattggacagtcccactacacgaaaacgtacctgcagaacttcgcccaggggtccaggactttgcccgacggacccgtccttctc

SEQ ID NO: 49663 - DNA, 607 bp, Heterodera glycines
  SCN-specific regions: Sequence locations=1-21,44-607
ggcgggcttctcggaacttgctgaaactatgacaaaagcttttggcgcctggccactgatcggtgcaagctgcgctacctctcagaatgctaaaagcggcgatgaattgtaattcggctcaatgatcttctaacggttgtgcagcattcgggaaattccctcttgcggtgtcactcccaccgccattggcccacaggatctaggcaaatgttcgattcaggacgaccctgcctaatacaatgggatcatcgctggattcaaattcactctccgagatgatggcgtccacggcttggacaaaggctgggcacactccgccgttggatatacgatgcatggccttggcaaattccgagtgtacaacatgttctagaatgtgtacgccgggatgatcggcgaggaattggcttacagctgccgtacctatttgtactttggcggctgggacagagcggagttcttcaccaacatgatgctggtgccgatggaggccaccaaagtgcgcatccaaacatcgcccggagctccgccaactctccacgggtgtgcgccgttcatttaccggaccgagggagtgatgggcctctacaatggactgccgccgatg

SEQ ID NO: 49664 - DNA, 626 bp, Heterodera glycines
  SCN-specific regions: Sequence locations=1-78,101-224,294-433,456 -509,533-626
gaccaggacagtctttttttctgtcataaaattggtgagcaaatcatctgtgcatgatgcagaccatcaaatgcgttgtggtgggcgacggcgcggtgggaaagacttgtctgctcatttcctacacaaccaacaaatttcccaacgaatatgtgccgacagtgttcgacaattatgcggtgactgtgatgatcggtggtgagccttacactttgggactgttcgacacggcgggacaggaggactatgacagactgagaccgctctcctacccacagacggatgtgttcctcgtttgtttttcagttgtcacgccggcatcatttgagaacataaaagaaaagtgggtacccgaaataacgcaccattgttcgaagacaccgtttcttttggttgggacacaagtggacttgcgcgaagacgccggcacctgcgagaagctggcgaagaacaaaatgaggccaatttcggcggagacaggcgaaaagttggccaaggagctgaaggcggtcaagtacgtggagtgttccgcactcactcagaagggcttgaaaaatgtgttcgatgaagccattctcgcagcgttggaaccgcctcagcttgaacgaaagcggaagtgttcaatt

SEQ ID NO: 49665 - DNA, 593 bp, Heterodera glycines
  SCN-specific regions: Sequence locations=1-62,84-593
ctttcttcaataataatttaatggacaatcccggcccatcaaatgggattgacttaatcgaacttggagacagtgacgatgaaagaatggaaaagtttgcatttggtggcaacgacacactttccctgatttcattaaagacggactttgaaaggccaccgaaggaagaagccatgttaaatttagtcgacgcttcctttgagctcatcgaccctaacccgaatgtccacgaacttttcgttacttttgaccaccaatttttctcgggaactttgaattcgaatgcgtgtgtcgtcgaatggagcaaaacgatgacatcttgcgctggcatttgtcggttcagtgtcgggaatcgcctttgttcaattcggctcagtgaacctttgctcaaacttaggccgagacgcgatttagtagaaactcttttgcacgaaatgatccacgcctaccaattcgttacggatggcattcaagacagagacggccatggccccgacttccgtttgcatatgcatcgcatcaacaaattggcgggcacttcgatttccgtttaccattcattccatgccgaagttgcccactacaaaaggcac

SEQ ID NO: 49666 - DNA, 642 bp, Heterodera glycines
  SCN-specific regions: Sequence locations=1-642
ctcatttacaattaccccgaacaattgttcgctgatcggaaagtgatggccatcgaacacgccgactttgagggcatcgaacgattggcacttgtattaggtggcgaaattgcttcaacatttgacagtccatcggaggtgaaattgggtagctgcaaactcattgaagaagtcaccgttggcgaagacactttgctccgcttttccggtgtcccgcttggcaatgcatgttccgttgtgcttcgtgggtccacccagcaaatcattgatgaagcagaacgttcgttgcacgacgcgctttgtgtgctgagtacgcatgtgaaagaccaacgcgtggtgcccggggcgggcgcatcggaaatgctcatggcaatggcagtgatgggcgaaagtcaaaaggtggccgggaaggagtccatcgcaatggaagcattcgcacgggcactcgccaaattgcccacaatcatttgcgacaacgccggactggacagtgccgaaatcatttcgcatgtgcgagccgaacacagcaaagggaatcgccaatttggcattgatgttgaaaatggtcgtatggcggatgtttacgagttgggcgtgttggagtcgtacaacgttaaattgggcgtgctttgcagtggcgcc

SEQ ID NO: 49667 - DNA, 304 bp, Heterodera glycines
  SCN-specific regions: Sequence locations=1-304
ctcttccaagattaacgcattgatattgaggaccccatctgcgcaggtgggacaacgttgcatggtgtcggtggttggcgatcaaacgatgacccatgcaccaacctacttggcgcgtggtgacaacaattaccgggatatcaaacttttggattccatccaacgcgatggcatttcggacccagtgctcggccaacccacgggtgtttgtgctgagaaaacggttgctgaatttggcttcccgcgttagcagcaggacgctgatgcactcgcctccctagctagtgcgaatccctcgtggcca

SEQ ID NO: 49668 - DNA, 566 bp, Heterodera glycines
  SCN-specific regions: Sequence locations=1-63,85-226,248-566
aaataaatgcgatgcttttccgctattttcccctgctaaacgaatatagcgcccataagcttttcctcactcttttcccctccaccggcagcgaaatggtgcgtggaaatccgcacttgccaataatcgtcgggaaagagcattgctccaacggaaccaaatggattctcaatgtgttcggcgattgtgtcgacactccgatgaaaatgtgcggcttttgggtcggattgatgtccttgttcttgtggctgatccctctgtttcctcaactgtacgaaaactttcggaacaaacgctgtgaaggcctttccatcttctttctgatgttttggtttatcggtgacagttgcaacatgatcggtgctgttctcacccatcaacagcctctgcaacagatcatcggcgtgtattacattttgcaagacttggctttgcttggtcagttcatctactacactcggctgtactcggcaacacgacgacgcgaaatgctcaacggaccgtcagtgattgtgccagtgtttctgttcggttttgttggccttttcacgcttttctccagttcg

SEQ ID NO: 49669 - DNA, 235 bp, Heterodera glycines
  SCN-specific regions: Sequence locations=1-157,181-235
gcactttgataagcaggttcccgtgcagcaagtgtttgagcaagacgatatgatcgactgtctccgtgtcgccaaacgaaacggtttccagggagtgacccctctatggcactgtaacaagttgcctcgcaatactcacgagggtctccgcaaggtggcttgtatcggtgcatggcatccgtcgcgtgtctcattcacagttgcgcgtgccggtcataagggctaccaccatcag

SEQ ID NO: 49670 - DNA, 492 bp, Heterodera glycines
  SCN-specific regions: Sequence locations=1-459,491-492
agctggccatgctcaggaaatcggcgcacaaagccaaaactgtcaccaacggaaatgccaatgacccgtttcgcttccagggctcaggcgtggattttaaggccaaattcatcggcgaacgcgacgtggccgaggcgcgcggggacgtactctgtgcggaagcgatgcgtctggccaaaatgagcgtcaaggcaagcgggtcgcacaagccacgcgtggtgctcaacatttcgttggacgggctgatgctgctcgacgaaaagtcgggggctgtgctctacaattttccggtcgccaaaatctcgttcattgcccgcgacacgacggatgcgcgcgcctttggcttcattttcggcacggcggacggcaaacacaaattttacggggtgaaaacggcacagacggcggaccacgcggtgctctccattcgggacatgttccaagttgtgttcgagatgaagaagaagcagttggaggaggagaagaagaagc

SEQ ID NO: 49671 - DNA, 563 bp, Heterodera glycines
  SCN-specific regions: Sequence locations=1-201,224-563
gtccaattaaggtgaaaatgtcctcaaacagtgccactaccacgacgagcacggacaatgggatttccctcgttgaggccgacgaacgcggcgccgaagggggcgaaggcgacgatcagctgaccatcaactcgttgagttcgtcgttgagcagcagcacggcgacgacggacacggagggcgaaagcggggcgggcgacggaggacgaaaaaggaaaaagagacggggcgacgggtcgtctagccgcgggagcagtgcgaaggaaatcgaacagtttgacgaggacgaagcggcggaggacgcccttttggacgacgaagcgccgccctacgcggcgaaaacgcgcgaccgcgccattggccgactgatcgtcttcagctgcattctgttcaccgtgcctctgactctgatgtacatcacatatcgctttttcttcatcgggcattaccatttggcacacgaccgtgccgttctctacgcggggattgtcgccgctgcgactggttatttgcttttggcactggtcgcttggattgcctatcgatcaagggacgagactgaa

SEQ ID NO: 49672 - DNA, 611 bp, Heterodera glycines
  SCN-specific regions: Sequence locations=1-40,62-264,286-611
cacaattaccgaaatatttacgtcgagtaatgaacaggcttagaagggatcaaaaagaaaaggttcaacagtttgtgtccttcacgcaggccaacgaacagacggcaattacatgcttgaccgcctccaactggaacttggagatggccggtgacatgttctatcaaaatccgtcttacaccaaccagcaagtgggaggcggcaccggtggtggcgcggacagtcgaaaaattgaccatttgttcaacaaatatgccagcgatgcaaaggacaaagcgcagaaaatcggacccgatcggatcggtcccaatggcatggtgcgtttcttgcgcgacttgaacatcgagccaacgagtcgggcagtgatggttttggcgtggaaaatgggtgctcaaaaacagtgcgaattcactgtacaggagttccgcgacggaatttccacactgattcccaccggcacggtcgacataaatggtctgcgcaacgcgttgctcaaggcggagaaggacactgttgctgaacgaaaagccttccgcgagctctaccagttcatattcaagtatgtgaagtctgccggccagtccagtctcgagttggacactgccgtggcg

SEQ ID NO: 49673 - DNA, 651 bp, Heterodera glycines
  SCN-specific regions: Sequence locations=1-9,32-199,222-651
aaatgcttcttaaattttttaattaattttacgcagaaaccacaaaactgcaccattgcccggaaatccaatatttattcaaaaaaataatcgttttcaatttgattttaccaattttcaatgggtagagcacgtagaaaaaaggggaaaactgccagaagagctcggcaaggattgcttggatttacacgaattgcaagagaaggaaagaagccaaaacaatttgagaagagagtcaatcaaagactggacagaaaagacgatgttcgaacggaggaaattttgcgtgaaaatattgccggacaaaagacccaagaggagccgagaacgccgcatgcatttgtaattcactcggcaggagtgggacgatatgtgcgacagttggagatggacttacggcgggtgatgagtccgaacacttcgaaggcattgcgggtgctgaaacgcaacaaactgaaagactttgtcgtgcattcgcaatttttgggcgtctctcatctgatcatcctctcgagaacagaactttccacgcatttgcgcattattcgaaacccgcaaggcccaacattgcacttcagagttgaaaaatattcgttgggacgcgacgtgctctccgtgcagaagagaccggtcatctacgaagaactgttc

SEQ ID NO: 49674 - DNA, 479 bp, Heterodera glycines
  misc_feature (467)..(467): n is a, c, g, or t
  SCN-specific regions: Sequence locations=1-479
gtttgaggttgctgaggcaagatctctggattccgtttgcgtttctctaaaaaatcttgcacaaaatgcggaagatgaaagcgagacagcggccgaacttttttacaaaggggctatggaaatagatgatttcataaagaaattcacggaaaaacgcgttattggccatacgagaaggctaaaggccgaaaagcttgccgaattgcttcgccaacaatgccaataccaaccgcagcacccgtctccttctgcacttggaatgaccactcaaactcagtattcgtctcaaggggtggcagcctcaatgtatcctgtccttggccaggcttatacgagcccagccaattttcggcattcttatatgagttaggagaacggttcaaccggagattacttggacacgcacttattattttctatcaattttttgccccgacaaataaacgttttataatgtccaaaaaaanaaaaaaaaaaaa

SEQ ID NO: 49675 - DNA, 139 bp, Heterodera glycines
  SCN-specific regions: Sequence locations=1-139
gaatgagatgcaccaggaggccattgagggcgctacccacgctttggagaaggataacgtagataaggacctcgctgcgttcttcctaaatgagtttgacaagaagttcaaccggacatggcattgcatcaccggacga

SEQ ID NO: 49676 - DNA, 424 bp, Heterodera glycines
  SCN-specific regions: Sequence locations=1-424
gggccttccggatcgacctttcaacggatgcgatcggattgggcgcattgtctattggtcgggcgacaagcgctttttcttaaaaggctagacgcgagatcggtacaatgagcgggtgtatggctcctccgcgactgcgggcgctcaattcgattacatccactacaacgaggaatcgaacttccaattggtcgactcgagtcgaccacaaaagccgcagaggcctttccgtcgtcagattccatttcgtcaattggctcaccgtgagcaggaacgccgagaatatgagaagtacaatgtttccacgaagatgaagcggactatactcaatgagcaacaaaatgcgtactaagtgtttttgcgttggggcggcggaactcgcggcaaagagcaccgaccgacagggcggtgcttcaatgaccga

SEQ ID NO: 49677 - DNA, 354 bp, Heterodera glycines
  SCN-specific regions: Sequence locations=1-87,109-354
gtttgagtgttcttttcacgtgaaatttgactaacaaattgactcttccagtctcttcatttattcatcaacattcgcaattcgtttgtttcttcactaatgagtggtgaattgcggcttgattcgagtcttgatctgatgcggcgtttgccaccgcaaaactgtgagaagcatttgaccgatttggtcgctcttgcgcccgacctttgcgagtctttgcttactgccgttgaccaaccgcttatatgtgcttaggacgaaacaacggggagggaatatttgctctgtgactaccacccacatggcgagagttacagggcgccggggaccagcgcttacaaccccccgcttgag

SEQ ID NO: 49678 - DNA, 480 bp, Heterodera glycines
  SCN-specific regions: Sequence locations=1-414,436-480
ctcagaatgtcaacccatcgtttgctcccgtccctcccgcgtttaaaagtgccaatcggacatcggccgcaacggcttaaacttccgtacattcccaacccgcgtgggcacttggaattggtgcgcaagttggtgaacagagtgatcagagaagaacggtgcgaattgaagtacaatcgagcggaagagtgccgtcagtacgtggagaggctcatccaactcggcatttaccgtggcccgaactgtgcctacaccgcggaaatgtttcagtggtggttcattgagcaggatttggtcgacaaaatgtggtctattttggtgccccgtttttcgcattatccaatcgatcagtcgtacaccgaaatctatcgattgccgaccattcgactcaagtcgaaagtcaacaaagagacagagttctggaaccgttactcaattgccgttctcgaactgaaagagaacccttttccgccaatggat

SEQ ID NO: 49679 - DNA, 316 bp, Heterodera glycines
  misc_feature (254)..(254): n is a, c, g, or t
  SCN-specific regions: Sequence locations=1-316
caaactgatcaagccaaccgaggacggaatacaagatgaaatccgcgggaaaaaacctcccaaagaagatgaaaatgcacttaaaatcaaggaagccccgaagatttcggcagcgatgtttctcaaatacaacacacaactcgggccccccttccacgtcattatcgacactttttttgttaatttttctataagaaaccgaatcgacattatgacggggttcatggactggctggaggctaaagtggtggcgnatatttcggactgtgtgctggggcgattggagaaaatgggacgacgggtggaggtggcggtg

SEQ ID NO: 49680 - DNA, 400 bp, Heterodera glycines
  SCN-specific regions: Sequence locations=1-245,269-400
caacagcatgaagtcgagctaagctctcggatcagagcttctcgtacatttggacaacacacatgagactgtttgagccatcaaatatatgacagttgaagcgagccatccgctgctctggagagtgcaacgcgacaagaaggacattgtgccgttccgccagttcaccagcggaacgcgacgcagattgcaggggccagcgtggggtcccacacagggactttggacgataaagtcccccgagatccttctccaacttctcccaaatgagtagattaatggccaggtgaacggcgaggacttcgaccatttggtcattgaccacatccacatgcaatctgtcgcgaacatgcatctgatcattcaccacgcgcacgggttcatcaatccgtacaagaat

SEQ ID NO: 49681 - DNA, 577 bp, Heterodera glycines
  SCN-specific regions: Sequence locations=1-121,148-388,412-577
gtcctccagctccaaatgtttctttggtatgacggcgccaaatttcatggtggacgccgttgtgaacggcaacttcacaactatttcgctggaacagttcaaatggcaatatgtggtgctgttcttctacccactcgatttcactttcgtttgcccgaccaaaataattgccttttcctacaaggcgggaaagttcaaaaagatcggtgtcccactcctcgggtgttctaccgactctaaattatgccatcttgaatggatccccacgccgcgaaagcagggaggacttggtgagatgaacatcccggtgctggcggacacccgccacaaaatcagccgtgactacagcgtgctgatggaggaggcgggcattgcttatcgcggattgttcatcatcgatgacaaaggcgttcttcgtcagatcaccgtcaacgatttgcctgttggtcgctcggttgacgagactcttcgtctcctgcaagcgttccgatacacggacaagcatggcgaggcgtgcccagtcaactgacagcccggcaccgacaccattaaaccggacccgtagggctcgcaggct

SEQ ID NO: 49682 - DNA, 647 bp, Heterodera glycines
  SCN-specific regions: Sequence locations=1-187,209-489,516-647
gtctgttggagaaggcgtacatgaaagtgatgggcggctacgactttcccggctccaattcgagcattgacctgaacgcgttgaccggttggatcccggaacggattccgatcagaccgaaggagagcagttttgaggccgacaaaacattcgagcgacttttctcccatttccaccaagggcattgtctgatcactttagccaccggtaaaattgacgaagctgaacaggagcggacggggctggtggatgcgcatgcttatgccgttttggaccttcgcaaagtcgatggcaagcgggtgtttctgctcaagaatccgtggacacatctgcgctggaaaggccgcttctcggagaaggacgtcgtctcgtggtcgcccgaactgtgtgccaagttggactacaacccgaaggatgcgcagcagttcgacgacggcatcttctggatcgattacgcgtccatctgcgctttcttcgacgtgttctacgtgaattggagtcccgctctgtttcccttccgctacgccctccattcttcgtgggatgcgggcaaagggccggtcaaagacctttacacggtgggcgacaatccgcaatatgtcctcgaggtgaacaaccgggacggcgtggcatccgtggggattttg

SEQ ID NO: 49683 - DNA, 409 bp, Heterodera glycines
  SCN-specific regions: Sequence locations=1-409
atcgctgatggtcagctaagacttctcctaaacgctcgcccgagccaaatccaatgatctcatcatggacttgctccaagggacccttacaccggagccgaaagtgctcgaggatgccaacctgaagaaggacgacatccacgaagccgtgttggtcggatggtcctctcgcgtacccccattgcatgatctgcgcgacgacttcttcaatgagaaggaaccggcccgctgcatcactcccgacgacactgcctcctatggtgcagccgttctagcaggagtcgtttctggggaggagagctcgcaaattgttctggtggatgtcatccctctttcaatgggcattgaaactgtcggtggagtgatgactcaactgatcactcaccacactgtcattccgaccaataag

SEQ ID NO: 49684 - DNA, 423 bp, Heterodera glycines
  SCN-specific regions: Sequence locations=1-277,306-394
caacgctatccatcaatgcgcgagttgcgaagggcaattgacgaacaaaggctgttccaaattttcggctccggcaccgcctgtgccgtgtctccggtcggtcgtatactgtaccgtgagccgggcacgggccaaatggaggagctgttgattccgacaatcacttctagcgcccatgtgatgcaaaggctttacaaaacgatcactgacatacagtatgggagagttatcagaagtgattggacgcggacagtggcataatggcataatgcctatcattatttaaaatttctttaattattttagaatcattgtggttgcaaattatatgtaaaaaaatcacaaatatatgtaagaaatatgtacaaaaactcaataaaaatattttaatgtgaaaaaaaaaaaaaaaaaaaaaaaaaaaaa

SEQ ID NO: 49685 - DNA, 441 bp, Heterodera glycines
  misc_feature (424)..(424): n is a, c, g, or t
  SCN-specific regions: Sequence locations=1-83,107-129,159-167,189-419
gtaaggtccacggccagcgcattgccctctctgacaacgctgttgttgagaagtcgctcggcaaggccggccttatctgcgtcgaggatttgattcacgagatctacactgtcggccccaacttcaagaaggccaacaacttcctctggcccttcaagctctcgtcgcccaacggtgccttcaacaagcgcaagttcaagcacttcattgagggtggtgactttggtaaccgcgaggagttcatcaacgagctcgtccgcaagatgaactaaggttcttgccctcgcttgctgttctccgcttgtcgagttgccccgttggtgtttgtcgtcgtttgtttgtttttgggcccgccgccacggctagctttggttgttccgagctgagcaaatgatgaatacatccccgtgcttctcctgaaaanaaaaaaaaaaaaaaaaa

SEQ ID NO: 49686 - DNA, 532 bp, Heterodera glycines
  SCN-specific regions: Sequence locations=1-458,480-532
gaccctccaaacgcgtccctacgaactgttcaaactcgattccggtccttcgactgaggtgcgactgacgctggatgacgcgttggattattacaaaaaaatgctgttggtccgactgatggacacatccgccaacaatttgtactacgaaaagcgcatccgcggcttctgtcacctttactcccgacaaaacgcatgaggcgttgggatggtggcagcgactgatgctaatgatgacgtgatcacggcttaccgatgtcacggatggacttatttgatgggtgcgaccgccccgtacattttggacgaactgacaggacgcattgctgggaatgtttaccgaacaagcggatccatgcatatgtacgcctagaacttcttctgtggacaaggaatcatctgcgaacaactgcctattgtggcgggaattggttttgccttgaaatatcgccgccagaggaacatctgtttgacactttacggagatggggcagataatcatcgaccgctgttcacagccacaaacatgacc

SEQ ID NO: 49687 - DNA, 578 bp, Heterodera glycines
  SCN-specific regions: Sequence locations=1-187,209-424,447-578
ccaactcctattacaacaaaattattgactggaaaacacgcattgacgaaagcgagaatattttcgtccgaactgttcgtggtaccttcgaacgtgtccaactcgcatttgaatccaaagacaatgtgtcggaagtgctaacgcaaatatccaaaatcgaccccgaattcgacaagtcggaatggctccgtttttgcgaaaaagaaatgatcccgaacattcttgaatcaacttaccaaatgaacttcgaagtccttcgtgattggtgttacgagaaagcgttcaatttaatcgcaaattctatcaaagaatacgaaaagattggcttcaacacgagggattctcgcattatcgatgttagcaaagtggagttggtcacggggaatatgaccgaccaagggccgactttggtcatccaattccaagtattcatgacaaatgtggtgaagaacagcgaggggaaaattgtccaaggtgaccctgaaaaagcggttcgagtgagacacatttgggtaatatgccgagacatggaggagttcaacccggcaacagcttggaaactgcttgagctgcacatg

SEQ ID NO: 49688 - DNA, 148 bp, Heterodera glycines
  SCN-specific regions: Sequence locations=1-148
aggcgcttctggggcgaaattccgggtttctcttgctcttcctgttggcgcaagaattaattgtgccgataacactggagcaaacaatctgtccgctattgctgtttatgtcatacgcggccgattgactcggatgcccaccgccgcc

SEQ ID NO: 49689 - DNA, 181 bp, Heterodera glycines
  SCN-specific regions: Sequence locations=1-181
aggtggagcccgaccatcgaacaaacgactccagcaaacgcaggcacaagtggatgaagtcgtcggcataatgaaggtgaacgttgagaaagtgatggagcgtgaccagaagctgtcccaattggacgatcacgctgatgctcttcaatattgtgcgacccaataccagaaatctgccgca

SEQ ID NO: 49690 - DNA, 486 bp, Heterodera glycines
  SCN-specific regions: Sequence locations=1-72,94-102,125-486
agcgcctaaaaagcactcattcagtgccaatgccaactcagtccactgtcattccaaagtttggcatttggtcagcatcaccaccttctacaacagaatcgggccgttcttcttcccttccaaccagtcttttgtctgtgaacaatgacagttttggggaagtgccattgtcgaatcggtgcttttgtaattacggcccgtcggtgtgcgacatggaggacacttgcataaaacacacttcggctgtctgttttcacgcgattgtgctggagtttaattctggcacgggtgccatcgaacgccgtcacttttttggttgtgctccactcgaaaaaggctcagacgcatcgcatcttacgtgcaacgcgtggcgttcctcccactcaaacggccgaaccgtcgcgtgctgttacgagggcaatttttgcaatcagaatttgactttgcccgactctccggctctccaagtgagcaccggtctcaaat

SEQ ID NO: 49691 - DNA, 349 bp, Heterodera glycines
  SCN-specific regions: Sequence locations=1-132,155-349
cccgaacggataccgccgcggcagtcgttacgtgttcgcccgcccgttccacgagcacggcgttgagccgctttcaacattctaccgcgcgtacaagcggggtgacattgtcgccgtccagggtaacagcgccttccagaagggcatgtcgttcaaggcgcacctcggtgacacagggcgggtgctcaatgtgaccaaacatgcgactgggcgtctttttcaacgagagtgttcgccatcgcatgacccgaagcgcgtgtatggccgcggacgccaggagaaaccgaccggctcccatctcgagttcctgcggcgatgcgaaacgaataagtggcagaagaaacgcaag

SEQ ID NO: 49692 - DNA, 554 bp, Heterodera glycines
  SCN-specific regions: Sequence locations=1-50,73-104,127-554
aagagatggaatcgtatgtgcaagttgaagatcaatattcgagggactccggcatttcgttggctcaatccaccacctcgcagcaaagctgttttgccaaaatttattttccaactttgtatcgacttcggggtcaaggcagtattcgcttgacaccgattaaacgggcccaagttccgcacaaaggcttccgcaggattaacgccgatacgatggccaaccttttggggtcactaacagaagaactgtttcaacggcggttcattctgatcgattgtcgctatccttacgaatacgatgcgggccacatttggtactcactgaatttgtgggagaccacttccattgagaagctcttctacccagaagaggaagaacggttcggcgaaattattgtgcgaactcccatcttctactgcgagtactcgcagaaaaggggacccaaaatggctcttgcactgcaagaatttgaccgggtccggaacgagtcgcgttacccctacgtggactaccacgacatttaccttatggaccgggggtaccgatacttcttc

SEQ ID NO: 49693 - DNA, 259 bp, Heterodera glycines
  SCN-specific regions: Sequence locations=1-37,61-259
ctgtcactacgaggtgatcgacttctgattccagacacagcgccccggcgcacgcacttccaacatggataagactgtcttcattcatctttgcccggaaggtgcatcaatcaaaaagaaaatgctttatgcttcatctgcgtcggccatcaaggcgtctctcggaaccgctaaaattctgcaatttcacgcgtctgatcagtccgacattgcccacaagaaatcgctcacgaagctgaacgacaaataccgcgacaat

SEQ ID NO: 49694 - DNA, 475 bp, Heterodera glycines
  SCN-specific regions: Sequence locations=1-104,155-247,283-475
cggagtcattgaggtcatccacagcaaaattgaggacattgagcaattgccaggcggaattgaacatgtcgacgtcattgtttccgagtggatgggctactgcttgttctacgagtccatgctcaacactgtgatctatgccagagacaaatggttggcatccgacggcattctcttcccggacaaagccacgctgtttttgtgtgccattgaagaccgtcagtacaaagatgattatattaactggtgggataacgtgtacggcttcaacatgtcctgcattcgtcagcttgccattactgagccgttggtcgatgtggttgaccgcggccaagtggtaacggacaatgtcgtccttaaggaagtcgacttgtacaccgtccaagtggccgagcttgcctgtgagaccactttttctttgcggggcattccaaacgattatgtagcagcgttgggcgctgtcttcgccggcgaa

SEQ ID NO: 49695 - DNA, 627 bp, Heterodera glycines
  SCN-specific regions: Sequence locations=1-138,161-248,271-461,483-627
gccattcgaccgtgaagtgttctcttcatttctccaaactgttcacaaatgggcgtcaaagttgccatcaccggtggcagtggctttctcgccgctcatctcatcaaacgcctgagggcagacgcaaatgtggacgaaatcagaaccatcgacagaaagccgttcagacagctcggaacaattgatgattgccctccttcctccgtcggttttccctcactcattcatttccaatgcgatttgctggatattgccaaacttgaaaaggcattggatggtgtcgacgtgttattccatttggccagaaaggctttcgaatatattttcttcgctgatcaaaaagcactgaatgatcgctacagcagagacaatttggaagccactcattcgcttctcaacaccattttcaaatgctccgttccgcgattggtccatgtcggagatgcctttgccaacattcccccgggcgacaactttggaagcgctgagcacatccatcgcggattgccctccaaatttttgcttggccattacggagagacgcggataaaggccgaattggccgggcgagaaaaatgcgggaaaatccttccaaacggacagcccttccacgcacttttcctccgt

SEQ ID NO: 49696 - DNA, 346 bp, Heterodera glycines
  SCN-specific regions: Sequence locations=1-287,309-346
cgtgacatctgctccgaacactgccgaaaattttagggctctgtgtactgctcaaaatgggatgggcaatagtggcaaacccttgcactacttctcgcgtcgcaacctcctaccgccatcattccaattttcctggttcagggcggcgacttttctcaatgcaatgggatcgcccgagactccctctctggccagatcatttccccacaagattttctaaaagaaacattgcctcccgagactgttgtctatggacgatgacgaccttctccctaaccattcgccgattttcttctccacagggaaaacaaactggcttgaaggcaaactcatatggtttaaccga

SEQ ID NO: 49697 - DNA, 470 bp, Heterodera glycines
  SCN-specific regions: Sequence locations=1-181,203-470
gtcaaaaaatggtccactacaaattgtattattttgatctcactgctcgcggtgagccaatccgatatttgctgcactacgctggccaaccctttgaggacattcgcattaaagccgaagattggcaaacagaaaagccaaaatttatctacggacaagtgccagttttggaggtggatggaaaacaattggcacaacaagcagccattatgcaatatttggccgaaaaattcgaattggccggtcttttctcgtgggaaacggctaaagcattggagatcacgtgttatgtgaatgacatcatcactgagttggtaccctatcttggcgcaacgatcggcttccttcccggggacgaggccgcccttcggtcggatgttttcctccggtgcgtgaaaagagcatttcctcttctgatcgctcagcttgatcaatcaaaggccgggttcatgcttccgtccggcttggcc

SEQ ID NO: 49698 - DNA, 489 bp, Heterodera glycines
  SCN-specific regions: Sequence locations=1-489
gtcagaagttgtcttgagattgggccgttgggcggagtgtttcacttggccatggtgctaagggactgtctgttcgagaatcagaaccagcaaaacttcaaagacgcggcggaggcgaagtatttcggcacgattagtcttgacgaggcgacgcgcaaaggctgcgagcagttacgatggttcgtcgtgttctcctccatcacttcgggacgcggaaatgccggacagaccaattacgggtggttcttctcgacaatggagcgaatcatcgaacagcgccgtgcggatggtttccccggcattgccatccaatggggcgccatcggagacgtgggcgtaatccttgagaacatgggcgacaataacactgtggtgggcgggacactgccgcagagaatgccgagctgtttggggtctttggacctgtttctctcgtggaaccatcctattgtttcgagtttactcaagcggacccccagtggaaagaag

SEQ ID NO: 49699 - DNA, 582 bp, Heterodera glycines
  misc_feature (438)..(438): n is a, c, g, or t
  SCN-specific regions: Sequence locations=1-81,114-141,168-204,228 -318,340-582
tttacggcattgctcgtcattgtttgctcaaaacaggaggaagggggcgcaaaggaaaagaagtactgcacaatcattggtattgaccttggcaccacctactcctgtgttggcgtctacaaaaacggcagagtggagataatcgccaatgaccagggaaaccgaataacgccttcctacgtggctttcacaccagactcgggcgagcgtctgatcggagatgctgcaaaataccagttgactctaaacccggaaaacaccattttcgatgccaaacgactcattggacgggaattcaccgacaaaaccgtccaggacgatatgaaactttggccttttaagatctacaacaaggcaaacaagccccatgttcaagtgaaagtcggtaacgaggataagcaatttgcggcggaggaggtttctgctatggttctgacnaagatgaaggaaattgcggagtcttacctcggtcacgaattgaaaaatgccgtccttactgttcccgcttactttaacgatgctcaacgcaccgcaacaaaagaatccgccaccatccctggaccgaaactggcgacgatccta

SEQ ID NO: 49700 - DNA, 656 bp, Heterodera glycines
  SCN-specific regions: Sequence locations=1-7,30-436,458-500,522-656
ggcaaatgacaaatcatttggacagaaaaggcatcgaatacgtcagcaagcgaatgccaaagattggcctcggcacttaccaaattcacggcaatgatatttttgaagtgattgatgccgcgttggaagttgggtaccgattcattgacaccgcacaaatttaccgaaatgaaaaacacattggcgatgcactgacggaactgttgccaaaatatgggcttaaaagggaggacattttcatcaccaccaaactgagtccggccaaccaaggcacagcgaaatgcgccaattcgttggcggaatcgcttaggttgctgaggaccgattatgtggatttggcactaatccattggcccggcacttctcgactgaagagggagaacccgcggaatgcgcagctgagggccgaaagttggaaggcaatggagcaaatgcacggggagggacagctcagagccatcggagtgtccaatttcaacgtgccacatttggaacaactgatcggcggagggtgggccaaagtgatgccggcggtgaaccaatgcgagtgccatccccactgggcacagcctcaactgatcgccttctgcgcacgcaatggcattcactttcaggcttacagtagttttggcggagaatccaaccgcggggaattg

SEQ ID NO: 49701 - DNA, 394 bp, Heterodera glycines
  SCN-specific regions: Sequence locations=1-37,59-394
gaaattgaatattgcttatcctgcgactggggcgcaaaaacatcttcggagattgaagatgagaaagaaacttcgcattttcttcgacaagcgaatggagcaggaagttgaagctgactcgatgggggatgaatggaagggctatgtgctccgaatttcgggcggaaacgacaagcgacggtttcctatgaaaccgggagtgatcaccatctcccgtgtgcgccttctcctctccagaggccattgctgctatcgcccacgctagaagggagagcgcaagccaaagtcgggtcccggatgcattggccactcaaatatgtccgggctggcattggtcgttgggaacagaggtgaacaggaggtcgaaggactgaccgacagagttgagccccga

SEQ ID NO: 49702 - DNA, 295 bp, Heterodera glycines
  SCN-specific regions: Sequence locations=1-295
caagatgatcccctggtatcccctgaccaatcataccgtcgggacaaccgagacccactcggagcgagagacttccctaatagcgcgtatccagcgattgcgcgactaatactagaacacggggatgcgtccaatggcggacggagtgttgctggcgcaccagcattcgctgactcacgggatgctgcttcaaatacaaacaactttcttcaaattggctggccgggaactgagccatgccgaaaagtgggtgggacgcacgaaaaggatgctcgaacaagacaccaggagggat

SEQ ID NO: 49703 - DNA, 490 bp, Heterodera glycines
  SCN-specific regions: Sequence locations=1-39,61-149,171-271,293-490
gggcaagggattccccaattttatgaccaacaaagacttccctcccagtgcatgggggaacttacaaatgaaatgccgaagctgtagacaaaagaatgacttgaagagaacaccacaggatgatttgcatgcccattatgataaggaccaagaaattctcaacaataaggcacttcttggtgactaacaagcgaggatgggcctttctttcatggacgatgcgcccgctggcattaacaataatagcgatgaaagatcggaaccgaagtacgaatggctgaggaaatacaatgcaccgcgtgaagaatgggcgaaaggaaatgaactcatccaggaccaacctttccgaattcaggtgcgatacgttcgctgtgtcaaatgtctcgcgtggggtcatttgaacacggaccgcgaatgcccactgtatggtatgagtggaaatgctgactaccatggctatgcaaataatccctccgatatcattcgtgat

SEQ ID NO: 49704 - DNA, 304 bp, Heterodera glycines
  SCN-specific regions: Sequence locations=1-113,136-219,241-304
tgccacctctttcattgacgcgatgcgttctttccaccattttgaacttcagccgtgccttcaaagtggtcggttgtctttcacctgctaatcgaaaaaagctccgggattcaaaactttttaatcattcctcgaggacattgccttggggactcaactgggagaggttggccggaagctctcctacggagacaaacggctcctcaaagggttcgaacttttctccgccgagccttttccgttttgaaaatgcctttaacgctctttgccccttttggagaattgtccccttttttctttcttt

SEQ ID NO: 49705 - DNA, 466 bp, Heterodera glycines
  SCN-specific regions: Sequence locations=1-40,82-85,118-124,147 -241,264-279,301-316,376-466
gtctgaacaatctttggccacctttgcgtttcaagcggagattgcgcagatgatgtccctgatcatcaacaccttctactcgaacaaggaaatcttcctccgtgagctgatctccaactcctctgacgctcttgacaagatccgttaccaggcgctgaccgacccgtctcaaatggagagtgggaaagagctcttcatccaaatcgtgccgattaaatcctttaagacattgaccatcatcgacactggcattggcatgaccacagcggacctcgtcaacaaccttggcaccattgccaaatccgggacaaaagcgttcatggaggctcttcaagctggtgcagatatttccatgattggccagttccgtgttggattatattcggctttccttggggccgaccgcgtcaacgtcacatcatagcaccatgacgacgaccgctatcaatgggacaactcagctggg

SEQ ID NO: 49706 - DNA, 612 bp, Heterodera glycines
  SCN-specific regions: Sequence locations=1-573,596-612
gtttgagagatattctcatttaaaatgatcaaaaattttctccaaaggatgctaagcccaatattaaggtcagaaactgtcatcaaattaaatcaaaaaagtgcactcaaacgaattgacgcaatagaaaaagggaaaataaaggcattggctcccaaacacacaacgacagcgaagcttcagcgagacattgacaaggacaacaaaatcaaagaagtgctaaactcaaaagaaaattcgtttattgacagaattaacaaaatcactattaattcttccgatcctccgataacagcaaatagacaaggtatcagaaaggagcaatatggtcagcagaatttcagtgaacacgaatacggattttttgaacttcctttggaaaagatgaagaacaataaagtgatgttcagagaggcgattgagattcttcgtgcacgaatggagctcctctcaaacaaaagtcctcacgaccagtcgtttttcgagcagcaaagtgattatattcaaaatcatccggccgtaaaacgtgttgacaaagacaaattggagcgggtttggcaatacttcagaccatttgccattatcagagatcagatgctgttgtcaaaacgg

SEQ ID NO: 49707 - DNA, 667 bp, Heterodera glycines
  SCN-specific regions: Sequence locations=1-263,292-306,328-667
gtttgaggtagtgtaataaattcttattgtagtaaaaatgtccgaaaataagtccgaaggtggcgctgaaaagaagaagagcggtggattcaacacgaagaagtttttgttggacctcgcatccggcggaactgctgctgcagtctcaaaaaccgctgttgcacccatcgagcgtgtcaagctgttgttgcaggtgcaagatgcttccattcacatcaccgcggactaacgctacaaaggcatcatcgacgtcctcgtccgtgttcccaaggagcagggctttctgtcgttgtggcgtggtaacctggccaacgtcatccgttactttccgactcaggcgctgaacttcgccttctaggacacttataagcgagtcttcacgcaaggagtggacaaggagaagcagttcttgaagttcttcaccatgaatttggcttcgggcggtgccgctggcgccacttcgctgtgttatgtgtaccctatggactttgcgcgaacgcggttggcaactgatgttgtaaaggccgatgcccgttcagtcagaagtttggcgtactggatcatgcaaatccgcaagtccgacggtcccatcggtctctaccgcggtttcttcggctcggtccgggggatcattattttacgcgcctcttactttggctggtttgac

SEQ ID NO: 49708 - DNA, 214 bp, Heterodera glycines
  SCN-specific regions: Sequence locations=1-214
gacccgcgtgaagacccatgaacttcaggtcaagaagaaagaggagctgatgagaatgttggaagaacttaaaacggagctgggcagtctgcatgtgtccaaggtgacgaacggggcggtgtccaaactgtccaacatccacgaggcgcgccaggaaatcgtccgtattctcaccgggatccgccagcggcccaagaatgacttgctccagttt

SEQ ID NO: 49709 - DNA, 468 bp, Heterodera glycines
  SCN-specific regions: Sequence locations=1-468
ctaaaaatgaataaagcgtttgtcaaagcagcactctgctccaaatcgacgaatgtttgcctcttcaaacgcctcgtcagacccgtcgtccaaattggctcccgtccaatcaccggcgccggttttggccatccgatgaccaggcaaaagatgcaaatgtacagcccggaaatgagggcagtcaattaccaacagaagcgcacccacatgcatgcaattctcaccaagaaaactgttgaagattgtgttatgctcaacttacatttgtttgacaaggtggacaatgacaaattgacgttcgactccgattttttcaaggacctcgggattgattcgctggactttgttgagtttatcattgcgattgaggacgaatttgagttcgaaattccggacggtgactcggacagaatgcgaacgccacgagatgtttacaattacatttgcgacaagtgcgatgtgtacgat

SEQ ID NO: 49710 - DNA, 425 bp, Heterodera glycines
  SCN-specific regions: Sequence locations=1-425
ggctgctcctctgtccgtgttgtggacgaagggcccggcctggacgggcgctcgtccgtctatgaatacatgatcgcccgcgcgccatgcgtgatcggctgcctgtggatggtcactgacggcgaaattgaccgatttttcatggcgctgactgagtactgctttgcagagttgcacaagaaagagggtggtgccgttccggacactttccgcctgttgctggagggcgttttggaagcgcggcgacggtgcaaattgccatttctgaccggcgccgcggtggtggcctacggactgccggtggctgcggcattgaccgccgcgctctcttcccccgccgtttccggcactttgtcctcgtcaaattgacccatttggtggcccatcaatcagccgactctcaaaattatttattaattattgct

SEQ ID NO: 49711 - DNA, 474 bp, Heterodera glycines
  SCN-specific regions: Sequence locations=1-45,68-474
cttcaattgttcgtcctcgcggcatttttcgctcgcttctgttttatttcagcagcaaaaattctctgctgttgcatcatcgcccaataaaaatttgaatgctgtgcttatcgatgctgtacgtactccctttctccaatcgaatacaactttccgtgagctgttggctgttgatcttcaaagacacgctcttaaaggaatgcaaaacgagcaatatcgcccgtgaggctgcgatcaccgccggtttccctgattcgatcccttgcaatacggtcactctcgcgtgtatttcttccggcgtttcaattcaaaatattagcctaatgatttccactggctatttaaaggcgggcatcgctggaggagtcgagttactctctgactttccaattcgttacaacagaaaggttcgactttctctcatcgatttgcagaagggcaaaagttttggagagagatttaagcacctgaaaa

SEQ ID NO: 49712 - DNA, 612 bp, Heterodera glycines
  SCN-specific regions: Sequence locations=1-342,364-612
ccgaagccgacactgcgttttgcggccgtccgaacgttgaaccgaatttccattgactaccctcaggcggtgatttcgtgcaacgtcgacttggagcagttgatcacggatagcaatcgttccattgccacattggccatcaccacgctgttgaagacgggtgccgaggcgagcgtggaacggctgatgaagcagattggcacttttgtcagcgagatcagcgacgaatttaagattgtcgtcatcgaggctatccgttcgctgtgccatcgctacccgcgcaaacacgccacactcatgaactttttggcctcaatgctgcgcgacgagggcggtttcgactacaaaaaggccattgtggacaccatcatcaccatcgtggaggacaaccccggcgccaaggacttgggcctgtcccatctttgcgagtttattgaggactgtgaacacgccgcattggccacccgtgtgctgcatttgctcggccgtgaaggaccgaccactgcgaacccgtcccgttacattcggttcatcgagagtcgcgtcagtgtggagagcagtcaggtccgtgcggccgctgtcactgcgcgggccgagattggggcggagtgt

SEQ ID NO: 49713 - DNA, 344 bp, Heterodera glycines
  SCN-specific regions: Sequence locations=1-121,143-153,179-344
aacgagggctgaactgcctgaggaagttgaacaacaatccgacgacattctctgacgaaaggaggccaatcgtcgaattttcaattgaaaatttgaatgcgttgagagtgaaggaaagacggcagcaaaaagaaacgaaaagcgaagaaaatgaggaggaaaaacaacaaacaaagaatagagtcggaaatgccgaggcattggagaaaacgaagcgcgaaatgatggccggcgggaagaaatggctgcctttttttattagggacgaaaattcggcacaaaaagccgcagaatggactcagcacgacgcctggcaaacgccgaggacagacaaaaaataaacc

SEQ ID NO: 49714 - DNA, 256 bp, Heterodera glycines
  SCN-specific regions: Sequence locations=1-100,122-256
ggtgtcgcacaccgacggcatccaacaacttcttgcagccgaaaaacgagctgctgaaaagattaatgacgcccggaagttaaaagcacagcggctcaaacaagccaaacaagaagcacaggcggagatcgaccaataccgacatgaaagggagcagcgttttcgcgagtttgtttttttttatttgggcacacgcgacgacattgaggcgcatatatattacgacacccaagccaatctgaaagccatggagcag

SEQ ID NO: 49715 - DNA, 334 bp, Heterodera glycines
  SCN-specific regions: Sequence locations=1-334
gaaatgtcctcctgttgtccacttcggcattaaagatgttgtataagccgtggagaacaaaaaggccagcttagatgtcgttgcacacgacgttgacccaatataaattgtgatttgcctgccggcaatttgccgcaaatttggagtgccgtatgccattgtgaagggaaaagtatttctcgggcaagttgtctaccggaagactacttttgtcgagtgtctttgcgacgttaatccggaggacagaaactcgcttacaaatttggctgagggtgcggtcacccatatcaatgaacccagtgatgaacttccgaagaattcgggaggcgcgatc

SEQ ID NO: 49716 - DNA, 379 bp, Heterodera glycines
  SCN-specific regions: Sequence locations=1-379
acggggggacatagggaccatgtaagggcacggcgccttccagaaagacgtgccgttctaggcggagcacagaaagaccgggcgcgtgttcaatgcgacctaacatgcgctgggcgtcttgaggaacaagcgtgttctgcatcgcatcatcccgaaacgcatcaatgtccgtgttgagcatgtgaaaccgtccggctcccggctcaagtttctgcagcgatgcaaagcgaatgacttgcagaagaagcagcacaaggagggcaacgcaccgtttgtggcgctgaagcggaagccgaaggagccccgggtggcgcacttggtcaaagtgaagagcaccaaagttgagcggctggcgcccgtcaaattcaaaattgtcgcc

SEQ ID NO: 49717 - DNA, 428 bp, Heterodera glycines
  SCN-specific regions: Sequence locations=1-109,131-428
actcccagcagaatattactgaacagtcggtatcggcaccaaccactgatcgcaacgaatatgaagaactttccaaattggtcaacccaatcgcaaaaccgcttgcaaacagaaaattggctaagaaagtctacaaattggtgaaaaaagcggcaaaagagaagggctttctgagacatggattggctgatgtgatgaaagccttccgaaagaatgaaaaaggaattatcgtcttggcagggaacgtttcaccgattgacgtgtacagtcatattcctgccatttgtgaaaaaaagggtcttccttatgttttcactccgtctcgtgaacagcttggactttgtgctggctataaacggcctgcagggggcctgttggggaagcgacgcgagtcgtacgcggagcttttgcagcgaacacccgaggcg

SEQ ID NO: 49718 - DNA, 350 bp, Heterodera glycines
  SCN-specific regions: Sequence locations=1-288,310-350
gatttattgtaattttgtcacgcatttaaggtattgctgaaccaccgccctcatcccatccctcctaaaaaatttggacgcaaaatttttaaatggccgaatccggtgaacatgaccatgactttacatctggcgagtcgggtgcagctgccacttacccaaagcaatgctctgccttgcgcaagaatgagttcgtcatgatcaaaggccgtccttgcaaagttgtcgagatgagcacctcgaatattttttagcacggccatgccaaggtgcacctggatgcgttgtacattttccccaccaaaaaggaggaggacgaccgcccgttcacccacagactgaaagtgcca

SEQ ID NO: 49719 - DNA, 449 bp, Heterodera glycines
  SCN-specific regions: Sequence locations=1-336,358-380,403-449
ccatttaagtgttattattcgtatgttaaaaatgttgctgaaatttccttccattcatcggttctgctccattcgctctttgactcaacttcccaattcttatgaagtgttgcgagaccgcggtgacactgctgagctgagtcagctgaaaaacggctttcgtgtcgcctcttatgcaaacggacgtccgacagtgacggtcggtgtttggctgaatgctggctcgaggattgaaaccaatgattattaacggaatcgcttcactttttgaagggttgctgcacaagggatcagggaaacgaaattcggtgcaacttcaaacggagctcgccaaacttggggctcggcttcgctctttcactacccgggagcattcggccttttttgtggaatgtcttaaatcggacaccgataaagtggtcgaattgcttgccgatgcgttgctgaac

SEQ ID NO: 49720 - DNA, 325 bp, Heterodera glycines
  SCN-specific regions: Sequence locations=1-136,158-325
tggtggtggcaaagatcggattgcagtttttccgtcacggatggctcaaactgtgatgaaaacgaggctgaaaggcgctcaaaaaaggcatagcttactgaacaaaaaggcggatgccttgaatatgcgatttcgtgaaattctgaagaaaatcactgaaaacaaaaaacgcatggctgatgtcctgaaagatttttttttttctcttgccgaggcgaaattcactgccggcgatttctctcacatgcttgatcaaaatgcggcttcccaagcgcagtacaccgtcagaatgaatcgccacaatgttgttggcgtttctcaaccg

SEQ ID NO: 49721 - DNA, 343 bp, Heterodera glycines
  SCN-specific regions: Sequence locations=1-343
cgctcgtacgaagttcaggcgttcgttccgcaagcacagtggtgaggcactgactacatgctaccgcgagtgcaaacggggcgacattgtcaccgtcaagggcaacggcgccttccagaagggcatgccgatcaaggcgtgccacggcaataccgggcgcgtgttcactgtgagccaacatgcgcttttctttgtcctcaacaagcgtgttcgccatcgaatcatcccaatacgcatcagtgtccgtgtggagcatgtgaaaccgtccggctcccggctcgagtttctgccgcgatccaaagcgaatgacttgcacaaaaaaccgcacaacgagggcagaccc

SEQ ID NO: 49722 - DNA, 622 bp, Heterodera glycines
  SCN-specific regions: Sequence locations=1-244,275-622
gttgtaagcaagcggcctcaacatgggcgcctacaaatacattcaggaactctaccgtaagaagcagagcgatgttcttcgctttttgctccgtattagagtttggcaataccgccagctcacaaagatgcacagggctcccaaaccttccaggccggacaaggcccgtcgcatgggatataaggccaagcacggatacgctgtgttccgtattcgggtacgtagaggaggccgcaagaagcccgttcctaagggtgccacctacggcaagcccaagagccagggtgtgaaccagctgaagcctacccgcaacctgcagtctgtggctgaggagcgtgttggtagaaggtgtggtggccttagggttctgaactcatactgggttgctgaagattctacctacaaatattttgaagttatctgtgttgaccctgcccacaaggctatcaggagagatcccaaggccaactggatctgcaaacctgtcatgaagcatcgcgagcttcccggtcttacctctgctggccgcaagtcccgaagaacttggaaaggtcacagatattctcagaccaagggcggaatctcccgtgccgtttggctcagaaagaattctctctttctg

SEQ ID NO: 49723 - DNA, 504 bp, Heterodera glycines
  misc_feature (485)..(485): n is a, c, g, or t
  SCN-specific regions: Sequence locations=1-159,186-504
gtttgagcagtgcctttatttattgaatccgacaaaatgtcatccagctcgaaagctttcattggtaagccggcgccaaatttcatggcggacgccgttgtgaacggcgacttcaaaacaatttcgctggaacagttcaaagggcaatatgtggtgctgttcttctacccactcgatttcactttcgtttgcccaaccgaaataattgccttttcggacaaggcgggagagttcaaaaagatcggtgtccaactcatcgcgtgttctaccgactctaaatttgccctcttgaatggatcaacaagccgcgaaaacaggaaagacttggcgagatgaacaatccggttgctggcgaacccagccaccaaatagccgtggataccgcgtgctgatggaggaggggggattgtttattccggaatgttcattatccatgaaaagggcggtcttcgctcagaaacccatcaccaattgcctttgggccnctccggtgaaaaaaacctt

SEQ ID NO: 49724 - DNA, 548 bp, Heterodera glycines
  SCN-specific regions: Sequence locations=1-6,29-31,53-143,165-423,445- 548
gctgtgcacgctgaacatggtgccgggcgagtcggtgtacggcgagaagcgcatctcctcccagcagaccgaaaatgcgccgattgctgcaataacgccgaagacggaagagacaacgaatggcagcaacggtgtctcagcacccaccgccgcggctgccggcccggcaccgccagtcgagtaccgggtgtggaacccgttccgctccaaactggccgccgccgtcatggccggcattgaggacacgcacatttacccgggtgcccgtgtgctttatcttggcgccgcttccggcacttccgtttcccatgtgtccgacatcgttggacccgaaggcatggtctatgcagttgagttttcacatcgcagtggacgtgacctgctcggcatggccaagaagcggtccaacgtggtgccaattgtggacgacgcacggcacccgcacaaatactccatgatgattggcattgtggacacaattttctcggacgtggcacagccggaccaggcacggattgtggcacacaatgcgcacaaatttctgaaga

SEQ ID NO: 49725 - DNA, 639 bp, Heterodera glycines
  SCN-specific regions: Sequence locations=1-34,117-294,336-351,374 -396,418-480,515-517,548-571,595-639
cctcggaattatttcaaaatgggtcgccgtccttcccgctgctaccgctactgcaagaacaagccgtaccccaagtcgcgcttctgccgtggtgtccccgaccccaagatccgcatttacgacatgggtcgtaagagggctggtgtcgaggagttcccgctctgcgtgcacttgctctccgacgagttgcagcaaatctcgtccgaggcccttgaggctgcccgtgtgacggccaaccgtttcatcttcaagcaggccggtaaggattcgttccacttgcgcgtgcgtgtgcaccccttccacgtgctccgcatcaacaagatgttgtcgtgcgccggtgccgatcgtctccagaccggtatgcgtggtgcctacggcaagccctacggtaccgctgcccgtgtcaacattggtcagatcctcttctcgatccgctgcaaggactcgaacaaggccgttgtcattgaggccttgcgtcgtgccaagtacaagttccctggccgccaaaagattctcgtgtccaagaagtggggcttcaccaagctttcccgcgaggacttccaggagggtatccagaacggctcggttgtccccgatggcaacggcatcaagatctacaacaaccacggcaccctccag

SEQ ID NO: 49726 - DNA, 538 bp, Heterodera glycines
  SCN-specific regions: Sequence locations=1-538
gaaatgaggtaaaagagcgatttggctctacccgactgaagcctacaagattactcatgctgaatttccttgatatgctcgacatcttgcctgacaccgtctccttatccccaagcactgccaaagtccattcaccttatctcgctcacgaacgcttcgaagaatctgtaaatggcctggacatggggatccgaactcttcctgtgactcgccctgcccgtatgccaccacactgggatttccgatacgtcctatgcgtgcgcgtcgtcccttattgaatggatatcctgatgctacaacattctccaagcacctttaccatgagctctacctcaaactaacctgaaatgccttccagaacaagcgcaagctcatggactacatctttaagaaagaaacccagaacaaactgtctaaaccgcttgcagaacaggacgaggaacgtctgaacaagaacaaagacacccgcaaacgtcgcgaggaccgtttggcctcaaagcgaaaggaactcttgcaccccgtttcggacagcgataaa

SEQ ID NO: 49727 - DNA, 403 bp, Heterodera glycines
  SCN-specific regions: Sequence locations=1-403
gggaacttgcatttctcgctcggatgtcccttaccgacgttttgagcacccctggcagaaactgacccttcaagaggtgaagagaccaattgttgaaattggcccggtcacggttgcgaccgccctctaattgtcgtgatatctgcctgattctcttggaggtaggcaagtgccacatgtaaccgggaagctaattatgcgcattctaccatcaaaggggagggcagcggaaatttgggaggatctttgtgatgtgatctgcaaggacggtaccatcctcaatgttgtggagcgtcgacgccatgatattgacgctgcggatacggtattctgggtggagagcacaatcaaccacttctgccgtgacttcatctgcaaacagatgctcaagcccacttggaag

SEQ ID NO: 49728 - DNA, 657 bp, Heterodera glycines
  SCN-specific regions: Sequence locations=1-657
caacagttggaatcaatcgcggatatgaaaaagtttgtggaacagtaccctcaattcaagaagatatcgggaacggtagctaaacacgttcagttggtgggtgaacttagccgaatggtcaccgatgaaaatttgttggaaatatcggagttagagcaaaacattgcggtcgcaaatggggattattcggcttgtctggattcccttcgaagacttatccagcatcccaaaacaactgatttgaatgccctccgattagcgatgcttttttctctccgtttcgaagggaacagcggcgctttgagcttcgttcatgagctgttgagaaagcgagggatggccaacaaacagctgcaattgatctcaacactgctcgaattcgcgggacagcgaagacggcaaaacgatttattcggggatagatccgcaatggaaatgaccaaacgattcataaaaggactgaaaggcgttgaaaatatctacacacagcacgagcctttcattctccaactcattgatttggcgtcgcgtggcaaactcccagaaagtgtttatccgtctacggatttggcaaatctgaattcccgctttgaaaatgttattttgtttgtcattggtgggacaactttcgaagagagtgctgcggtggcaaattta

SEQ ID NO: 49729 - DNA, 645 bp, Heterodera glycines
  misc_feature (644)..(644): n is a, c, g, or t
  SCN-specific regions: Sequence locations=1-645
tggtcgaatacgctcaactccttttccaagacgaccaactttgggaaattgcgcccgaatatttgatcgccagcggattgggcagtgttggtcagcggatactcgaccaactcgtcagccaattcaactggaggggaaacacatcggtggcacagcgacttctgacaatttgtgaccgctacgaactgggcacggcacgggaggacattttgagatcgctcgttttaatgctttgccggcagggagaatggacgagtgcgcttggctgggctctccaaatgagttccaacgaactcaccgttaacgtttctcgtcgtattctcgagggtgccatttcgcccgatcgcattggacagatgcgcatttttgaagcactcgacgaccaatttgtgaactgttctgagctcgtccttctctacaagttctacacattcaaacggttgctgcttgagggcgaacttcgccaggccgttcatattctccatgaattgttcatcgacaactcttcccccgtggaattccacgccgttctctttgaggagatgatacgcattttgtgctctttccaacaaccactggtcggtctggacgtattaaaccccgaagaaatgatcactcctggccttgaccgcgaattggtgcang

SEQ ID NO: 49730 - DNA, 615 bp, Heterodera glycines
  SCN-specific regions: Sequence locations=1-257,292-615
cgcgcgatggcagtgcccttcagccttcaagtggacggccttatctacagagtcagaaactccacttacgggcaatttcccttagatgtgacggagcacgacttacgccagctttgcgatgccacgatggacgtcttccggcagcagcagacactcgtcaggattcaaccgcccgtcaacgtctgcggcgacatccatggccaattcacggacctgctgcggatcttctcgacgctgggccccccgccggagaaaaaatacctcttcctcggtgactacgtggacagaggcccccaatcgctggaaacggtggtgctcctcttctgttataaggtcaaatatccggagagtgtgacgctgttgcgcgggaaccacgagtgcagtaacatcaacagagtatatggcttctactcggagatcgagcagcgctaccaccaagcggacactcgacggctcttcgacatgttcaaccaaacttttgcctggatgccgtacgtgggcctgatcggggacaggattctgtgcatgcatggcggcatttctgacaggatcaccagcttgcagcagctcaacgaattacgccgcccgctgctcaccctgccgagcccgtcgttg

SEQ ID NO: 49731 - DNA, 568 bp, Heterodera glycines
  SCN-specific regions: Sequence locations=1-568
tttgaatgtagctacatccctcatcgcaatgcaaaaaatggtctaccacctgtatgcttatgtgtgaatgcgccaatgagacggtgttcacctcatacttcattgctccatagcacgtcacaaactgttggtcaccattcgtgtcaacgatggcattaatagatccttcctaggtgattgctgccgatgctccaccacgaacaccgcacgcaaataggctcaacatcgcctttcacaacacgtgcctatcacctccgtggccgttttacccccgtgctcctctgcacgcaaccattttcactacaattactccgaacctcggctgctcttggtgtccgaggcgcacgtggagcttcaggcggttcgtcatgaactctacgcgaacactccgaggattgcaactgccaacacggactcgcctctgcaattggtggacattgcctttccggcaaacgataatcaaaagctctcctttgaacagtattcgtggatgttgctccgcgaaattttgctggatgcgctgggcatacactgcacactgtgtttatggtggatcacatgtgatctt

SEQ ID NO: 49732 - DNA, 638 bp, Heterodera glycines
  SCN-specific regions: Sequence locations=1-59,82-638
tcaatcgccacttttcccattggtccgtcccagatgaccgccgtgccgaattcaccttggaaaaagtgtggcatcatttgcgttatttcgaacattccgcagctaaagaagcgctccgtgaagcttcagaattgtccggcattgaaaaagtcgaatttggcggagcattgggtcgtcgcacacgctttcaacaaaaagaagtcccacaattgtttttacaggtgactctttcctcctctcaaaatggcgacggttctttggcgccatcgccgagtgaacttcccaagaattgtgagagcggcgacgacactcttttggaaagaattgttttttcggaaggaactgagcagaaagttctcaacccggtgcagtgcgcgtgtgtgttgaacatggcattggtggaaaggcacggaaaggcgacggcggacgaaatccgcacggaggaaacgacggcatttttggaagagattatcaaccaaaagtcctgttgggctgttcaatttcgtgcgctttacgagcggagtttgttggaacggcaaaatcggcgcagaatggagagggcgtgtgctcaactcgagtctcttggcaaagtgttggacaatgccacgccctcttcggtcaccctcctccatcgtttg

SEQ ID NO: 49733 - DNA, 373 bp, Heterodera glycines
  SCN-specific regions: Sequence locations=1-292,314-373
gcaacttccaccagaggacgtcgcaacaatgcccacgcagaaggtcgtcttcaacgccccgttcgacaacgaggccacctactacatgcgggtgatcaaccctgggacgaagcgcatcggctacgccttcaagaccaccaaaccgaagcgcatctacatgaacccgccgaacggagtgctcggccctaaggagtccgtcgacgtggccgtctcctgcgacgccttctaccccggcagcgaggacaccaagggcgaccgtgtgaccgtggagtggaccaacacgccggacccagccgccaccgcgttacagctctagtggttccagggatactggatggtgcgccgcaagaacttgccgatcgagtacaacgtc

SEQ ID NO: 49734 - DNA, 661 bp, Heterodera glycines
  SCN-specific regions: Sequence locations=1-6,28-246,268-300,322 -349,382-550,578-661
aattaattgaactttgtttcctcatttaatcaattgttgttgtgaaatggaggcaatggaagttgacagcaaagcatctggaggtggcgaaccgatgaataacaataacaacgccaattcgtcgtcaaatccgcgcaccgttctcgatgagagtggtggaccgaaaaagatgagccatgaactaagccgagagttcatcaaagacattgacgaatggatagcgcagttgtacgagtgcaagcagctcagcgagacacaagtgcgactgctctgtgacaaggccagagagatactcaaaacagagtccaatgtgcaggaggttaagtgtccggtcacagtttgcggcgacgttcatggccagttccacgacctgatggagctgttcaaaatgggcggcaaatcaccggacaccaactatttgtttatgggcgactatgtggaccgaggctactactccgttgagacagtgtcgctgcttgtttgtttaaaggtacggtatcccgaacgtgtgaccatcttgcggggcaaccacgagtcgcgtcagatcacccaagtgtacggcttctatgacgagtgtttgcgcaaatatggcaattcgaaggtgtggaattatttcaccgatctgttcgactattttccgctgactgcgttggtggacggc

SEQ ID NO: 49735 - DNA, 602 bp, Heterodera glycines
  SCN-specific regions: Sequence locations=1-378,400-602
ctctgctgccattggaccattctctgctcgaccaactcgcttctgtttacgctcgcgcgggcactgaaataaaaaggatgacattcaaaagcatcgaaattgcgatcaaatccatcggaatgcattctgaggagttgctgaacatgatcaacacgtgcccttccgaggccgagactttggtcgcgcgcattgtccatttgctgaccgaacgcactgccccatccgtcgcttaggttgacagtgtccgcaaattgcatcattctcggaacaccgacgttcgctcactgattccaattctgaccggactgaataaggaggaactgctccaattggtgcccaagtttgtgctctcagcaaaaaacagcaattcggtgcccgcatttttcaaaaaacttttgttcggtcggcacattgaaaacggcgagccattgatcacagctcaagaacttctgttggagttgcacagaatacggccaaacagaaaggaattgggctttttgatgcaaaatttggacattcttctcgtggatgccaacagagaatttacaattggcaaagatgttttggctaatacagtggaaactttgcttaacgacgagcct

SEQ ID NO: 49736 - DNA, 561 bp, Heterodera glycines
  SCN-specific regions: Sequence locations=1-561
ttccctaaaaacgatgcgcctccgctcgacttgcttttggggacgaagtcggatgctcaacaacaaaatgagaatgggtctgcgatggcactcgaaaaagtgccaaaaatcgactggaaccaattcgaggtccaatatttggacttagtcagtgccctccattatttgctcaccgtggaagtgcctcgaaaccccgttcttggaaacaccgaattgaccgcgttgaaacgtttcgtccatttgcttcgtcttcatggccccggttcgacatccgtccgacgccttttctatcgtctggacgaatggctgtcctcgcagcatcagccggtagtgatgaccgacaaatatctgtccactttggacgaaattcagagtgacttgggccatcccatcccttccaacacttctttcgtggcgtgtcgcggctcaaagccctttttgcggggttacacttgcggtctttggactctcttccaccttttgacagtgcaggcgtacaaagaacggcaccgaagccccagttttgaccccgtcgcggaagtgttggagcccattcatagt

SEQ ID NO: 49737 - DNA, 318 bp, Heterodera glycines
  SCN-specific regions: Sequence locations=1-136,158-318
gacggttcgaaggtagaagcggaagtgttccttaaggacaaagtggtcgctgtttacttctccgccgggtggtgcccgccgtgtcgcgcgttcactcccgaacttaagaaattctacgaggagctgaaaaaggcaggcaaaaacttcgaggttttgttcatctcgcttttccgtgctgctaaagacctcgtcgaatattaccgtgactttcactaagcttgggcctagcacaaggacggaaacccgaaaattcaggaacttctccagaacaacgaaaagaaaaccatgccgactggaagaagaataaaaccgatcgga

SEQ ID NO: 49738 - DNA, 641 bp, Heterodera glycines
  SCN-specific regions: Sequence locations=1-77,100-345,367-641
cgcaatttatcggccattttccttcccttggcactcttttaactaaacattcttcggaatccgagaaggaacagcaacttcagcaacacaacataaaaaaggacgaaacaaacggcggaggggacgaaatggcaactgaaaaagccgaattagtggccaaaagagcgaaaatgataagcagcaaatgccaaacattttacgccgatgagcccattttggtcactcgcgcgtcgatgcaattccttttcgatgagaatgggagacgtttcctggactgtatttcgaatgtgcaacatgttggccattgccatccgcgcgtcgttgaggctgtccactgccaaatgcgactgtccacttgcaacattcggtttctctctccgcttctgaccgaatgtgccgaatcgctgcttcagactctgccggctcaattggacactgttctcttttgcaattcgggctcagaagcaaatgatttggccttgcaattggccagggattggaccgggacgagggatgtcgctgtgttggagcacgcgtaccacgggcatcagacaacggcgatgcaaatgagtccatacaaattcgacagaggagccaaaatcaaacggcccaaatggggccacgtgtgtccgacgcccgat

SEQ ID NO: 49739 - DNA, 443 bp, Heterodera glycines
  SCN-specific regions: Sequence locations=1-62,101-225,247-255,295 -312,335-443
gagaactagtctcgagtttttttttcttttcccgttcttttttgtttttttcattttaccagaaaaaaatatcattttaataaaataatattatttatttcacctatgttaaaatttggtctttttcaataaaaattcagattttttcttacaatggaaattttttgcctttttttccccctattttttacaattttattccgttttgcacaccggatcattttgaaacaaaatataatgttccaaattttcgtcaaaactctcaccgggaagaccatcacccttgaagtcgaggcgagcgaccccatcgagaatgtgaaagcgaagatccagggcaaggagggaattccgccggaccaacagcgcctcattttcgcgggtacatccgcttgatatgccaagatattaaatgtttcacgtaatccttgtttttaggaaaacag

SEQ ID NO: 49740 - DNA, 374 bp, Heterodera glycines
  SCN-specific regions: Sequence locations=1-97,142-147,173-202,236 -280,311-374
ggcgaagaaagcggtgaagtccaccaaagcggtgcgaacgggcgacaagaagaggcgtaaggctcgcaaggagtcgtactctgtgtacatctaccgcgtgctgaagcaggttcacccggacaccggcatctcctccaaggcgatgtccatcatgaactcgttcgtcaacgacgttttcgagcgcattgccgcggaagcctctcgtctggcccactacaacaagcgatcgaccatctcttcgcgcgaaatccaaacggccgtccgtctgattctgcctggcgagttggccaagcacgccgtgtcggaggggaccaaggcggtgacgaagtacccctcgtcaaagtgatgatgcgatggtcgacttcggtgtccgg

SEQ ID NO: 49741 - DNA, 594 bp, Heterodera glycines
  SCN-specific regions: Sequence locations=1-594
gtgatcaatgtgtggaacacacgcttcaaaacggcatcgcccgagatgacattcaccagctcatcacgcgtgatgagcatgacatgggacatgttcaacgcgaacatcatcttcggtgcatgttattcgggtcaaatttgcatttgggacacgcgggtgaacaagcggatgcctgtgtgtaagactccgttgaccgccaaagcacacacacagccccttttgtgcatgcgaatggtgggcacagcaaatgcgcacgatttggtcaccatttcgacggacggtcgaatgtgttcatggagcattgacaacttgcagtcgcccattgaagccaccgaattgacatgtaacaggacaaaaaagccgatttgtgcacttagcatggcattcctacacaacagcatcaacaattacgtactgggcactgaggagggcgagctgtacattggcgaccgacacgcggccagcggcgagtcgagcagaaacattgccgcccaccaattgccgatcactgcgctggacacacaccgcgcgttgggtgccattgacttcagctcactgtggttgacttgctccatggagtttggcatcaaactg

SEQ ID NO: 49742 - DNA, 157 bp, Heterodera glycines
  SCN-specific regions: Sequence locations=1-35,73-157
taaaaagatgcaaatcacccctcgccatttgcaattggctgtgcgcaacgacgaggagttgaacaagcttctctcggaggtcaccatttctcgtggcggtgtgttgcccaacattcacacggaacttttgtccaagatgcaacagaacaagcagcag

SEQ ID NO: 49743 - DNA, 508 bp, Heterodera glycines
  SCN-specific regions: Sequence locations=1-79,101-508
tggccatttgtactttgtgtttatggatgttgtgccggtggaacggcgccatcgctttcgctaccgatacgacaaatcgcaatggcaaagtgcgggcaaagcggacaaacagcccttcgggcgactgtttctgcacaacgaatcgccattcagcggagaacagcttccgctccaattggtcacttttgactaagcaaagttgaccaacaacgagaagagcagcccggacccggaccagctattgctcaattccatgcacaaatatcggccccgtgtccatgtcctgtgcgtcgcgccgtccgccgaccgttcggtccaaacgccgacttttccgcggcaattccgccgggcggccgacttcgacaagctcagccgatttccctacagaacattcgaattcccggaaacaaaatttgtcgctgtcaccgcttatcaaaatcaattggtgacgcgcaaaaaaatcgaattgaatcccttcgcgaagggatttagagaccaaaagggcgac

SEQ ID NO: 49744 - DNA, 550 bp, Heterodera glycines
  SCN-specific regions: Sequence locations=1-187,217-307,329-550
gttggatttggggaagaaaaagaagaagaaaaaggcgaagaccacagaactcaaattgtcagaagatgagcatgaggaggaaaaggaagtcactgcactcgccgaaggcgttggccgtacaaatttgctcgacacaaaaaaccccgacgcgtggacggactacaactacgacgagatgctggacatggtcttcaacatcatgcgggagaagaacccagaaatggtttccggcaagaaaaagacatttgtgatgaaaccgccggaggtgcaaagggcgggcagcaaaaagacggcgttcacaaatttcactgaaatttgtcggctgctgaagcgtgacccgaagcatgtgctgcaatttcttatggccgagctgggaacgacgggctcaattgacggcaatcagtgtttaattgtcaagggcaagttccaacagaaacactttgagaatgtgctgcgcggttacatcaatgaatacgtccgctgtcacacgtggcgctcctcggacacccagttgaccaaggatgtgtcccccctgttcttcatccaatgc

SEQ ID NO: 49745 - DNA, 169 bp, Heterodera glycines
  SCN-specific regions: Sequence locations=1-169
aacgtttggcatttggctccgctaccattctcgtactggacaccactacatgtaccgcgagtacctcgatgtgtgtgaagcggaagctgatactcactgctatcacgacatgggcgctcgtcagcgtcctcaagcggatctcattcagatcgtcacagcgcaaaccatc

SEQ ID NO: 49746 - DNA, 406 bp, Heterodera glycines
  SCN-specific regions: Sequence locations=1-406
gcgaattgcactggagctcagttcttctctttcgcgctgcttctcaacaattggagtcgtcccaattgcttcggctatttgtggcactttggccttgattggcaatgccatttaatcgctccctttctcctccatttgctcttccggcgacaaagcgtcggtttgattgtcgtcgccgttttgatcatcggttcgatgtgtcttcgtgctttcaaatgcgtctccaatggaatatgcaataaaagtgacgtggacattccggtgggttcactgctttggacattggcatactcattgtcagatagcataagactcaatgttatgtaaagaaaattgttatcgaaaatataccaagaaatcggacccattcgcttgcttaaaccatctcttcctcttccaatgcgtc

SEQ ID NO: 49747 - DNA, 481 bp, Heterodera glycines
  SCN-specific regions: Sequence locations=1-12,34-481
gttaattgtttgataaataataaaataataattgcacaacgtcaatgcctccattatttcccgaaaaggtagagagcattcgtcacttgtccacaaaatcttgggaggcgacatttacgaaggattatctctccaatgaaggccaactccgttttctttcgcgcatgtgttacctcgcaatggcacattaccttttgtaccgtggagtgctccccaaaggagttttcaaacgccgaaagctcgaagatttggctatttactgtttcgatggcaacacgcgttggggacgtaaattgtcggagatgatgaaaggtatcagagaggccatcgaccaaaagtacatcaaacaagcattcgtgatgatcaacgaggacaaagaggacccggacgtcgcaactgaagttttctcagtcggtttttgttacaacgaacagcacacgatgactgtcttggatgacaaaggcaatcgtatcgtttcatt

SEQ ID NO: 49748 - DNA, 543 bp, Heterodera glycines
  SCN-specific regions: Sequence locations=1-434,457-543
gtttgagtaattgtaacatttcggcacctaatatgatttattccgcctactatagaaggtgaacagcttgaaaatgatgaaaacgtttctccgagtcgcgtttcccccaccaatgcctttggtgttcaaaagagtggccatttgctgcacaattttgctgagcctggaccactgacgacaaagatttattattacgtcgatgaccaacaaattccgttctccaccttttttgccatccctccgtccaaaattacgctggcggacttcaaaaagtgtatcacgcgcaggaactaccgatattattgcaaagtgatggacccggcacttaacgccgaggtgaagacggacattcgcgacgaaaacgccgtgctaaagccaaattcgaagaatggacgctttgaactgtttttgctgtccgagacacaacagacgcactcgtccgcctccactctccccatccaaaagctacagcatgtcgatgccatccgtgcctctctcatggaaaaacggacaacggccaataattacattcttgacgggagg

SEQ ID NO: 49749 - DNA, 580 bp, Heterodera glycines
  SCN-specific regions: Sequence locations=1-580
aatttcatttgtcctaaggttggagagccttctccactccaacaaagagttcgaatacttgttctttgtcgaacaagcggaaggaaccgatgaattcccagagaacgttgacatcgaagacactggaatgttaaaaaaatgtaatgcaagagatatcggactctttcacgaccgcgatattctgagcaaactgaatttggattgcaatcactgctagctggtggaggacttgatggaaacacgaaaagggaccatggcataccccatttattacaaccagaggctcattgaggggatggcgaggcccaacaacggcactgacatctgctgattcttggccgactcttttccgaccgtgaacgcttatgtgagggatagtgcacgatcacacaaaccgacgactatcatgaccatgatgatctaaagctgctccattgtttatcgtaccaagttgccagctttcgacaatatgcataggtaagacgtgggggagcctgcttttaccagaaaatggatgtagagattttatgacgttacaactgcgcttgaccaaaattctgacagattcgtgaacaaactt

SEQ ID NO: 49750 - DNA, 220 bp, Heterodera glycines
  SCN-specific regions: Sequence locations=1-220
tcgtggcgagtcgggaggaactgcctcttaccctgagcaatgttctgtgttgcgctgcattgagttactcatgatcaaaggccgcccttgtaaacttgtcgagatgagcgcctcctacaccgggaagcgcggtcctgccgaggtgcttctggttgcgttggacattttcaccttcaagaattgggattacatttgcccgtccacccacatcatggatgtg

SEQ ID NO: 49751 - DNA, 349 bp, Heterodera glycines
  SCN-specific regions: Sequence locations=1-73,95-349
agaggatgaaaagaaacttcgcattttcttcgactagcgaatggcgcaggaagctgaagctgactcgttgggggatgagtggaagggctatgtgctgcgaatttcgggtggtaacaacaagcaaggctttcctatgaagcatggagtgatcaccaactcgcgtgtgcgccttctcctctcccaaggccattcctgctatcgcctacgctagaagggacagcgcatgcgatagtcgtttctcggatgcattggcgactcgaatatgtccgggctggcattggacgctgtgaagaaaggataatagcaaatcgaaggactggccgacttagttctgcctcgtcgtcgtggc

SEQ ID NO: 49752 - DNA, 526 bp, Heterodera glycines
  SCN-specific regions: Sequence locations=1-526
gaatcatcgtggcactgtttattccgtgtctttcaatccttttactcactcggaagcgcccatttattttgccactgtaaggaaaaatagggtgtctgtgcacctttgtccacccgaaaagggctttctattggtgcggcaattccaacaccaacacgcgaacgacgagttttattactccgtcacttgggcttataaccttgaaaaagcacaacatgtgttggtcgtccgcggatttcgcggaatcatccgtgtggttatcccactcaatgggcgacttcgttgcgcattaatcggtgacggcgactccatcaacgaattgtgcacttcgcccgtctctccgatgattgtcgcttcagcgagtaatgatctgacagtgcgaatttggaacgtcacttactcgcaatgtttggccatcctcggggggaccaacggacaccgtgaccaagatttcgattcgtccggcgcttttttgggcactgcgagtatggaccacgcggttgatctatggcacattggcaaagca

SEQ ID NO: 49753 - DNA, 504 bp, Heterodera glycines
  SCN-specific regions: Sequence locations=1-504
gcactcgcactgctcaagcaggacgtgttcatccaggccaggaagtaccctctcgcctctcaacttaacgacattcccaattacattttttccaccattggacttgacggaacgcatgtcgaactttatgacgaacgcaaacccatcgcgagttctgccgaccttaagttgccctttcccggcatggataagagtggacgcggtgtctgccttaaaaacgaagtcaaagcgtgcatgtttggtgcattatgtcctctccgacacatcatcaaggacaaacaagttgtgtgcaagcattggttacgcggactttgcaaaaaaggggaccaatgcgaatttctccacgaatacgatctgagtcgaatgcccgaatgcttttttttctcaaaatacttggcttgcagcaacagggaatgcccatttcgacacattgacccggagagcaaaatcaaggattgtccatggtacgaccgcggtttttgcagacatggaccgttttgcaaa

SEQ ID NO: 49754 - DNA, 478 bp, Heterodera glycines
  SCN-specific regions: Sequence locations=1-478
agtgttttcgcgaaaagtgtttatcggtggtcttccgattgacatcactgagacggagttgaagcaggcttttcataagttcggttcgttgctagtcgattggcccaaccgatcatccgattcacactttgttaaaaaagaacattatagtggcgctgccagcagagtcaccggctacgcatttctcatctttttggaggaggcgtcggtgcagcgtctgatcgctaagtgctactcggagggcgaccgtttctacatgctgatgtccagtcagactgttcgcgagaagcccgttcaggtgcggccgtggcgcctcgccgacatggactacatgccgcgcccgtcggcccacttggacccgcgccgcaccattttcatcggcggtgtgccacgaccaaccaaagcgaacgagttggcatttgtgctcgaagccgccttcggtccggtttgctacgcgagcattgacgtcgacccggaa

SEQ ID NO: 49755 - DNA, 252 bp, Heterodera glycines
  misc_feature (172)..(172): n is a, c, g, or t
  SCN-specific regions: Sequence locations=1-176,200-252
cccatttggaatagtcttttgattccggtcaaccccctcaatcatcgcaaaaatggtccaaaggctccagtaccgtcgtcgcttgtcgtacaacaccaagtccaacaaggtccgtgttgtcaagacccccggtggcaagcttgtctaccactacgagctcaagaagggcctnggcttcccccaagtgcggtgactgcggctcggctctcactggcatcccggccctccgcccccgcaagtacgcgaccctct

SEQ ID NO: 49756 - DNA, 409 bp, Heterodera glycines
  SCN-specific regions: Sequence locations=1-409
ctcttttcatcaatgtgtccatcccgaagacgacttcgagcgtcttctgccaaatggagtgaccaattctttcactcctgtgattcccggccgtggacgtcggaagatgaaccgcggattgaaccgaaagcacaaatctttgctcgttcgtctgcgtaaggctactctccattgtcccaagctgatgaaaccggagtgcgtgaagactcatttgcgtgatatgatcgtgctgccggagatggtccgctgtgtggttggcattcacagtgggaaggcatacaatcaggttgaaattctagctgacatgattggatattacttgggcgaattttctattacgcacacgcctgtccaacaccggcgtcccggaatctgcgcaacacacagttcgcgtgtcatcccactcaaa

SEQ ID NO: 49757 - DNA, 511 bp, Heterodera glycines
  SCN-specific regions: Sequence locations=1-43,67-368,390-391,419-511
tcttgactccattcttccaccgctattaccaactgacaagccattgcgtttgcctctccaggatgtgtataatattggaggcattgggacagtgccggctggccgtggccagactggcgctctcaagcctggaatggtggacacttttgctccgcaacgcatttcctgtgaacccaaaaaggtggaaatgccccgccagcccttgccagaagcgcttccatgagatttttttggcttcaacgcgaaaaacatctctgtgaaggatattcttcctcgttcgggcgcgacggacgcgaaaacctacccggcaaaggaagcctttatcttcccagctcaagtgatcatcattaaccaccccggactgatcactgctggttacacacccgtgggagactggcacaccgctcacatcgcatgcgaattcgcccaacttaaggagaaagttcgaccgaccgcctgaaaaccacagcgaaggacgacacccaaggcgataatcgccgggaaaacgggg

SEQ ID NO: 49758 - DNA, 364 bp, Heterodera glycines
  SCN-specific regions: Sequence locations=1-152,177-273,295-343
tcgccacccggacgtgctgtgggcgcaacgtgccaacgtaggcctgctctcgatcgaggtccacgactgcaagaacccaaagttcaagctcgacaagaacaaggtcattttcgaggcgcagggccagggcattgccacaggcaccgattccaagctgtaccgcgccgagctggacctctatgctccgattgaccccgagaaatcgtcctaccacattggcgcccgcctcgtgacgctgacgctggccaaggccgacaccgacgcgccgtggtggccgcgcctgctctcggacaagcgcaagccctcatggctcaaggtggatttcgcgccgtggaaggactaggacgaagacgacgaggaagag

SEQ ID NO: 49759 - DNA, 647 bp, Heterodera glycines
  SCN-specific regions: Sequence locations=1-647
gtttgagcaaataaactatggagcattatgatcgtgcaattacgattttttctccggatggcagactttttcaagttgactatgcgcaagaagcagtgaagaagggctcaacagcggttgccgtgaaaggaaaaaattgtgttgtaattggagtcgaaaaaaaatctatcccgactctgcaagacgaacgtaccattcgtaaaatacatgcattggattcgcatgtgatggtcgcattcgccggactcagcgccgatgcacgcgtccttatcgaccgtgctcgagttgaatgcgaaaattacaaattgacgcttgaggaccgcgtatctgtcatgcatatctctcgcatcatagctgatataaaacagagatacactcaaaccactggccgtcggccttttggaatttcaatgcttgtcggaggcttcgattctgatgggacccctcatcttttcaagacggaaccgtccggagtttactacgaattgttggccggttcaatagggcgaaatgaaaagattgtgaaggagtatctggagaaagaatacggcaacgacaacacagctgatgaggagtctacgcttaaactgatgctcaagtctttagccccagtggtccaatcgggggcgcagaatatcgaaattgcg

SEQ ID NO: 49760 - DNA, 262 bp, Heterodera glycines
  SCN-specific regions: Sequence locations=1-262
atataccatccatttgcacaaacgcttccacggaatacgcttccaacatcgagctccgcaagcgatccaagaagtgaaaaagctcgctgagcagcatatgggcacaccctacgtacgcgttgacgcgcctctgaatatatttctctgggctctaggcgctcataatgttccattctcgcgctctggcctgactttcgctctcacgcatgtgacggacgacgactctcgcggcaaattataccctttggcgacacatgtgcct

SEQ ID NO: 49761 - DNA, 502 bp, Heterodera glycines
  SCN-specific regions: Sequence locations=1-502
agactattctaataccgatccctttgcactaagtatgcctcttccttgcactgctgcggacactcccaactcgcttccgggccccgccggtgcttccattggtgccttcaccggtgctactagcaatggcacatcattagatcgagaattggtccaatctgtctacaatcaaaactctccttctttcgaccgatgctgctcatacgattatttgctaggcaacactgacgacaccttgccgggcggttacgcttcttatttggtctacaaaattggaggaggttttgattacacggacacgactgttgcattgggactgtacggggcgacggtgctcagcggctgttttttggtgcccatgctcaagaagcaggatactaaggcgctgactgccaacgctgttgtccttgccggactttccgtcgccacttctgtggctttctacaacatcgacaagatttccgcttattggaccatgcccttcactctatgggccattttc

SEQ ID NO: 49762 - DNA, 248 bp, Heterodera glycines
  misc_feature (114)..(114): n is a, c, g, or t
  SCN-specific regions: Sequence locations=1-248
cgacttcagcaagtgccgagcaagaaatgccaaatgtaacgacagaaggcaacaacatcgggtcgtacgaggaattacgcaggaaatgccgtgacttgttccccgtttgtttcnaaggtgccaaggcaatggtccaaaaggggctcagctcgcattttcaggtttctcataacatcagcatttctccagcactcaatgggtatcgcttcggcgcgacttatgtgggatatatggagggcgaccccagc

SEQ ID NO: 49763 - DNA, 145 bp, Heterodera glycines
  SCN-specific regions: Sequence locations=1-145
gatttaccaccgatttgatgagattggccgtgtcgtttacattgccaaggggaaggaccaaggcaaactgccagctcttgtgaatgtcatcgacagcatcaacgttttattggacggcccctcctcaggtgtgactcggcgagtc

SEQ ID NO: 49764 - DNA, 655 bp, Heterodera glycines
  SCN-specific regions: Sequence locations=1-156,193-522,545-655
gaagctcaacattgccgacccctcgagcggttctcgaaagacctttgaaatcgatgatgagaagcgctaccacgtcctcatcgacaagcgcatctcgcaagagattcccggagaccaggtcggctacgagttcaagggctacgtcttcagaatcaccggaggaaacgacaagcagggtttccccatgaagcacggagtgctcgtcaaccaccgtgtgcgcctcctcctctcggagggccactcgtgctagcgcccccgccgtaccggcgagcgcaagcgcaatgcgatccgcgggtgcatcatcaaccacgacagcgcgggtgtttcccttgttgacttcaagaagggcgaggacgacattggcggtgtcacagacgtgactgtgcccaagctccttggttcccagcgcgcgtccgagattcgcaagacgttcgaattgacgaaggaggacgatgtgctcaagtacgagatccgccgtgaggtgcccaagaaggctgggaaggccgacttcaaggtctccagaatccagcgtcttgtgacccccttgactctccagcgcaagcgcgcccaccatgccgagaagcgcatccgcgccgtggctgccccgtgagccgctgcttcctacaagaaagtgctcgctgaccgtgcccatgag

SEQ ID NO: 49765 - DNA, 613 bp, Heterodera glycines
  SCN-specific regions: Sequence locations=1-613
gcaacataacagaggaatttcggcaaactgttaacttcatagaaaattgttataaagacggattcaaacagccgctgattttgttttgccaacgagcggattatatgacacatgaaagtaaagagaacaatgagaagaaattggaattgaagcaggtggaaattaataccggcccaattggcggccttggcacttcgtcccgtgtcactatgcttcatcagcatgtcctttccatggccaatgccgacatttcgcctcgggcgcttccgcctaatcacacggacacaatggtggccaaagcactgcacatggcatggaatgagttcggtaacagcgaggcggtgatcctctttcttcactcttctccttccgacacacgcttaattgaatcgcgccaagtccaaaatgaggtggcgcgaatttcgaacggacaaacaaagtgcgttttcctcattctgcgcgaagccattaaccggctgaagctccatccgaaggatttctcacttattttggacgacaaatatttggtggccgtcgctgtccatcgctacagtagtacaactccacaggaattgacatttactcgagaaattatacgccggtcaacggctat

SEQ ID NO: 49766 - DNA, 599 bp, Heterodera glycines
  SCN-specific regions: Sequence locations=1-89,111-599
gtttgagaataattttgtaattaatctgctgctcacccattcgcggcaaagtgcaatgctccaagtggggaaagttgttctccttggcatatctgaaaacaaaaatagaagccgccctccgggaaaagaatgacccaacgtcggtctctgtcccaaaacacctgaaagtatcgtataattatgcccagtgtttacatgactgacaatgagtgcccaccttttggaggtgtcccttcagtctgatcagttctttgtctcgcgtcgctttgccctgctgaatgaaataatcgccatgcattcgtccgataatcccaaaagctgacccaattacctttcgagtggccacgccttttgtttgaaggacagtgaacaaagtgggcacatcggcggtgctctgatggttcacaatgacaaggacgcgatctttttcaccgtacttcctgatgtcttcgccatattcgtagactaatggggaacggacgttccaatatcgcaacaattgaaggattaccgtcataatcagcagtgtatccccaataagcgatgaacgcttgcaaccacatgtacaattttccctcgtaaaaccaataaaatcgtgg

SEQ ID NO: 49767 - DNA, 226 bp, Heterodera glycines
  SCN-specific regions: Sequence locations=1-226
gaatgtcgatctctccgtattccagcaccaatcttgttcctatatcctcaagagcactttccccatgcgacttattctccacttatctcactctgaaaaggcctaccacaacccattgtcagtttcctaaatccccaacacgtcctttgagccggccaagcaaaagatcaaaagcgatccacattttggtaattatgtccacatgtgccttctctaccgaggagat

SEQ ID NO: 49768 - DNA, 648 bp, Heterodera glycines
  SCN-specific regions: Sequence locations=1-172,196-238,263-463,500 -518,542-648
gttccattcgatccaatctctggcttcatggcgacccatgttggagccgtctgacaggatgccgcggtttaatgggtgggccatccagcgcaaagatggcaatgcatctggtaaaactctgctcgaggctcttgactccattcttccaccgcaaagaccaactgacaacccattgcgtttgcctctccaggatgtgtataacattgtaggtattgggacagtgccgggtggctgtgtcgagactggtgttctcaagcctggaatggaggtcacttttgctccgccaagcatttccactgaagtcaaatcattggaaatgcaccaagaatacttgccaaaagcgcttccatgagacaatgtgggcttcaacgtgaaaaacatctctgtgaaggacattcgccgtgggtcggtcgcgtccgactcgaagaacaacccggctaaggaaaccaagagcttcacagctcaagtcatcatcatgaaccacccgggtcagatcgctgctggttacactcccgtgttggactgtcacaccgctcacatcacgtggaaattcgccgaacttaaggagaaagttgaccgacagtctggaaagataagggacgacaacccgaaggcgctgaaaaccggcgatgctgggatcgtccattt

SEQ ID NO: 49769 - DNA, 608 bp, Heterodera glycines
  SCN-specific regions: Sequence locations=1-70,92-109,147-155,178-565
accacgttgtcatatcacatcaactggcgcaattttattggctgacatcattccatcacttatcatcaaattgttttctccctttattattgaccgagtgccatttgggtttataattttatttttatcaatcattaatttattaactctaacgctaattaattaatttatttattagttttcgacatttacttgtgtgcataatgcaggcactcagctttgtcattgtggcattttcccaatcattcacactgtcattaattggcattatttttgcatcattaggcagtggtttgggcgaaaattgcttgctggccctctcatctcattacaaacggtaaaaaaattcatatgggtaaaattcatgaatttatgatgtttaattaattaatgattattagatcaacaatttcggcatggtcatccggcacgggcggtgccggaattgttggctcagtggcatacgctgcacttacagagccaaaattgttcggattgtcaccacgaaatgccctactttccatgctaattgtgccaatcatttttgcaattgcgtcagttattgaattttaaaaataaaaatttaatttagtttaatatcttaaaat

SEQ ID NO: 49770 - DNA, 552 bp, Heterodera glycines
  SCN-specific regions: Sequence locations=1-28,60-227,281-340,376 -383,422-479,514-552
caagttagctgctctcgtggtgaactatgggtccggaatgtgcaaagccggtttcacggacgatgacgctccccgcgcggggtttccgtccattgtgggccgaccccgtcatcaaggcggcatggctttgcatggatacagaacgactacctactctgtggaggactatgtcgcagctccaagcagagatattctgacactgaactacccgattgagcactgtatcctcaccaactgggaccacatggagaagatctggcaccacaccttctacaacaagatgcgtgtcacccccaaagatcacccggtgctgctcacataggtcccgctgaagccgatcgccaacacacaaaagatgacccagatcatgttcgacacgttcgacacgccggccatgtacgtggccatccacgccgtgctgaccctgtacatatccggtcgtaccacctgtctcacgttagactccggctatggtgacacgcacaccgtgcccatctacgaggggtacaccctgacccacaccatactgacgatggacttgggcggacgaga

SEQ ID NO: 49771 - DNA, 606 bp, Heterodera glycines
  SCN-specific regions: Sequence locations=1-277,300-606
gctcgaaaagaagaagagcggtggattcaacacgaagaagtttttgttggacctcacatccagcggaactgctgctgcagtctcaaaaaccgctgttgcacccatccagcgtgtcaaggtgttgttgcaggagaaagatgcttccattcacatcaccgcggacaagcgctacaaaggcgtcatctacgtcctcgtccgtgttcctatggagcagggctttctgtcgatgtggcgtggaaacctggacaacgtcatccgttagtttccgactcaggcgctgaacttcgccttcaaggacacttataaacgaggcttcacgctaggagtggacgaagagaaacagctcttgaagatcttcgccatgaatttggcttcgggcggtgccgctggcgccacgtcgatgggctttgagtaccctttggactctgcgcgaacgcgtttggcagcagatgctggaaaggccgatgcccgagagttcaaaggatcggcggactgcatcatgaagatcctcaagtcggacggtcccatcggtctctaccgcggattcttcgtcgacggccagggcatcatcatttaccgcgccgcgtacttctgctgcttcgacac

SEQ ID NO: 49772 - DNA, 619 bp, Heterodera glycines
  SCN-specific regions: Sequence locations=1-7,29-619
ttttcccagcctttgttttctccccaatggcgtggctcagtcgtgcgactttttgtcctcaccaattacaccaaaaagctgtcaaaacgccgttacagaaagcggtcacttcggcggcagagcgtgcgcttgacattgtcggcaatgcgtcgcgagtgcggcttcaggacttgagggacaacccgggcgcgaggacggtgggcaggcaagtgcgcgcgaaggtcactaccaagcgggtcacaccattggcgagttgcaacacgcgtcgaagccgccgctcggctgggtttggggcgactattacaaaccttggcagcggtcctttgacggcgacagacgcttcaacggggacataaatctccgccgtgaatacattcccatttctttggtcgagcttcagcgcctcatcgacttgggctggttggacacgagtcgactcgtcgacatcgccgcaatttgtgccaccaaattgttggaacagaaattcaagccggaattgcgtcagtttggcattcatctgactgatgaacgcgaagaaatattctcaactccgatcaatttggaggtccaatgggccctcggcactgcaattgctgccatcgaacgcgctggtggtcga

SEQ ID NO: 49773 - DNA, 514 bp, Heterodera glycines
  SCN-specific regions: Sequence locations=1-80,102-514
ggactccactgatcagtacggcagtgtttttgtcgagagtgggtgccgtcgcagcccacttctgcgtcttttttctccacaaaataaagcccttctgtggcgccagctttggatttggctggccgaatccgaacgcgaattgggccttgaggcgcaaatcagtgccgaaatggtggccgagctgaaagcccaaaagcacaacatcaactgggacaaaatccgagcaaatgaacggacgatgaagcatgaagtcgtggcacatatccacgcctacagcgaagtgtgcccgttggccaaagggatcatccatttgggtgccacttcgagtttcgtgcaggacaacacttgtttgatactccaacgggaggcgatcgaccatttgcttgaacgtttggccatctgattgggccgagctgctgattttgcgcaaaatacgccgattttcgatccatgggcgcaccatttccaagcgggcgtcgtgacaaccgtcggcaaagggccacaactttggccg

SEQ ID NO: 49774 - DNA, 251 bp, Heterodera glycines
  SCN-specific regions: Sequence locations=1-188,210-251
ccgcctacttcatcagatattataatcggagaaactgcccgtaactaatttccattttggacttacttgaggcctggataaacgaattccctcctgaagatatgggattgcaacgctttggcaacaaatctttcaagaaatggttcgagcgcctcatgtcggatggacaaagtttgctgagcgatttgtttcccgaaaatttaaagtccgctgttcttgaaatctggccttatttgatggattcgtttgga

SEQ ID NO: 49775 - DNA, 313 bp, Heterodera glycines
  SCN-specific regions: Sequence locations=1-313
ttctgcggcgcttctgcagaactatccgcgctgtttggaaagagagcgcctccagcggaatccctccgggtgggaatttgggaagaatcgagcgcaacataacttcatttacagggtcattttttgtcctactataaatgctattgctgcccgagtcacccattactaagatggaattgagatcgaagcgtcagctcctgtcaagactgtccacagtcaactatacagtctgactgatgtctccgccgcttataacattggtcggatgatggctcatcgatgccatatggccgcgattgagcattgcatgtct

SEQ ID NO: 49776 - DNA, 262 bp, Heterodera glycines
  misc_feature (180)..(180): n is a, c, g, or t
  SCN-specific regions: Sequence locations=1-34,56-262
gtcttctgtcgtctccggccagcgcatcatcatttaccgcgccgcttacttcggctgctgcgacccctccaacatgctcttctctcgggagggcaagcagatgaacttcttcatcaactgggccattgcgcccgtcttcaccgtggcgtccatagttatacactacccgcgggacaccgntcctaaacgtatgatgatttaattgggccgtgaggacttgatggcccaaaactttggggactgtgccgtcaaaatcttcaaa

SEQ ID NO: 49777 - DNA, 487 bp, Heterodera glycines
  SCN-specific regions: Sequence locations=1-205,229-487
gggacgtcgtcccgctctttactatcgctgccttaggaacaagccttatcccaagtctcgcttttgttgcggcgcccctgaccctaagagtcgcatttttgacttgagtgggaagcgcggatctgttgacgagtttccttgcggtgtgctcctgatatccaatgtatgggaacatttctcttctgaggctctcgatgctgctcgaatttgtgcgaacaaatacatggtgaacaattgcggtatggacgtcttacacatgagcctccgaatccagccgttccgtgtgattcccatcaacaaaatgatgacctgttctggtgctgaccgtcttcacacgggatggcgctgatcctgtgggaaacccctcgggttgttggcacgtgtctgcatcggtgatatcctgacgacggatcgtgtccgtgactggcatcgcgccctcgctctttagacattccgtcaagcaaagttaatgttccctcgccatcta

SEQ ID NO: 49778 - DNA, 856 bp, Heterodera glycines
  SCN-specific regions: Sequence locations=1-6,28-614,636-856
gttcaataaagaattttagaaaatggatttgttagaaatcattgcccttaaaagaaaacagattgaggatattgcaatcgaacatgggagtggtgcgaaaatgatcagacattctgatctgtttaagaaagagaaggacgcttatttggagcgacaaaaacagctgggaaaggaacagcacctttctgtcaagggtttaaacaccgaggaacttttggacgcaaagttttcattgaccggctcggattcgatgccgcgtcccgaagttgtgcgtcgattgagggcccgagggcagcccattcggctttttggtgaatccgatgcgatggctttaaagcgattgaggcgtttggaaattgaaaagacggaacaaaatgaggggtggaagaacgactttcaagcggcactcagtcaggtggagaatgaggaactgatggagcaagtgatcagggggaagcgtggaaaagacgaaatgggcagacacgacgtgcaaattgaacagagtgaggatgacgccagctgggaccaaattgtgatgatggcacctttgcttggcagcggaaatgaccaggccgactgcgacctcatccgggcttttctttcctacattttgaaacgctggggcaaagagctgaacgcacgggaagagagcataaagcgaagtgcaacaggcaaaatgcaagcggggatgcacaaacaaacggtggaacatctctccccgctgatgaaatccctggaaaagtacacagtgaacaacgacatccgactgtacttgaccaacattaccaaactttgtgttgtcgaacgcaaatacatcgtcgcaagcactgcttacatggaaatgtcaattggcaat

SEQ ID NO: 49779 - DNA, 852 bp, Heterodera glycines
  SCN-specific regions: Sequence locations=1-85,110-852
agcccatgaattattttttattaaatgccgactttaaatctttcatctttcgccccaagacgacttttctcgacgactgcagcgaatttttgttgtcacagcaccattggtttggtggcatcaccaatgccaacagcgactggattcgccgcctatgcccgtttttccaccagcgatgggccgccgtccggcagcagtgcccctcacaacaatcagttggcatcgccaaagccaagtgcggacaaaatggccgagatgggcaatgcggacgaagagttcgacgaaaatgggcgtgagacgcgggaaaggatagggacaattccgaacatcatttgcatgctaagaatggcttccactccgttgctcggctatttggtggtccacgagcagtatttgccgggttgcattctctttgtgctcatcgctttcaccgacattttggatgggtccgtggcacggcacttcccttcccagcggtcgctgctcggcactttcctcgacccaattgcggacaaatttctcatcagcactttgttcatcactctcacttatatgcaactaatcccagtccctgtgactgccatcgttttcggcagggatttgctgttggtgctctgcagcattgtgctccgtttcaaaatggtcgatgctccgctgactgtgcggcgcttttttgaccccaccgtttcgcccatgcgaattcagcccacctcgctgagcaaatacaacacatttctccaactttcgcttgtttctctgagtttggcagcaccggtgttcaactttcccgggcattacgcgctacaaggccttcaattcctaactgttctgactaccgttttctcgggccta

SEQ ID NO: 49780 - DNA, 812 bp, Heterodera glycines
  SCN-specific regions: Sequence locations=1-281,304-396,418-812
gtccccttaagattattttctcaacaaacttccgcttaatcttcacactttcacgattttcttgtttaaaaaagttgcaacgatggtgaaaccaaaggttggcatcaacggttttggacgtattggacgcttggcattgcgtgcagcgattgaaaaggacactgtccaagtggtggcggtcaacgacccgttcatcgaactcgactacatggtgtatatgttcaactacgactccacccatggccgtttcaagggcaaaatttccacaaacgccggcaatttggtggtggagaaggaggggaagagcgcgcacaccatcaaagtgttcaacctcaaagacccggccgaaatcaaatggggcgaagcgggcgcggaatatgtgatcgaatccccggagtgttaccaccattgagaagggctctgctcatctttaagcggtgcaagaaggtggtcatctccgctccgtctgcggatgcccccatgtacgtgaagggcttcaacaggaacagtacgacccggcttagggacgagggaacaaccatgcctcgtggcccaccacctgcttagcttccgttggcaaagtgatcaacgacaagtttggcttcatccaaaggctgattaccactgtggttgcggtgaccgcccatccaaaaacgggggacggggccaccggcaaacattggccaaaccgaacctgtgcgggccaaaaattctttccgcccacaaccgggccgccaaaggggtgggccaatctttcccggaatttaacgaaaactgaccggatggggttccttggcccattcccaacggtc

SEQ ID NO: 49781 - DNA, 665 bp, Heterodera glycines
  SCN-specific regions: Sequence locations=1-198,222-222,244-313,335-665
accttacattagtccattccatcatgtccaatccgctctcatcttccttcctttgccgcaaatgttttcttcgacccgttcattttcattcacaacaaaagcatggcatttcttcacttttgaaagggaatgccgacaattttgtcgtcgttatgtccaacagttatttggccgaaggatttacggaaacgtttaaatttttgtcttccgtctctctgctcggtccgtcctcctccgttcttctgctcgccgtcggtctccgattggccaccgttccggtgagaattctcaccgaaaaactgacgtctcaacgtctgatgatggtccacttggtgcgcaagcaggtgtacgagaaaattggctcccattatggcattgcgacaacatttgacgcagtgaacggcaaatggacactgaacacgcgtgactcgctcattcggaagagtgcagacgaactgtcagaggaaaatgtcaaacggcaagtcaatgaccagaagttgaccatgtctcggctggtgatgcttcgctactgtttggtccccatttggatcccatgcaatttcggcattctccgatacgtcgaaggtctttttggacaacaaattccgggcttttttgggctcgactcgtttactctcccggaccctttcatggtcttccgcttt

SEQ ID NO: 49782 - DNA, 591 bp, Heterodera glycines
  SCN-specific regions: Sequence locations=1-591
atgctttcaaaaatcacggtggttttggcatttctctgcctgctgttggcattattggtgggcatcgatgctcagcaaagtcaatgggagcagaagcagaaccgtgcagcaccgcgagggttggcaagtgtgacattgcgccggatggacaccgtccgctcgcggctggcagccgccggttcactcgtccaattccgtaagcatttgcgccaggcgctgcgccaacgcttggaccgtctgtacagtgacaaaatggcacgcgcagacgtggcatttgacaccgatgccgcggcaagggaaggcattgacgaagtgttgcgcaattacatggatgctcaatattatggtgacatttctattggctctccaccgcaaaacttcaccgtgattttcgacaccggttcctcaaatctttgggtgccgtccaaaaaatgctcatttttcgacctcgcatgccgctaccatagtaaatatgaccacaaaaaatcgtccacctatcagccggacggacgcgaagtggcaattgaatacggtaccggatcaatgaaaggcttcgtctccaaggacacggtttgcattatggacggtatg

SEQ ID NO: 49783 - DNA, 310 bp, Heterodera glycines
  SCN-specific regions: Sequence locations=1-12,36-212,235-310
tcttgacattgggccgttgggcggagtgtttctcttggccatggtgctaagggactgtctgttctagaatctcaaccagcaaaacttctaatacgcgggggaggcgaagtatttcggcacgattactcttgacgaggcgactcgcaaacgctgcgagcacttaccatggttcgtcatgttctcctccatcacttacggacgcagaaatgccggacagaccatctactggctggtcgcactctacaatggagtctatcatcggacagcgacgtgcggatggtttccctgctatcgcatccgatggggcgca

SEQ ID NO: 49784 - DNA, 310 bp, Heterodera glycines
  SCN-specific regions: Sequence locations=1-234,256-310
gggatagccgaacggaatgagaaccgcgctaaaactgacaaaacatcgccaggagcaccgctggaatgacgagcgttacgagaaaaccaatcgtggaactcggtggaaagccgatccttgcggcggagcctgtatggccaaaggaattgttctcgacaacattggcgacgaagcgaaacagccaggttctgcgattcaaagatgtgtccgtgtgcaacttatcaaagataggagaaagatcactgcttttgttccaaacgacagttgcttgtattgtatccaggacaacgacgaagtgcttgtgtctggg

SEQ ID NO: 49785 - DNA, 634 bp, Heterodera glycines
  SCN-specific regions: Sequence locations=1-116,138-634
gtttctgaatggtactaccacactgtactttgtgtacaagccgaagacaccgcaagacaaaggcggcgttattgtggcggtcgattctcgtgcaacgggcggaacttacatcagctccaaaacggtagaaaaaatcattccgatcaacgaccaattggtcgcgacgatggcaggcggagcatcggactgtcattattggacgcgggtggagagcgaatattgtaatcttttcgaacttcgcgagggtactcaaatttcggtggctgcagccaataaatattttgccaatgttatgtaccactatcgtggccaagagctgggcgttcactcgatggtttgcggggtagacaagttcggtccttccatatacgtggtctaagctgaagggactcacttgaatattgacaccatttgctcacgtctgtcgggcatgttacactccatgcacattttggacaccaaatacaatgaggcgatgactgacgcggaagccttggagttaggcagagaaggcattgagtacacgacattccgcgacgcagcttccggtggtcattgcaatttgtgacatatcacttccgaaggacagaccatatacgcgccattcgatgtcggtgataagtattatgaattc

SEQ ID NO: 49786 - DNA, 394 bp, Heterodera glycines
  SCN-specific regions: Sequence locations=1-394
tgccaacgaatctttccagaaatggtccaagcgcctcatggcggatggacaaaggttgctgagcgatgagcttcccgaaaatttacagtgcgcgctgatcttgaaatctggccttatttgatgcattcccttggaaatgtccactctgactgagtaaggatcaagtcgcgaaacttcttttctcattttcctcttctgcctggaccaaattggtgtgctccgttcccccgacaatgaccgagcttccatcttatggattttccatccatatctgaaattagctagacgacttcagagcgagtatcgaatggaaccctgtggatccaaaggagaccctgccattgatgactttcacctttgggctcttctgactgggagagctcggctaattgac

SEQ ID NO: 49787 - DNA, 178 bp, Heterodera glycines
  SCN-specific regions: Sequence locations=1-178
aagcaaaggcaactcgttggatcttctcatcggacatcacaacattgacattgtctctcgatgccatggacttaaccatgcttgccataccgtactggcaaatggccgcgagtatcatttccacctgatgccttcccgattggcctcacaaaaggtgttgaacattgtcggaaacgga

SEQ ID NO: 49788 - DNA, 490 bp, Heterodera glycines
  SCN-specific regions: Sequence locations=1-490
ggaagccttcgttttagaagcatgtcgaactccacttggctctttccgatctcaattgggttcctggacatggacggcattggtctccgaatgcattacaaaattgttgaagagaagtaacgggccggccaaggaaactcatcacgtatatctaagtcaagtttgtcaggctagtggtgccaacgcaccgacaagaccagccgcacttggttccgctttggatgtggcagcggcggtatgtaccgtctccagcgtgtgcaggactggcctaatatccagcatgctggccgccgccataattgtcctgaatcatcagtaattggacatcgggggagagatggaatctatgagtcatgtgaatttctatttggagagaggcaaattaccttatggaggagccaaactaattgatggcattgcgagagatagactgacggatgcttactattcggagcatatgagcgattgtgcggagaggacggcaaaagaa

SEQ ID NO: 49789 - DNA, 628 bp, Heterodera glycines
  SCN-specific regions: Sequence locations=1-20,53-128,151-628
caaatatcgcatggcagggtccccgcccccgatggctcggactgtgacgacaacgaagctgagccgcgctcaaaaagggcatatctaactgaagaaaaacgcggatgcattcaatatgcatattcccaagaaattctgaagaaaatcactgagaaccagaaacgcctggctgatggccagaaataagcaactttttctcatgcgcaaagcgaaattcactgccggcgattcctctcacatggtggaactaaatgaggcttcccccgctcagaacacactcagaatgaatcgccaaaatgtcgttggagattgtctgcccgtgatccaaccccaccgagaagacggctctgacggagacacctactacctgacgggactcgaccaaggcggggctaactctgagaagctcaagcgctactacaacgacgctggggaactgctggtggagatgcccacgctggccactggctttatcacgctgcacgaggccatcaaaatgaccaatcggcccgagaacactcttgaactcataatcttccctaagactgataacacgcccactcaccttgtcaccgagttcgactagacggaccgcgacgaattctttctcatgacgaacatccgagcc

SEQ ID NO: 49790 - DNA, 670 bp, Heterodera glycines
  SCN-specific regions: Sequence locations=1-584,606-670
catccaggtggagttgaccagactgcgcgagctcgacaacgactatccaatcttggacgtggacaccgaatacccccgagacatcgctacggcggcgggtcggttccgcaggaaagaggatgtcaattatctacctgtcaagctccaagtggactgcttgaagctcatccaggtcggcttcactctgatgattgagggggggcaactgcctccctcccgtgtcttttgacacttcattttacacttcgatccgagcatcgattcgttcgcgcacaattcgctggaactgctcccaactgaggcctttgacttcaactaacaccatactgagggcatcctattggaggactgtggcgagctgctgaccacttccgggctggtggctgatcggcgcatcacctgactgacctttcacagctgtttcgactacggccacctcatcagggccattatgctggtcaaactgcccgaggacgaccaagacttcttccgctaccatcgcaaattgatcccgaaccgtttccacttcgagattctgttgcgactgaccgggtcgcgcgacaccatgctcaatggccgacttcaggagctggccgaccaactgcacgtcccgcgcattgccacatgccaccaagtcggctcggactcgttgctcactgcgatgactttc

SEQ ID NO: 49791 - DNA, 403 bp, Heterodera glycines
  SCN-specific regions: Sequence locations=1-403
ttcccagcaagcgataactaagaagcgtaaagctgtgcaatacggaattttcagagccgaattatacaactttctcatgaaagagatggactaggaaaagaattcccgtgtctaagtgcctaatgcaccttcccggactgaactgatgctcatggggacccgcacccaatgtgtgctcggatagcgcgggcaatgcatccaccaactgtgagctcgcgtgcagaaatggcttgggtattcctctgaacaaattgagctctatgacgagaaagtgtccagccacgatctttgcgcggaggccaactgtgaccatttgcgaatcaacttagtcggggggctccacgagggcatgcgggctactgcgtgctgctcttcatcgtggaaagtaatgacagtgggtgct

SEQ ID NO: 49792 - DNA, 706 bp, Heterodera glycines
  SCN-specific regions: Sequence locations=1-634,656-706
caacattcgtggatcaaaggctgatgcggatgcggtgctgacgactcttgggcctcgggcaatggacataatgatcctgtcgggcgacagaaaagtgactattacccacgatggggcaactattctcaaccacatgtcggttgtgcatcccaccgcaaaaatgttggtcaagctgtccatggcacaagacattgtggctggcgatggtaccaccactgttgtggtgttggccgggtctttattggacgctgcataaaaacttcttgccaaaggaattcatcctaccaccatttccgactcatttcaacgggcggccacattttctgaaacagttctcgaggaaatggccacacccattgacattaacgatgacgacgagttggtgaagctcaccatgacgagtttgaactccaatgtcgattctcaatattcccatcttttgacaccaatggcggtgccggcagtgaagaaactgatgagttcaccggaggactcaagtgaccatctgaagtagattaaaggcgataatcagttgggccacacggtggacgagtcacagctcattgatggggcgctgatcgatcacaaatcgatgggccactgaggtcccgcgcaggtggagaacgcgaagattgggctcatccaattcctattctcaccatgaaagcctaacatggaaaatcaagtggtcatctctgactatgct

SEQ ID NO: 49793 - DNA, 826 bp, Heterodera glycines
  SCN-specific regions: Sequence locations=1-23,45-274,308-389,413 -482,505-741,763-826
ggaaaatccttaaaatggcgcaagcagttgctgctgttgctcccgcacccatgaaaacgcagcctcggctcaggcaacccaaccgcaggttatggcaccatcctatccgttggcttctctctatgtcggcgatcttcatccggatgtcactgaggcaatgctctttgagcggttcagcaatgctggtcctgtgctctccattcgtgtttgtcgtgacgcgatcactcgtcgttcgcttggctatgcctatgtgaattttcagcagccggcggatgccgaacgtgctttggacaccatgaactttgatatgatcctgaacaaaccgattcgcatcatgtggtcgcaacgtgacccaagcattcgtcgctcgggtgctgggaacattttcatcaaaaacttgggcaaggaaatcgacacaaaggccatctacgacaccttttccatgtttggaagcattctgagttgcaagatttccactgacattgatggaggaagcaaaggatatgggttcatccattttgagactgaggaagcagcgaacagtgcaattgcaaaagtgaacgggatgcttttggatgggaagaaagtgtttgttggaaaatttttgccacgttccgctcgtgacaagcaaattggtgatccgtccagtcgtttcaccaatggttatgtgaagaattttggtgatgcaatgaattcggagaagctgagcgaagtgttttcacagtttggcgaaatcatcagtgcaaaggtgatggagggatgacagcggcagtccaagggggtcggcttcgtcgcctacaaggaccctgaaagtgctgcgagggcg

SEQ ID NO: 49794 - DNA, 546 bp, Heterodera glycines
  SCN-specific regions: Sequence locations=1-6,28-403,425-546
tacctctaaacttaaacccccttttgccaaaacgcaccggtctcgcttctctttgaactgtgggtcaacggtgttgtaacgcacatgctcgtgcagtttgtctgcaggaatgcgttcgtttgtcagcggcgaaattatgtacttctccgtggaggcagccgcagttttggacaccggaccaccacgcgctgaaaacaaataaaacaaagaattaaactcatcggaaatcaaaaatattaacagttaaagttattgagttgacaagtcctcgtaaaattaccagaagtcaagcattaaatattgtaaaatacccacattttttagggtcgtagtcgcggatgattactctgccggcggtcggcgccgcgggtgccggttgcgtcagcgttgagccggtgtgttgcttctccgccccgatgttcaagcgttggtgcagttcgccagccgcatcctccgccgcttcgattgcggctcgttctttggccgtttcctcgtcacccgactcggcgccgccctcctcgtccgactcgaccttagcgtgggggg

SEQ ID NO: 49795 - DNA, 397 bp, Heterodera glycines
  SCN-specific regions: Sequence locations=1-397
ggatgaaagtgtttcggcatcggctgctgcaattcaggagagagaacgccgtgaacgccttctgacgatatcggacgcaatgaagttttacctggagaggaagcatgaccacatggccattctggacaaggagaatttgctgtacacgcagggaaagcgccacttggccaacattatgggcttcaatcccgactcgatcattggggaccaaatatcgcattccatccgttatttgttccccagcggcctattccacaatgaagcgctacccgtgatgaaacccccggaggaagtgttcccgaaaatcgtgaagattgacgtggactcctccggctctccgaatcattcgctgtttttcactgccgaacccaaattctattctttgctttcggacata

SEQ ID NO: 49796 - DNA, 265 bp, Heterodera glycines
  misc_feature (51)..(51): n is a, c, g, or t
  SCN-specific regions: Sequence locations=1-170,194-232,254-265
tgggagagccagcatcactgacattgaattcgggccgtattatttgggccnttaattgggcgcttgcacttcctctggtcgactgatcatttacgaagctgaggacattatggcattggacaattggaacgttctccacgactatgaagtgagaaagaatcggcttagttccctttggtggaggaaaaatggatttgacgctcctcatattgttgtctcgtttgatgatgtcgatgctgctccagcagagaaagtgttcgttttt

SEQ ID NO: 49797 - DNA, 579 bp, Heterodera glycines
  SCN-specific regions: Sequence locations=1-75,117-186,208-229,323 -327,354-367,391-415,437-504,527-579
tagaagcaccaatcccaaccagacttaatgtgcgacgaagaagttgctgctctcgtggtggacaatgggtccggaatgtgcaaggccggtttcgcgggcgatgacgcgccccgcgcggtgtttccgtccattgtgggccgcccccgtcatcagggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgcgtgtcgccctctatgagcacccggtgctgctcacagaggccccgcttgacccgaaggccacagagaaaagatgaccccaatcttgttcgagacgttccacccgcccggccatgtacgtgggccttcaggcccggctggtcctggaccgcctcgggccgtacaaccggtcttcgtgttgaactccggggatgggggcaccccaacccgggcccctcaacaaggggtatagccttgccccaagcattctttcgtttggatttggcggg

SEQ ID NO: 49798 - DNA, 832 bp, Heterodera glycines
  SCN-specific regions: Sequence locations=1-832
gaaatcgtaaatgaaggcggtcttcctgggcttgatgatcagacggcttatcgaagcggagaagggcgtttgcgaggcggacgatcgcgatttttacggaaacaaacgcattgagttggctggatctttgctttctctgttattcgaggaccttttcaaaaggttcaactccgaattgaaacgaattgccgacagtcacctcaaccgaaatatggccgctccgctggacatcgtacgacacatgcgccaagatttgataacaaatggtcttgtcaatgctcttgccactgggaattggacaattaggcgttttaaaatggaacggcatggcgtcacgcaagttttgtcacggttgtcttacatcagtgtgttgggaatgatgacgaggatcaattcgacgttcgaaaagacacgcaaagtgtcagggccacgttccctgcagtcttcgcaatggggaatgatttgtcccgccgatacgcccgagggcgaatcttgcggtttggtcaagaatttatcgttgctcagtcacataaccacggacagcgacgaagcgcccattttgcaacttctctacaatttcggtgtccaagacgttcgtccgttgaaatttagcgtcgttcatgaaagacgttatcacatcgttttcctcaatggttccattggcggaattactgatgacgttgaaaaaatcattggcacggtgcgactgatgcgccgaagagggaatttggggtgcctttgtctcgggcggtttcaacaccgccacaaatgcgctgtatttggccaccgaggggggcgactctggccgccctatggcatcgttgaaaatggg

SEQ ID NO: 49799 - DNA, 547 bp, Heterodera glycines
  SCN-specific regions: Sequence locations=1-127,149-254,282-422,445-547
cgaagaagctgctgctctcggggcggacaatgggtccggaacgagcaaggccgcgttcccgggcgacgacgcgccccgcacggcgcttccgtccagtgcgggccgcccccgccatcacggactgatggccggcatgggacagaacgactcgtacacgggaaaccatgcgcctcccaagcggggtactccgaccctgaagaacccgattgagcaccgaagcgcctccaactgcgacgacgtggagaagagctgggaccacaccttctactacgagctgcgtgacgcccccgatgagcgcccggagctgctcacaaatgccccgctgaacccgaaggtctactgagaaactacgacccaagtcatggacgagacctacaacactccggacatggacgcggccatacaagccgtgctggccctgaacgcctccgggcgcaccaccggtctcgcgtaggactccggcgatggggtcggcctcagcgagcacatctgctagggttacgacctgccccacgccatccacggtatggacttggcgcgccgagac

SEQ ID NO: 49800 - DNA, 665 bp, Heterodera glycines
  SCN-specific regions: Sequence locations=1-332,354-665
cacttctctcttaattctcttcccttaatggtcctgctttttctccaattggcactgattttgctctgttcggtgtttgcttttattgtaatgatgcgcaaacatcgcaagtactggtccaaccgtggcattccgtccccaaccccgcagctgatcagtggcaatttcggctcgctgtacggcgattatccgagcatgttccagctgcgggattggaccagacagtacggcaagcagtacggtgtccagtacggttggcgcaacgcgttggtgatttcggacccggcattggtccacgagttgctggtcaccaaatttgaatatttccacgcaagaaatgttggcacttttgtttttgaaaattcttttttggtttctctgctttttgtcccttggattagcttacgccaatctttggcaatactgacacaaacaaatggatcagcatgttcttggccaggggaggccggtggaaaaggctccgaatgattgcgaacccggcattttcggtagcgaatctgaaaaagtgcatgtgtctcattgacgattcagttaaaaatgccatcaattttctggaaaaagcgcgcaacaaaggcgaatcctttaacattcacaggcatttcgtagaaatgagtttcgatgtgatcgcccgcgtggcgttgggg

SEQ ID NO: 49801 - DNA, 634 bp, Heterodera glycines
  SCN-specific regions: Sequence locations=1-65,88-187,260-387,437 -464,491-498,520-573,616-634
gtgctacgaacaagttgctgctctcgtggcggacactgggaccggaatgagcaaggccaggttcacgggcgatgacgcgccccgcgcggtgattccgtccattgtgagccgcccccgtcatcaaggagtcatggtcgacatgggacagaatgactcatgcgtgggagacaatgcacagtcccagcgtggtattctgacactgaaatacccgattgagcacggcatcatcaccaactgggacgacgtggagaagatctggtatctcaccttatacaacgaactgcgtgtcggcccccatgagcatccggagctgctcacagaagccacgctgaacccgatggccaaaatagaaacgatgacccaaatcgtgttcaagacgttcaacgcaccagccatgtacgtggccatccatgccgtgctgtctctgtacgcctccagccgtaccaccagactcgtgttggactcaggagatggtgtctcccacaccgtgaccatctaagagggatacgccctgcgccaaggcatcctccgatgggacttggacggccatgacctcactgaataactgatgacgattctcactgaacgaggttactccttcgtgaccacggccgaacgtgagatcgcacgtgaa

SEQ ID NO: 49802 - DNA, 888 bp, Heterodera glycines
  misc_feature (377)..(377): n is a, c, g, or t
  SCN-specific regions: Sequence locations=1-243,272-286,308-320,343 -472,494-552,695-701
attcttcttttagtaaaaatgtccgagaataagtccgaaggtggcgctgcatagaagagagcgttggattcaacacgaagaagtttttgttggacctcgcatccggcggaactgctgctgcagtctcaaaaaccgctgttgcacccatcgagcgtgtcaagctgttgttgcaggtgcaagatgcttccattcacatcaccgcggacaagcgctacaaaggcatcatcgacgtcctcgtccgtgttcccaaggagcagggctttctgtcgttgttgcgtggtaacctggccaacgtcatccgttactttccgactcaggcgctgaacttcgccttcaaggacacttatgattttttcttcacgcaaggagtggacaangagaagcagttcttgaagttcttcgccatgagattggcttccgggggtgccgctggcgccacttcgctgtggatggggtgacctttggactttgcggggacgggtgtgggaggggatggtgaaaaggccgatggccgtggggtcggaggttggtcgggcggcggcggaaggggctggggggggaggggcgcagtcggggcggggggggggtggggggggggggggcccggcgggggggtggagcgggggggcgggagtgtggggcgtggggggggggggagggggggtggtcgggcggagggggggaggggaggaggcgtcggcggcgcggtggggcgggtcggcggagcgccgggcgtggggtggggcgggggcgtttctgcgaggcgggggggcggggcggcgcgggcggcgcgtgcggactgcaacggcgggccgcggcccgggggggcgtgcggggggcggggcctgggaatggccccggggcggaagggcggccgggggggcgggg

SEQ ID NO: 49803 - DNA, 223 bp, Heterodera glycines
  SCN-specific regions: Sequence locations=1-188,210-223
gcttactacccacgggagtctcgaacactctgactgtctattaatggttgacaatgaagtcatctaccatatttgtcctcgaaatttggaggtggaacgctcttcttacaccactttgaagcgtttgatttcataagctgtctcttcgatgaccgcttaacttcgatgtgatggcgctttgaatgtccatctcactgaattccataactgtcttgtgccttat

SEQ ID NO: 49804 - DNA, 538 bp, Heterodera glycines
  misc_feature (2)..(3): n is a, c, g, or t
  misc_feature (34)..(34): n is a, c, g, or t
  misc_feature (42)..(43): n is a, c, g, or t
  misc_feature (45)..(45): n is a, c, g, or t
  misc_feature (58)..(58): n is a, c, g, or t
  misc_feature (61)..(61): n is a, c, g, or t
  misc_feature (69)..(69): n is a, c, g, or t
  misc_feature (75)..(75): n is a, c, g, or t
  misc_feature (98)..(98): n is a, c, g, or t
  misc_feature (102)..(102): n is a, c, g, or t
  misc_feature (119)..(119): n is a, c, g, or t
  misc_feature (132)..(132): n is a, c, g, or t
  misc_feature (135)..(135): n is a, c, g, or t
  misc_feature (141)..(141): n is a, c, g, or t
  misc_feature (146)..(146): n is a, c, g, or t
  misc_feature (168)..(168): n is a, c, g, or t
  misc_feature (186)..(186): n is a, c, g, or t
  misc_feature (197)..(197): n is a, c, g, or t
  misc_feature (210)..(210): n is a, c, g, or t
  misc_feature (227)..(228): n is a, c, g, or t
  SCN-specific regions: Sequence locations=1-234,257-257,397-420,471-538
anncgcgggagaagacgcgccccgcgcggagganccgaccanngngggccgcccccgncancagggcgncagggncggcaggggacagaaggacgcgnacgngggagacgaggcgcagnccaagcggggaanccngacgcngaagnacccgagggagcacggcaccgncaccaacggggacgacanggagaagagcnggcaccacacccnccactttttttttgcgnngccgcccccgaggagcacccgtgtgctggtcacagaggccccgctgaacccgaaggccaacagagaaaagatgacccaaatcatgttcgagacgttcaacacgccggccatgtacgtgggcatccaggccgtgctggtcctgtacgcctccggccgtaccaccggtctcgtgttggacttcggggatggtggcacccacaccgtgcccatctacgaggggtacggccctgccccacgccatccctcggttgggacttggccggggcgggacctcactggactacggatgaagaacctcgacgggagcggg

SEQ ID NO: 49805 - DNA, 424 bp, Heterodera glycines
  SCN-specific regions: Sequence locations=1-424
gactgacgatgacactctcaaatattgggtgtgcgactctcacgtcggaccccacaatatggactaccagatggatcattatgcgtggatccctctatcaaacgggattcacatcctcaacattccccaaacgagggagagactgttgctcgccatccgtgccatctcggccattgaaaatccctccgatgctgtggatggctctgctccacccaacaccccccgccctatgctcccgctcgcctgtcacatctgtgccactcccatcggtggacgcttttggcccggctcattgaccaaccgaagtctaatgaatttcttggaaccgcggatgctcgcgatgggccacgactctttgtaccacaaggagaaccgagaggtcccctacatcaaccatccgatacttacactggtcgacacggac

SEQ ID NO: 49806 - DNA, 565 bp, Heterodera glycines
  misc_feature (5)..(7): n is a, c, g, or t
  misc_feature (17)..(17): n is a, c, g, or t
  misc_feature (22)..(22): n is a, c, g, or t
  misc_feature (33)..(33): n is a, c, g, or t
  misc_feature (35)..(35): n is a, c, g, or t
  misc_feature (43)..(43): n is a, c, g, or t
  misc_feature (49)..(49): n is a, c, g, or t
  misc_feature (54)..(55): n is a, c, g, or t
  misc_feature (63)..(63): n is a, c, g, or t
  misc_feature (65)..(65): n is a, c, g, or t
  misc_feature (67)..(67): n is a, c, g, or t
  misc_feature (81)..(81): n is a, c, g, or t
  misc_feature (99)..(100): n is a, c, g, or t
  misc_feature (110)..(111): n is a, c, g, or t
  misc_feature (113)..(113): n is a, c, g, or t
  misc_feature (115)..(115): n is a, c, g, or t
  misc_feature (118)..(118): n is a, c, g, or t
  misc_feature (120)..(121): n is a, c, g, or t
  misc_feature (125)..(125): n is a, c, g, or t
  misc_feature (131)..(131): n is a, c, g, or t
  misc_feature (134)..(134): n is a, c, g, or t
  misc_feature (140)..(140): n is a, c, g, or t
  misc_feature (145)..(146): n is a, c, g, or t
  misc_feature (156)..(157): n is a, c, g, or t
  misc_feature (161)..(162): n is a, c, g, or t
  misc_feature (173)..(173): n is a, c, g, or t
  misc_feature (181)..(181): n is a, c, g, or t
  misc_feature (183)..(183): n is a, c, g, or t
  misc_feature (186)..(186): n is a, c, g, or t
  misc_feature (197)..(197): n is a, c, g, or t
  misc_feature (199)..(199): n is a, c, g, or t
  misc_feature (211)..(211): n is a, c, g, or t
  misc_feature (214)..(214): n is a, c, g, or t
  misc_feature (221)..(221): n is a, c, g, or t
  misc_feature (228)..(228): n is a, c, g, or t
  misc_feature (233)..(233): n is a, c, g, or t
  misc_feature (245)..(245): n is a, c, g, or t
  misc_feature (249)..(250): n is a, c, g, or t
  misc_feature (253)..(253): n is a, c, g, or t
  misc_feature (259)..(259): n is a, c, g, or t
  misc_feature (263)..(263): n is a, c, g, or t
  misc_feature (269)..(269): n is a, c, g, or t
  misc_feature (271)..(271): n is a, c, g, or t
  misc_feature (273)..(274): n is a, c, g, or t
  misc_feature (283)..(286): n is a, c, g, or t
  misc_feature (289)..(290): n is a, c, g, or t
  misc_feature (313)..(313): n is a, c, g, or t
  misc_feature (316)..(316): n is a, c, g, or t
  misc_feature (326)..(326): n is a, c, g, or t
  misc_feature (328)..(328): n is a, c, g, or t
  misc_feature (336)..(337): n is a, c, g, or t
  misc_feature (341)..(341): n is a, c, g, or t
  misc_feature (349)..(350): n is a, c, g, or t
  misc_feature (354)..(354): n is a, c, g, or t
  misc_feature (358)..(358): n is a, c, g, or t
  misc_feature (360)..(360): n is a, c, g, or t
  misc_feature (365)..(365): n is a, c, g, or t
  misc_feature (368)..(368): n is a, c, g, or t
  misc_feature (379)..(379): n is a, c, g, or t
  misc_feature (387)..(387): n is a, c, g, or t
  misc_feature (389)..(389): n is a, c, g, or t
  misc_feature (395)..(395): n is a, c, g, or t
  misc_feature (398)..(398): n is a, c, g, or t
  misc_feature (403)..(403): n is a, c, g, or t
  misc_feature (407)..(407): n is a, c, g, or t
  misc_feature (422)..(422): n is a, c, g, or t
  misc_feature (429)..(430): n is a, c, g, or t
  misc_feature (445)..(445): n is a, c, g, or t
  misc_feature (457)..(457): n is a, c, g, or t
  misc_feature (469)..(469): n is a, c, g, or t
  misc_feature (502)..(502): n is a, c, g, or t
  misc_feature (504)..(504): n is a, c, g, or t
  misc_feature (514)..(514): n is a, c, g, or t
  misc_feature (523)..(523): n is a, c, g, or t
  misc_feature (528)..(528): n is a, c, g, or t
  misc_feature (562)..(562): n is a, c, g, or t
  SCN-specific regions: Sequence locations=1-531,553-565
agttnnngagattaaantgttngggaagtggtntnttaatgangtggangtgtnngaaatttnantngtggattatgttgnggtgaaagaaaagggggnnaaatatttgnngnanagngnnggtngttaanagnagaagngtttnngtaagggganntgtnnggtggtggaanggttggtntngtnaatgatgatgnangggttgaataanggnaagaaantgatggnggtgngtattgtgaagnatgnnttngaaatnattnatttgntnannggagagaannnngtnnaagtgttagttaatggtgtgatnaanagtggacctngngaggattnnaagngtattggnngtgngggnanagttngtngaaaggaagtngatgtgtngnttttgngtngtgtnaatnagggaatttggttgntttgtannggtttccgggagggnggttttagaaanattaaaaagatnggggaatggtttggggatgagttgatgaatggngntaaggggttnaagaatttntaagnaattaaaaagaaagaagaattggaaggggtgggnaaa

SEQ ID NO: 49807 - DNA, 806 bp, Heterodera glycines
  SCN-specific regions: Sequence locations=1-99,121-157,180-806
ttgagctttacataggattaagaataaattgctaatcacagattattgcttatgattagttgctgttagatgaaaattgagcataacaaattcatactcaacaaacaaacaacaaattgtacaacaaaaaaatgtcaagcgatgatcaatcagacaaggagtgccctctttgcatggaggccttcgacattgatgacatcaacttttacccatgcaattgtcagtatcaaatttgcagattctgttggcacaggatcaggacaaatgaaaacgggttgtgcccggcttgccgccagtcgtaccccgaggacccggtcaattttcagccgttgtccagcgccgatgtgcggaagatcaaaagtgagaagaagcagaaggtgcagcagcagaagaacaaagtggtggagagcaggaagcacttggctgagtttcgggtgctccaaaagaatttggtgtacgcggtagggctcagccatcggatggcggacccggagctcttgaagaaacccgaattctttggcaagtttggcaaaatcatcaaaattgcggtcggcgctgccccggccatcaacagtgctcagcccgcggtgcacaccgcgtacattacttacacacggagcgaggacgcattgcgcgcaattcacgcggtcaccaacatgatggtggagggccgctttctgaaggcgtcgcttggcaccaccaaatactgctccaatttcttgaagggacaagcgtgccataagccggaatgcatgtatttgcatgagggggccgaggaccagatcagcttcaccaaggaggacatg

SEQ ID NO: 49808 - DNA, 127 bp, Heterodera glycines
  SCN-specific regions: Sequence locations=1-127
gagcaaccaagaaattgctgctctcaaggaggacaatgggtcccgaatgtgcaacgccggtttcacgggccatgacacgccccacgcggtgtatccgtccattgagggccgcccccaccatcagggc

SEQ ID NO: 49809 - DNA, 806 bp, Heterodera glycines
  SCN-specific regions: Sequence locations=1-190,212-250,273-376,409 -771,793-806
ctggacgttcagtggcggagctgaaacaacgcatcgacgagttaactccttgaggggagaacacgcaacgtgagctgcgaggcgcactcgccgagcttcagaagatgaagcacctgtacgagaaggccgtcgagcagaaggaggcacttgcgcgtgagaacaaaaaactgcaggacgacttgcacgaggccaaggaagcgcttgcggacgccaaccgcaagctgcacgagctggacctggagaatgcacgcctggcgggtgagatccgtgagctgcaaaccgcgctgaaagaggcggatgcggcacgacgcgacgcggagaaccgcgcgcaccgtgcactggccgagctgcaagcgctccgcattgagatggaacgccgcctgcaggagaaggaggaggagattgagaacctgcgcaagaacatgcaattcgagattgaccggctgactgcagcgcttgcggacgcggaggcccgaatgaaagcggaaatttcacgcctgaaaaagaaataccaggccgaaattgcggagctggaaatgaccgtcgacaatttgaaccgtgccaacatcgaggcacagaagaccatcaagaagcagagcgagcagctcaaggtgttgcaggccagcctggaggacacgcagcgccagttgcagcaaacgctggaccagtacgcgcttgcccaacgcaaagtgtccgcactggcggcagagctggaggagtgcaagactgcgctggacaatgcggtgcgcgcacgcaagcaggccgagttggacctggaagaggcgcacggacgcatcaacgacctg

SEQ ID NO: 49810 - DNA, 478 bp, Heterodera glycines
  misc_feature (111)..(111): n is a, c, g, or t
  SCN-specific regions: Sequence locations=1-31,73-121,150-289,311 -314,337-356,378-478
tgctgctctcgtgggtggacatgggtccggaatgtgcaaggccggtttcgcgggcgatgacgcgccccgcgcgggtgtttcggtcatttgtggccgcccccgtcatcaggncgtcatggtcgggatgggacagaaggactcctacgtggaaaagaagggcaatccaagcgtggtattcttgaccttaatataccgaatggagaacggatctgtcaccaattgggacaacttgaaaaaaattttggaccccccccttttaaaacaaatttggtgtcgccccccaaggaacacccgggggttttttcccaaagcgccccctttaccccgaagggcccacaaaaaaaaaattacccccattctgttttgaaaaattttcacccccccccctctttaattggcgccttcagagcggggggtttccgtgtaacctcccgggcggacaccccggttccctgtgaacacccccgaggatggtgtc

SEQ ID NO: 49811 - DNA, 744 bp, Heterodera glycines
  SCN-specific regions: Sequence locations=1-40,67-200,269-269,295 -310,337-345,371-388,442-477,499-544,580-707,733-744
gtgcgacgaagaagtggctgctctcgaggtggacgatgggtccggaatgtgcaaggccggattcgcgggcgatgacgccccccgcgcggagtttccgcccattgtgggccgcccccgtcatcacggcgccctggtcggcatgggacagaacgactcgtacgtgagagactaggcccagtccaagcgtggtattctgacgctgaagtacccgattgagcacggcatcatcgcccactgggacgacatggagaagatctggctccacaccatctacaacgagctgcgtgtcgcccccgaggagcacccggcgctgctcacagaggccccgctgaacccgaacgccatcagagaaaagatgacccaaatcatgatcaagacgttcatcacgccgaccatgtacgtggccatccaggacgtgctgtccctgtacgcctccggccggaccaccggtctcgtgatggactccggcgatggtgacacccacaacgtggccatctacaaggggtacgtcctgcaccgcgacatcctgcgtttggacttggtcggccgggacctcactgactacctgatgaatatcctcactgagcgtggccactccttcctgaccacggccgaccgtgacatcgtccgtgacatcaacgacaaggtgtgctacgagacactctacttcgagcaagaaatggtcaatgccgactcctcctccgcggtggagaagagctacgaactgaccgactgccaagtgat

SEQ ID NO: 49812 - DNA, 765 bp, Heterodera glycines
  SCN-specific regions: Sequence locations=1-236,258-474,497-631,658-765
aaataccgtcataggcgacagaacaattattcctctctacttttggctcttggagctgcgtcaatgtcttctatatctacattacgtcgccaagtgaagaatgtggcctgcaattacactgatgcacaagtaaaagttagagaggcgaccagcaacgacccatggggaccaaccacagtgctaatgtctgaaatcgcagatttaactcacaacccagtttcattcaccgaaattatgtctatggtttggaaaaggctaaatgaccacggaaagaattggcgtcatgtgtacaaaagtttggtgctccttgactatttgataaagtgcggaagcgagaaagtgtcagctcaatgccgcgagaatctcttttcaattgagacactcaaagatttccaacacatcgaggacaaccgtgaccaaggattgaatgtgcgtgcaaaagccaaacagatggtcgctttgttgcaggacgacgaaaaattgaagaatgagcgagcccgttttttgttgactcgaaagcgcttcattcaaaacggatcttctgggatttcatcggacggttcgagacgatctgttggaaggagaaacatcgaaacaggcgcaacggatcctgaatttgaagaagcgcggccgtcttcccttggagaggaggaaatgcaactgcaaattgcattagcactttcaaaggaagaatgtgaaaaggaacgtgaactccgtcgaggtgatgacatccgcttgcaaatcgcaattgaagagagcaagcgt

SEQ ID NO: 49813 - DNA, 784 bp, Heterodera glycines
  SCN-specific regions: Sequence locations=1-310,333-475,497-784
gtgtttccgttcaatcaaactatttttaaaacccaaataggggttcaatcttacaattttggaatttatgaaagtgtcgtcgaaaaaatgctaaaattggcacgattttgtggatcagcggtcgcaaatgtagggacaattcttaggaggacgaagaaaaaaaaaatcaaaatccccgaatttccggaagaatgatgccgaatattttaaatggttgataaaaaaaatgtttttcgaccgtttacaaagctgaaaattttaacgcggaatgaattcctcttctcccgttggttatattccgctgctctaccgagacaggccagaatggcgagacgtgaccccaatttacaacagtgctgaggagaatgccgttgtccgaattgccaccagcgaggaatttgacgatgcctttgcgtatttgcgtgccgtaatgaatgccaatgagctcagtgagcggacactcgaactcacacagacatgcattgcacaaaaccccgcaaattattcagtttggttatatcgccgtgccattctgcgcgctttgaacaaggatgtgagcgaagaactgcgctactgtgaggagatcatcattgaaaatccgaagaactaccaagtttggcacaatcgtaaaacattggtggacgagtcgggcatttacgctgctgaactgccattcattgcccagcaattgcatgacgagccgaagaattaccacgcatggcaacacagacaatgggtagtccagcggttcgacctgttcaacgagcaggagatggattttgca

SEQ ID NO: 49814 - DNA, 223 bp, Heterodera glycines
  SCN-specific regions: Sequence locations=1-223
agaagaagagcgctggattcacacgaagaagtttttgttggacctcgcatccggcggaactgctgctgcagtctcaaaaaccgctgttgcacccatcgagcgtgtcaagctgttgttgcaggtgcaagatgcttccaatcacatcaccgcggacaagcgctacaaaagcatcatcgacgtcctccgtcgtggttcccaagagcagggctttctggcgttgtgg

SEQ ID NO: 49815 - DNA, 739 bp, Heterodera glycines
  SCN-specific regions: Sequence locations=1-739
gttatccatgcagttgtgactgactgttttttgttaacaaaagtgcactttactacacactttagccacatttatttcttgttatgatggccatggaagctcagcaacaattagcaattaatggtgccattttgggaatgccgaaaaatgaacctcaaacggtgcttcgatgagtaagcctgacttggattatttgtcccaactgctcaaggacaagaagcagctcagtgcttttcccaacatttttgcgcacgtcgaacgccttgtggacgaagaaatcaacagagtccgcgtgtccattttccagtgcgagttcagccatgagccgttgcaattgcccgagcccattggcgaagtgaccgttcgccaggagaaagtgttcgtgcccgtcaagcagtacccggagtataatttcgtcggtcgcattttgggcccgcggggaatgaccgccaaacaattggagacggagacgggctgcagaataatggtgcgcgggaagggctcaatgcgggacaaaaagaaggaggaaatgaaccggggaaagcccaattgggagcatctgagcgaggaattgcacgtgatcatccagtgtgaggacgcgccaaaccgtgccgaagtgaaaatggcacgtgccgtggaggaagtcaataaattgttggtgccagctcccgagggcgaagacgacttgaagaagaagcagctgatggagttggccatcataaacggcacttttcgcagc

SEQ ID NO: 49816 - DNA, 634 bp, Heterodera glycines
  misc_feature (9)..(10): n is a, c, g, or t
  misc_feature (36)..(36): n is a, c, g, or t
  SCN-specific regions: Sequence locations=1-634
gcggctccnnggagccgagcagcaacaacgagaacntcgtcagcggcccgcggaaagcaaggcccaacggcgcaaaacagccggagaggaagcgcaccaccaaacgccaacgcccgcgagggggcgccccccacgagagaagagccacaaacggccaaaaggagaatttttttttggcatcgccgtccttaggccttctcgagagaatcatcaaaggagtgccggtgggagagatgaggtacagcgtcgagtctccccgacgcgagctgttcagcgacacgatggactgcagatgctccaaaaagtacacttccgttgatgaacccgtacatgcactcggcctcagcgtcagcaccatttctccgcttgcagggatttcccttggcattacaattgtgcccgcctcacaatgaaagggcaggcggtgccgatttatacacctttgccttcagaacaatttctgcgggcgtcgaggcacaacaaaagcgaacgaatgaatgtactcgaaaaggactccgttcagttggcacttgaagtgggagaaactcgactgccgcgagaccaaatgccgtttgatgtattccattccagaagcggcaattcccggacacgaccatcgaagagagaatagcga

SEQ ID NO: 49817 - DNA, 748 bp, Heterodera glycines
  SCN-specific regions: Sequence locations=1-114,136-748
gtgccacaaaaaatgctctgctctcgtgggggactgtgggcccagaatgcgcagcgcctgtctcgcgcgatatcacgccccccgcgcggtgtttccgtccattgtggcccgcccccctcatcggggcctcgtgctcggtatgacacaaagagactcacacgtgagacacgacgcgcactccaagcgtgatattctcactctgaaacaccatagtgagcaccgtctcctccccctgtgagaccatgtagaaaatatgtggcaccacattttctaccacgatctgcgtgtccccccagaagagcacccggcgctgctcacagacgcccctctgaacccaagggcccacagaaaagatatgacccatattgtgctcgacactctccacaccccggacgtgtacgtggacatacagggcgcgctgtctgtgtacctctccgggcataacaccggtctcgtgttacactccggatatggtgtcccccacagcgtgcctatatacgaggtatacgctgtgccacacgatattctccgtttacacttgcgcggccgagatctctcagactaccagaagaagattctctctgagcgtggacactccctcgagaccacccgcgagcgagatatcgcccgacatctcagagagaatgtgcgatacgtggcactacacttcgaacgagatatggacagtggcgtcttcttctcctctggagaaaagatctaaaatgtgcgccagcgacaagtgctcacc

SEQ ID NO: 49818 - DNA, 318 bp, Heterodera glycines
  SCN-specific regions: Sequence locations=1-81,113-135,158-176,198-318
gagttctttaaatttttcctccattgcttccatggacaatttcgcgagtgtttacaggcatatgctcgctggacagttggtcattcgtctcgtctcttttctcctcaatttcgctcttttacgcctcgtcgacccttcccttttgggctttttcaatgtgaaaatgactttgctttacaccaccatttgctttctttcccgtgagcccatccgccggctctgtctcagttccgattttccgctccacaaagtgccgtcctacgcttctctaagtccagtccgctgttcgccttggccaccctttccctctgctgtgtc

SEQ ID NO: 49819 - DNA, 526 bp, Heterodera glycines
  SCN-specific regions: Sequence locations=1-526
gaagatgaacgacgtttccgcgccagataacgagaacgtcgagcagaagtctaccgtgtgccgcgcgcacaagaatagcgagcgccaggctgagctgaaacgtcattactagcactacaaaagatgagcgcatccagcgttatcagggactgatctgtacgtacacaacctgcaccataccctcaatgatgagacacttcgaagcaattatgaatcctaccgacacctcccaagtgctaagggtatgcgcgatgaacatggccgctccgaacgattcggttctgtgtgcttcgaaagggcggataaagcaaccgacgctgttgtggaaatgaacaacaaaatcatcgaaaacgaaccgctttacctcgcgcttgctgcaacctgaagaagaccgcacagctcaactggcctcgcaggactgcagcgcttagccgcgatgcgcatgcacaaccctgctggcctcatgctgacaatgtatgcgcctgccagcgacggattcttcctgccacaggccatctacaaccaa

SEQ ID NO: 49820 - DNA, 720 bp, Heterodera glycines
  SCN-specific regions: Sequence locations=1-46,87-199,221-221,289 -290,320-342,380-380,417-417,444-479,529-534,597-622,648-648,694-720
gtgcgactaagaaattgctgctctcgtggaggacaatgggtccggaatgtgcaaggccggtttcgcgggcgatgacgcgccccgcggggggtgtccgaccattgtgggacgcccccgtgatcatggcgtcatggtcggcatgggacagaaggactcgtacgtgggatacaaggcgcagtccaagcgtgggattctgacgctgaagtacccaattgagcacagtatcgtcaccaactgggacgacatggagaagatctggcaccacaccttctaccacgagctgcgtgtctcccccgaggagcacccggtgctgctcacaaatggcccgctgaacccgaaggacaacagagaaaagatgacccaaatcatgttcgagacgatcaacacgccggccatgtacgtggccatccaagccgagctgtccctgtacgcctccggccgtaacaccggtctcgtgttggaatccggcgatggtgtcacgcacaccgtgcccatctacgagggttacgccctgccccacaccatcctacgttgggacttggccggccgtgacctcactgactacctgatgaagatcctcactgagcgagggtactccttcatgaccacggtcgagcgtgatatcgtccgcgacatcaaggagaagtagtgctacgtggcactcgacttcgagcaggagatggacactgccgcctgctcctcctcggaggagaatagcta

SEQ ID NO: 49821 - DNA, 388 bp, Heterodera glycines
  SCN-specific regions: Sequence locations=1-74,96-388
gaacctttctgctctcgtgggtggaacattgggtccgggaatgtggcacggccgaatttcgcggggcgatgacgcgcccccgcgcgggtgtttccgttcaattgtgggccgccccggtcatcaaggggtcatggtcggcatgggaaaaaagaaccctacgtggaaaacaaggccaatccaaccggggattttgaacctaaataacccaattgagacgggatcgtacacaatgggaaacaaattgaaaaaaattggacccaaccttttaaaaaagaagtgggtgccccccccaagaaaaccggggcttttcaaaaaggcccccgttaacccaaagggcaaaaaaaaaaaaataaccccaaatttggtcagaaaatttaaaaacccggga

SEQ ID NO: 49822 - DNA, 247 bp, Heterodera glycines
  SCN-specific regions: Sequence locations=1-137,160-207,230-247
gtgcgacgaataagatgctgctctcgtggcggacaatgggtccggaatgtgcaacgccgggttcacgggcaaagacgctccccgcgcggtgtttccgaccattgtgggccgcccccggcatcaaggcgtgatggtccgcctgggacagaaggactcctacttgggagactaggcgcactgcaaacggggtattctgacgctgaagcacccgattgagcacggcatcatcccatctgggacgacatgg

SEQ ID NO: 49823 - DNA, 667 bp, Heterodera glycines
  SCN-specific regions: Sequence locations=1-120,149-149,176-667
ggaggcgcccagcgccaccatggagaccaaagtggcgggcggcggcgctgcgccgaagcgcgtctggcgctggacgttgtcacagctgcgccagacggacggcatcatcccgtcccagggcggttggaacaagggagactcgcagaagctgatgaccaactttggtacgccgcgtgacaccaccaccaaagtcaaagtggagaatctggccgagattcgggaggacattttgctgaaaagccacggggaggtgcgtctgcagtccggtaccaaccggttcgcctcccacaagggctttgattcgatcggtaccggacgtgatgtgtgtcgtgaaggtgtgaatgtgaacatcctgccggccgacttggacccgctgccggaagagacaatccgcgccagtgactggattgtgcgtctgcacgccggtgcgacccgattctactcgcagaaaggtgtgaccctgttcggtaccggacgtcctgagaccaccagaatgaaggagagcacgcacccggagtactctcacgagcgcgacattgacaacacggagattccgcttctgatggggacgaacaaattcgcctcgcataatggcatgactggcttcggctcaaagcgtcgtgagaccaccaaaatgttggacacctcgcccccggagtacagccac

SEQ ID NO: 49824 - DNA, 412 bp, Heterodera glycines
  SCN-specific regions: Sequence locations=1-412
tcccttcagttcaatcgcccaccgaccctttgtaccctttccccggtatttgaagaacgacggccaatcaaatgggaaaccgcggcttgatctgaacgtggagaaggcgtgggctctcggatacaccggcaaaaacattacaacggcgataatggacgatggggtcgattacatgcatgccgatctccgcttcaacttcaatgccgaggcgagttacgacttcagctccaacgacccttacccgtacccgcggtacaccgacgattggttcaactctcacggcacgcgctgtgcgggagagatttcagctgctcgcgacaacggaatttgcggggtcggcgttgcctatgacagcaaagtggcagggatacgaatgcttgaccagccgtacatgaccgatctgatcgaagcc

SEQ ID NO: 49825 - DNA, 727 bp, Heterodera glycines
  SCN-specific regions: Sequence locations=1-727
gtgcaatggccgtttcgcgagcgatgacggaccgcgaacggcgtgtccgtacactgcgggacgcccccgcaataaaggcgccatgcgccggatgggacaaaaggacacaggcccgggacaataggcccaccccacacgtgcgattccgacacggaaaaagccaaatgagcaccgcatctacaccgactgggaccacgtggaaaagatgtggcaccacctcttctacaaccagctgcgtggaacccccgaggatcacccagagctgctcacaaaagacccacataaggctgagggcagcacaaaaaagagaaccacagtccagtacgagacaacgcgcactccggccatgaacggggacataccggccatgctggcgatggaccactacgggcgcaataccggtaaccagttggactggggccaaggtgtcgcacagaccgagaccagaaaccaaggtgaagccccgcatcaagacatccaccgtgaagactcggccagccgggacaacactgaatacaagaagacgaaccgacacggagcgagggactcgttcgtgaccacggccagactgcgagatcgcaccagacccccggacaagatgtgctactagggggtccacttcgagcaagaattgggcaaagtgcgcgccgcaccctcgctggagaatagctcacaaccgcccgactgtgaattgatcaccgacagcaaagaccgcttacgtggtcca

SEQ ID NO: 49826 - DNA, 727 bp, Heterodera glycines
  SCN-specific regions: Sequence locations=1-180,202-727
acagcgcttctgcatccttgcaaattcgccgctatcgctgattgcagcatcgttggccactaaggatttattcgctctggcatcgaaccactccacgacgtacgcgaagcgtccaatgcaagcaaaacatgccaattcggcgaccagtggtaaaatagccaaaaatattgcataacatatggagggaaggattgacctcagttaggtgaataatgtcgtcaacagccatattttgggatttgagaacgactaagtgtcgattaatgttgctcccaaccaactgatgcatgagacaccagcccaatatattccaattcgctggttgaaatggctgtgtatgagaccaaggcacaccatggtaactctggtgggaaacagcagtactttgtcggagaagttgaactggcccgagaaacgggcgatgacacgggccaaagatcagggggactgcggctcgtggtggacattcaccgacaacggtaccattgagggagcattgggatagaaaaccgcctcgaagagtatttcatagtccgaacgaaacctggtcgacagtgcgtccaagtacggtaacaagggctgtgacggcggactgatggacagcgcatttgaatatgtgcgatacaacgaggggttggacacagatgaggcctacccgtaggaggccgaaacgggcaaatgccgatgtcaaaatgagaccgagggcggaactgccgttaggttcaaa

SEQ ID NO: 49827 - DNA, 601 bp, Heterodera glycines
  SCN-specific regions: Sequence locations=1-601
gaacttgcttataaggtatcatgaagacaaggtcctccagtttgtgtccttcacacacgtcatcgttgacacggaacactcacctgatttgtctgagttccaactgagaacttggagataggctgtgacatgatctaacttgatgctgcctactcctacctttatatcggactgccacactgtgggagcttaccgtcagaaaattgaccatttgttcaacaaatatgcttgcgatggggacgacgaagcgcataaagctggacccgatcggatctgcccctatgggatggtgcttttccttcatgacttgtacatcactcctaccattccggcagtgatggttttggcgtggaaattgcgtgcccacaaacggtgcaaattcacactggacgagttccatcaccgtattgccacactgattcccaccggtgcggaggacataaatcgactgcgcaccattttgctcaaagcggaacaagacttctgtgctgaaagaacattattccgcgaactgtaccagttcatattcatctctgtgaaggctgccgaacagaccagtatcaagttggacgctgctcccgcttgttaccaaatgctgttg

SEQ ID NO: 49828 - DNA, 375 bp, Heterodera glycines
  SCN-specific regions: Sequence locations=1-280,302-327,349-351
caccctaaacacttacgtcgcttgcgaagcgattcagcaggtgactgcgccgtgcgtttggaatgaccagcagtgcgagctgagcatccaactcgaccggggcatcaaactgagcaccaccggcgacggccaaatgctgtggcagtaccctttcgaggccattcgcgcgaccggcgacgatgggcagcaatttttgtggatggattttggggaaccaattggtgaacaggtgagcgaacgaacggaacagcacgagaccctaaccaaaacgaagaaattgaaaattgttttttatggaatgatcatcctcaaaaactattaactaacaaaaaaaaattatttttttttgctaaaaaaaaaaaaaaaaaaaaaaaa

SEQ ID NO: 49829 - DNA, 220 bp, Heterodera glycines
  SCN-specific regions: Sequence locations=1-220
agccggtgaccgtggaacgtttggcacgtctgggggggaccgggccactatcgccccacataaccccgacattaagcgtacgcgagcgcatcttccatcaggtgggaagagggaaaacccagccgccacccatgtaatgatcgttgttgttgctgcccgtggccccacgggccgaaaactgaagaaggcccgaccagactaccatcctataagggcaaac

SEQ ID NO: 49830 - DNA, 486 bp, Heterodera glycines
  misc_feature (202)..(202): n is a, c, g, or t
  SCN-specific regions: Sequence locations=1-486
gtcctataaattcgaacttgttgggtgtggcgtaagaacaaccgctggtgacgttatttgccgcgacgtaacgactcccacaacctaatcgacatggacgagctgggcgaacaatgcgccaccttttccgacccaatgcccgccgatccacccaaactttgggtggcgtggctgtacacagattcttacgggtcgggacganagatcagggaccaggtgacaaagctctttggcaaagacgcgaaaacgggcgaaatgcaagtgttcaaaaacacactgtcgaccaacaaacagttgtggaagaataagcatctgctcgaatacgggcggtaacatttcctaacggagagcccggggcgggaaatgcgacacatttggagattatggcggatggacgctgtgtaatccacccgcaaaatttggctaatgtcgaccaatttccactgattggacgcagcaagccagtcagcccgcggtatttggctt

SEQ ID NO: 49831 - DNA, 814 bp, Heterodera glycines
  SCN-specific regions: Sequence locations=1-586,608-719,743-814
cgtcctagaaggttgtgacccggcggatgtcgacgtgtgcatggcctcatacacaaagagtttcggggcggccggaggctatttggccggaaaatcgtcgctgatcgcccatctcaggcgccattcgccgaccagcttttactccttggcaatgtccgcgccggtggctcagcaagtgttcacttccatgtccatcataatgggtcgtgataacactgaccagggatggcgtcgcattgagcggttggcacgcaacacgcgctacttccgccttcgactcaaacagatgggcttcattgtgtacgggtcgaacgattcgccggtcattccgataatgatttaccaccctaccaaatgcggactttgggggcgtcttttgctggagcgcaaaatcagcgcggtggtcgtctcttttcccgccactgcaatgacagaaagtcgctgtcgcatttgtatcagtgcggcacatgacaaagagatgctggacagagtgttggatgccatcgacgaagttggcgacatcagtgccaccaaacattcgcacagaacgcaccgttaccgccaattggacgtgaaatggtgaacaaagaaaggggaggacggacacacgagaagagaagagacaatgacgggaaataaacaaaaggaccgacttttgccttattttatgttttttgttagatcatccgttgagttttgctacgtatttctttcacgcgaacttttgccattgccttttcttgccgaccctttcctccctaattttgctcatcactttgcttcttctaatgccctccccctttcgtctgctgat

SEQ ID NO: 49832 - DNA, 655 bp, Heterodera glycines
  SCN-specific regions: Sequence locations=1-353,375-655
tgaaagcgttgtggacatctgtgtttctaccctaatgtcgaagcttcaaaattacacagaggaccaattgcagaatttgttacacgatgagtcaagattgaatgcgatggtggatagtatgccgcaggtttcgtctcttcctaatgacaaagagatcaaattggcccacagcaaatccttggccgagtacaatctgtccattgagccacaactgaataaggctcttaatcatttgcgcgaaacgcatgccaatgccgtgagaacgaagggggaagtgaatgagatgaaggcgaaattggattcggttgctgaggcaagatctctggattccgtttgcgtttctctaaaaaatcttgcacaaaatgctgaagatgaaagcgagacagcggccgaacttttttacaaaggggctatggaaatagatgatttcataaagaaattcacggaaaaacgcgttattggccatacgacaaggctaaaggccgaaaagcttgccgaattgcttcgccaacaatgccaataccaaccgcaacacccgtctccttctgcacttggaatgaccactcaaactcaatattcgtctccaggggtggcagcctcaatgtatcctgtccttggccaggcttatacgagcccagccaattttcggcattct

SEQ ID NO: 49833 - DNA, 558 bp, Heterodera glycines
  SCN-specific regions: Sequence locations=1-56,88-95,119-178,201 -309,346-375,397-420,448-530,552-558
tcctttaaacactcgtcctcgtactccccctcaaacccccccactctccttctcaacatgggtcgcatgcacgctcctggcaagggtatctcctcgtcggctttgccctaccgccgcactcccccctcgtggtgcaaggtcaccccccagaaggttgtcgagaccatctgcaagctcgccaagaagggtatgaccccctcgcaaattggtgtcaccctccgtgactcgcacggcgtgccccaggtcaagaacatcaccggtaacaagattctccgtgtgctcaagtctaacggtcttgcccccgaaatccccgaggatctctaccacctgatcaagaaggccgtgtctgtgcgcaagcatctcgagcgcaaccgcaaggacaaggactccaagttccgtctcattctcatcgagtcgcgtatccaccgtcttgcccgttactacaagaccgttggccagctccctcccacctggaagtacgagtcgtccaacgccggtgcccttgttggtatgtaaggaccttacgtcggacgagcacctggtccatgtcccaagacg

SEQ ID NO: 49834 - DNA, 671 bp, Heterodera glycines
  SCN-specific regions: Sequence locations=1-671
atgcagtgagggacagttcaaaatgatcttgaaatttgaagttcccctgattcaatgcgctttgcgttctgccggttgtgataatgtcggtctgacattaattgtctcgaacaaactgcagaatgttcgcttcttcagcaaacagattcaacctaatgcgaagccccctgaacaaaacatcaaaccgggtacggtcatcgacacggctgtagtgcatccgtcaaactgcgaattctttctcaattctcatcgtactcttcaggggactgcacgtaccccaaaatacaccgtagtctacgacgacaacaaattcagtctcatggacctcgaggaaatgtcttaccacttgtgctttggccatcagatcatcaattcaatagtttctttgcctgcgcctgtttacatcgcaaatgaatatgcaaaacggggccgcaatctcttcaattactatgatgctccacgtgacatggaaacgttcgctgatctgaatcagaagctttgtctggaacatgccggttggattgcacctcatcgagtcaatgcctgattttgagagaatttcttcgtacaccatttgatttccctttgtcccttttttaaatttaatttgttcccacttaagatttaaattgttcccacataagatttaaattgttcccatttttaagatt

SEQ ID NO: 49835 - DNA, 824 bp, Heterodera glycines
  SCN-specific regions: Sequence locations=22-718,740-824
cccctctgttcaccaaatctggaattatattttcgttagaaataatgcaaccatttgtccattggtcgaaatgcatattcaaacgtccattttctaattcttcaaaattattttcgtcgtcattttcaatggggtttaattttgaatttaccgaagaacaaaaacaactccaagcggctgtaaagaaatttactcaagatgaaatcattcctaaagcgtcacattatgataagacaatggagtttccatgggaagtgataaagaaagcacacgccaatggatttatgaacgttgacattccgtcggattgcgggggtcttgacttggaacttgtaagcaacgtgctgatcagtgaggtcattgggtatggatgcaccggaattggaacggcaattttgggaaatgacttagccgcgactcctctggtcattggtgccaaagaagaagtcaaaaagaaatttttatcccgtttgattgatgagccaataatggcttcttattgtgtgactgaaccaggcgccggttctgacgttgccgcgcttaaaacgaaggcggagaaaaagggcgacgaatgggtcatcaacggatcgaagatgtggataactaatggtggagttgccagttggtattttgtacttgcaaggactgacccggacccgaaggcttccacgggaaaagcatttactgcatttgttgttgacgggaatactcctggaattgttaggggaaaaaaggaaatcaacatgggccagcgatgttccgacactcgtgccatcagttttgaggatgttgtcgtcccaaatgcccaggtcatcggtgcgccc

SEQ ID NO: 49836 - DNA, 718 bp, Heterodera glycines
  SCN-specific regions: Sequence locations=1-10,35-506,528-718
gtccaataaagggaaaatcccaaaaattttttaagttttgcagttctggcgattatgattactgccgattttcacgcgtcccatccgtcgttgggtccctcccaaattgtctatcgaattgaccaattgcccaacactctccgcctcagtctgaacaatttcagtttgccgctgttccgacaattcactcaattggacattgaccagggaacggtggcgttggaacacacgccgagcagcgaaatggccaaatgtgacgtaatcggacttcgaattgggatggaggggcacgaagacggacacggacagcagcagaaggcttctccgcagtttgtccactcgcgcgttttggccattcgcatcgacccaatggcactgttgagcagcgcccatttgggcgccgaatcaaacggagaacgatcggccataatttacaatgtgacgaaacggcccgaaaatggcactttcttttgggtggacagagagaaggaggcgggcagtttcagccagcggagcattgaccggggggaagtgctttacgcgcagatgaacatggaagcatttcaggacattttcgaatatgtgttgagcaatgatgaaatggagttgttgccgaaaaaaggcattgtgcgagttcagcccgtcttccagcccccaccaacgcacgcaccgttactcagcttggtctggcccatctcaacaccactgcgcttgaagg

SEQ ID NO: 49837 - DNA, 253 bp, Heterodera glycines
  SCN-specific regions: Sequence locations=1-100,127-253
ggtgagccaatatgtgaacaaacggatcagcaatcactacaaagccacgattggtgctgattttcttacaaaagacgtgatgatcgatgaccgacttgtcaccatgcagatttgggacactgccgggcaatagcgaatgcactcgctacgcgactccttttaccgtgacgctgactggtgtgcgctggcttacgatggcactcacgcgccgtccttctaatcattgaagagttggcgcgacgatttccttgtg

SEQ ID NO: 49838 - DNA, 830 bp, Heterodera glycines
  SCN-specific regions: Sequence locations=1-830
cggcagtggacaaaacgcgggagcaggagacacgccaacgttacaatttgccacgggtgtccggcctgatgaggccgttccccgacacgtccaccggctccatttactcgaccctgacactgaacgaagtgaactcggaggcgatacggcaacagatcatcaactactatcgaatcccgggctccggcgaacgcttcacggactatcagcagcaggcgttgaaccaattccaaatccccaccgacaacatgttcaccaccagcaaggaggaggacaagaagttcgaggcgttccccgaggcgtccatcaaaagtgagcccatctacaaaacggcggccatctacgaaacgcctcagtatcgttttgtgcctcggaccggcgctgtgctaatgcaaatgctgcagcagtgcaacgatttggccaaccgagagacaattggtcttcagccgtaccaaggccaaatgtactgggactgggccagccaatgcccggacaatcccggaaaaatcttgcaagaatgtggtgacaatgtgccttgtctgtacgattacacgctgctgaacgcggaagtgttgggcaacgaagtgaaggacacgtggaacgcgttcttccatgaccgttggtccgccattcaaaattataacagttgtggcccgatcaacattgagtacccggaatatctgatcaaaactccggcactctcctccggctacctccagggggacattgcgcgtttcgagtgcttccaaactcactggatcaaaggggatgccgagtttaaatgtacccaagtggtggactacaactttccgcaaatgtggcgttttgaa

SEQ ID NO: 49839 - DNA, 322 bp, Heterodera glycines
  SCN-specific regions: Sequence locations=1-4,37-322
gcatacatgcattttgaattcaaagcgaactcttctgtagacgataatgcacgatgcgaatggtcgtgaactgaaatgttgggcttattcgaagactaacaatgaggtgattgtcgcgagtcgggagacggtctacttctatgacattaaccactgcttggaaacgggtggagaaaacagacgatgttgcgccatggggaaatgaagcgacaaagtgctgtcactggtggagaaatacgcgcaaatcgcagtgtttagtgagcacgaaacgcgatgtcaatcagacgacacatgagtgaatgttctctctgtgatggacatc

SEQ ID NO: 49840 - DNA, 220 bp, Heterodera glycines
  misc_feature (2)..(2): n is a, c, g, or t
  misc_feature (4)..(4): n is a, c, g, or t
  misc_feature (7)..(7): n is a, c, g, or t
  SCN-specific regions: Sequence locations=1-57,81-220
ananggnggaggaggagggaagggcaagaagaacacccggaggaagggaaaggtgcgcgacaaactcgccaacatgggcgtatttgaccaagccaccgatgacaaattggacaaggaaatcatctccgtcaaacggatcagtccgagggggggcgccgaagggctcaaagggcgcgcgtcgctgggcaaggcggggcggggaggagtggaccagaagggg

SEQ ID NO: 49841 - DNA, 415 bp, Heterodera glycines
  SCN-specific regions: Sequence locations=1-103,125-328,350-415
caaattcgcgcacaaactcagcgagcgatacaactttgttcctttcggagaactcatcacaaagttttgccttaaagattcagaaattgaacataactttatactttataaattccagaaaaaacagcaaaaccatgctcgatttgaccattgctgaaaatatctggagcgagtgcgatcgttggcccattggtacatcgatgcggtctcttacactgacaatgatgaccatggctattacaattattttctgtttgccgtgcgtcaatcttactatggcgatggttcttccgtccatcggttcgacaggtacggcaatatgtaccgtttttaccaccatccggacaaggaacgagtgcgcattgcacaaattctggtgccaccaacttaccagcgcattgcgttgggtccgcca

SEQ ID NO: 49842 - DNA, 630 bp, Heterodera glycines
  misc_feature (27)..(27): n is a, c, g, or t
  SCN-specific regions: Sequence locations=1-66,88-316,338-630
ggccctccatgtttctcctcgttcgtnatgttttatcacgacccctacgaagacgattatagtcatgataaagagttaaaacagttggtacaaatggacgaccttgcaattcccaaatttgtaatgcctccgctcggcattaagccaaaaaaatttgtgcgcaaacattttgggccgaacagtcggcttccaatggcgcagtttctgaagggcactaccacactgtcctttgtgtacaagccgaagacaccgcaagacaaaggcggcgttattgtggcggtcgattcgcgtgcaacgggcggaacttacatcagctccaaaacggtagaaaaaatcattcctatcaacgaccaattggtcgcgacgatggcaggcggtgcagcggactgtcagtattgtacgcgggccgcgagcaaatattgcaatcttttccaactaaaagaggggacgcaaatttcggtggctgcggccagtaaatattttgccaatgttatgtacgactatcgtggccaagagctgggcgttcactcgatggtttgcggggttgacaagttcggcccttccatttacatgggcgaaactgaagggactcgcgtgaagattgacaacatttgttcacttcggtcgggg

SEQ ID NO: 49843 - DNA, 537 bp, Heterodera glycines
  SCN-specific regions: Sequence locations=1-537
cggcaggcgatttcactgacgccagctgcagttgcgcgagtgcggcaactgatcgaacagaggccaagcgccagggcattgcgggttggtgtgcaacagcgtggctgcaacgggttcacctacacattggactacgctgaacagaagaatcgttttgacgaggaggtcaaacaggacggagtgaacatttggattgacgcaaaggcccagctgacactgctcggctccgaaatggatttcggcgagtctaaattggcctccgagttcgtcttccacaacccgaacatcaaaggcacttgcggatgcggtgaaagctttaacatggacgacaacacgacgatgggtgctgctgctgttaccaattcgtccaccgcgccaacggaaatggcatcatcgccggagaggcaaatgccatcatcgacgaacgcgcaaagctattggactgaaggcagcagcagccacagttcttacagtggtggcggcagcagtgattacagtagcggtggcagcagcggttctgacagtagttccagtacg

SEQ ID NO: 49844 - DNA, 666 bp, Heterodera glycines
  SCN-specific regions: Sequence locations=1-666
gtccataaagacagttcacaaaaattttattgcctttcaccaacctttaaaagggcactatttaaggtcaatttaagccctccctcgcaacaacctccacaatcgtcctccgcgacccatcaaggaggtcatcatcgccacacatcttcaggccatcaccattcgtctggaatgactgcttcttcttcgcgtgctccgaataggacacgtaccggagatgacctgcacattggcaagtacaaactgctgaaaacaattggaaaaggcaacttcgcaaaggtcaaattggcaaagcacgtgccgaccggagtggaagtagcaatcaaaatcatcgacaaaacggtactgaatcagagcagcttgcagaagctttttcgtgaagtccggatcatgaaacaatgcattgtaagtgacgaaacggcgcgtgcaaatcccgaatcacttgagaccgaccgaataacggaaatgcattcgatcagaggatgcgttttcagcacgagggcactcgtttttgtcggcaatgggaacaaagttggcggttttgcattggcaagggcttccggcttcaaagtgaatttggcaattgcccgtgccgtgaaaaaggcggcgcgcgaccttttccacatcgaattgcacgaggacagaaccgtcttccaagactttttc

SEQ ID NO: 49845 - DNA, 705 bp, Heterodera glycines
  misc_feature (2)..(2): n is a, c, g, or t
  SCN-specific regions: Sequence locations=1-21,44-123,145-159,189 -198,222-264,318-369,393-417,465-705
gncctaaaagggctgcaatttcaattccattttttaaattttgcctacaaattaaacagtgccgaaaactaaatgacttccagggatgacgaatatgactatttgtttaaggttgtattaatcggcgactcgggggtcggcaagtccaacctgttgtcccgcttcacgcgcaacgagttcaacctggaaagcaagtcgaccatcggagtggagtttgccacgcgaagcatccaggtcgactccaaaacggtgaaagcgcaaatttgggacacggcgggccaggagcgctaccgggccatcacttccgcgtactaccggggcgccgtcggtgcactgctcgtctacgacattgccaagcatgtgacctacgagaatgtggagcggtggctgaaagagttgcgcgaccattccgaccaaaacattgtgatcatgctggtgggcaacaagagcgacctgcgccatctgcgggcagtgccgaccgacgaggccaaggcgtacgcggaacgcaaccagctgtcattcattgagaccagcgcgttggacgccaccaatgtggaggacgcgttcaccaacattctgaccgaaatttatcgctctgtcagcacacgacaagtgccaccggaccggatggtgccaatccacagccagcacaacatcacactgtcctcctccaccagtgccaacaaggagaagaaggcgtgctgt

SEQ ID NO: 49846 - DNA, 699 bp, Heterodera glycines
  SCN-specific regions: Sequence locations=1-12,34-54,129-132,191 -345,367-583,605-699
ctccatgcaagagactcacattgttctcgggattgcctcggtgcttctcagttggctatcatcgccacagtcgtcactctgccatctctgtactcggagatgagccaaatgaacagcaaagtgcgcgatggagttgaggccttccgcgtcaacaccgactcggcctggactgacttgatggacgtgcaagtggtcgtgacgccgccgtcgaagccccgtgataaccccttcaactccatcttccgtgccaaacgtcaactgcccggacactgccagtgcgctggcctccaacagccaagctgtccccctggtccgcccggcccgtccggaccgcctggacagcctggacagcccggacgccccggagccgctggccaacccggacagcctggagcgaacggagttgtctcacgcccaattcctggcccgaagggaccgcctggagcgcctggccagaacggaaaccccggaggccaaggtcagccaggacagccaggaggccaaggaccgcccggacctcctggcgcgcccggtcagcccggccagcctggaaactctggccagcctggacagcccggagcaccgggacagcccggcaaggacagcggctactgtccgtgcccgccccgctcttccgtgttggcagtcaaaaagaagatggcggcagccaagaaagcataagcgacaagcgcagggaga

SEQ ID NO: 49847 - DNA, 504 bp, Heterodera glycines
  SCN-specific regions: Sequence locations=1-504
cagcataccgtgtttattcgtggcttgcccggcaatatgagcaccgacgaaattcgtgaatttttcgagaaggactttggcgcttgcacgttcgactttgtcaaagtgtcccctgaccgtaccaagttgtacattgcagtccgatttgacagcaaagcggcggcacgtaaagtcatgtttaacttttccactgacggagaattactcggcttcaaggttgagatgacatggttccgtgacattcgccgctatttggcccattgtgctaaacaaggaattcgttcaagccgttttcgtggccgttccgactatcgccgggatgacgagcagtacaaagggcgcgggcgttcaaggtcacctactcggtcccccgaacgtgaagagggcgcgcgcagtcgctccgcgtcggccgcttcgcgccaattcaacgccaaccgccgtcgttcgcagagccgttcacactccgcccactcacactcgcacagtcgttccctctcgtcgggg

SEQ ID NO: 49848 - DNA, 676 bp, Heterodera glycines
  SCN-specific regions: Sequence locations=1-600,641-676
tgcttttgatcaacccggcagggtgagcttcgccccttgccccacgggggaacttcatttgggctccgttcggactgcttagttcaattttctgtgggcacgtaaatacaacgggaaatttgtgttgcgaatcgaagacaccgacagagagcgattggtggagggatcggagcaaaggattgagcagaccctctaccactttggacttacacccgactaaagtccgttgcgtggtggccaattaggttcctattaccaatccgaacggatgcctctttaccgggaattggctgatcagtcggttgacatcggccattcgtacaagggattctgcattcaaaaacgactcgactatttgcatcgaaaagcgaactccgaacgcattccgttccgtaaggatggcatttgtcgacaggtttcgacagaagaaacgcgagctcgggaacaaaacgaagaagaatttgttgttaggctcaaatgggacgggagaacgaccggatttacggacatcgaattctggtattatgaacattattccgagggaggggattttttggacctcaaaagggatggattccccacttatccctgatgtacggtgggggagaagaaagggaagaaaagtcaggaagggaaagaagagggagcggaatggatatgctcgagcgcgaagaga

SEQ ID NO: 49849 - DNA, 326 bp, Heterodera glycines
  SCN-specific regions: Sequence locations=1-326
gcccctttgacctttggctcacgcaaattcgccaaaacactaaacccttgatggacctttgtcttcgtccgatggcttttcgtccgccattttttggtgggaattcattctcaacggcgcatttgccaaccatttgcccgaactgcctctgaatgttgacacaattctcggctctgattcaccgatggaaaattttgtgacaacggctccgtttgatgtgctcaaccccttaaatttcactgccatttgggctagtacggcttaacaaatgcacattgtacaaattggtcctctccttgctcagatccctaccttttgatgataaa

SEQ ID NO: 49850 - DNA, 607 bp, Heterodera glycines
  SCN-specific regions: Sequence locations=1-607
aaacgatgttgaaaagcgttacggactcctcatcgacaaccgcatctcgcaagagattcccggcgaccagctctgcgagtagttcatgggctacgtcttctagatccccagtggaaacgagaagcagggtttccgcatgaaccagggtgtgctcttcaaccaccgtgtgagcctccgcctctcggagggacactcgtggtaccggctccgccgtacccgcgagcgcaagggcgagaccatccgcggttgcatcgtcaacctcgacatctcggttgtgtcccttgttgtcggcaagaagggcgaggccgacattgccggggtcaccgacgtgactgcgcccaagcgccttggccccaagcgcgcgtggaagattgcgcagatgctcaccttgagcaacgaggactatgtgcttgagtacgtgctccgccgtgaggtgcccgagaagtcgggctagcccgagtccaatgcccctaagatccagcggcttgtgacccccttgacgctccagcgcaagcgcgcccaccatgccgagaagcgcatccgcgtcgtggctgcccgtgaggccgctgctttctacaataatttgctcgctgaccgtgcccatgag

SEQ ID NO: 49851 - DNA, 304 bp, Heterodera glycines
  SCN-specific regions: Sequence locations=1-304
ctcaagaaaattgaaaccacatcgtcaggagcggcgctggaatgacaagcgctgcaaaaaaacccctcttggaactcgttggaaagacgatcctttcagaggagcctggatggccaaaggaattggtctcgactagattggcgtcgaatcgagacagcctacttctgcgattccaaaatgcgtccgcgagcaacttgtcaaaaatagcaacaagatcactgcttatgttccaaacaacggtcgcttgaatttgatcgacgaaaacgactaaacgcttgtgtctgtgttctgacgaagtggacag

SEQ ID NO: 49852 - DNA, 517 bp, Heterodera glycines
  SCN-specific regions: Sequence locations=1-256,279-517
acatcccttcccctggacgcgcacttttaaaaccggccagacccactatcagtacatctgctctcccgacaatcctgtgctgaaacaggcatcgcgaaggtccccggcgaccaagacacaacccgctgaacttaccgctgctgaccacagcgtctggacgaggcatagcgccatgtacgccaatgacatcgcgaaagagcgtggcagcattggggacgccgttcctcccttccccgcctagaaatcgcctttacacctggtgcttgaagtgctcccgcgtctccaggaccactattacagcatttcaacgacggaccgcctggacaccccactcctcccgctcactgccgatgagctgcactacaacacaagccacgagcgactggacaaacgggagtgcaccaactccttggaggacctggcccccgccgagtccaccgagccagtgtacttctctcagtcccaattgctcttgccacagcaccggctgcagcccctgatcataaccgaaaccccg

SEQ ID NO: 49853 - DNA, 382 bp, Heterodera glycines
  misc_feature (4)..(4): n is a, c, g, or t
  misc_feature (12)..(16): n is a, c, g, or t
  misc_feature (19)..(19): n is a, c, g, or t
  misc_feature (21)..(21): n is a, c, g, or t
  misc_feature (28)..(28): n is a, c, g, or t
  misc_feature (30)..(30): n is a, c, g, or t
  misc_feature (32)..(33): n is a, c, g, or t
  SCN-specific regions: Sequence locations=1-303,325-382
aggngaaaaggnnnnnggngnggagaananannagaggaattccatgagacttttgttcatgtgaccgatttgtctggacgtgaaaccattgtcaaaatcaccgggggaatgcgtgttaaggacgaccgagacgaggcaagttcgtacgctgttatgctcgccgcgcaggatgttgcggaacgttgtaagcaggttggcattaatgctcttcatgtcaaattgagtgaaacgggtgggaccaaaaccaaaaaggcggggtttttttttcaggcagagatgagggcccacgagcgttcgggtatgaagattggtcgaattgaagatggcaggcctattcctttagactagaatagccaaaaaggaggcagtcgtggaagtcgt

SEQ ID NO: 49854 - DNA, 810 bp, Heterodera glycines
  SCN-specific regions: Sequence locations=1-810
gtcctctcacgttactgtcgcatgagagagtaccaaagtctttccttttgcggcaccgacgaatatgggacggccacggaaatgaaggcactttcggagggacttacaccgcgacaactttgtgacaaattttacgagttgcacaagaaaacgtacgattggttttccattgattttgacttcttcggacggacatcgaacccaaatcagacagaaattgcgcaggacattttcaacaaattgtttgctaacggattcacttcaattgacgcgcaaatgcaattgcattgtgcgaattgcaacaagtttcttgccgaccgttttgtcaatggcatttgtccccattgtcagttcgccgacgcacggggcgaccaatgcgacgggtgtggccatttgttggatggtgtcgatttggtcgaaccgaagtgtcgcatttgcgggggcaaaccaacacttgagcaatctcgacacattttcttggacttggaccgactcaagcctcatctccaagcatttctcgaccgcacaatggcaacgtccgactcgcgttggtccgccaatgccatttcgatcactaaacagtggcttaaccatggcctcggacggcggggcatcacacgtgatttaaagtggggcacaccggtgccgttggccgaggttgcctccaaagtgttttacgtttggttcgacgcgcccattggctatttgtccattaccaaatcccaccttggcaacgattggcaccgatggtggaagaacccggacgaccgtgagctgttcaactttatcggcaaggacaccgcgcctttc

SEQ ID NO: 49855 - DNA, 406 bp, Heterodera glycines
  SCN-specific regions: Sequence locations=1-155,177-406
aagacacgcattggagatagcgataggaacccaaatcttggacctttcggtcgagacacatctcttcaccgggacgctgctttccgagagacgaaatgtttttagccaagaaacgctgaaccaattcatgggactgagtcggtagtgttggctcgaggagcgtctccacctcccatcgttgctagtacatgccaacccaatgcttatcgatgatagcgaattgcgcgaaagggctttggctgcggagacagaggccaagatgcattttcccgaccaaattggcgattacactgacttttactcctctatttatcatgccacggatgatggcacaaaggttcgtgtaaaaaacaacgaccttatgaaaaatggaaatgggttgccgcttgtttacctgggaagggct

SEQ ID NO: 49856 - DNA, 220 bp, Heterodera glycines
  SCN-specific regions: Sequence locations=1-220
cggcaacaaaattgtgcgcattcttcgatcaaaggggatggcaccagaaattccggaggatctttaccatctgatcaagaaggcgggtagcatccgcaaggcatttgagcgtttccgccaggacattgaatcaaagtacccgtctaattttggtgggaaagtcgaatccaccggctcggccctttactttcaaaccaaacggttgctccccgccccttgg

SEQ ID NO: 49857 - DNA, 418 bp, Heterodera glycines
  SCN-specific regions: Sequence locations=1-227,253-262,292-295,317-418
aaagccgacgggaattagaaccgcaagacaactgaaaaaacgtcgtcaggagcagcgctggaatgacaagcgttacaaaatcgccggtcttggaactccttggaaagccgatcctttcggcggagcctgtatggccaaacgaattgttctcgagaaaagtgggggcaaacccagacagccaaattctgcgattcgaaaatgtgcccgcgtgcaacttatcaagaatagcaaaaagatcactgcttttgttccaaacgacggatgcttgaattttattgaggaaaacgacgaaaagcttgtgtctgggttcggacgaagaggacatgccgttggagacattcctggagttcgtttcaaagtagtcagacgagccaacacggctttgctcgcacttttccgagtaaacaaagagaggcct

SEQ ID NO: 49858 - DNA, 448 bp, Heterodera glycines
  misc_feature (422)..(428): n is a, c, g, or t
  misc_feature (430)..(439): n is a, c, g, or t
  SCN-specific regions: Sequence locations=1-106,128-448
tgtctgtccgtctctactccaaggcccgcattctcggctacaagcgttcccagcgcaaccagcagaccaaccaggtcttgctccgcgtcgagggcgtcaacaccaaggaggacactgagttctacctcggcaagcgtgttgcctacgtctacaaggccgagcgcgccatcaacggctccaaggtccgcgtcatgtggggccgcattgcccgccctcacggcaactctggtgtggtcaaggtgctcttcaagaacaccgttccccccaagtcgttcggtgcccgtgcccgcgttatgttgtacccctcccgcgtgtaagagtcgctttgtgttcttgcgtgcccaacgagcgatgcaatcacaatgcttccatgacaaatgcatgaatgattcttgtttttgccatgcatcattgataccacnnnnnnnannnnnnnnnnaaaaaaaaa

SEQ ID NO: 49859 - DNA, 761 bp, Heterodera glycines
  SCN-specific regions: Sequence locations=1-699,721-761
attcttttgattttttgaaggaacacgacgattgtgtcaagtttccggaaaagctgaaaagcggcagttgtgaatcgaatgggctgaaaccgattatgatcactgattgggacggcactatgaaggattactgttctcgatatgcaaccaatttgcagccaatttacactgcgattagtttggctaaattttcacaggcctacactcgtcttagtgctgtactgacagccggtcctctgagaggcccgggtattctcgatttgatcgctctgccgaaagacgggccaattgtatttggaggctcgtatggaagagaatggtggttcgacggaaaacggattgttcatgacgaaggaatttctgacgcgggtttaactgcattggacagtctttctgaaaagatggccactttgctgcaagacaatgaatacgcccatttcgctctcatcggtagtggtgtccagcggaaggtcgaccgtttgactttgggcgtacaaactgtttctaagcacgtagatgttgcactgtctcagaaataccaaaacgaagtcattcagctggtgcaaagagttgacccgaattcgcaatttttgcactttgcgccgtcgaatggatgcgaagtcgaagtgatggtgcacgaacaaggaaaggtttggaccaaagctaaaggaatggcgaaaatagttggaacgctcggcgaatccctggaaaaagggacggtgcttatttgtggggacacgcattctgacttaccgatggtg

SEQ ID NO: 49860 - DNA, 686 bp, Heterodera glycines
  SCN-specific regions: Sequence locations=1-686
atcgtaaggagccaatggattttgaatatattgttgccaacccctccgaggggggcacagattctgcatttcttgacgaagattttgagggctgcaattgtacggacggccaatgctgcacgtcggcagcaggcggttgcagctgtttgcccggcaaaagggacaattacaatccgatcaccggcaaatggattgatcaggggggcactgatcagcggcagggtgtgccacatttggagtgtcaccagaattgtgtgtgcgcatgggagccggacaaatgcgcaaatcgtcaagttcaattcggtgtccgacaaccgatcagggttgccccgtgtactagtggcaaaggcttcggtgtttttgcttccgcgttgatcgaaattggcacttttgtgatcgaatatgttggcgaagtgcttggggaagaggaggcgcggcgccgaattaacattgttggacggcacgagcacaattatctgttcacaattcgcgaattcttcggaggtgagtgcaggagcactttcattgatgcacggcacaagggcaacatttcacgcttcatcaaccatagctgtgagccaaatttgtcactgcaaattgttcgtttgggtcgccaatgtccgtcgttggcgatgttcgcctccagagatatccaatcaggtgaggagctctcgtacagttacggc

SEQ ID NO: 49861 - DNA, 473 bp, Heterodera glycines
  misc_feature (439)..(439): n is a, c, g, or t
  SCN-specific regions: Sequence locations=1-280,302-347,369-370,392 -409,431-439
tccataacgccctggggcgggcccgcctacctgcacaggggatcttccagaaaggacctgctcgccgacatggagccgaacggagttgacattttccgcgtggcgaaaaaaatttcgccgaacattgtctactttttgccgaaaaacacccgcactgatcagttaattgcattggcaggccccggaggccgtgtggagttggagcaaacggtgcttaacgagaagatcaaggcgttgcatgcttattttggcctgttggcggccaattgagtccctcgtcttttttcgcgcttttctttggttgttacactcacggattatctcaaattattatctctttgaattcgttgcttttccattttctcttgatcattttgaaaattttgatattgtttcaccttctcttgctacaaattttccaataaattttcccatttcnaaaaaaaaaaagaaaaaaaaaaaaaaaaaaaaaa

SEQ ID NO: 49862 - DNA, 448 bp, Heterodera glycines
  SCN-specific regions: Sequence locations=1-448
cagacgatcatggcttcacgtagacaacacaattggactgtgcctccaggttattgtttcacttggaactccaaacttccgaaagccttgccccggaatgtgtcatacgattgaaggctaagataacggttaagtgcgagtcatccgacaagactcattttacgacggatatgctgctgcccgccttaaatcatcgatccgacccacaaacgaccattcgtgcgccgacagactcttcgccctcaatctttcactgcccttacaaacgcccgaactgattgtctccatggtctctgccgaagagccgatccggctgcacgacttcgatccttctcaataccttcgcgaacattccgcccaatccgtcccaaatgattaccacatgcccggcccttctctccccaaacttatgctgctcgtcgtttctcccgcctccagcaaaagcact

SEQ ID NO: 49863 - DNA, 547 bp, Heterodera glycines
  SCN-specific regions: Sequence locations=1-547
caaaaacggcacagaactctggtttcggtgtgctctatttcatggaggagaattgcagttctactcgtgagctcaacattgaatcggatacttttcggatgctctcattgtcctggcaccatattgcgatgcacctttgattgtgaatctgaccggagttgcaattccgacgatgaagtcaacatccacaccattcaggctactgagactcccgggcttttcccgcttagttcttgtcgacaaatgcccggagatcaacatgacaacccgaagactcaagacgactggcggtggtacagtgactttctccaatcccatcaagaggaattgactggctgtgccacgcattaagccacgaaaagagtgcatgatcacaggtcacgcttaactatacaaagagagcgcgtacatcgcatcgcgaatgattgacgggactcaacagatgcttctcggaagcctttctgacgtttacattaccattgaccagaggattgtgccccaggactgactatcactcagatatggaatcttcttgacggctgataca

SEQ ID NO: 49864 - DNA, 710 bp, Heterodera glycines
  SCN-specific regions: Sequence locations=1-157,194-710
ttcccggggaattcgctcttgccaggattcttggcaacaatttatgcgggattctgatggcggtgctatacatcctcatcattgtgttggtcggtgccaatgccgcactcgccgccacagtttacttcggtctcgctctgtttaccgtcgtcctttgcattttttctttccattttcttcaaaaattgaatttctacaattactatgtccaaaaagcggcgaaagcgcgcgcgaacaatggaacgaatattctgcacgaggaggaaacgggcgaagcgaaggccaatataaaagtgacgcatccgccgctaaaaacatacatcgcaattttctctgaggtccgtcgccagttgctcgatgtttggcttgtcttttttgtcactttggctctgtttccgaccgttttgttgaaagtgtctttaattagtccgttcaacgaccagaaaacttccgaatcgctctacaagcagctgacagttttcctcaatttcaatgtttgggccgctgtcggctgttggctgtccggcttttccccgaggccttcccccgattatttgtccctgccgatttgcctccgtctgctctttcttccgttgttttgggtttgcgattaccaatatgaccatttgactccgcgtcgcttcgtgttcatccacaacccatgggtgttcactgttctgatcactcttatggcactcagtcacggctat

SEQ ID NO: 49865 - DNA, 328 bp, Heterodera glycines
  SCN-specific regions: Sequence locations=1-206,250-328
gaatacgacggggaagaagttggtgagtccctccgcggaaggccttgagctgccagagagtgaggaggacaacaagaaatttgaacaggacaaggtcacgttcgacaagctgtgcaaagtcattaaggacatcttggacaatagagtccgaaaggtttctgtctcagaccgtttggtctcttctccgtgttgcattgtgaccggagagtacggatggtctgccaacatggaacggatcatgaaggcccacacattgcctgactcctccacactgggatacatggcgtccaaaaagaacctggagatcgtccctgaccattcgatcgtc

SEQ ID NO: 49866 - DNA, 716 bp, Heterodera glycines
  misc_feature (436)..(436): n is a, c, g, or t
  SCN-specific regions: Sequence locations=1-26,48-163,185-281,303 -413,435-475,497-628,650-716
ggttcgattggtccaactcatcctcgtttttgtcattgctctgttttgctcaaatatttgcttgcttcgtcctccctcacctttggctttctctccgtcttctcaaaatgccttctgtttcttttgtggatgtccccgttaattcgccgtttacctttgagaatctcccgttcggcgtcttctcaacaaatgaaaatagcaaaaaacgcattggagtagcgattggagcccaatccgggacctttccgtcgtgaaacatctcttccacggtcgctgctttcgagagacaaaatgtttttaagtcagaaacgctgaaccaatcctgggactgaatccgcaatgtttgctccaaggccgtcttacccttccattccgtgctgtcccaatgccaccccaatgcttcccgatgacaacaaatttcccaaaagggtttttnttcgcaattcgaaggccaaattcatttgccccccccaattgggattaaactgacatttaatcccctattaatccggcccccaatgtttgaccaatgtttcctgggaaaacacaccccttttggagaaattgaaattggtgccccttgctaccatgggagggggtcaaattttttgtttccggaccggaaacatttcccccggggccaaataaagggggaaataatccccccccaccttttgacaaaccggtatgggcttttgttggaaatgggttttttt

SEQ ID NO: 49867 - DNA, 774 bp, Heterodera glycines
  SCN-specific regions: Sequence locations=1-534,557-774
tctcctaatagcacatgaatctctccccagtcgactccgttacccattgcacaacaacctccaccatgactcaaattaccaagcccgtcgacccctggaacgagtgcctcaacacctcgctcgaggtcgaggacccggaaatgttccgcctggtcgagctcgaaaagtaccgccagtactcgtgcctcgaactcattgcctcggaaaacttcacgtcgcaggccgtcatggaggccaacgggtcggccttgaccaacaagtactctgagggcttgcccaacgcccggtactatggcggtaacgagttcattgaccaagtcgaagtgctctgccagcaacgtgccctcaaggccttcaacctcgactcgtccacgtggggcatcaacgtgcaatcctactctggctcgaccgccaacttttcggccttgacagccttgctcgccccgcacgaccgtatcatgggtctcgacctcccctcaggcggccacttgacccacggttaccaaacggccaagaagaagatttcctcttcggccatctactttgagtcgatgccgtatcaagtcgacatgacgaccggtttgctggattacgaccgcttggagcaaaatgcggccttgttccgccccaagctcatcatttgcggcgcctcggcgtacgctcgcgactgggattacgctcgcctgcgcaagattgccgacacgcacggcgcctacctaatggcggatattgcccacatttcgggcctggttgccgctcaggagcaaaacaacc

SEQ ID NO: 49868 - DNA, 244 bp, Heterodera glycines
  SCN-specific regions: Sequence locations=1-244
cgccgtatgcgcccatgacggccatggggtgcacttctgagtacaggcatgccgcgcttgtgccggcttgttccaacgctccaccatcgcggaacgcgtctatcggtgccgataccacggaaactgtgacatctgccaaagggaagtgcgttgtgtgtgccacgcgtgtccattagacaaatgtttggggcttggcatggacccggacgctgttccacgacaccgtgaccaaattgggccccga

SEQ ID NO: 49869 - DNA, 688 bp, Heterodera glycines
  SCN-specific regions: Sequence locations=1-10,32-304,326-352,410 -410,483-539,572-639,661-688
ccgcgaccagggccgctgtggctcttgctgggctctcgctgccgtcaccgctatgtccgaccgtgtctgcgtcgcctccaatggcaaaactcaagtgagcctctctgccgaggacttggtatcctgctgccgcatctgcggtatgggctgcaatggtggataccccgccatggtctggcaatacttcaagcactggggtctcatctccggtggctacctgcccgacaagtccgagggctgcctggactactccgtcctgccctgcgaacaccacaccgccggcccccgcggcacctgcgacgaaggccccacccccaagtgcaccaagaagagcagcgctgcgtctggcctcacctacaagaagagcctgtactacgccaagagcgcgtactccgtcagctccgacccctaggccatccagaaggagatcatgactaacggacccgtcgaggttgccttcagcgtctacgacgacttccccaattacaaggacggtgtgtaccaccagaccaccgacaacttcctgagcggtcatgcactcagggctattggctggggcgaggagaatggcgaaccctactggctcatcgctcactcctgagacaccgactggggtaaagatggtctgttcaagatcaagaggggcaccaacgagtgcggtattgagggtcaagtcgtcgcgggcatc

SEQ ID NO: 49870 - DNA, 376 bp, Heterodera glycines
  SCN-specific regions: Sequence locations=1-376
tgcactgatcaccatcgattcctaccgtctcagtgatcgtgctcatagggctaacatttattctgagtgcatggaacatggggacatcatactcatttatatgtttacttcttttgaccgattgcttaatgttgttcggaaaacggcggacctccacaaagttgaggacgccttcttacggctgatcccactgcgctactatggcattgaactcgacattttattctctcggttggcgttgatacaaataaaggaataccaaaaactctcagacgacaatttgcttaacatcttggacgataacacttttccctctctgaatggttgtcatgtggccgatgaaattttgccattggtcccaaatcgactgaatttc

SEQ ID NO: 49871 - DNA, 819 bp, Heterodera glycines
  SCN-specific regions: Sequence locations=1-110,134-221,243-465,488 -674,696-819
gtcaacagaatgacgcacaaaatgcggttgacccgtgtgctcacgtggtccacgtgctcatgtgctaccaaatgggcggggaggacgaagaatttgtgcgcaaagcaatcgaaagtttggtgaagaaattgaaggatcgtcgtgagcaattggaatcgcttatttccgcggtcacttccggcggcaaacaatcaaccagttgtgttacaattccgcgttcattggatggccgactgcaagtggccggcagaaaagggctgccccacgttgtctacgcgcgcatttggcggtggccaaatgtcagtaaaacggaattgctcaagttgcgcagttgtgccacccccgctgaccatgtcgatttgatctgtgtcaatcccttccattacgaccgcgtcgtctcttccggcctttccgctttcgatttggcctcttttcgcttggatcctctttcgtcttcgtccccttccgctgcttttcgtcctcctccgccgagtgatcaaatgccaatacctttgccaattggccattcgtttgcccatttttccggtgcctttgactcccatccgtccttttctgcttcctcttctcaccatttgccttccgtcccaattgaccaccaaagtgccaattccaatgctttcgatgcgccattccctcccattccgtcgttcgttccccacccccaacaaaatcagcagcggtgtccactgatcgttcactgtttgggcgagggacaacaacagcaaatcgggccgtttcagcagcagatgtgtcaccaaaatacgactgaccaaagtcaaacgcatcggttcactcatt

SEQ ID NO: 49872 - DNA, 441 bp, Heterodera glycines
  misc_feature (422)..(422): n is a, c, g, or t
  SCN-specific regions: Sequence locations=1-196,226-329,355-377,410-415
gcgcatgtgcgaccgtttgacccaaatccaagaccttgtcaacgatttggccaaccacatgtgcaattcggtcggtgttctgcaggcgagtgccgggccgtgcgaatttgggacagctccggagacactttacaaaatcgccaacaaggtcaaaaacttcgccgtcatttacttggtggacatcagtgaggtgcccgacttcaacaaaatgtatgagttgtacgacccggtcaccgcgatgttcttcttcagtctatcgtcaaacttctttgcctccacacattgctgtgtttgaacaatggactgcacaaattctccattctgaagggcaataatgaacaataacaacaacaatcaatcatcgcatatttgatatttttgaacactttttaactgtttaagaaataatcgtttgattttanaaaaaaaaaaaaaaaaaaa

SEQ ID NO: 49873 - DNA, 325 bp, Heterodera glycines
  SCN-specific regions: Sequence locations=1-325
cccgcccgccaaacgtcagagcatgaaccgcggattgaacctaacgcccaaatctttgctccctcgtctgcgtaagggaaaactcaactgtccggaggtgatgaaacccgaatgcgtgaacactcatttgcatgacatgatcgtgctgccggagacggtcggctgtgaggcgggcactctgagcgggcaggtggacgatgcggaaggagtgcgagctgagatgatgggctattacttgggcgaattatctattacgcagcagcctgtggagcacgggaccactggcaccggagcaaagcacacggcgccgggcataccactaagg

SEQ ID NO: 49874 - DNA, 310 bp, Heterodera glycines
  SCN-specific regions: Sequence locations=22-115,137-229,256-310
acgcactttcatcgccatcaaacacgacagtgtacagcgcggattggatgccaaaatcactaaacagttctagcagcgtgggtacaaaatggtttgcatgaaacttgccaaaggcactgtcccccatttggaggtccactaccataacctcaagaacaaacttttctttgccgggcttcccaaatacatggcatcaggcccgattgtcccctaggttttggaaaggtttggatggggttccccggggccccggttgctccggccttaaaacccttgggccagtggcccgggacaattccgggagattttt

SEQ ID NO: 49875 - DNA, 247 bp, Heterodera glycines
  SCN-specific regions: Sequence locations=1-247
cggtgtccagcgcggattggttgccaaaatcattaaacagatctaccactgaggttacgagttgattgccatgaaacttgcaaaggcacctgtcccccatttggaggtccactaccatcagctcaaggacaaaccttactttgccgggctcatcgaataggtgacatcaggccctattgtcgctatggtttgggaaggtttggatgagggtacacagggacacgttttgctcggggctacgattccg

SEQ ID NO: 49876 - DNA, 702 bp, Heterodera glycines
  SCN-specific regions: Sequence locations=1-433,455-563,587-673,695-702
ccctttataatacggcgctctttcgtgctcgggcaacgattttgcaataaaaaaacggaagagtcatttagggacaaagaaaaagttttgccattggacggactgcagaaagaccttcgtacgacagcaacttcgagcttctctctttactgctcccatgctcaccaaattttgaccgacgtaactgaattgcgcgatttggtgttggacaaacgcaaggagtacattttgtgcagcaatgcattttcgctttacggtgtccagaaatttatgtccgatgaggacaggaggaaattcgaccaggaaacggatttggcctttagacattgcaccaaattgatcaagagtcttgaggcacaaattgaatctgatcgcactttgcgtccatccgaccaattaaagcatctgcttgccgtgacgaatttgctcaatgtttatttgaaagaagtgctttctatcgttacgcaattaagggcaattcatgtgcgaaaatcacgccaaattcgtcgtatttgccggttggccaatctcgttgaaatgtatggggcacgaattgaacagacgcaaaaggaggaggaagaaaaggcgctgaaattggtgcgaatgttagaagagctaaaagagaacgaaaaatgccagtggaggaaagaggaaacacgggaagaagacaaagagaatgttatgttaaagaaaggaccaagg

SEQ ID NO: 49877 - DNA, 220 bp, Heterodera glycines
  SCN-specific regions: Sequence locations=1-19,44-220
agccaaggaagaagccgacgaggaaatggacgctgctgacgaggctattgccgctctcccccaattcagcgacccattggctgccttgcccccgggctcatttgtgatggacatgttcaagcgcgtttattccaatgaatacaccgcatcgcaaagcattccttattcttgggatgatttcaaccccacaaggtacagcctttggttttctgaatacaat

SEQ ID NO: 49878 - DNA, 307 bp, Heterodera glycines
  SCN-specific regions: Sequence locations=1-135,157-307
atacgcgcataatatgaatgacatgttgggcatggaaacctggtccggcaaatactgcctgtgctacaaaaaatacttgataaccctgctctcagacaaggctcagctggtgatcctcttcagcaacaccccatctctcagactgagtgaaattgattactacgccatgttgactgagaccggcgtgctcgattactatggaaacatcgtcgagctgggcaccgagtgtggttaactgctccactggtacatgctgaacatcactgacccgggtgagtcggactttattcactacatgccgacggag

SEQ ID NO: 49879 - DNA, 807 bp, Heterodera glycines
  SCN-specific regions: Sequence locations=1-529,551-807
gcccattagactgctaaaatgggtaaaaacaaaaaaccgttcattgaccgaaaaagtgccgtaaattacacactgaacaacagagagttggaggagacgcagcggatcagtgattacaagagcttttcgtttcgttcactcgacaaacgttttgagggtatttacgaggactatgcgaatgaagaggaggagggagcggaggaaatggacgacgaagaaggacaaacgggggctgattctgcgattttccgttctctgctggcggatgggcaatcccagcggagttgcgaagaacgttttcaccgggagctgcccgattccgagctgaagggcgcggtgttgcgttatgcaaaagcgatggaaattggcaaaggaagggccgagccgacggaggacattttggtggacagtgcgaagagaagccgctgggattgcgagtccattctctccatgcattccaccctttacaatcatccgaccgaaattagggagccgatgaaagtcattgggaggcgaagggggaggacgaccaaagagaaggaaatggccaatttggaggaaacggaagttgacggagaccaaagagacgggccaccggcgccgtccgtccgcacgcgcacttcgatggttagcgtaattcgaccgaagggggagacgacggaagagcggcggatgcgtaaaattgcagtgaaagaagaacggagagagcggcgtaaggaaaagaaggcgaacaaagaaacctttcgggcggagagactgaaattggaggcacagcgaaaaacgaatcagccgaagacgcgacaaatt

SEQ ID NO: 49880 - DNA, 437 bp, Heterodera glycines
  misc_feature (22)..(22): n is a, c, g, or t
  misc_feature (25)..(25): n is a, c, g, or t
  misc_feature (29)..(29): n is a, c, g, or t
  misc_feature (70)..(70): n is a, c, g, or t
  SCN-specific regions: Sequence locations=1-148,187-237,261-437
ctttactgatctgtacaccagnaancctnccaccagcaacctcatccaaagcacgctcatccaccatggncaagatcggcatcaacggtttcgggcgtatcggtcgtctcgtcttccgcgcgtcgctccagaaccccgacgtgcaatgcgttgccatcaacgatcccttcattgacctcgagtacatgacctacctcctccgctacgactcgacccacggcctcttcaagggcacgatcgaggtcaaggacggcaagctcgttgttgacggccacaccatcagcgtgtacaagtcgatgaagcccgaggagatacaatggggtgctgccggtgctcattattttgtcgaggcaagcggggtcttcctctctggggagaaggcgggactccactgcaatggtggcgccaaaaaggggggggggaatgggccatcaggc

SEQ ID NO: 49881 - DNA, 855 bp, Heterodera glycines
  SCN-specific regions: Sequence locations=1-855
cgtactttcatgttgtctgatcttaccatgggagagatgaaaatcttgcccaaagatgtacaactttgtgctgaggttgcgactggtgttgaacggatgggccaatatcagtaccaagacctggtgatgctggataaagaaacagttggagtaatcgttcgtttggaacgcgaaaatgtggaagttttgagtatgcatggcaaaatacttcgtgttaaccctcaaacgattgaatgcaaaaagaattcgcggttcgtcaaggcacttgattctcaaaagaatacaatccaagcgggagatacggtcaaagttgttgagggcttcctggcgcgaaagaaggaaactgaagaagaacgtcagggcgagatcaagcatcttttcagaaattgggccttcgttttttcacgtaaatatccacaaaacgggggaatgtttgtttgcaaagcgcggaatttggcattgattggtggaagcaaagcgtcggagtcacaaatcaacactactattttggataacagtcaacttatgagtcctcgtcctaatccgctcgaaagtcctcgcaccattcacggcggaatgactccccattccgggtcaagtgttgttggtgcacaatctgtccgtggcgatcatggttttaaagcaccaagtgtggtcgggagcatcgcaacatcagcaaccggagttggtcggcaacatgtacgtcggaacatggaaataatgggcaaaactgtgcgcgttctggctggtccaatgaagggttacattggaattgtgaaagatgcaacggaatcgactgtcaaggtggaactgcacaccatgccaaaaacggtcaattttgacatcaacaaagtg

SEQ ID NO: 49882 - DNA, 780 bp, Heterodera glycines
  SCN-specific regions: Sequence locations=1-292,314-780
gatcctatgcgttcaaaattcgtaattgttgcgccatgaaacccactaagcgtccgatgaagcatccctctgctcccttttcgcgcgactccccgcgctcaaaacggttgaaacaatcaacagacggtgccggcgggaaacggttgttcgttgtgattgaggactgcagtctcgaagtggccaaagtcggcgccgaacacgtcgtgttgtgcagtgacaaacacgcgaattggctgcgcaaacagaacagggacccggcccagttcaggccggacattcttcaccagtgtttgctgatgctgcaggacagtccgctgaacagtgccggtcttttgcgcgtctttttccgcaccaaacagaatgtgctggtcagcgtgagcccgcagtgccgacttccgcgcacttttgaccgattttgtggactgatggttcaacttttgcacaaattgcaaattcgggcggctgattcttcacaaaaattgttgaacgtggtcaaaaacccggtgaccaaccatttgccggtgggctgccgtaaatttctgagcacactgaactgccccaatttggtgtccaacatggccgagaaggtacagcccgaagcggaagagccggtggtaattgtggtcggtggaatagcacatggaaagattagcaccgattacacggaggaggacatcaaaatttcaaattatcctttaagcgcggctctctgttgtgccaaattgacaagtgcttttgagcagttgtggggcgtcctttgacgacacatttttttttttg

SEQ ID NO: 49883 - DNA, 853 bp, Heterodera glycines
  SCN-specific regions: Sequence locations=1-433,455-549,592-620,642-853
gttccatgaatacaaatttggccacaatgtcggcacattccttcgtctgcttacgttcagccaatttcattttttgttttatgcgtcgcgaccattgccaaatacttttgcgatggtattggtgctgctcgtcttccaaaagttgctcgactttcgttttctccacgccgctgcctttgcaacggtcgccacttttttgttccgttttgaacttctccttctcttcggcccggcctttctttttgcttttgtcgtttattggcgtcacatttcggtgctcaaaactttgctcgttggattttgttcgctgattatcgtcttgattttgtctgtgcttctcgactctctcatgtggcgtcgttgggtttggcctgagggggaagtgattcactttaatgtgtggcacaatcgtagcagcgagtacggcgtgttgcccttttggtggtactttttctccgctttgcctcgtgccatgtttctctccgtctttttggtcccttttggccttctcatccatcaacgtgtccaattcgctttggtttcgctgtgtcttcccgcctttctttttgtgcttctcttctcctttttgccgcacaaggaactccgtttcattctctacgctgtcccattgttcaacacttccgttgctgttttttgcgcttggatatggaaaaaggctcgcgactcgtggttcttccgcttctgtgcctttttggttgcgttgcatttgctcgtcaatgccattttctccgtcagttttgtttatgcgagcgcacaaaactacccgggcggagttgcactgctcaaattgcagcataagcaccgcttccttcgggacaagccaatcgccgtt

SEQ ID NO: 49884 - DNA, 374 bp, Heterodera glycines
  misc_feature (358)..(359): n is a, c, g, or t
  misc_feature (361)..(369): n is a, c, g, or t
  SCN-specific regions: Sequence locations=1-29,52-374
tccctttttcggtttatttttgtcactttatttgtccccaaaagcagaaaatgccgcgccaagtgctcgaattgtccgattacttcgctccattagctgccttaattatgttcgctttggccatcctcgtcttctctttcttcgtgatcaatttcttttacatcaccgatcgggacgacttgacagtgtttgagaaatttggtgcccatttgcacctctgtttgggcccccattcgatgtccgacatttaccgagggggaccacgggattatccgcagccccaaggaacggacaaggagatgaacagctgaaaagtcaaactatctgattaaataaacgattgtcaatacgctaaaanntnnnnnnnnnaaaaa

SEQ ID NO: 49885 - DNA, 471 bp, Heterodera glycines
  SCN-specific regions: Sequence locations=1-10,35-53,79-97,127-471
caatgtgaagacgaagatccaagacaaggagggcgttccgccggatcagcaacggctgatcttcgccggcaaacagctcgaggacggacgaacgttggccgactacaacatacagaaggagtccacgctccacttggtcctccgtctccggggcggaaatgggaagagaaacacgggtaagaacaagaaaagcaataaaaagcttgatcagaattgatcagcagcgaacgcaccatcacatgattgattggcacagtgattttccaccaccaaattcacaacacttttctcttttccgggttatctttgatttccattttcggttattgttttctgtttttctcctctatcttttgtaaaattctgttactttgatccttagttttatcatttatcatcgcatatatagaagttatcatagtccatatttctgtccctttttatttatttttttgactataaaacttttgg

SEQ ID NO: 49886 - DNA, 537 bp, Heterodera glycines
  SCN-specific regions: Sequence locations=1-163,204-256,281-292,336 -426,448-462,489-537
ttcttcgctgtttcaatttttgctctccaaacaacaaaaatgtccggacgaggaaagggcggaaaagcgaaaacgggcggcaagcagaagacgcgttcatcacgggctggacttcaattccccgtcggacgtctccaccggctgttgcgcaaaggtcactacgcggaacgcgtgggcgccggcgcgcctgtctatctggcagcggtgttggagtacctggcggcggaagtgctcgagttggccggcaacgcatcgcgggacaacaagaagacgcggatcaacccacgccacttgcagttggctgtgcgcaacgacgaggagttgaacaagcttctctcgggcgtcaccatctcgcagggcggtgtgttgccgaacattcaggcggtccttctgcccaagaagacgcagcacggcgaaagtcagtgagcggaggcgaggagagaaagcatcaaacaaaactatcccaaacggccctctttagggccacaatcattcaaatggacggattgacatgctttttaatttttttgttttgga

SEQ ID NO: 49887 - DNA, 346 bp, Heterodera glycines
  SCN-specific regions: Sequence locations=1-346
ttccacaaacatcggaattcaccccaaagaaagcgttcttttggctgcggaaaggcactcaatgaccaaattggtggcggaccactccctgatcaaaatttcacaagttgacaaccacattgccgtcgactcggccgctctcatcgcaaattcacgcacttgggtcgaacgctcccgcgtggacgctcacctcttttgtgttacttacggggtcaaaattctggcgaaacacgttactctatacggctcaagatcgccactgcattttagggacgacgactctactatcgagctctatcacccagactgtagctctatgctttttgccgtgattgattgccaggag

SEQ ID NO: 49888 - DNA, 515 bp, Heterodera glycines
  SCN-specific regions: Sequence locations=1-49,145-145,169-186,245 -260,302-315,350-350,374-515
caaacttttttgcaattttatatcttattttatattcttcatttttattggcttatcaaatgcttccgtctaatcctgacgacaaaatagatgaggtcgacaagattctttcaaaacttgatggaaaaattgaacgtaaaatgggccctttgatgtgtcgccataacccaagacagaaatgcacaaattgtctcccattggacccctacgatgaaagatttctgcatgaaaaggacatcaaacatttgtcttttcatgctcatgtgcacaaattgaccgatttgcatggccgagggacgcgctcaaacaatgtgctggagaatgtgtgctgcaaactgcgcccgaactgcgcgggtggccatttgccatacccaaaaggcatttgcacgcgttgccgcccctcaacattgacactcaacagacagccatttcgtcacgtggacaacatcgaatttgccaattcgcacattgtcaacaatttcctcaacttttggcgtcgttcgtccttccaacgc

SEQ ID NO: 49889 - DNA, 458 bp, Heterodera glycines
  SCN-specific regions: Sequence locations=1-186,225-353,375-434
atcgattcaccagctctcttcaacaaaaccttcgcctctccacatttcgacgacaaaatgcctccaaaaccatccggcaaaggagcgaagaaggcggtcaagtcgaccaaggcggtgcgcacgggagacaaaaagcggagaaaggcccgcaaggagtcttactcggtgtacatctaccgtgtgctcaagcaggtccacccggacaccggcatttcctccaaagcgatgtccatcatgaactcgtaaggcccaatttggcgtttttccgtcccaagattctcaattttcccatttttaaggtttgtcaatgacgtgttcgagcgcattgcggcggagcctcgcgattggcccattacaacaagcggtccaccatctcatcgcgcgaaattcagacggctgtccgactgattctgcccggcgagttggccaagcgtgccgtgtccgaggggaccaaggcg

SEQ ID NO: 49890 - DNA, 394 bp, Heterodera glycines
  SCN-specific regions: Sequence locations=1-394
tggcaaacagtcgaacactctcagctacgccttgcgctacattcagcccacttggatattttcgggaactcttgcgccaaccgaactccatttgtgttactaccacaaacagagtgaacacttgcagttcggcgttgaatttgaggcgaatttcaagcttcaggaggtgaacacgaccttcgcctatcaaattgagttgcccttctcgctggcgatcagtggcgtgctcgatcacgtcaaagcgcagggaaagttcggcatcggactgctcattggctgattggcgactgatgaggggagaagcggcgaatgttcgcaattgttagcttctgccaatttacattttacaccattttttgctggccgaccattttctgttgtgtcgccgttgttt

SEQ ID NO: 49891 - DNA, 531 bp, Heterodera glycines
  SCN-specific regions: Sequence locations=1-33,55-531
ttgaaaatttatacggaaattttgatggatttcaatggcgcagaaagacactgccaaacttattacgatgaaagaaatgcatcgactcgcaacattttcttcgaccttttccattattatataaaaggcgaaatgcctcaaaaagaggtcattcaagctgaaagtgattacgaaattcggcgcaaaccaaacatttcggaggcgctgaagttgttcaaaaggcatccgaccaaaatagacacagtgggcgcttttgctctcattccgccgacaactgcattcaacagaatttgcgaagcggttaaagctttgtttgggtctctgaacaatcaattggcctcaaccaatttgattgtctctttcacaaatttggtgattagaagaacaaagaatcgcctggacgaattgaagcggcaacgcatttcgatcaccgagaatgtggaatgctcaatttgtagaaaaaggatcatgaacagtgcctccgtcagaaaccgcggacattccttcgctcactttttctgctacaaaaac

SEQ ID NO: 49892 - DNA, 528 bp, Heterodera glycines
  misc_feature (512)..(512): n is a, c, g, or t
  SCN-specific regions: Sequence locations=1-528
aggaaggcagccgtaaagagaccaaatcccttaaagaggtgctgcaaaagtttcgtcatgccaaagaaacgcgtaaacgcaagaaaaatttggaccaggccaagaaggtcattgtcactgcacagcgcaagaaggaagagaagcgactgcccaaagacatgaagcaatgcaacatggaagccatcaatgccatctacgaccctcagagttttgtggaccgtctcttcacgacgctggagggtcgtcagcggaacgagaaatacgcgattagacttctccaaattgcactgtgtgctcgagtgattggtgttcatcaactacaaacgcttggtttttactcatatttgcatcgctatatacgaccaaaacagaaggaggtgacacgcattttgctatacgccgcgcaggcgtgccacccattggtgccgtcggatgtcattgaacaattgattcgagtggttgcacaaaattttgtttccgaccgcaacacaccggaggcaatcactgtcggnctgaatacaattcgtg

SEQ ID NO: 49893 - DNA, 536 bp, Heterodera glycines
  SCN-specific regions: Sequence locations=1-62,84-536
gagtaattgggccgcggtgtgacaaatgcgagcctaaatatttctgagacccgaaaaacggcggcacctgcacatatgaacttgccattgacttcatcttcacttttaagctggacagcaatgacattcgggacaaatacgttaatcagatcaactttttcagcgtgccttacaaacgtgacacggacgttcaattctcgatcacatgcgaatgcgacaccggcgcaaaagtgaccattaacctgaccactcagttgctcgaaggccgtccgcctcacacaaagcatttgatggccggtcagttgtgcacggcttcagggataaagcgcacttacagctcaacagatcccggatttgcattcggaacagaaacaaatacgacttttcacgttcgggttaatgatttcgagacaccaattaagatccaaatttcatttgcacaatcattgccaatcaattggattttgttttttgttatttttgtagcctgattcattgttcttctcgatgctgcgggattgatatggatatcaaaa

SEQ ID NO: 49894 - DNA, 542 bp, Heterodera glycines
  SCN-specific regions: Sequence locations=1-127,149-542
tgacatttacaatggttgaaccaaaaattccaacaacaagcgattttaacgaagaaaaccctgtaaaatcgacgccagaatcacattcgttaatcaagaatggattttttatgagtgaagaatatgggatgacaacgaaaagtgtctacacttcacaaatttcacaatctgtgataaaagctggactttattctaagaaaaatctgggagtgcatgtttctgcggcgggtagtctggaaaatgctatttggaatgcaattgaaatgggttgtcgttcatttgcgttgtttgtccggaatcagcgtcgttggaatgcaaagcctatggatgagtcagttgttgagcggtggaattgtgcaattaaaaagacaaaattcccgttgcaccaaatcgtcccacatggctcgtatttgctgaatgccgggtcacccgaccaaaaaaaattggagatgacacggaaagcgatgctggacgaatgtcagcggtgtgaaaggctgggaattcaattttacaatttccatcccggcttcacaactggaaag

SEQ ID NO: 49895 - DNA, 534 bp, Heterodera glycines
  SCN-specific regions: Sequence locations=1-196,218-309,333-363,390-534
aaagccaattatttcactcgcattatttcgctttacgaagaatacccaaaatgtcttttggtcggtgtcgacaatgttgggtcgaaacaaatgcaggaaattcgcggggcaatgcgagggcatggtgaaatattgatgggaaagaacacaatgattcgcaaagccatccgtggaaatcttcaaaaattcccgttgcttgagaagctgttgccttacattgtcggcaacgtcggattcgttttcaccaacgaggatttgggtgatgtgcgcaaaaaactgttggagaacaaacgaggcgcgcctgcaaaggctggtgccattgcgccatgtgacgtgcgattgccgcctcaaaacagtggaatgggtccagagaagacgtccttcttccaagccttgcaaattccgaccaaaatttcgcgtggtaccatcgaaattctcaacgaggtccatctgatcaagactggggagaaagtcggcgcttccgagtcagccttgcttaacatgttgggcattcaaccgttttcctacggactg

SEQ ID NO: 49896 - DNA, 351 bp, Heterodera glycines
  SCN-specific regions: Sequence locations=1-268,295-351
caaatcatctgccaaatccagaaagaagaccagaaaggaaactttcaacacttatatctacaaagtattgaaacaagtgcacccagataccggtgtttccaacaaagccatgtcgatcatgaactctttcgttgcagatatttttgaaagagttgctgaagaagcttccaagctagcaacttacaacaagagatccaccatctcttcccgtgaaatccaaaccgctgttcgtttgattcttcctggtgaattggctaaacacgcagtatctgaaggaaccaaagccgttaccaaataccagtcttcttaatgtgttctttaacataatataactttaatacacataaaaaa

SEQ ID NO: 49897 - DNA, 518 bp, Heterodera glycines
  SCN-specific regions: Sequence locations=1-332,356-518
aaataaatgaactgtataaatgttcgacttcggttgcagagcgtttcttttccacttatggtctgttctcgaccaatttgtctcattgtcaggcattgaccaaatttttgcccgagtccaattgttgcattggaaatgagaaaagcggcaccacatcggacaacttaaaaaccccagatttcgttagtgaaaacagcacaactgtccgtttatatttggagggaattcgtgacaagctcagaccaaatattgaatccgatgttgaggctgccgatgaccatggcgatgagcgtgaagcggaagggacaagcggaacgactaagattgcggacaatgatgtgaaaaaagatgcatttccgatcccggatttatgtcctccaccaccgccatcgatgtttggaaagatagccgttgcgggcaatgagaaggaggcactgaccaacatgcttatgtcgtggtacatgtccggataccacaccggcttctaccagggtgttatgcatgaaaagacgacccgt

SEQ ID NO: 49898 - DNA, 500 bp, Heterodera glycines
  SCN-specific regions: Sequence locations=1-55,77-500
ctttggaattgagctgtgagaaaatgccggcgccggaacgactcccccaattttgggttgacaataaattggcattgttggaattcatccgtttggcacacattggcatcaaaggaatggtcagcgatgcacgtaacggtgaaccaattgcaaatgccgtggtgtgggtgagaaatgtgaccgacggagacggacaaacggccatcaaacacccggtgaccacgtggatcactggcgattatttccgtccgttggtctccggctgttaccaaatcgcggtggaagcggacggttatgaaattggcatcaaaacgctgaacatcagtcagaaggacgtgaaggaagtgcccactctgatgctgatcaaggaggcgctcattgtggagaagtgctgacgacgacggcaagcgatatacgagaaatgcgcgcgatattattattataacttttttgttttaatatgatatggtgacacaatgtccagttactattacatattg

SEQ ID NO: 49899 - DNA, 420 bp, Heterodera glycines
  SCN-specific regions: Sequence locations=1-420
gacgggcgactctttggtcacaatccgaggccgtaaagaatttgtcgagggagcgaaggctcgaattgaagcaattgtggaagacttggaggcccagacgcaaatccaaattgatgtcgacccaaaacatcaccggcacttcatcatccgtggcgcggaagttctcaagaatattcaaaaggaattcgattgccaaatttcgttcccgaagcaagagacaggcgactctttagtcacaatccgaggccgcaaggaattagtcgaaggagcgaaggctcgaattgaagcagattcaaaaggaatttaaatgtcaaatttcgtttccgaaacaagagacgggcgactctttggtcacagtccgaggccgtgttgataacgtcgaacgggccaaatcccgcattgaggagatcatcgaagaat

SEQ ID NO: 49900 - DNA, 511 bp, Heterodera glycines
  SCN-specific regions: Sequence locations=1-132,166-369,391-511
aatcggagaaaagtcggaaagcggaaaaatggcggacattgaagcggcaccggcaccaaaatcggatgaggaagccaaacggcaggcattggccgccaaaaaggcggaagtgcgcaaacggttggaagaagcagggaaaaagggcaagaagaagaagggtttcctgacgccggagcgcaagaagaagctgaggaaactgttgatgatcaaagcagcggagaacctgaggaaccagcagaaacagcttgactcggaacgccaaaatgtgctgagcaagcgaattccgcaatgtccgaatatcgacgcaattgaggacaaaggacagctggagaagatgtacaacgacctgttccagcaaatgctcaagttggaggaggagaagtacgacatcaacttcgtggtctcgcaaaaggacgcggagatcagcgaaataaccatttctgtgaatgatttgcgtggaaaatttgtgaaaccaacgctgaaagaagtgtcccaatatgacaacaaattc

SEQ ID NO: 49901 - DNA, 550 bp, Heterodera glycines
  SCN-specific regions: Sequence locations=1-505,527-550
ttctttgcacgagcaatatgttaacctgaaggaagtcactcgtgttgattatatttcatacctttcgaagttcgaccatctccacgaactttccagagaaaaaacgaagaagacgggtgcctacaaaacatatgtcctttctctggaggaatatctgagggatttcatttcccgggccaagccactcattgacattgttatggaattggatcgtgtggacaaagattttgaagaaaaattgaaggaaggcaaagtgattgggtggtccaacgaaaagccaagcggcgcaatgaaaaagttcgcgcaaccgtccgcagagatcgatgtgtccaacttcaacagccccgaggaattggaggaattaggcgccgaccgactcaaagcggcgttaatcgcactcggactcaaatgcggagggactgtgaaagaaagggctttccgtttattttccaccagaagctccgatggttcaaatgctgtcaatggaaatggaaaactcaccgctgaagacacaaaagaagagaatcggaagtacactcttgccaaggca

SEQ ID NO: 49902 - DNA, 436 bp, Heterodera glycines
  SCN-specific regions: Sequence locations=1-230,260-436
ggaacagcaagcgaatagaattttgcgctgcattaagcggggagcattgatcagacaagcaaaaggtcgcgcacttcaattggcggtttccagcgacgaagcaatcgtttgctgtgtgggttccgactcaatgttggacatttacaggcatttcactgttgaagaaagcaaaaaacggtaccaaaagaaactgcggaaactccgactaagggcggactcgcaaccaacggaaagtgagaaagaaacaaatgaagcaatggaaagtgaagtatcgcgtgatgtcactactctgatcaccagaatcggggattttagagccgatgccaagctgaaatgggtcgatttatgtgaagagtttgatgacgcttcccttcacttttgtgccggacctttttgaaggaaatgggcaaatgcgtgcgttccaattacaaatccg

SEQ ID NO: 49903 - DNA, 403 bp, Heterodera glycines
  SCN-specific regions: Sequence locations=1-167,189-365,387-403
gttcaccaaattgttgtacgtcgccaacgtgttcctgcaatttgtcattctgaatgccctccttggccctcagtacactttctggggcattggaattctctctgacatttggaacggaagagaatggagcgagtaaaaaccgaaagctttgcgattcgcaaacaaataaaaaggtccggccatttccctcgcgtcacaatgtgcgatttcaatgtgcgcgtcctcggcaacattcaccggtggactgtccaatgcgtgctgatgataaacatgttcaacgagaagatcttcctcttcttctggtgggtctgccgttgttcggcactctttcgtccttccgtttaggttttggttcatttttgtcggccttctctctctgctcagccttttttactgggcattc

SEQ ID NO: 49904 - DNA, 465 bp, Heterodera glycines
  SCN-specific regions: Sequence locations=1-49,72-465
tgcagccggccaaccccatttacctcagttttatgtgcggaaaccccgctggggtggccgtccacgagacaatgcacgccctgggcttccaacacgagcagctccgcttcgaccgcgaccagttcatcaccatccaatgggaaaatgtgaatccgcagcagttggacttcttcaccatgtcggacgttaccaaattctcaagctacggaatcaaatacgactacggctccatcatgcaatatgcgagcacaattgcttcaagtgccccgggcaaaaagacaatggtggccaaattgaagccgaccgaaaatgaacggctaatgggacagcgggaaggactgtccctttcggacgtggaagcggtgaagaaaatgtactgccaaccgagttgtgacgacaaaataatcttttgtggcatttgggcgacgatgaatttgtgtgagttcagttgaaaatgattatctc

SEQ ID NO: 49905 - DNA, 453 bp, Heterodera glycines
  SCN-specific regions: Sequence locations=1-453
gagttttgagcgttgcgacccatcggttcgacttttcgatgtgactgataatgcaacaaattcaagaataggctttttgtacgtcgacattttttcacgcgaaactaagaaaatcggccgtggtcaatggctctctatgcttggaaggcctcctaatcaactccgtgacttggacgctttggtttattttttgggtgcccatccccactccgaaaatgaacacgaatcgttcctccatcatgaagaattgagtgaaatgctgtccgcttttggccgtgctcttcaacttttactctcccgggctccgtgccatttcctttcgcttccattggctccttattacgcttcggacttcgacgcaaatgattttatgcctgcttttatgaagttttgcatatacaagccaagatttcttggacttttgagtagtccgaattcgcaaaatggacaaca

SEQ ID NO: 49906 - DNA, 557 bp, Heterodera glycines
  SCN-specific regions: Sequence locations=1-45,74-557
tttggggggttaatctgctgattggcacggacacgggtctgatgctgttggacagaagtggccaaggcaaagtttaccatctgatcactcgccgtcgctttgaccaaatgtccgtcatggagggacagaacattttggtgacaatcagcggaaagaaacggcgcgtccgcgtttattacctctcgtggctgaagcaaaagattctgcggactgaagggttgcaacagacggagaaaaggaacggatggacaaatgtcggcgaattccaatgcgccactcatttcaaaatcgtgcgctatgagcgcatcaaatttttggtgattggcattgaggactccatttccatttacgcgtgggcacccaaaccttacaacagattcatggccttcaagagttttggccaattgtcccatgcgccggtaatcgtcgatttgaccatcgaagagaacgcgcgtctgaaggtgctttacggcagccttgccggcttccacgccatcgacttggactcggcgtccatttacgacatttactcgcctcacagagcacaatgtggccag

SEQ ID NO: 49907 - DNA, 268 bp, Heterodera glycines
  SCN-specific regions: Sequence locations=1-146,168-268
gaagggctaccaccatacgacggaaatcgactccacgatccacccccttggaaatccacgctcaacttccaactgcaatagatacccaatgaccaacttcgacatctctgagaaaaacattaacccaacgactaatttcccccactatgggctgtacaagcatgacattccgatgatccgtgcctggtgcacactaagcaaaaggccttccatcacattgcgcaagactttgatcaagcacaccgcacggttacctctccataagaaa

SEQ ID NO: 49908 - DNA, 408 bp, Heterodera glycines
  misc_feature (381)..(381): n is a, c, g, or t
  misc_feature (383)..(383): n is a, c, g, or t
  misc_feature (385)..(385): n is a, c, g, or t
  SCN-specific regions: Sequence locations=1-242,274-408
ctgtaccgttcaaacagttcactccattccgtgatcactttggtcactttcttccgatggcgtttctctagacgttcctccgcatcacggaaacgttcgtgctcattgccttgcgggtcgtccttaaagtacgggtcctgctcggcctttgcgtccgccgtcgtctccttctttgcggttttgtcatccggttcttcctcttcgtcgtcatcgccgtactcctcgtcgtagaaaacacaaatgataggggatgaaagaaagaaagaaacgaacgaattgtattgggtgtctgttggtcggagcatttactttcttcctgcgcttaaacgacagagggaacggacgaacagaagtcggaagaggcgggggggggggaaggancncnaacgggtcggggcgggcggagta

SEQ ID NO: 49909 - DNA, 271 bp, Heterodera glycines
  SCN-specific regions: Sequence locations=1-225,247-271
agacaatcatttgtgggggaaattcaacttgaccggcattcctcctgctccccgaggcgttcctcaaatccaagtcacttttgagatcgatgtcagtggaattttgcacgtgactgccgaggacaagaggactggcaataggaacaagattacgatcaccaatgatcactaccgactggcgccggaagagattgagcgaaggatctattttgccgaaaaccccgcagaggaggacaagaaaaccaaggaactcgtctgagcgaggaacgaa

SEQ ID NO: 49910 - DNA, 396 bp, Heterodera glycines
  misc_feature (384)..(384): n is a, c, g, or t
  SCN-specific regions: Sequence locations=1-24,47-396
cgtggccagcgtgttcggcctcggcttccccccgttttggggcggtccgttccgtttcgtcgatttgtacggggcgcaaaagttgatcaagcacatggagcgctacgggaacatttactcggccgtgcaattcaaaccgtgccaactgctgtctgactacgccaaagcgggccgcaaattctacccaaaatgagcgtccgaagttggaactgtgacaacaaaagaattgggatgaatgagttcgttaaatgatcgatgatatatgctgccttttatttcaatgtttatagcgcaggacagatcagaaatttgtatttaataattatttcattagatcatttctggcgttttgacaccaaataaatttttcggtcctcaaaaaanaaaaaaaaaaaa

SEQ ID NO: 49911 - DNA, 383 bp, Heterodera glycines
  SCN-specific regions: Sequence locations=23-41,67-85,115-383
gaagatccaagacaaggagggcgttccgccggatcagcaacggctgatcttcgccggcaaacagctcgaggacggacgaacgttggccgactacaacatacagaaggagtccacgctccacttggtcctccgtctccggggcggaaatgggaagagaagcacgggtaagaacaagacaagcaacaaaaagcttgatcagaattgatcagcagcgaacgcaccatcacatgattgattggcacagtgagtttccaccaccaaattcacaacacttttcccttttccgggttatctttgatttccattttcggttattgttttctgtttttctcctctatcttttgtaaaattctgttattttgatccttagttttatcatttat

SEQ ID NO: 49912 - DNA, 481 bp, Heterodera glycines
  SCN-specific regions: Sequence locations=1-481
ggcccagttgaactcacaaaactgtccctatttaatgggaaaaccaaaaatttttttcatccaagcgtgccgtggagaaatcaaagactttggagtgctccgtgcgttgccaattggcacggactgtgccgacggcgcggtctcttcaaaagcggcggcgtccaacaacagcaaaaggggcccactgagcatgttctcgcgcaacagttcaccacggaacagtttggcggcatctatccaaattccgttacatctgcgaaatgagggcgaatgttcagcaaatttgacatccaaggaaatatttcaaaaagatcccacaaatgctgacctttttggtggtccattcgaccaccccccattatgtgtcgtggcggaacagtgcaaacggcgcttggttcgtgcagagtttgtgcaaagtgttcagtgaaatggccccgaagcattgtgaaattcttgaaatgctaacgacagttaattatga

SEQ ID NO: 49913 - DNA, 484 bp, Heterodera glycines
  SCN-specific regions: Sequence locations=1-484
gaaagaggagatggaaagtgcgcagcgcgagttggaagtagcacaagggcgaattcggcgcctggaagatcaaatttacgagttgaatgaggcaaaacgattgttggaagaaaaggagcacgagctacaaacattgaacactgaactggcatcagagagagctatgagcgaggaggaacggtcaagactgctcactgaaattgcaatgcaagaatcgcgcgtttccgaaatgcgattcgaagttaagaacaaaacggatgagatgaacaaactgaaggcggaggttgaaagtgggaagacaactgcacacatttacaacccgggcaatggtcatttgccgaccgaattcaatgacccggacgatctgacaaacgcccacattgaattgagtacattccacgagggagacgtcaacaatgtgatgccacagcgtgaattggatcggaccaacttcactgatcaggacatgtcgttgaagacaaac

SEQ ID NO: 49914 - DNA, 475 bp, Heterodera glycines
  SCN-specific regions: Sequence locations=1-475
aaaaattgatacatttttaatggatataaaaaccaaaaagaaccgtcgatatgaaaaaattaaacatttgggtgaagttcgcaaatgtttaccaagcaaaggacattgaaaccgggacgatagttgctgtgaagaagatcaaacttggctcaagacatgaagcgcgcgatggtgttaataggacggcaattcgcgaaatcaaattgttgatggaaatacgccatgacaacataatcacacttttggacgtgattggtcacagaacgagcatccaattggtattcgactttatggagacagatttggagaatgttatcaaggatagtgaaacaattctccagcactcccacattaaaaatatgcttttgcaagtctttttgggccttgaacaccttcatttgctcttcatactccaccgagatctaaagccaaataatttgcttatgaatacttctggtcgcataaaaattgctga

SEQ ID NO: 49915 - DNA, 539 bp, Heterodera glycines
  SCN-specific regions: Sequence locations=1-202,224-229,251-539
ctcatcgttttaagccgttttaaatctgagcaattttgagtttgggcccttaaaaacttatttattttttatgggacaattaaaggaagcgatacccacccaaaatggaaatgtcgacttcatttcttgactctttgcctggattttctgttgtagattttaatggaagtcatgagaaaagaacttgtgttcctggttagtgtaaaaaatttaaaaagttgtgattcgcttttctttaggtgaacaattattttcagtctcaagtggatatcatgcgggaaatggctgttatgaatttcatggttcaatatgtgcttctcttgcaggatttttgcacgtttattcacttagagattcgcaaaacaccgagacaaacattgtcgaagtgagacgcaacattgacgagagaagcaatgtgctgccgtcacagggaaagatagtcactgcaagggtgaatttgaaattttaatatacatagttctaatttcgattttgtattacttagcatatcgatttaccaacaaaaatatgaagagggg

SEQ ID NO: 49916 - DNA, 142 bp, Heterodera glycines
  SCN-specific regions: Sequence locations=1-142
tctgaagaagttggtgtcaactcaagttggaaccaaatgggacaaattgcttctcaagaaatggaacaccatttatagggatcacatcacattgcccgactactagatccacgacggattcaatttcgagctgtactatcaa

SEQ ID NO: 49917 - DNA, 494 bp, Heterodera glycines
  SCN-specific regions: Sequence locations=1-268,295-389,417-421,455-494
gtgatttcatctctgaagttcaaaatgttcgcgaactgttctccgtccacgacaatccctacgaagcagctattggctgttacgcggtcgtaattctaaccgagtgggacgaattcaaagatttggactataatcgaatctacggggacatgaaaaagcctgtatgtccgttcgacggacgccgaattgtcaacgaagagaatctgcgaaacatcggtttccgtgtttttaaggttgggtccgcgtcgaatcagactctcaatttcttcccctaatttttaatataattattgttattgcctatctcgtcatcatttgttatcaatttaaatcaattctttaattaggtaacttaatttgactgtttacttaaatattcctacacattaccaaaaattccagttttaaaatatgaaatcatgcatttggtttattcatttaatttaagaaatggaaacaaaaaatataaatcaaatgtcgctttgcttgttctg

SEQ ID NO: 49918 - DNA, 518 bp, Heterodera glycines
  SCN-specific regions: Sequence locations=1-518
atgtggcgggcaatttgctgatggtcggcaccgcgcacatccattgggaccccgagttttgcgatgtcaaactgattcaggcgatgatgttggtgcatgaattacagaaaatccttgacagaattgctctcaaatatcatctacgcacgcaacaaattccggtgcttgttactggcgactttaattctcttccggagttgggagtgctcgaatttttgagcaaaggagccatttcgaaggaccatccggacctgaagagtttccgcgaggacagctgtttgagttgtttgtcagctgaccatgaggatcagcagaactttacccactcacttcgacttgacagttcggtggacgcgagtcaaatcccgttcacgaactacacgttggacttcaagggaatgatcgattatatttttgcgacccctcaatcgttggctcgtcttggtattctcggccctctcgactcctcttgggtgcagcaaaacaaattcgttggttttccccaacctcatgtgccc

SEQ ID NO: 49919 - DNA, 302 bp, Heterodera glycines
  SCN-specific regions: Sequence locations=1-302
gactgcttccattggccacacatgtcacggaacagtgccattctttgacactgatcggtttgatgacgattggatcgattagccaaagtttgggaagcggagacgaaaatgcggactttgcactgctccgaaagttgcgtgacgcattgcaaacggaactgcggttgtccaccgagttggagttgtccatgggaatgagtgccgactatcaattggcgatcaaatatggcagtacaaatgtgcgcgttggttcaaccatttttggtgtaccaaattataccaaaaaaattggacaccgaaga

SEQ ID NO: 49920 - DNA, 650 bp, Heterodera glycines
  SCN-specific regions: Sequence locations=1-24,131-131,164-166,272-650
gtcgcgggtgtgtggcgatcgtcaaatatttgacatttaacaaagatggctctgcgatcaacaaatatcgggtgcacccatttgttacggaatcgtaccgaaaaatcatggaatccggcgattttgagcagttgatcatggaacagggatggttggactcggccgtccaatggaactccacaatccttgcccattgggctgaccaaagtttggctgaactgctcgacaaaagcttttcaaggcttcaaacgccaaaattgcgttgggaatcgatgaaactccgatttgatgacgcaacgccaatcaatgcgcgagggatcaaattgccaccgacaccttccgatgaagcgagaccatttttcatttcattggtcatgacatttgcttatccgcaactccacgcacaagtcactgctgggctcaaccatttgctgaaatcgcccttctctgttcatccagaaaatggaaatgttaccattccattgagtaccaaagaaatccatacctgtgatcccaatgtagtgccacaaattaatgaattattaacacaccttagctcattacaatcctaccgagaaaacaaagaaaatcatcgttcaattatctatgcgcaaactttattagcttcacacattactagatttgaacaa

SEQ ID NO: 49921 - DNA, 510 bp, Heterodera glycines
  SCN-specific regions: Sequence locations=1-175,217-471
acatcgccgatcagctgctggcattcagcgacgcgcacatcgctttggtgttgaaccgtcctgagaaaaacgaaaaactgagcgaattggccacggaacactcggagaatgtttcacagtttgacagtttcggtaccggcgacaatgcgcggatacgcgtctgctgggcaaatcgttgtgcgatggcattgtggcatttcaaatgggccaattcgaacgcacattcgacttggtctatccgatccgaacgcaattgtacaaaatcagtgggagcaatgcgcagcgagacattttcacccaaatgcttcttcacgcggcacttcgctgcgcggacaatgagagacggtcaaaagcgactgtcttaattgaggaaaggaacaaaatgaagccgaattcggcggtcattgaacgattgcttcaaaagcataagcaaacagcgcacaacaattgttgaattgacacattttcagcaaattataaaataaatcttttaaaaaaaaaaaaaaaaaa

SEQ ID NO: 49922 - DNA, 434 bp, Heterodera glycines
  SCN-specific regions: Sequence locations=1-135,157-434
ctcccaaaatgtattctcacgcgacccccggtggcattgggtttcaagtggtggcacagcaagccaccaaattcaatgaccaatagggcaagctgatcctgcactgggtcaaaaagctaactggtgaaaactttagcacggatgggagccgagagaattcctataaatcggtgaacgatggtactttgttgtgcaaattgaccaacggcattcaccccggatcggtcaagaaaattcaacaaccgaccggcaatttcgcctgtatggaaaacatcaacgcttttgtgtcatttgccaaggcccaaggagtgccaacggaggaaacttttcagagtgtcgacttgttcgaggctcgcgacctgtactccgttagtggcactgtgctctcattgggacgaatcttggaaacgaagggcaagccaaagccgttctct

SEQ ID NO: 49923 - DNA, 534 bp, Heterodera glycines
  misc_feature (151)..(152): n is a, c, g, or t
  misc_feature (528)..(528): n is a, c, g, or t
  SCN-specific regions: Sequence locations=1-9,31-167,193-207,231 -252,277-295,321-339,369-534
gcccgtcactcattttcttccctttcctttgtcttccattcattccgcttttccctccccatttctcaattgttcttctccgcttcttctctccccgatgaatcactttgggctgacttttctgttcgtcgccgtttctctgctgctaatnntgcgcccggcttcgatggcatgcaaattttcgtgaagacattgacgggcaaaacgatcactttggaggtggagagctcggacactgtggacaatgtgaagacgaagatccaagacaaggagggcgttccgccggatcagcaacggctgatcttcgccggcaaacagctcgaggacggacgaacgttggccgactacaacatacagaaggagtccacgctccacttggtcctccgtctccggggcggaaatgggaagagaaacacgggtaagaacaagaaaagcaataaaaagcttgatcagaattgatcagcagcgaacgcaccatcacatgattgattggcacagtgattttccaccaccaaattcacaacactnttctct

SEQ ID NO: 49924 - DNA, 597 bp, Heterodera glycines
  SCN-specific regions: Sequence locations=1-46,69-144,166-597
taatcctccaatccgtctccattcatttccaaattattcaaatccgataaaatataatacacaaaaatggaatattttccttctaaatttgtttgctgcttgctcattgcattgatcgctgttccgtgctctgttttggcactttctgatagcagccgcgtagcggtgctcgccttacacaacaattaccgctcacaactggccaaaggcactgcagcaaatttgaccggcacaatgccggcaggcagcaatctaattcaacaaaaatataatacgagcattgagtcggtagcgcagaattgggccaacggatgctcaatgtcccactcgagttcatcagggatgggagagaatttgtacatgaccagttcgtcgacaatttcggaagctgatgcgctgaaacaagcttgcgacatgtggtgggcggagctgaagcagtacggcttccagtcgagtcttgtgctggacatggatcagttcaacaagggcatcggacattggagccagcaagcgtgggccaacactgctcaaattggctgtgccatggcacgctgtccctcctcgacctggaagacatgggttgtgtgccactacaag

SEQ ID NO: 49925 - DNA, 310 bp, Heterodera glycines
  SCN-specific regions: Sequence locations=1-310
gggcgacattactgaagagcagaaaaaagttgctgaggcggccgtactcagtgagcaggttgccgaaaagggctccaaacaatcgcgttctgaaaagaaggctcgtaaactattcagcaaacttggcctcaagcaagtgcacggcgtttctcgcgtatgcatgcgcaatttgaagagcattacgttcgtcatcaacatgccggacgtgtacaaaattccaggctccaacacatacgtcgtttttggcgaggcataaattgaagatttggcgcaacacgctcaaatcactgacgtggagaatatgaaacca

SEQ ID NO: 49926 - DNA, 569 bp, Heterodera glycines
  SCN-specific regions: Sequence locations=1-190,212-569
cttcggtaaatgactactgaaaaagaatcatcgagtggctccgacgatgtgattaatgccagcgaatttgccagtgaggaaaccttttactcgcctcctgcccaaaaatcggtgaaggaaatcatcgaagctgaccataacgacgaaagcctgaaaaaatataaagagcaacttctgggcgagaatgcttcaggcccggtgttggtggagcccgacaaccccaaaaatgtgcttgtaagacgcatttcgctggtttcggacgaccaagtcaagcacagcatggacctccccgcaaagggtgacttcgtcttctgcgtgaaagaaagctgcacctatcggatacgcttcgaattcgttgttcagcgtgaaattatatgcggactcaaatacgcacacaaatgaccaaagagttgtacatgctcggctcctacggtccccggcacgaaccgtacacttacgaaacatcaccggaggaggcgccttcggccggggaaaatatcgagtacattccctcatcaccgacgacgacaaaaacatttggttggattggtcgtggcacatcgaaatcg

SEQ ID NO: 49927 - DNA, 400 bp, Heterodera glycines
  SCN-specific regions: Sequence locations=1-400
cgacgtcgaccaacaatacattgtgccctcagtgacctcctttacaaaaacaattggcactatcccatcgccctactgggtggccatggacagctcgggcacatacacaaaggtgccacctaccaatccctactggtatcacgcgcgcccgtcatccctgcctccacctatgaacatccgatcaccgtccagtgactgctcgtgacctaacgagtatggtggaaaaaatcgccgcagattcgcacccatgcactacaccaaggcgtacggggcagtgattcataaggcattgcactcgttggaggaaatcaaatgggtggagaaagacggaggcactggtggacgcaaactgaccaaacagggccagaaggatctggaccgcattgcgtcacagctgcgt

SEQ ID NO: 49928 - DNA, 472 bp, Heterodera glycines
  SCN-specific regions: Sequence locations=1-196,218-472
tccattgggcaggcctttgtccaacacttttacaccaaatttgatgtgcccgatggtccgactcgcaccgtcggccttcatgatttgtatgatgctgaacactcttttatgacttttgaggggaaccaagtgaaaggtcgacaggccattttggacaaatatggagcgctacctttccgaacgattcaacatgggattacaaaggttttctccaaattagtcttttgcctttcattcttttcggtttggaaatttattaaccaataaaacttcagactgacagtcagccgcttccggatgggtcaattttggtgacggtgattggtcagcttaagaccgacgatgacccagtgaattcattcaaccactgcttcattctgagaccaaattcttgcgggggatttttcatttcgaatgaagtgttccgtcttgttttgcattgaagtgctgaagccgttctctcgtggacatt

SEQ ID NO: 49929 - DNA, 699 bp, Heterodera glycines
  SCN-specific regions: Sequence locations=1-699
gcaaatcgcacagctcgagacgcacataccataaaaggcacaaatcctcaatatttaattgaaaagatcatccggactcgcatctacgattctctttactggaaggaacagtgttttggactctcagctgaaacagtcgtcgaccgtgccactgaattgcgttacattggtggaatatatgctgggaacataaagccggctcagtttctctgtcttacactcaaattgctccaattgcaacccgacaaagacataataattgaatttataagacaagacgacttcaagtatgtccgtgctttgggtgccatgtatatccgtttggtatttaattccgtcgaagtcttcaaatacttggaaccgctgtacaacgattaccgaaaactgcgttacatgaacagaatgggaaaattcgagttgctatacatggatgaatttgtcgacaatttgttaagagaagaccattattgtaatatacagctgcctcgtctacagaaactgcaagcactcgaagaataggaccaactcgagttgtacgctttcgccttggacgaagacttagagcgtctctccaccgactccgaagatgagcaggagacgcgtaacagcactccaaatatcggttctctgcgccgaagtctcttgcgcatccgtggccgaattctgagcaaatccagagaacggatacgccgatcactt

SEQ ID NO: 49930 - DNA, 193 bp, Heterodera glycines
  SCN-specific regions: Sequence locations=1-76,98-193
ccttcgtggtggaaaggtccacggatcattggcgcgtgcagggaaagttcgtgctcaaacacctagagaggagaaacaagaaaacaagactaagaagcgtggccgtgccttgcgtgacattcattacaaacgtagtgacgtcaacgtcgctgcaacaggaccgggccgacgacgtgggccaaactccaatgct

SEQ ID NO: 49931 - DNA, 519 bp, Heterodera glycines
  SCN-specific regions: Sequence locations=1-519
agaaatggcttttgtaaattctttatcgtccaacactaaaacaattcactttttgaagaagtctttacttcttgcacacaattattgcactttttcgcgcgaatggtctgagatggaatatgaaaggcgcgctgaggacactttggtggcactcactgagtatttggacacattgccggaccgtgtcgattgtgaatctgtaagcatttaatcagagacattttgatgtaaaataaaggccttcgatgtttcatattcaatgggcgttttgaccgcgcacataagcccacgaataggcacttatgtgatcaataaacaaactccgaacaaacaaatttggctttcatcgccagtttctggtccaaaaaggtacgacctcagcgacaaaggccggtgggtgtataagcatgatggagttacgctacgcgaattgctcgagaaagaatttagacacattttcaaaaacgatcaaatttcgttacatcagagttaaagatttatcgttttttataccgatat

SEQ ID NO: 49932 - DNA, 295 bp, Heterodera glycines
  SCN-specific regions: Sequence locations=1-295
gtcgccacatcatgaccgcgccgatgtctgaatgaatggcccaagatacaccgagtgcattctacgcacactcccgattgatgactaggtgactgtcacccgaggccactacagaggcaatgccggccgactgatgcttgtgtgtcggaagaaagatgtatagcacgttgacaaaatcactcgggacaaggccatcactaacaaccgcgccctcggaattcatacttgaagtgtgcagatcacagatgtgaagatggacaaggaccgacgttcattgctcgagaggcaagcggca

SEQ ID NO: 49933 - DNA, 525 bp, Heterodera glycines
  SCN-specific regions: Sequence locations=1-525
cctcgatggtgacgtcatttcctgtgtcattttttctgtttttttctacggctctaatccacggcacaatgggaggccttttctggtcgaaaaagccggcggattcagcggacgattcgctgtggagccgataccatgatcaaaatgcaatggaagagttgttggagaaggtgcacagcaaatgccccaatgtcgctcgtctgtacagcgtcggccgatcagtccaaggccgcgatttggcggtcattgaattttccctccatcccggacggcatcaaattttgaagcccgaaatgaaatacatcggaaatatgcacggcaacgaggcgatcggcaggaaattggcatcaaaacgctgaacatcagtcagaaggacgtgaaggaacgacgtccacacattgtgaacttccaattgcgtccgatcgaagttgaagtgccggaggcgcgaattggaagagaaatgggcgaggaagaacggggggaggaggagaacggaccactgacaccagaacaagcagccgaatt

SEQ ID NO: 49934 - DNA, 488 bp, Heterodera glycines
  SCN-specific regions: Sequence locations=1-93,118-154,176-488
aacttcattgtatttgattgacaacatgtgcgatgctaaaatggaaattgaggagagtgcgacgtctacttctgttgcttaattatcagcgattaagaagcgttttgaagtcaaaaaatggaacgcagttgcactttgggcatgggacattgttgttgatacatgtgccatctgccgtaaccacataatggatttgtgcatcgagtgtcaggcaaatcaggcttcttcaaccaatgaggagtgtactgttgcttggggcgtgtgcaaccacgctttccatttccattgcatttcgcgttggcttcgtactcgtcaggtttgtccgttggacaatcgcgactgggagttccaaagatatggacattgagttgccttgcggttattgcacacggctgaatatttgggatcacgatcattatttaaatatgtgttttgttaggtacttgacaaaatcatgactttgttttttctatgaaagtattaaaaag

SEQ ID NO: 49935 - DNA, 232 bp, Heterodera glycines
  SCN-specific regions: Sequence locations=1-232
tgcgggaagcgctagattgattgtcccgagaaatgttcgtcgtcttctcgatgatttcggctcagaccacgcttttattcgattggaggttgtgtacgtggatcaggcgactgggcgaatgattcccggcaaaacgacgaagtactccatttgtggaaagctgcgcttcatgggcgagacggatgattgcattctgagcttggctgaaagggatggaataattccaccagat

SEQ ID NO: 49936 - DNA, 511 bp, Heterodera glycines
  misc_feature (489)..(489): n is a, c, g, or t
  SCN-specific regions: Sequence locations=1-411,433-511
atgcaacaattgtctaaaaagtcggcttgggtttccaaagtttcgggcgagttgctgttggccaaagtgaagcaaatcaccaccatcggactgcagagggacacctgtgtcaaagtcaaaatctccaaaaacaatttctacgaatacaaccgaatgttcttcatgagttctgcctatgaatggtcgctcgaccccgagtccaaatgcagggtgggcgacgttgtgttgatcagacgcctctcagagatccacagaccatcaaaaactgtccagtacgctgtggaaaaggttgtgttccaacatggcaatttcattgatcccgtgacaaagagacgcgtgtttggtgccaaagaatttgagaaggaagtcgaattgcgcaaggatctcgtcgacaaaatatacagcgagccattgggggaggaggacgaaggcattaagaatgatgatcagctgaagcggaacaaaatccgacggaggatggaggagcanagggaaaggagggcaaacgacg

SEQ ID NO: 49937 - DNA, 562 bp, Heterodera glycines
  SCN-specific regions: Sequence locations=1-37,60-151,175-363,393-562
gtttgacaacaaataagaactcgtccagcggtttaagttggctgagcaagctgagcgctgggatgacatggctcagtcgatgaaaaaggtgacggaattgggtgcggagttgagtaatgaggagcgcatcctgttgtcggttgcatacaaaaatgtggtcggtgcgcgccgctcctcgtggcgcgttatctcgtgcattgaacaggagactgatggctcggagaagaagcactagatgtgtcaggaatatcgggagaaggttgagcaggagttgcgagacatctgttacgacttgctggatttgctcgacatatatctgatcccgaatgctggctacccggaatcaaaggtgttctacctgatgatgaagggtgactactaccgctacctggtagaggttgtcatcggtgatgatgcgatcgctgttgtcgagacgtattagccgtcattccagtaagcgtgtgacattgccaatgacagattgcagccgactcatgccattacgttttatattgcgctgtacttgtgtgtgttctacttagaagatgtgatttcagcggat

SEQ ID NO: 49938 - DNA, 304 bp, Heterodera glycines
  SCN-specific regions: Sequence locations=1-304
cgttaaaacaaaggaagaagactctaaaaaaacgacaacggacgacggatcgagttcagaggaagaagtgcccgagctcgaagagggcgacgttactgaagagcagaaaaaagttgctgaggcggccggactcagtgagcacgttgccgaaaagggctccaaacaatcgcgttctgaaaagaaggctcgttaactattctgcgaacttggcgctccgcgggtgcacagcgtttcgcgcgtctgcatccgtcaatcgaagagcgttgttgtcgtcatcaaccagccggacgtgtacgagagttcg

SEQ ID NO: 49939 - DNA, 187 bp, Heterodera glycines
  SCN-specific regions: Sequence locations=1-187
tgaccatctgacttatgttcgtgagcaatgcgatcataccgttgcccatttgaagtccattttggaggaatgcaacgagcgcgtgcggaccactcctaagacgactgtaattagtcacatggagatgatcgactacatggagggcctagatcattgtgccaaacggaaggcattcaaagcactgaaa

SEQ ID NO: 49940 - DNA, 283 bp, Heterodera glycines
  SCN-specific regions: Sequence locations=1-283
gattcacaaactctgtcccaacattcgcgtcggtgattctggggaccgcctcactcatgctgcaaaggactgagaacaattgactggtcaaactccggctctgtccaaggctcgtcacactgcgcgctcgctcggaattcatgggagtgaaaaaatcgctgggcattgcacagatcgtggaccaaaagctgatgaaatcattgatcgtgggctcaaagtctgcgaatatgaactctaccgcgagaatttttccgacactgccacttttgggtcccccattcag

SEQ ID NO: 49941 - DNA, 386 bp, Heterodera glycines
  SCN-specific regions: Sequence locations=1-74,111-155,177-386
tgaaaatcgtctagacctatttaatttttcgaaaaatgtctgacaacaaagaagaactcgttcagcgggctaagttggctgagcaagctgagcgctacgatgacatggctcagtcgatgaaaaaggtgacggaattgggtgcggagttgagtaatgaggagcgcaacctgttgtcggttgcatacaaaaatgtggtcggtgcgcgtcgttcctcgtggcgcgttatctcgtccattgaacagaagactgagggctcggagaagaagcaactgatcgggcggacagacgttgaagaccaagaaaatgccccacgaaattttttccaccgaatcatttaatgacaattatgcttttctcaatatggcacttttgattgggtaaatttt

SEQ ID NO: 49942 - DNA, 391 bp, Heterodera glycines
  SCN-specific regions: Sequence locations=1-391
cctttgtatggttttccaaagggtcgcaagccaagagaaatgcaggcttcgtgggaagaattggagaaaatgaaaatgccgattagtgagcgagattattgtgcccataaaatggttgctttgcgcaaatgcgtttgggatagggcgccatttgcctcgcattattgccatggacgtcgacacgatttgggactgtgtctttatgatgatcatttgatgcgtatgaaagaatttgagcgggagaaaaggctccttatgagaaaggcaagaaaggaaagggcaaaggctgcttaagaaactaatgttgatttgctagacaattgtatctttgtggcctctgattaggaatatttccatgtttatgtgtaaaatcattgcttaaaaaaaaaaa

SEQ ID NO: 49943 - DNA, 524 bp, Heterodera glycines
  SCN-specific regions: Sequence locations=1-524
acatttgcgccttaaacagcatgcacaccggttcaaataatagggttggcattcggacggggagtgccgcatcttctgcatcagcgggtgctgtaagtgatgagcagttccgttcgtccttcgaggcggtgccaaatgttcgggtggaatcatttcgcgatttgattgccgaacttcaaaaacaagcggctttgctggagaatgtgaacaacgattggaccaagcgaataaaagcgcttcaaatgttacgtgcccttctcgtgacggacattggctgctatggtgccctcgtggaacagtcctacgccctgctcggcaatgcctttcttttgtccgtcaaagacctgcgctcccaattgtgccgcgaagcttgcattaccatcgcgttattttttgccaatttataaattcgatctgatttcttcaatgatctgggtttaggagaccgcccaaaaagactcgcattttaaaaatttgaaaaaatgtacggaaatatttttgtctgccattaccaattaatcaga

SEQ ID NO: 49944 - DNA, 472 bp, Heterodera glycines
  SCN-specific regions: Sequence locations=1-74,98-472
ggagcatcaaacgcgagcagttttatgtgcgctattatgttggccacaaaggaaagttcggtcatgaatttctcgagttcgaatttcgcccggacggcaagttgcgctacgcgaacaattccaattacaaaaacgacactttgatccgaaaggaatgctatgtgggcaagtcggttatggacgaattgaagcgtatcattgaagattctgagattatgaatgaggatgatgccaattggcccgaacctgaccgagttggacgtcaggaactcgaaatattgagcgggaatgaccacgtgtcattcactaccagcaaaatcggttgtctcgtcgaagtgaacgacagcaaagatccggtgggactgcgctcgttttactatttggcccaggacttgaagtgtttggtgttctcactcatcggactgcacttcaaaatacgaccaattgcgcaatgatggactaattggtgacg

SEQ ID NO: 49945 - DNA, 378 bp, Heterodera glycines
  SCN-specific regions: Sequence locations=1-258,282-378
atttgagggatgtctggtgacaattcggcacttattgcagcggagcaagcggcgtatggcccattttttggctcacttggcgtcactgcggcgatgattttcaccgcggccgggtcggcctatggcacggcaaaatccggtactggcattgcgtgtatggctgtagcaaggcctgacctcgtgatgaaggcgatcattcctggtgctcggtctctacggaatgattgtctcactgctgctaagttcctcctgaacaatggaaggaagaaagaaggaaagaatggcacgtctgctgaacattgtgccgaccgtcgtgttttgatgatcaaaatgaccagccaccgtatataatagataaactagcgggtgcgtaaaaaa

SEQ ID NO: 49946 - DNA, 468 bp, Heterodera glycines
  SCN-specific regions: Sequence locations=1-468
ccgaagaataaagggaaaggaggcaaaaatcgtcgccgagggaggaatgaaaatgatataatgaaacgggaactcgtcgaaaaggacggcgacgaccaagcatatgcccaggtggtgaaaatgttgggcaacggtcggttgacagcattttgttttgacggcaaaaatcgcctgtgccacatacggggcaagttgcgcaaaaaagtgtggatcaacaccggcgacatcattttgatcggcttgcgagggtaccaagatgacaaggcggatgtgaatttaaaatacacgccggacgaggcacgcattctgaagaattcgggtcagttgccggagagcacaaaactgaacgaggtcggcgaggagcaaaatgagggcgaagtggaattcattgacaacggcaaccggtctgacgaggacgaagtggctgcgcaagaccgcaacttttcgctgagcgaaagcagcagcgaa

SEQ ID NO: 49947 - DNA, 219 bp, Heterodera glycines
  SCN-specific regions: Sequence locations=1-219
caaaattcactactgcaagcgtccggacaacagcacaaagtcgtgcaaagctcgtggttcagatcttcgtgtccatttcaagaacacacgtgagacggcgcgtgccatcaattggcacgtggcgaattctgagtgacccgaggacatccccgaaccacactctctttgtgcggcttgttttgttatttggtggcgataaaatttgttgaaccttaaaaa

SEQ ID NO: 49948 - DNA, 500 bp, Heterodera glycines
  SCN-specific regions: Sequence locations=1-500
agacagcactgtgctccaaatcgcggaatgcttttctcttcaaacgcctcgtcagccccgtccaaattgattgccgtccaatcaccggcggtggttttggccatccaatgaccaggcaaaagatgcaaatgtacagcccggaaatgagggcagtcaattaccaacaaaagcgcacccacatgcatgcaattctcaccaagaaaactgttgaagaccgagttatgctcaacttacatttgtttgacaaggtggacaatgacaaattgacgttcgactccgattttttcaaggatcttgggattgattcgcttgactttgttgagtttatcattgcgattgaggacgaatttgagttcgaaattccggacggtgactcggacagaatgcgaacgccacgagatgtttacaattacatttgcgacaagtgcgatgtgtacgattgaatgtatgacaaatgctgccgtcaaaaaattgttctttgttaaagctaggacataaat

SEQ ID NO: 49949 - DNA, 492 bp, Heterodera glycines
  SCN-specific regions: Sequence locations=1-300,322-492
taattatcatcctttccgtcacattcttatttaaagcaatgccgaaaatggattttgacctcttcgatatgttcgcacccattgtggtggcattaattttcgcggcaattctccttattctttccttcacttgcatcaattggtactgtatcacgcaaaaggatgacctcacaatattcgaaaagctcggcgcccgtgccaacctccgtctcggcccccacacaatgatccaaatcaaacggggcgggtacgcgtccacctacgccagagaagaagacgacgaacgccgcaagctgaccatgacaagtcagcagcagcaacggatggagctgttgctggaggaggacaatccaaaaggaacagtcgcgcagatttaactaacaaaagaacacaacgttcagaggcgtattcaaatcttatgtctaatgaagcttccgccctcccccttttttgaagaaattttaagccataaaaatagcgaaagtgttaaaa

SEQ ID NO: 49950 - DNA, 545 bp, Heterodera glycines
  SCN-specific regions: Sequence locations=1-193,215-545
cagtcagtccagagaagaacggcctcgaaaattgcctaaacaaaacaacggcgaaccaaacgaaaatattgtacgaattaatcgaacggaaatgccagaggaatttcaagctgttcttttatctgacaatgttgttcagcaagtaatgaaaagtggccaaaatacgactaatgacctgcggacacgcgaactcgacaaagaactcacaatgcagagagaacggaacaaacaactcacagaacaacttcgaactttggaggagaaacgggccgttgaaagtgcttccgccgctgtttctgcggcggtttctgccgtgaaaaccattgaaacatccgcacgaaattcgaaagaggaggaaattgaggaaaaacgacgcattttcgaagagaccgccaaacgattggaagaaacttttctcagcagacattggcctgatgcatgtgcagacgaacaaaaggaaatcgtcggatgtctcgccaaatttcctggccaagttctttcgtgtcattctcttctggacatttatcggaagtgtatcaacaatt

SEQ ID NO: 49951 - DNA, 604 bp, Heterodera glycines
  SCN-specific regions: Sequence locations=1-464,486-604
acgctgaaacattcaaactttggcgcgtacgtaagactgttatgcaggtagttaatgtgaaggattttggtaaagtgtttgacttgcgtgtctttctgaccaaagaggcgattcgtttgttacataaatttgtctgcagatgtgccacgaccgagggtatttggttacgcaagacgagttggaccaaacgctggaccaattcaaggaccaattcggcgatagacccagcgaacggaggcccggcaggggcgagctgaccattttggtggcacataatgacgaccctactggtgaatcctacagagaaggagctttactaaaatgccgttttctagaccaaatatctgtcaacaaatgcaagaacagaacatcactcgagcgatcattgtggttcaaagtgggatgacaccgagcgcaaaacaggcgattgtggacatggcgcccaaatacattctcgagcactttttggaggcggaactgatgataaacatcactgaacatgagcttgttccggaacacgtggtgatgagcagcgaagaaaaagcggaactgttggcgcgatacaagctcagagataatcaactgccgcgcattcaagtcagtg

SEQ ID NO: 49952 - DNA, 397 bp, Heterodera glycines
  SCN-specific regions: Sequence locations=1-309,331-397
aaatggtgtgtcccccgtcttttgagcgtgctccctccatcatcaacaaacccaacggttcggtgctgttcgagtgcatttggaacgcgaaccccgagccgacggtcaaatggtttttgaaggacaaagaattggcgggcgatcgcttcgtcagcaaagtgaagaagcaagtgggcaagtacttgtgcacactgaccatcaaatctccaaatcagcaagatcaaggcatttacaaggtcgtcgctacgaacccccaggggacgcactccgtctcccaaaattacatgctgatgtgcaccgccaacgaagtgttcaaaacccaaatggactgaaaacggataaatttttacaaaaatttccaacggattttcaaaaataaatactttcagattcaaaa

SEQ ID NO: 49953 - DNA, 472 bp, Heterodera glycines
  SCN-specific regions: Sequence locations=1-472
atcacaaatgagctcatccgctttggtaaagataaagttggatcaggaagtgtgtgctgatgctgagaaattagtgcgcctttacactgaattggcagatgttcaccggaccagaatttcaaaattatattcggcgcatgatcctcaaatcgtatggaacggaaatccttacaaagggatgccagaaattgaaacattttggcggaatttacccgaaacttcgcatgacgtcgcttgtttggatgctcatcgaattgacccaaccagcgatgacatgtcattggtcgtgttggcgatgggcacagtcataatcggcggattgagccacgcctacaatcagtcccttttgctagttcttgaaggaagtacttacaaaatcaaaagtgacaattacagggtgatcgactgaatttaccacattgataatttgttcaaatctctatcaaagcgagtaaagcaaagaatgcaaaaa

SEQ ID NO: 49954 - DNA, 524 bp, Heterodera glycines
  SCN-specific regions: Sequence locations=1-524
aatattatattgaatgcttatattgcaagaattggatccgccgacagaggcggtaatcgaaacggagggtcaagtggtcgctcattgggaaaatcattgccttggccagggaactttatatttgatagagagcgctttggtttggataagccacggcactaaaaatggttttcgtttgcctattccgtcaattgtcgtccatgcagcatccggagccaatgaggacttttccgagccatgcctttttctgatggttgactattcaaagactggacattgaatacgttcccgcggaggtcgacgacattgacgaagagaccgaggaggaccctgaggtcaaaactgtggcagttcgtctcgtcccgacaaatgcaatgcgaatttctgaactgttttctacattgagcaaatgtcatgaactgaatcccgagattgatgaacagatgtcagataatgacagccttctcggtgacgacgagtgcgatgacgacggcgaatgggcgcagaatggaaattccgaccat

SEQ ID NO: 49955 - DNA, 529 bp, Heterodera glycines
  SCN-specific regions: Sequence locations=1-529
aagctgctcattctgcccaaatgaaaaactcgatctttataaatgcccacaatgttcatctttttattgttctcttcggtgttttcgatgtaaaaagcacataaaatgctcagaggatttttaccgcaaggaatgtgaaaagcataacgaattactttcaaatgacccttttgaattaaacccaacagatgacaaacaaaagaaaacgaaagtaatgacttttgaacagtatatggcgcagcaaaatcagaattctggtggcaaaaaagataagagtacggccaatcctcaaatagcagtcagggcggatgaggaaatattattcgattccgacgacgaaccggaatatctctccaaaatgattgcgtcaacgctcgagcaattcaattcgctggatgatcaggaattggacagacgaattctgaatgccggactgccaattggacttggggaagagcaaacggcgaaaggggagaccagtcaagaagagatggaaatactttaccagcaactgatgggcgaggaaaag

SEQ ID NO: 49956 - DNA, 526 bp, Heterodera glycines
  SCN-specific regions: Sequence locations=1-526
cttcaccctttaggtgtttacagacgcccatttgacgactttggacattaacctaatcccggccgaataccgttaattgatccccgaggaggtgaccaaattctaccaccagctgaccgaggatgacaaaaaggcgctgaaggaagtggcagaacgccaccaggaattccaaacggaagatcatgcaatggaagcgctgaaggaaaagagtgagaagctgtacaacaaagcggtcgaactgcgcacccttgtcaagggaaaaattgaccaattggtgcccgactcgaaggcattcgttatcaggatgatcgaaaaggcaaagggaatgcgccctaaggccgtcgagaagccgaagcttgaggagctgcgcacggtggccaacgagctgatcgacaagtacaaagcattgaatgacgataccaaagagtcgctgaagtccaactgtccgcagattacgagcgtcatccataacgagaaattgcaaaccttggccaagagtttgttggaacacgaggcaccggccgcc

SEQ ID NO: 49957 - DNA, 413 bp, Heterodera glycines
  SCN-specific regions: Sequence locations=1-23,45-413
tcggcctaagacggttccaaaagagcagcaccctttttacatcctccaccccgagcctattcgaatctctccgctgctccgatttgctcgttggtcggccctcggcctaggcattgtgtatggtttcgtccgtcttcgtatggtcagcaaataccacgcggacatccgcgaatgggaagtgcaaaagaccatccacaagaaggatgcggataagaaggagtcactgagagtgctgcgtgagcaaaacgaatggattatgaagatcaccgacatgaatttggaggagggaaagtcgcaattgggcgtggagcatttgtacgatttgaaatagaaagcgaagaatcgtctcacaacgacaaattgcgattagggatttctttgtgttatcagtcacagttgacgaacctttcaat

SEQ ID NO: 49958 - DNA, 468 bp, Heterodera glycines
  SCN-specific regions: Sequence locations=1-192,214-301,323-354,378-468
tacaatggagcgtttattgcgattgggaggccttagtggtttgggagcaggttcattgaacgcaacaccacacgattcgaaccaagttgacacttcggaaactgtttacatcagttcattggctttattaaaaatgctaaaacatggacgagctggcgtcccgatggaggttatgggtttaatgctaggtgaatttgttgatgattatacggttaacgtgattgatgtctttgcaatgccgcagtctgggacggttaatttgtttttttttgtctgctttatttgccgataataattgaattttaagggagtttctgttgaggccgtcgatccagtctttctggggtcgatataaacactcagcagagttttgaggcgttgtctgacagagcagttgcttttgtagttgacccaattcaatctgtgaagggaaaggttgtcatcgatgctgttcgcacaattaaccca

SEQ ID NO: 49959 - DNA, 1066 bp, Heterodera glycines
  SCN-specific regions: Sequence locations=1-56,79-309,336-531,555-1066
gtccaattaagcgttaatacacttagaagtgaaatggcttctcgacccttggtctctatttataatgagaaaaatgagccaaccggcaagcaaatcaagcttccggccgttttccgggctccaattcggcctgacattgtgagcttcatccatgaccaaattcgcaaaaacaagcgacaagcgtatgctgtgtcaaccgctgccggtcatcaaacttccgccgaatcgtggggcactggtcgcgcagtggcgcgtattccgcgcgtccgtggcggtggcacccaccgctctggccaaggagcgttcggcaacatgtgtcgtggtggccgtatgttcgcaccgaccaaagtgtaccgtcgttggcaccgccgggttaatgtggcgcaacgtcgttacgccattgtgtccgcaattgccgcttcggcggttcccgcactggtccaagcgcgtggccatgtgattgaccagctcaacgaaattccgctcgtcatttcggacaaaattgagtcgttcacgaagaccaaggaagcggttggctttctccagcgagcgcatttgtgggacgatgttgagaaggtttacaaatcgaaacgcttccgcgccggggaaaggaaagcgacgcaaccgtcggctacaaacagaaattgggcccgctggtcatctacaacaacgacggtggcattgtgcgcgcatttcgcaacgtccccggcgtcacattgctctccgtcagccacctcaacttgttgaagattgcgcccggtggtcacttgggtcgtcttgttgtgtggacagagtccgccttccgccagttggacccactttttggcacatggactcggcagagcaatgtcaagaagggctttacgttgcctcgtgccaagatgaccaattcggactttgcgcgaatcattcgctcggaggaaatcaccaaagtgttgcgaccgacgatggcgcgaaaagtgcgccgggtggccaagattcatggcaacccgctgaagaaaccctcgctgatggccaagctgaacccgtacgccgctgttctgcgccgtgccgcggtgttggcatc

SEQ ID NO: 49960 - DNA, 1432 bp, Heterodera glycines
  SCN-specific regions: Sequence locations=1-195,227-227,262-292,316 -346,382-465,487-506,529-549,576-730,752-945,968-1432
ctccactcatttcacttttcccatctgtccaattcgtccgtttcttcagggccttcttcttccatcggttgttgagcacgaacgtgaactcggcactttgatcggatcgtaagcgcagcagaactcgaacagaagcagcagagaatctgtagctcatccatctcttctcatcttcatcctctacttttgtccttctccccatcgccatgtctgaagaggaatcgcaatattccgacgaagaggttgaggaggaaagcattgccgcggatgaagtgagcgtgcaggaaccggcaccgcccaaagaagaggagccggcgccggaagccgaagcggaggcaccgccggcggaagaaaaggaagaggaggaggaagaagagccggggtcacccggaggggcaggcgatgcgccgaaagaagaatttcgtcgcaccagtgttacggagtccgtcgcgccgacggcgcaacttcgccgcgcgccgccccctcagccgaagccggcagaagaatcgatgacggaggcggaagcggcgatgctggcggtgaagaagcgccacgaggaggaggaggaagccaaaatgcgcgacaatgacgagcgacgccgccaggaactcgctgcagttgaggacgaactgcgcgttttgaaagaacgccaagcggagaggcgagcggagcgcgagaaggaggaggccgaattcgccgaacgacggcggtcaagacgaggaccgacggcggaaggatgaggaggaacgaaaggcacgactcgaagcggagaaagcgaagcgcgacgaggagaagcggaagcgccacctgatgatggccggcggatttggcggatttgtggcggcggacgcggaaggagcaggcaaaaactttgtagttcccgagaaaagcgagaagggcgcacagcagggaatgccgggacagacgagcaaaccgcgaggactgagcaaagagcagcaggaggaggccaaacgcaattacatgtccattgtgaaccgaccggtggacgtgtcgaacatgttgcccaatgacatcaaggcaaatatcaagcagttgcacgcgcgcattgtcaaattggagggtgaaaagtacgacttggagaagcgaaaagatcgccaggaatacgatctgaaagagctcagcgagcgtcagaagcagcacgcgcgcgccaaggccctggagacgggcgcggaccccaccgaagtggaatcgtccggcaatttcccgccaaaggtccgcgtggcttcaagattcgaccgtcagacggacctccgcggatatggtcagagacgcgacttgttcgaacacccggcagaaacaccggagccaaaaattgtgcacggcagcggacgaccgccaccggaatggggccgcaaagaatttgaggaattggagaacatccggaagaatttagaaccaccaaagtacgtgg

SEQ ID NO: 49961 - DNA, 511 bp, Heterodera glycines
  SCN-specific regions: Sequence locations=33-88,110-511
cctcgtgccgaattcggcacgaggcaacatcattgcctccgttgctacttgagcgcctgaagaagcgtgggattgttgcgtcaaagaatgaggacgaggaagtttttgctgagagttatgatcaagatgacgattcgaaattggaaatttcccgtgagaaatatcgcggcggtgcccccggatgtcctaacaagcacaatccgttccacgtctgcacagacttttgctttgaccattggcaggagggctatccggagagtcgactatccgataaatacttggagcagcggaacaaaatgttgcggaattacccactgccgaaggattgggtcgaaatttacgacccagggatgcaccgccattactattggaaccaaatgaccgacgaagtcagttggctctccccaaaacacccaaaggccgtcatttcggaagcggcagcaaaatcggcaaaagaagcatggaacatgagcaaaatcgagcgcagtgaaggcgaaagaggcgggcgaag

SEQ ID NO: 49962 - DNA, 707 bp, Heterodera glycines
  SCN-specific regions: Sequence locations=1-376,398-707
tgagtatcgaaatgaaaaggtctataatgcaaaaagattgtacttcaaaaggtgaaaatgtttctcaactcgataaaagcactagcaaaatggagggaagcaaacctctgcagattgaggaatatgataccagcgacgaagaggatttacgcaacacaattggcaatattccggttcaatggtacaacgactacgaccatgttggatacacattaagtggcgataaaatcaaaaaagatgccattaaaactgacgaaattgacgcgtttttacaaaaagaggaagactcggactattggcgtaaggttttcgaccgtcagtcgggtcagcaaatggcactcactgaccaacaggtggagaaactgaatgccattgcggacaaccggttcccggaaataggttacaatccctaccctcctttcttggacattttctcctccgttcgcgagattcacccaatttccaatcgaccccccgacaaacgctctttcgttccgagtgccgatgaacgtcgaattgtcggccgaatggtccacgccattaaaatgggatggctaaaaaggaaagagccccccaaaggctcagaagaagaggaggagccgaggctttacgacctttgggacgacgagggggacgagcagcggaagagcaaatcgcaaatggcacgcgtccgaatgcatttgccggcaccgaaggtgaaaccaccg

SEQ ID NO: 49963 - DNA, 594 bp, Heterodera glycines
  SCN-specific regions: Sequence locations=1-8,31-145,177-177,212 -296,332-415,437-456,479-499,527-594
aaaaaaatagaaaactaaaaattttcagtttttaacattttttcgtaagggaaacgatgcgcgggaaacgggggggggggggaagcagcagagaatctgtagctcatccatctcttctcatcttcatcctctacttttgtccttctccccatcgccatgtctgaagaggaatcgcaatattccgacgaagaggttgaggaggaaagcattgccgcggatgaagtgagcgtgcaggaaccggcaccgccctaagaagaggagccggcgccggaagccgaagcggaggcaccgccggcggaagaaaaggaagaggaggaggaagaagagccggggtcacccggaggggcaggcgatgcgccgaaagaagaatttcgtcgcaccagtgttacggagtccgtcgcgccgacggcgcaacttcgccgcgcgccgccccctcagccgaagccggcagaagaatcgatgacggaggcggaagcggcgatgctggcggtgaagaagcgccacgaggaggaggaagaagccaatatgcgcgacaatgacgagcgacgccgccaggaactcgctgcagttgaggacgaactgcgcgttttgaaa

SEQ ID NO: 49964 - DNA, 586 bp, Heterodera glycines
  SCN-specific regions: Sequence locations=1-227,289-322,344-368,391 -403,439-522,544-586
gtgcgacgaagaagttgctgctctcttggcggacaatggatcctgaatgtgcaatgccggtttcccggtcgatgacgcaccccgcgcggtgtttccgtccattgtgggccgcccccgtcatcagggcgtcatggtccgtatgggacataaggactcatacgtgggacacgaggcacaatccaaccgcggtattctgactctgaactacccgattgaccactgcatcctcacccactgggacgacatggagaatatctggcaccacaccttctaccacgagctgcgtgtccccccccaagaacaccccgtgcttctccccaaagccccccttaaccccaagggccaccgaaaaaagatgaccccaatcctgttccaaaacttccacacccccgccatttacctggccctcccagccctgctgtccctgtacgccttcgggccgaccaccggtctcctgttggacttccgcgatggtggtacccacaccgggcccctttaccaagggtacccccttgcccacgccctcctccggttggacttgggcggccctgacctcactgactaccctgagaaaatcccccctgag

SEQ ID NO: 49965 - DNA, 1375 bp, Heterodera glycines
  SCN-specific regions: Sequence locations=1-135,177-246,268-289,606 -648,692-699,837-837,1056-1064,1096-1101,1244-1375
gtcgacgacagcacacacagccgaaaagcgcttcttctcatcgccttcgccttcaaaacttagaagcaccaatcccaaccagaaaaaatgtgcgacgaagaagttgctgctctcgtggtggacaatgggtccggaatgtgcaaggccggtttcgcgggcgatgacgcgccccgcgcggtgtttccgtccattgtgggccgcccccgtcatcagggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgcgtgtcgccccccgaggagcacccggtgctgctcacagaggccccgctgaacccgaaggccaacagagaaaagatgacccaaatcatgttcgagacgttcaacacgccggccatgtacgtgggcccatccaggccgtgctgtcccctgtacgcctccggccgtaccaccggtctcgtgttggactccggcgatggtgtcacccacaccgtgcccatctacgagggttacggcccctgccccacggcccatccttccgtttggacttgggccgggcggtgacctcactgactacctgatgaagatcctcactgagcgtgggtactcctttcgtgaccacggccgagcgtgagatcgtccgtgacatcaaggagaagttgtgctacgtggcactcgacttcgagcaggaaatggccactgccgcctcctcctcctcgctggagaagagctacgaactgcccgacggccaagtgatcaccgtcggcaacgagcgcttccgttgcccagaggcgctgttccagccgtccttcatcggcatggagtcggccggcatccacgagtccacctacaactcgatcatgaagtgcgacatcgacatccgtaaggacctgtacgccaacaatgtgctgtccggcggcaccaccatgtacccgggcattgctgaccgcatgcagaaggagatgaccgcgctggcccccgtccaccatgaagatcaaaatcatcgctcccccggagcgcaagtactccgtctggatcggcggctccatcctcgcctccctgtccaccttccaacagatgtggatcagcaagcaggagtacgacgagtcgggcccgtccattgtccaccgcaagtgcttctgagcagcagctgcacgaccgcacggaggaggagagcagaaaatgcctttcatcaagagcatcggagtgcggggattggcacgaacaccaaaaagagcaatggcatccaatcacatttttttttgtttttatggcttttcttttcat

SEQ ID NO: 49966 - DNA, 480 bp, Heterodera glycines
  SCN-specific regions: Sequence locations=1-49,71-480
tttgagtctaaattctgtttaatgtgtcaatgagcaacaacgacatcatttttggaaatgaggaaggcgttaattatttggcaccatggacatattcctgtctcatcaaaacttcgatagatcggttgaaaactgctttatctgagaatcgtgaagccatacatgctttaaatcatttacaagaagtctttcgtcaaattgaccgtgcttctccctcctttctttatgatttctcaaaacttttgctgatcgagtcgggcgttgcaggaactaatgtgcaggaatcgtaccttcgaatgcatgcaaacgcggccacagaagagctggaactgccacaatttgcacacattgcagaatttcaatatttgtcaatgagagctgtttcactgtgcaaggtgcttgccagaattccggacgaaatgactgatagaaggccatttctggagaccatcaaagagattgcttcgtccattaagcaat

SEQ ID NO: 49967 - DNA, 1887 bp, Heterodera glycines
  SCN-specific regions: Sequence locations=1-227,250-266,288-690,712 -1433,1456-1793,1815-1887
gtttccttacctcattgacaatttttttcttcattttgagctgttttcatcatgagtgacgacaactgctgcggctctgttggtgcccgttctccgactggctccatctcatcaagcggttccgctgactataacgttgccctttcgccaacccaattgcttgcaatggcaatcaagaaacgtcgtcacttgctcgaggacaagcagcgcgactaccaacgggagctgctccactcgcacctcatccagaacttgtagcgatgccaattttggtggtgatggtggaggccggggcccacggtggctcaacaaacgctcttctcactctgacgacggtggacctccgatgaaacgaaaccgggcggactcttccgaggatgggctcacattcattgatctcttttataccttgtgaggttgggaagttcgatggagaatttgcagatggtggacggatattctgatcggaatggcatggtcgtcatgatatgattacagtttctttatttttttctacgtgtattttttttttaccgcagataaataatttatagatcacagcgagcaaaataatcactggaaggtcttttgtgtgtagagcatttatgcgttctttcatactggcaagttgaacgtataattcaaacgatcaatggtgatttgtcatttatccaacgttactttttctagttttaattgcagaaaatcgcaactttgcgcggagttttaaaaatgctcaaacattgcacccaaattcgttcatttgccacccaccaaagcattttctacgacgtggtcattgtcggtggtgggttggtcgggagtgcgatggcttgctccatcggcacaaattcggctttgggtccatccacgagggtgctcctgttggagagtggacgactgcacagcgtcaagcagtcaaaagaagccgaaaccaaacacacttataacaaccgcgtttccgcggtcagcccatcctccgttgaaatgttcataagtaatcctgagtctctcaaccaagtgctttatccgagaatatccaaattcttacctatgttgctgattctgccaatccaattccatcctcttcccttaaaattagccattccttttttattcacaattcggtgtttgggatgagatttgctcgaagcgagttcatccaatttctgcgctttacgttcgtattatttttctggttcaacccattaaaattagtgaagaaaagaaacgaaaaatcaggttgaggatggctgtgccaaatccaaaatccatttcaaacaattggataagcgttcaccgattgctcacatcgtccagaatgagctcatcgtcgccgcactgcagcaatgcattcgggaccgatgtgccaatgtggaagtgcgccaaggcgcggttgttgaccagaatttgagtgttcctgacaatctcggccaaaatgtcaccattcagttcgaagatggcacaattgaagcttcattgatgattgccgccgatgggtccaaaagtacggcacggaaaagggttttcattgattttgaagaaacggcctatgagcagcgtgccgttgtgggcacattggccctccagcacaattcggagtccgatgaatccttcgcttggcaacgctttgtgccgtcgggccccgtcgcgcttctgccgcttggccatgaactgtgctcgttggtttggaccgtgtcaactgccgacgcggcacggcttctccaactgtcgcccgaacactttgtggaagagctgaatgggacacttgtaagcagtgccttttatgggtctccaaataatgggcaatttgacaactcttcggctaattccctcgtcaacaattcgttggattgtcttggcaaggcactgaactttttgccgtcc

SEQ ID NO: 49968 - DNA, 1214 bp, Heterodera glycines
  SCN-specific regions: Sequence locations=1-36,59-168,197-350,377 -389,422-518,548-548,590-590,638-680,731-853,875-912,948-1013,1038 -1142,1169-1214
gggcgccgttatttcaacatacatcttttacgataattatttattttacttttagcttaaaaaacagacatcattcagtattatttataagaacaccaaaaatgcgtgaagtgatctctattcatgtgggacaagcgggcgtgcaaattggaaatgcttgttgggaattgtactgcttggaacatggcattcagcccgatggaaaaatgccatccgaccaaaacaaccaagacgattcgttcagcaccttcttctcggaaacaggcaatgggcgtcatgttccgcgtgcggttatggtcgacttggagccaacagtgatcgacgagatccgcactgggacttacaagcatctcttccaccctgaacagctcatcactggaaaagaagacgcggccaacaactacgctagaggacactacacagtcggcaaagaaatcatcgaccccgtcttggatcggattcgtcgcatcgcggataactgcaccggacttcaaggctttctcatcttccattcgttcggtggtggcactggctctgggttcacatcgctgcttatggaacgtctctctgttgactatgggaagaagtctaagctcgagttctccatctaccctgctcctcaagtgtccaccgctgtcgttgagccgtacaattcggtgcttactacgcacacgactctcgaacactctgactgtgcatttatggttgacaatgaggccatctacgatatttgtcgtcgaaatttggacgtggaacgaccttcttacaccaatttgaaccgtttgatttctcaagttgtctcttcgataaccgcttcacttcgatttgatggtgctttgaatgtcgatctcactgaattccagaccaatcttgttccttatcctcgaattcactttcctcttgcgacttattctccagttatctcagctgagaaggcctaccacgaatcattgtcggtttcccgaatcaccaacatgtgctttgagccgtccaaccaaatggtcaaatgcgatccacgtcacggcaaatacatggccgtgtgccttctctaccgaggtgacgtcgtcccgaaggatgtaaatgcggccattgcttcgatcaaaacgaaccgttcaattcaattcgtggactggtgcccgaccggcttcaaggttggtatcaattatcaacctccgactgttgttcccggcggtgacgttgccaaagtcccacgt

SEQ ID NO: 49969 - DNA, 1439 bp, Heterodera glycines
  SCN-specific regions: Sequence locations=1-239,268-320,342-1439
gcaacactgaaacttcaggattttcttcgacaaagacttttttccatcagtcaaccaaaagttgtcagtgtccaagctcgtcagtttccagttacaatttattttgaacgacgcactccaacaaattatttggaagcaacattcaaaaaagtgtgtaaaatccacgaggaataccctgcgggtggcatccttgcgttcgtcaccggtcaacgtgaagtcacacatttggtcaaattgctagaaaacaaatacacaaaaatatctgcatcaaaattactgagaaaagagaaaatgaaaaagtgtcggaaaaaagagacaaaagaggaggaggaagagggactactgcttgacaacgacgaattcggaacttcggatatggaccttgaagacgaggcgtggcaaaataccttttttgggtctgacgatgaatcacttaatgcttcgcaatcgttcaaaaagtaccctcctctgctggccatccctctctattctctcctaccagtgaatttgcagaagaaaattttcaacgaaccgccagatgacgggtctagggtgtgtgtagtttctacaaatgttgcagaaacttcgttgacgattccaaatgtccgttacgtcatcgattctgggcgggaaaagaagagggaatatgacccgattacgggagtttctcggtttgtggtcggatggtgttcaaaggcgtctgcagaccaaagatccggtcgtgccggacgagttcagtccggatacgcattcagattgtattcttcggctgtttacgaagatatgcgcgatcattctactcctgagatccttaataaaccgatcgaccaattgattcttatgttgaaagcaatgaatttcacgaaaatcgacaattttcctttcccgactcctccaagattggaccaaatcaaatcttctgagctgagactttctcacataggggcgcttagagttcaagaagggctttataccatcacacaacttggacaatcacttgcgcagctgcctctcactccttcttttgcgaaggtcgtcatcagttcaattcgtggcggacttcttccttttgccgtcactttgcacaaaagaggacggaacggaagagagacgaaaaagagtgtccgaagtgattaagcaaagatttctttggtgtgctgttggggaggctctactctttggtgatttgacagtaattctgaacactgttggtgctgctgactatgaggaagagaacgctcgcgcaatcgaagccctaggacttcgccctaaggccctaaagggaatcaacaaacagagacatcagctgacgcttcttctgaacaaatccgattctgtggagaagttgcccgagaagttcagaatggatgcaccctcccaagaacaactgaggagattaaggcatataatggtgaaatgccatccggataaattggcaa

SEQ ID NO: 49970 - DNA, 702 bp, Heterodera glycines
  SCN-specific regions: Sequence locations=1-112,134-200,222-390,425-702
cttccttaataacttagagatcgcttgactattcgcaagaatgactaaagccgaacaagctgcggcaaaaaaaggagaagaagttgggaaaccccatgagagatttaaagattcaaaaactctgtctcaacatttgcgtcggtgagtctggtgaccgtctcactcgtgctgcaaaggtcttagaacaattgactggtcaaactccggttctttcaaaggctcgttacactgtgcgctcgtttggaattcgtcgtaatgaaaaaatcgctgtccattgcacagttcgtggaccaaaagctgaggaaatcattgatcgtgggctcaaagtcaaggaatatgagctttaccgcgagaatttttcggacactggcaattttgggttcggcattcaggagcacatcgatttgggcataaagtacgacccgtcgattggtatctacggaatggacttttatgtggtgctcggtcgtgctggtttgcgggtggcaaaacgtcgacgaatccaaggacgaattggcgcatcgcatcgtgtgcaaaaggaggaagcggtcaaatggttccaacaaaagtatgacggtgttattttgccacccaaaccgaaggaatcccgtaagggtggtcaccgcggacgtaagcgctaattttggatcgttttgttgaatgctattttcccttgttgataaattactatttgttgaaaaa

SEQ ID NO: 49971 - DNA, 558 bp, Heterodera glycines
  SCN-specific regions: Sequence locations=1-369,393-535
ttgagaaattcagcagtccaaaaacaaatttcaccagcaatgatttaccaccgatttgttgagattggccgtgtcgtttacattgccaaggggaaggaccaaggcaaattggcagtcattgtgaatgtcatcgacggtaacaaggttttattggacggcccctcctcgggtgtgcctcgcggtgtttggaatttcaaagacttgcagttgacaaaattcaccctcccattgcgtatcggccaacgtacgaaaggagtgcgcgaggcttatgaaactgccaaaatcaacgagttatggcaaggcactgagtgggcaaagcgcattgatcggaaacagaagcgtgccgggctcaacgacttcgagcgcttcaaagtgttcaaagccaaacagcaccgaaaccgtttggtccgcgttgagatggctaaactgaaaaagatttcgaagccgacagcgaagtaaatgactgaatttggcctgatcatattttgaacacacaaatgccgtcttttttgttgatgaaattatttgttggagttaaattgttttttaattcaaaaa

SEQ ID NO: 49972 - DNA, 540 bp, Heterodera glycines
  SCN-specific regions: Sequence locations=1-152,176-198,228-236,258 -488,519-540
tggagctccccgcggtggcggccgccctccaactagtggatcccccgggctgcatgcctcaagacgagggtaaggtccacggccagcgcattgccctctctgacaacgctgttgttgagaagtcgctcggcaaggccggccttatctgcgtcgaggatttgattcacgagatctacactgtcggccccaacttcaagaaggccaacaacttcctctggcccttcaagctctcgtcgcccaacggtgccttcaacaagcgcaagttcaagcacttcattgagggtggtgactttggtaaccgcgaggagttcatcaacgagctcgtccgcaagatgaactaaggttcttgccctcgcttgctgttctccgcttgtcgagttgccccgttggtgtttgtcgtcgtttgtttgtttttgggcccgccgccacggctagctttggttgttccgagctgagcaaatgatgaatacatccccgtgcttctcctgaaaaaaaaaaaaaaaaaaaaaaaaaaaaaacctccagggggggcccggtacc

SEQ ID NO: 49973 - DNA, 546 bp, Heterodera glycines
  SCN-specific regions: Sequence locations=1-546
ccaagtttgagcatttgtgttccgtttagcagaactatgatatttttgacttcgttttccaaacatccgttgtccgctgcctttcggttcttttcttctgttaacgaagtgaccctccaaacgcgtccctacaaactgttcaaactcgattcgggtccttcgacggaggtgcgactgacgcgggatgaggcgttggattattacagaaaaatgcaattggtccgacggatggagacatcggccttctttttgtacaaggaaaagcgtatccgtggcttctgtcacctttactccggacaagaggcatgtgccgttgggatggtggcagcgactgatcccaatgatgccgtgatcacggcttaccgatgtcacggatggacttatttgatgggggcgacggtccaggacattttgggcgaactgacaggacgcattgctgggaatgtttacggaaggaggggatgcatgggtagtggacccaaagaacctttttcggcgggggacgggaacccgctgggcgtacgaacggacagcatggggggggga

SEQ ID NO: 49974 - DNA, 597 bp, Heterodera glycines
  SCN-specific regions: Sequence locations=1-597
caagtttgagctactctattcaaatcaaagtgtaaagcgtattcaaaatgcttatgccacaaggtgatcggaagaaaatttacgagcatttgtttgaggatggagtttgcatcgcgaagaaggactactgcttgaagtcgcatcccgaaattaagggagtgaagaacctttacgtcatcaaggcattgaagagtcttgcatctcgtggacttgtcaaggagcagtatgcctggcaccactattatttctaccttcaacccgaagggattgtccatttgcgtgcttatcttggacttcctgacgatgtgttgccgaacacgcacaagcaaaggaccgacgctattcaaaaggcttttgcagacaaaggaggccgaggtccgattcgcgccgacaccgatcgtgggggttatcgcgctgccgcagataaacaagcggaggctgggcctggtgctgctccgattagtcatcgtcagggcttcggacgtggaggaggtgcccctgctccccaataagaacttcgggaatgcttgatctttgatttctggagattttttttgttgattttttggttataaagtgttgatcagttgaaaaaaa

SEQ ID NO: 49975 - DNA, 401 bp, Heterodera glycines
  SCN-specific regions: Sequence locations=1-12,35-299,321-334,359-401
caagtttgagctttttccaaattattttcattcaacaaaatgaaggaaggccaaaagccccgccagtcacgacacaagggacgactctcaaagaagacgcgcattgtgcgcgagcttgttcgcgaggttgttggtttcgcgccgtatgaacgccgtgtgcaagagttgctcaaaatcagcaaggacaaaaaggcgctgaagttcttgaagaagcgcatcggacagcacacgcgggccaagcgaaagcgtgacgaaatgcagcaagtgttggtggcccagcgcaaggcgcacaaatagacggagagaggagatagaggcgggaaaattttcatggatttccttgttttcctttgttgaaacttggatgatggatggataaattgtttgttgtttttaaagaa

SEQ ID NO: 49976 - DNA, 475 bp, Heterodera glycines
  SCN-specific regions: Sequence locations=1-475
gtttgagtgactgcttggttctttattcaaatggggcgacacaaaaagactcagaaattccgcaataagcttcagaaactgatcaagccaaccgatgacagaataaaagatgaaatccgcgtgaaaaaacctcccaaagaagatgaaaatgcacttaaaatcaaggaagccccgaagatttcggcagcgatgtttctcaaatacaacacacaactcgggccccccttccacgtcattatcgacacaaattttgtcaatttttctataaaaaaccgaatcgacattatgacggggttcatggactgtctgtacgctaaagtggtgccgtatatttcggactgtgtgctgggcgaattggagaaaatgggacgacggttcaaacttgcgctaaaaatcataaaggacaaccgcttccagcgactccaatgcacccacaagggcatttatgccgacgattgcatcgttcaacgagtaa

SEQ ID NO: 49977 - DNA, 525 bp, Heterodera glycines
  SCN-specific regions: Sequence locations=1-525
agtgcaatcaacaatgtcagcacccgctgcaaagttaccccgccctccagagcacatgctgcgttatatggctcacatccgggccaagtctcttgttttctgtgcgatgggggtcagtggtctcattggcctttccttttacttcttttacgtcgaagttcgtcgcaaggcatatatggaatttgggaaaaattacaacccataccagagaatgcgtgaaatttgcgagtatcccgtcaagtacatgcattcctgcccttctgagctagccaagcgcctcgaagagaagggagtgctcattggtgaccgcgactattccatcccattggacgacgttgtgcctgaaagccggaagaaggagttcatgatggcgaatgcgttcgaacgttttatgaaccgttaggcaattaagtcaggtgatcggactgttgacattaggatggatttagcacaattaaagatgctttctttcgagttgtaaatcattcgttcttttacacataaactgaaaatccctcaaaaaaa

SEQ ID NO: 49978 - DNA, 672 bp, Heterodera glycines
  SCN-specific regions: Sequence locations=1-90,112-291,313-672
caagtttgagtgttcttttcacgtgaaatttgactaacaaattgactcttcgagtctcttcatttattcatcaacattcgcaattcgtttgtttcttcactaatgagtggtgaattgcggcttgattcgagtcttgatctgatgcggcgtttgccaccgcaaaactgtgagaagcatttgaccgatttggtcgctcttgcgcccgacctttgcgagtctttgcttactgccgttgaccaaccgcttaaagtggcgaaggacaaaacaacggggagggaatatttgctctgcgactacaacagagatggcgacagttacaggtcgccgtggaccaacgcttacgaccccccgcttgaggatggcgtgtctccttccgacaccattcgaaagttggaaattgaagtcaacgccgccttcgaggcctatcgcgacatgtatttcgaaggcggagtgtcgagcgtttacctgtgggacattgacaacggatttgcgggtgtcgtactgctcaaaaaggagacggacaattcgctgtcggggcgccagggcgtcaagggttgttgggactctatccacgtgctcgaagtcaatgagaagacgaaggcggcgaaattcgccaagtacaaattgaccagcacggtaatgctttggctgcagacccaaaacccgacaacc

SEQ ID NO: 49979 - DNA, 667 bp, Heterodera glycines
  SCN-specific regions: Sequence locations=1-667
ctccttcgaacagtgtgttccgatgttgccagcaataaaacctgcaaattccgatgggattgttttagacgcgcttccatatattgacgatcaacaatataccgatgaacatcgtcaattggcactgcaactgattcaggccgaatgcaaaaagtttcctatgacaaagaattacctgagaaatctgcctgaacctgactatgataagtttacaaccccgagaataatggaacaccaagcgaagatggccaacaaacaagaaattgagaaaatcgatttgttgcgatacgaagtgccatccccagcaaatacgagtcgatcgggcaataagaaagcgtggcttggtgccatcgataattgcagggcccaactgtcaaatcaatcgttacgcaaaatgaacttggaacttttggacgaatttggcccggaggcgtttttacggtcgaatcagcacctaaaaaagcaagttgagaaagaggaagccgaattgtttaagcttcgctcccaactctatgaattgaatgctcgccgaaaaagatcgcaattggatgctggggaaaggctggctgcgttgggacaaacatgggttgaactagtgacgaagaatgccgcgatggttgtccgccatgacaaacttggaaaccgaattcgaacattggcgaaatta

SEQ ID NO: 49980 - DNA, 1383 bp, Heterodera glycines
  SCN-specific regions: Sequence locations=1-760,785-1383
aagaaatataatgactgccaaattatatggaaatcaagacaactttcgtgtgaaaaaagttctaattgcggccaaattgtccgggaaggatattaaggcgattcctcagcttcctccaacaaatctcttcccattgggacaagcacccgctttcgatgatggaaaagtgtgtcttttcggtgccgaggcaatttccaaatatcttttgggcactggttcaatttatttgccacagaacccggaattggaccaatggattggttggactgcttcttctttgcaaccaaatgtcctttcctatgttttgccttgcgtttccgctgccaaaattgaccaaaatgctttagagacggcaaagaatgaattgcttgcccaactttctctcttcgaccaaattctccttcccaaaacttttctcgttggcgagcgtttgtcccttgcggacatttccgttgcgattgatcttctgccggcttatcaatacgttttgggagaagaagctcgcaaaggccttgtgaatgttaaccgatggtttcaaacggtggtcagtcaaccaggaatcagagaagtgctcggggagttcagcttcatcaaggatcccttgaccttcgatgaaaaagagtacaacaaactcttgaatgctgctggtcaacctgcgaagaaggaacaaaagccggaaaagcagaaaggtgccaaagaggaaaagccaaaaagcgctaaagaggaaaagccgaagaaaaaagccaaggaagaagccgacgaggaaatggacgctgctgacgaggctattgccgctcagccaaaattcagcgacccattggctgcgttgcccccgggctcatttgtgatggacagcttcaagcgcgtttattcgaatgaagacaccgcaaccaaagcaattccttatttttgggaaaatttcgaccccacaaattacagcatttggttttctgaatacaaataccccgaggaacttaaattagtctacatgtcttgcaatttgattggcggaatgtttcaacgactcgagaaaatgaagaagcatgcgttcgcctctgtttgtttgttcggaactgacaacaactcgacaatctcgggaatttggatctggcgtggccagcagttggcgttcgagttgtgccaagattggcaagtcgactacgaaagctatgagtggaagaagctcgaaccggaaaacgaagctgacaagaagatggttaacgagtattttatgtgggagggtgactttggtggtaagaagttcaaccagggaaaaatcttcaagtgattctgatcagtaatcacagttttgttgcctacaactgttattttttgttgacgaatttttatactttattcaagtgattaaaggtgggtcctttc

SEQ ID NO: 49981 - DNA, 857 bp, Heterodera glycines
  SCN-specific regions: Sequence locations=1-50,89-857
gaattcaagaaaaagatatcacaaattttctttatttgtacaaacatatgaataaattaatattttatacatttttgtattattaaatgtcatcacttatccgtggtgaaattcagcagtttgcatcttttgcaaatgttttccactggtttgatgagcttcatggatgcttccgacctcttcactcttttaaccaattgagaattccttggctctccgcccatttggccacttcttctttgaatgccgtccatcttccgttgtctggtaaacagattttagatgtcggatgtggtgcaggcattttatcgacttctctttgtcgacgaggcgctttagtcactggcttagatgcggataaatctgtgctagaaattgctaatggttataaggaaacaatggcgccgagtcttcgcaaaaaaatagaatttattcctggcacgattgagagacttgcgcaagaaaaggatcgaatcggaacattcgatgcggtcgtttcttcggaagtggttgagcacgtttccgacttgcccttgttcattcggagttgttgcaaattggctcgtccgaattctccaatttttttcacaacaatcaaccgtacaatttggagccaactcttggctaaaacaatagctgaggatttgctccggatactgcctcaagggttgcatcaattcgaacaatttgttgctccgcgcgacttgcgcaaattgctactggacgagcagtgcagcgttgggccggtgcttggaatggcctacaacccattttttaacatttggaattggactcggtttactggcgttaattacgcacttgttgctcacactaaaaattaacataatttattgtgc

SEQ ID NO: 49982 - DNA, 698 bp, Heterodera glycines
  SCN-specific regions: Sequence locations=1-73,108-192,214-627,649-698
gtttgaggttttaaaatttttcgcagtcaattttccaacgtctcttctgtgaaaatgtcatctgacaagaacaaggaacgcactttcatcgccatcaaacccgacggtgtccagcgcggattggttgccaaaatcattaaacaattcgagcagcgtggttacaaattggttgccatgaaacttgccaaggcaactgtcccccatttggaggtccactaccaagacctcaaggacaaacctttctttgccgggctcgtcaaatacatggcatcaggcccgattgtcgctatggtttgggaaggtttggatgtggttaaacagggtcgcgttttgctcggcgctacgaatccgttggccagtgccccagggactattcgtggcaatttttgcattgagatgggacgtaacatttgccacggctccgattcggtgccttctgccgaccgtgaaattgcccattggttcaagccggaagaactcgtcgactgggaaagtgcgcagaatgcgtgggtttacgaatgatggaaagaggcaaatttgtgcagtgaaaggcctctgctttcgaatcgatgaccaatgacgaccatccaatttttgtttgacattcttccattctgttagttaggtttttcttttgttgttggctttgtttgtgttcttccttttcaattcgagcataaaattcctaatttttaaaa

SEQ ID NO: 49983 - DNA, 795 bp, Heterodera glycines
  SCN-specific regions: Sequence locations=1-622,644-795
atcattactctaccacaatttgatctgcctgaatgtgtgtcgactctcaacggatggggtccggggtctgtaagtgacagtcaagtactctcagagtttgtgggccttccgtatcaacatttcaacaaatgcgatcggattgggcgtatcgtcgattggttgggcgtcgatcgctttttcaaaaaaggcgaaacgcgagatcggtacaatgagcgtgtgtatggctcctcagcgactgcgggcgttcaattcgattacatccacgacaacgaggaatcgaacttccaattggtcgactcgagtcgaccacaaaagccgcagaggcctttccgtcgtcaaattccatttcgtaaattggctcaacgtgagcaggaacgccgagaatatgagaagtacaatgtttcgacgaagatgaagcggagtatactcaaggagcaacaaaaagcgtacaaagtgtttttgcgtcggggcggtggaactcgcggcacagcgcagcgaccgaccgggcggcgcttcaatgaccgacaggcgggcaaagggcgacagccttcggttcaagttcgacccgattgggcggttctgaaggagttggactttgtccagctgaacaaactttacctgccaaacattgaacctggaaaggatatacccggcgaaacgtacggcacccttcacttttatgataaagcattaatggacaaactgagcgtcaaaaacccgctgcatttggagaaattccacgcgtctttttattcgctgaccaccactgaagacccggtgttcagaaagctgtcc

SEQ ID NO: 49984 - DNA, 634 bp, Heterodera glycines
  SCN-specific regions: Sequence locations=1-335,357-610
ggccaattaagctcaattaatgctgaaaaataacttattaatccgtggcaaatccgtccttttctcgttgccgttgagggctttttccctgtccgctcagtgcgccaacggtgagcccattcgtcgcgtcgttctgatccccggcgatggcattgggcccgaaatttcttccgcggtgcaaaagattttcgaggcggccaaaaccccgattgactgggatcccgtcgatgtcacaccggtgcagggccgggacggcattttccgcattccgaacaaatgcattgagctgatgcacaagaacaaagtgggactgaaggggccgctggagacgccgattggaaaggggcaccgttcactgaatttggcggtccgaaaggagtttaatttgtacgccaatgttcggccgtgccgttcgttggagggccacaaaacgctgtacgacaatgtggacgtggtgaccattcgggagaataccgaaggcgaatattcaggcattgaacacgagattgtctctggtgttgtgcagagcatcaaactgatcactgaacaggcgtcccgacgcgtcgcccgttttgcgtttgaatacgcacgacaaaacggacgaaaagaggtcaccgctgtgcacaaagccaac

SEQ ID NO: 49985 - DNA, 699 bp, Heterodera glycines
  SCN-specific regions: Sequence locations=1-699
gaggaagagaatgggcaacagttccacttcgcttatgctgcaggaagaggaagtcgttggaattgcgaaggaaacgggattttctcgaaatcaaattgtccgtctgtacagtcgcttcctttcgcttgatcgacagggacgtggatatttggaccgggatgattttcaacggatccctgagttggccataaatccgctcggtgatcgcattgtcgacgcttttttctccgaattcggagattccggtgccaaagttgaactcataaacttccgccaattcgtcaaagtccttgctcattttcgtcctctcagcaaatcgaagccgaacaccgtaaacagcagagaggaaaaattgaaattcgctttttccatgtacgacctgaacaagaatgggtacataacgcgagacgaattcaaaatcattttgaatatgatggtggggacgaacatcaccgccgaccaacttgacagcattgctgaccgcacgatcactgaagctgacgccgacaaagacgggaaaatttcgttcgaggaattttgcaaggcaatggagcgcactgatgttgaccagaaaatgtcgatccgatttctaaattgagttcaaaaatgcaaataatgcgagcacattgtgattttgtctagtgactaatttccccaattaagagtcggatttattgtagagtaaatttattgtaactt

SEQ ID NO: 49986 - DNA, 1132 bp, Heterodera glycines
  SCN-specific regions: Sequence locations=1-1132
gtccaattaagatatcctttctatttgacaaatgtcccgttttgtgtgtgctatttctggaaatgagcctgaggtggctgtggcatcgcccgtctccggagaagtctttgagaaacggctgctcatcaagtacattgaagagaacggcaccgatccgatcaccggccacaaacttgacacttccaacttggtcgagctgaagcaggacccgggcattcgttctatgcaaaagtcattggccaccgcctcgttgccttcgttgcttaagcaattgcaagacgaatgggacgccaccatgctgaacaacttcacgctcagacaggagttgaaggcagcccgcgaggagttgacccacgcgctttaccagaatgacgcggcatgccgtgtgatcaaccgtctgagcagtgagctgcagtccgcgcgtcaaatcatcgcgacactgccgcacggacgacgcgctgccgcggagagtgagacggaggcgaccgatgttgagatgcgtccggaggaagcggaggagggcgctggtgcggacggtctgccgggcatcagcgaagagttggtcaattttttcaccgacaaatgccaagacttttccaccgcgcgtaagcagcgtggccgaaatttgcccgaggggttggcatcagtggaacaaattcaaaagtatgaggaggttgcgtgccacgatgcgctgcacagtgccagcgtgcccggcatcaccgcgttggatttgcagaaaaatttcatcgcaaccggcggaatggacaagaccatcgtgctgttcgactcggagacggagaacatcaagaacacgttcaaggggcaccagaaacgcatcagtgccgtccgcctccatcccaaccttcaaacaattgtctcgggctcttttgactcacagatacgaatttggaacgcggatgatcaaagtgccagaaatgtgattggcatccacgaccgacttttttttgacgtgtctctgcacccaaccggcgattatgtgctctgttcctctgaggattcgcattggtcgctcatcgacctcaatgctggacgtccgttgataaaagtgaaatccgacgacgacgatgtgccgggaattcgctgtggccactttcaccccgaaggactcatc

SEQ ID NO: 49987 - DNA, 450 bp, Heterodera glycines
  SCN-specific regions: Sequence locations=1-77,100-152,187-187,216 -265,328-450
gtccaattaagttattttccgttaatttcttcattttcgttcgcttgcattttgttcttccgtaattatgggcgacagaaaggcggtgattaaaaacgcggatatgaccgaagagatgcagcaggaggccattgagtgcgctacgcaggctttggagaagtataacattgagaaggacatcgctgcgtacatcaaaaaggagtttgacaagaagttcaacccgacatggcattgcatcgtcggacggaacttcggctcttacgtcacacacgagaccaaacacttcatttacttctacttgggccaagtggccattcttttgtttaagagcggctgatccgactttttgagacgaacggaagccgacgatgcaaaaaacttattatggccgtgctgtaagacagttttgtcatttcatcaccaataaatacttttcaaatttgcaaaaaa

SEQ ID NO: 49988 - DNA, 635 bp, Heterodera glycines
  SCN-specific regions: Sequence locations=1-210,234-635
gttttggcttctgtataaatgaatggaggtggcagcaacaacagttttctctgtgtaatttttgactgtaatgcgtacaattggggctgtgtggtcgctgaacgcggtgtgtctacgcttaacgaaactgtctccgcactaattgctctttgcaatgcgcataatttctcctcgctcggaaatcgtcttttgctactcgcaaaaggagccaaacaacaagaaaagaaattgttcaccaacgaacgaattactgcgaaagaattgacaaattttgggccggccattgaaggaattattcatcaaattttggctaagaatgtttctgctgaagaaagccctttcaatttgtccagtgcattgtctttgagtatttgcgcattccaaaggttcaagaagcaatttccctcttcatttgggcatgttgtcttcataaacctttcggaacaatttacttctgagcaaaatgccctgctgaatttgtttttcgcctctcgtcagtactctctgcactttcatgtggcctcttttcacaaaactgtgccaattctgcagcaggcttcggacattaccggtggttcctacatgtacattgacaacaccaagcttttggcccacaaactgctgtgtcactgcat

SEQ ID NO: 49989 - DNA, 763 bp, Heterodera glycines
  SCN-specific regions: Sequence locations=1-259,282-763
tgaaagcgttgtggacatctgtgtttctaccctaatgtcgaagcttcgaaattacacagaggaccaattgcagaatttgttacaggatgagtcaagattgaatgcgatggtggatagtatgccgcaggtttcgtctcttcctaatgacaaagagatcaaattggcccacagcaaatccttggccgagtacaatctgtccattgagccacaactgaataaggctcttaatcatttgcgcgaaacgcatgccaatgccgtgagaaccaagggggaagtgaatgagatgaaggcgaaattggattcggttgctgaggcaagatctctggattccgtttgcgtttctctaaaaaatcttgcacaaaatgcggaagatgaaagcgagacagcggccgaacttttttacaaaggggctatggaaatagatgatttcataaagaaattcacggaaaaacgcgttattggccatacgagaaggctaaaggccgaaaagcttgccgaattgcttcgccaacaatgccaataccaaccgcagcacccgtctccttctgcacttggaatgaccactcaaactcagtattcgtctcaaggggtggcagcctcaatgtatcctgtccttggccaggcttatacgagcccagccaattttcggcattcttatatgagttaggagaacggttcaaccggagattacttggacacgcacttattattttctatcaattttttgccccgacaaataaacgttttataatgtccaaaaaaa

SEQ ID NO: 49990 - DNA, 1334 bp, Heterodera glycines
  SCN-specific regions: Sequence locations=1-35,57-247,269-429,451 -914,938-1055,1097-1301,1323-1334
cgagcttatacacaccaatatttcaattctcccaattctataaagcaagcaaaatgcttcttcttttcttattatcaatgcttctacttcagacaaatggttggcgtgcccgcgagcgtgcaattgaattggccgactcggacgaatcgatcgaattgcagaacattggccaacggaaaacggacattcgaacaccgacagaacgaatgtctgctcttcgtcaaatgatcgaacgcggcttttccgattggaatgcttacaaacagaagcatgggaaagcatacgcggaccaagaagtggagaacgaacggatgctgacttatttgagcgccaaacagttcattgacaagcacaacgaggcgtacaaagagggcaaagtgtccttccgagtgggagagactcatattgccgacctgcccttttccgaataccaaaagctgaacggattccgtcgtttgatgggcgatagtttgcgccgcaatgcgtccacttttctggcgccaatgaatgtgggcgatttgccggaatcggtggactggcgggacaaaggatgggtgaccgaagtgaaaaaccagggaatgtgcggctcgtgctgggcattcagtgccaccggcgcattggagggacaacacgtgcgcgacaagggacatcttgtttcactgtcggaacaaaatctgatcgactgctcgaagaagtacggaaacatgggctgcaacggaggcatcatggacaacgccttccaatacattaaggacaacaaaggcatcgacaaagagacggcctacccctacaaggccaagaccggcaaaaagtgtttgttcaagcgcaacgacgtgggggcaaccgactcgggttataacgacatagccgaaggggacgaggaggacctgaagatggctgttgcaacgcaagggcccgtctcagttgccattgatgctggtcaccgttccttccaattgtacaccaacggcgtttactttgagaaggaatgcgacccggaaaatttggaccatggtgtgctcgtggtgggctacggcaccgacccaacccaaggcgactattggattgtgaagaacagctggggcacccgctgggggcgagcagggatacattcgcatggcacgcaatcgcaacaacaattgcggcatcgcttcccacgcctctttcccattggtctgatcggagtgaatttgttgcccttgcgctgattcagagacatttcatttgattaatcgtgcaaaatgataagataattgataatccatcagtcaatcggtcgatttccattttttatgttcgcaattttattcacatataaataaattactgatttt

SEQ ID NO: 49991 - DNA, 567 bp, Heterodera glycines
  SCN-specific regions: Sequence locations=1-64,86-254,294-300,327 -444,468-538
aaaagctggagctccccgcggtggcggccgctcttcaatagtggatcccccgggctgcaggatctcggcacgagggtttgagatcactcgatttctctgctttttgtccattagactttatttaattccttccattctaaacagcgaattgcttttacgccaccataaaatatgggtttggccatttccggtctgttcagtcgacttttcggcaaaaaggaagtgcgcattttgatggttgggctggacgcggcgggaaagaccaccattctgtacaagctgaagttgggcgaaattgtcaccaccattccaacaattggcttcaacgtggaaactgtcgaatacaaaaacatttcattcaccgtctgggacgttggtggacaagacaaaattcgaccgttatggcgatactatttccaaaatacgcaaggactgatttttgtcgtggacagcaacgaccgcgagcgtgtgggcgaggcgcgtgaggaactgatgcgaatgctggcggaagacgaactgcgcgacgcggtgctgttgatttttgcgaacaaacaggatttgccaaat

SEQ ID NO: 49992 - DNA, 694 bp, Heterodera glycines
  SCN-specific regions: Sequence locations=1-369,405-654,678-694
gtgctttttaagaaatataatgccaattcaagagataaacaattaggtatttgctttgggaaattcacatatttgatttgttggttaccaatgactgctccttgcattgatgttggcaatcttttactcattgatgttgagacggacgccgaagatttggccagtagcaactcagaacggattaacgaacttacaagcaaaaatgcccagcttttgttcaatgaaatatggaaattacccagaaaaattgtgcaagatgcgacttgttctcagcttcccgaatacacttatggccttcctcgtgaaaaacccattccaaaaccgaaagaaccaacgaaatgggagaagttcgcgagggctaaagggataacaaagaagaaagacaggaaagtctgggacaaaacgactcaggaatggaagccgaaatacggatacagacgagccgagaaccaatcgaaggaatggctcattgaaattcccgaccaaaaagacccatacaaagattattttgctgagaagacggaggaaaagcgggaaaagaataacaagcaggagttgcaacggctgaagaacatttcccgcgcctctaacaaatacaaagttccaactgggaacagaaaggtgttcaaagattgatcaaatcaaatctgtcaattgttttatgtttttgttgttttcataaacaattttaatc

SEQ ID NO: 49993 - DNA, 380 bp, Heterodera glycines
  SCN-specific regions: Sequence locations=1-356,378-380
ccaagtttgagctttacttacttctatcaaaatgcaaaacgacgcgggagatttcgttgatttatatgtcccgaggaaatgttcgtcgtcttctcgaatcatttcggctaaagaccacgcttctattcaattggaggttgtcgaggtggaccaggcgactgggcgaatgattaccggcaaaacgacgaagtacgccatttgtggaaagttgcgcttcatgggcgagtcggatgattgcattctgcgcttggctcagagggatggaataattccgcaaaatttgtgaacgttgattcttcacagggatgcggcgttcttttgttgattttgttgcctgcagaatgataaacactgttaaaaaacacaacaaaccaaccgca

SEQ ID NO: 49994 - DNA, 856 bp, Heterodera glycines
  SCN-specific regions: Sequence locations=1-66,88-192,216-243,268 -401,423-802,825-856
gttttaatatacaaagtaatgaaattgaatattgcttatcctgcgactggggcgcaaaaactcttcgagattgaagatgaaaagaaacttcgcattttcttcgacaagcgaatggcgcaggaagttgaagctgactcgttgggggatgaatggaagggctatgtgctccgaatttcgggtggtaacgacaagcaaggctttcctatgaagcagggagtgatcaccaactcgcgtgtgcgccttctcctctccaaaggccattcctgctatcgccaacgcaagaagggagagcgcaagcgaaagtcggttcgcggatgcattgtcgactcgaatatgtccgtgctggcattggtcgttgtgaagaaaggtgaacaggaaatcgaaggactgaccgacagagttgtgccccgtcgtcttggtccaaagcgtgccacaaagattcgccgtctgttcaacctgaacaaggaagacgacgtgcgaaagtacgtaatccgtcgcacactgccggctaaggaaggtaaaaagccgcgtacgaagacgccgaaaattcagcgtttggtcacgccggtgacgttgcaacggaagcgcaggcgcattgcgctgaaaaacaaacggcgtgttaagcgacgcgaggaagccgctctttaccaccaaacacttgctaaatacgcaaaggaaaagcaggcggaaaaggtcgctcgtcgccactcttccgcttcgcactctcaaggctgaggaggagaaagaaagtgcgaattgacttccgatatgcgctcttttcgtctatgtttggctgttattgttttgttgttttgcaatgataattctttgcgataaattggcgaattgtttaaaa

SEQ ID NO: 49995 - DNA, 665 bp, Heterodera glycines
  SCN-specific regions: Sequence locations=1-642
gtccaattaagctcaattcgccaaaattctcaacttcaaccaacttcacaaacttcacaccgacatttctctcctgaacatgtccgagaaatttgtcggcaaatggaatttggagtcgtcggagaactttgacgacttcatgaaggaggtcggcgtcaactttctcacccgcaaggccgctggctgtgtcaaaccggtgctggaattcgaagtgtccaacgccggcgagcactggaagatgacgtccacgtcgacgttcaccacctggaactgcgagttcgacctgaacaaggagttcgaggtgaagacggccgatggacgcacggtgaagaccattttcgcctacgaaaacggcaagctgaccgagaagcagtccaagctcaaggacgacgagaaggacagctactacgagcgctacatcgatgaaagcggcaaactcgtcattacgatggaagccggctcggtgaaggccaagcgcgtgtacacgaaggcggcctgagaaccgaagaagatgacgccgatctccgaagacgacggacgcttctgacccgttttcgtcattcttgaggccttttgatccgcaattcttaatttccatcttctaatttatttaatgcgatcaataaaagggttctctctgttaaaaaaaaaaaaaaaaaaaaaaa

SEQ ID NO: 49996 - DNA, 476 bp, Heterodera glycines
  SCN-specific regions: Sequence locations=1-40,62-264,286-476
cacaattaccgaaatatttacgtcgagtaatgaacaggcttagaagggatcaaaaagaaaaggttcaacagtttgtgtccttcacgcaggccaacgaacagacggcaattacatgcttgaccgcctccaactggaacttggagatggccggtgacatgttctatcaaaatccgtcttacaccaaccagcaagtgggaggcggcaccggtggtggcgcggacagtcgaaaaattgaccatttgttcaacaaatatgccagcgatgcaaaggacaaagcgcagaaaatcggacccgatcggatcggtcccaatggcatggtgcgtttcttgcgcgacttgaacatcgagccaacgagtcgggcagtgatggttttggcgtggaaaatgggtgctcaaaaacagtgcgaattcactgtacaggagttccgcgacggaatttccacactgattcccaccggcacggtcgacataaatggt

SEQ ID NO: 49997 - DNA, 487 bp, Heterodera glycines
  SCN-specific regions: Sequence locations=1-57,79-221,243-386,408-487
cttcatcgagataattcaaaaattaatcgccaaagaaacacgagcaatgaacaggcttagaagggatcaaaaagaaaaggtccaacagtttgtgtccttaacgcaggcaaacgaacagacggcaattacatgtttgacggcctccaactgggacttggagatggcctgtgacatgttctaccaaaatccgtcatacaccaaccagcaagtgggcgccaccggtggggcggacagtcggaaaattgagcacttgttcaacaaatatgcttgcgatccaaaggacaaatctcagaaaattggacccgatcggatcggtcccaatgggatggttcgtttcttgcgcgacttgaacatcgagccaacgagtcgggcagttatggttttggcgtggaaaatgggtgctcagaaacagtgcgaattcacactgcaggagttccgcgacggaatttccacactgattcccaccggtacggtggaaataaatggt

SEQ ID NO: 49998 - DNA, 1414 bp, Heterodera glycines
  SCN-specific regions: Sequence locations=1-16,38-262,284-1414
cttttccatggacatcgaaactgatgcaaatgcagttacacttgccttttaacatttgttagcattcattctcattttgctgttgttcttttggatgtttccgtttcgcccaataagaaaagtcccgtggtaccggcgcaaagttcctgatcggataagcttagttgcagaagaaacaattagccctgccgatgagaaattggttgggtggcgtttacatgactattacgaaattcaagagctcgtgaatatattgccgacgataaaggaaaagatcgattttgtgaacccctacgagaggccgtggaaacagtcggagctacgttggcacagaccatggatggcacctttatctaagcctcgctcggcatgggtcgtcccaccaactccagcttattttgatgtgctcgacttttccaaatatatcaccaagacacggttggccaccgatgaggaagccgaatgggaatttgacgcatattacaaaggcataaatttgccaacagccaaatttgaggaacgtgttgccgaaagtctggcacttcatttggaaagagaagaaatgtctaaaagagagaatcaccccgaaaaggaaagggaagaaaaccgcgccaaatttctccgctcgctcatcgatgatgcccatttaattttggcacatggaaacccaaaaatcatcgaccatcgcatttcacattctgaccgttgcgagtccttttggataagggccggttttctccctctgtacgagagtttgcccgtttgggaaatggaaaaagtgccgtccattcgaaaagtgaagttcaccggcgatgacagacgccgtcttggcgaactttcctttacaatgcgcgacaaacatacgatgcaagtgcggacgaaaagcccaatgaaaaggctcttcgattgggatgaacctgacaaactcgaggcaccagtgtttccgccgtcttttgacgttgcggatgaattgataatgtcacccatggtttataatcttctcgccgacacagagccattgtggcaatgcccaggctacgaatatgactcgggtgaaacgcataagtacggtcggttggctatcaaggacattactccgctgatcactcgtctggacactcattggcgttgcgacacggaacatgagcgaaaggaagtgctcagagaatgtttggccgcaacggcggtcgtatctctcttcaattggttgaatggacaagcgcattgtcttggacacactcaatacacagaaattgtcgccccgttgagttcccaattgatactttctgacggcttgcaattgttttatttcgctctcggtcaactcaacactctcgcaattaacattgatgttgaaggcttcaataatcagcggtccaatttttgttgtgttaatggacccttcaaactgtac

SEQ ID NO: 49999 - DNA, 646 bp, Heterodera glycines
  SCN-specific regions: Sequence locations=1-88,126-126,210-210,304 -304,387-646
gtccatttaagatatactattagtgggtgtaatgcgtgttctgtcatttgctggattacaactcaaattggacacaatcggagatggtgagaagatagcggccaaaatccgcgagtgtgccggcttggaggtgttggaaatgcgcggcaatacgcttggtgtgggtgcgaccgctccgatcgccgaagcattggagtgccagagcaacttgaagagagccctttggagtgacatgttcaccgggcgactcaaagaagagattcccaggacattgaaaactttgtgcgacgcaatgattctgagtggagcgaggctgaccgagcttgacctgagtgacaatgccattggtcctatggctgtgccggggataaaagaatttcttgctggcgaggcggcctttgccttaaagacgctgaagcttaacaactgcggccttggaattgcgggaaagacaattgctcactgtttgatagaatgccatcggcgatcagttagccatggcactccgctttgtctgaaaatctttgtcgcccgaaggaatcgcttggagtacacgtgaacagctgcgctagctgaagcatttcagataattggcacgcttgaggaaatctccatgccacaaaacgggattagcgctgaagggata

SEQ ID NO: 50000 - DNA, 481 bp, Heterodera glycines
  SCN-specific regions: Sequence locations=1-22,44-283,305-425,455-481
cactgtttgagttggattctgtccatttcgctgtgtcttcctcagaaattttgttgcatttgtgcaagacggaaatttgcaagtcggccaatgtggagaatgaggaccgaatgcgccgcctcatttcgcatttgttccgtgctcgctccctttacccgctgtgcccgtgtgaccaaaatttgccatttgcgccctctgcgagtgccaatgccaaactgcgcctgcccaggaagccacacgtgatggttctgccttcgctgcttcagccagtcacaaaggtggtggatgactgcgtggtgctcaatccgggccgcttcgacagagggaagggcaccggcacattttccgttctcgacttggacctttcgagtgccattggcgccacttcggtctcaccgttttgcgaagtctcactcttttcaacccaacaacaacaatgacaaaaatcacatttttgagtgtcgcaattgcccattttaac

SEQ ID NO: 50001 - DNA, 651 bp, Heterodera glycines
  SCN-specific regions: Sequence locations=1-651
tgctcatttgtcagcccatcccaaaaactgataaaaaaaaatggcgttcctctcccgtctctccatccttccaaattcgccaatttcgctgcttgcagtttctttggccgttttggctttcgtcgctttggcatcggccaatccgccgacggcacgcgaaacggcgccaaatgcacagcaaaacaatgccaattcagtggcaactggggaaattgcgaaaaatattgcggaaaagatggagcggatgaatgagttcattaattattttagggcgaagaagttcatcgatgcacataatttggcatttgagaagggcgaagtgtcgttcaaagttgcgccaaaccatctgatgcattttacacctgcccaatataatcgaattcgcggcttgcaaatgcgcagcaaccgacaacggcacaacatggcaactctggcgggaaacagcagtactttgccggaaaagttggactggcgcgagaaaggggcggtgaccgaggtcaaagatcagggggactgcggctcgtgttgggcattcagtgccaccggtgccattgagggagcattggcacagaaaaaagcgtcgaaaattatttcattgtccgaacaaaaccttgtcgactgttcgtccaagtacggtaacgagggctgtga

SEQ ID NO: 50002 - DNA, 1350 bp, Heterodera glycines
  SCN-specific regions: Sequence locations=1-180,203-365,387-761,783 -1350
gtcagttggaggacgaggtgctgctgcgcactgagctggagaatcgtctgcacaccgccaaagacgacttggattttgcgcgtcgcagtcacagcaaccaaattgaggagatacggcgcaagcgccaagtggaaatgacatcgttcagcgacgaagtggagcaccgttaccaggccaagctgcaggaacagctgcaggccatgcggttattactttgacaatcgcattgcgcagaaccgtgccgaggtcgatgaactgtaccgcaacaagctgggcgaggcggctgaaaacgcgaacagaaaccgtgacttggcggccaaggcgcgcgaggaagcggcaatgtggcgcgtccgtgttcaggacttggagaactccagcaaagaccatcagggcatcgtcgagtcgctgaaccgtcgtgttaaggacttggaggcggcgttgcgccgcgcgcacgaggacgccgacattcgcattcaacagcgcgacgaacagattgagcaactgcagaaggaaattgcgttgatgatcagtgactaccaggacttgttggatgtcaaagtgcagttggacaccgaattgcaggcgtaccagaagatgttggagcaggaggagaccagattgcacattacgccgtcgaccagtccgaacacgtcggttgtcgggcagaacatcagcacgcctaacatggtcatttccacgccacgtccggtcagcccgcgtttggcgacgccggttactcagagcgaaagtctgaccaccgtccgccgtggggtgaagcgccgccgtctcaaccaggatgacattgtctccttcgacaaaacgtccagctcgtggaagagcaatggccattccaacggcaatttggtgatcggcgaggtggacaaggagggacagtacgtgagcgtgatcaacaagggcaaggaggacgtggcggtgggcaattggactctgaagtcgagtgccggcggcagggaggtgcagtacaaattccactcacgacagacggtgaaggcgggcaaaacgctgatggtttggtccaccaactcgggccaggagcatcagccgcccaacaatttggtgttcaagaaccagcaatggccacacgacgacgccatccgcacggagctgttgaacgcggaccgtgaggtggaggcgtggaacgaggcgtttctgcagcacagcttcagcagccgcgtggaggagggcaccgacattgataagaattgtcgcattatgtagatgagtgacaaagtgatggaaggatgatgattggagtaattgagttcgttaaatcaattgtttttttgttctgtttgcttttgaacgataaagtccatccctcgtaaaaaa

SEQ ID NO: 50003 - DNA, 2094 bp, Heterodera glycines
  SCN-specific regions: Sequence locations=1-95,152-187,227-275,317 -416,441-467,529-550,573-582,608-622,672-672,708-770,801-837,861 -872,897-904,926-929,958-1202,1224-1345,1369-1385,1420-1451,1473 -1474,1507-1518,1567-1585,...
  SCN-specific regions: Sequence locations=...1618-1654,1679-1713,1759 -1801,1840-1855,1879-1963,1993-2028,2050-2094
gtccaattaagtattgtcaaattgctttttcaaaaatgccagctaaagctaatgcaattggtattgacctcggcacgacgtattcgtgtgttggagtcttccagcacggaaaggtggagatcatcgcgaacgaccaaggcaaccgcaccacgccgtcctatgtcgcgttcaccgcacaccgaacgtttgatcggcgatgcggccaagaaccaggtggcgatgaacccatccaacaccgtgttcgacgccaaacgtctcatcggacgcaagttcgacgacccggcggtgcagtcggacatgaagcactggccgttcaaagtggtgcagggagagggtgctcgtccgaaagtgatggtggaagtcaaaggcgaggacaaagcgttcttccctgaggaggtttcgtccatggtgcttatcaagatgaaggagacggccgaggccttccttggccagactgtcacggatgcggtggtcacagtgcccgcttacttcaacgactcgcagcgtcaggccaccaaggacgcggggaccatcgccgggctgaacgtgttgcgcatcatcaacgagccgacagccgccgcgattgcctacggcttggacaagaaggggcagggtgagcgccatgtgctcattttcgacttgggcggtggcactttcgacgtgtccatccttaccatcgaggacggcatcttcgaggtgaaatcgaccgccggtgacactcatctcggtggcgaggacttcgacaatcgaatggtcaaccactttgtcgcggagttcaagcgcaagcacaagaaggacctcagttcgaaccctcgtgcgttgcgtcgtttgcgtacggcctgcgagcgcgccaagcgcactctgtccggttccacccaggccagcatcgaaattgactctctcttcgacggcatcgacttctacaccaacatcacgcgcgcccgcttcgaggagctttgcgccgaccttttccgcaacaccatggaccctgtggagaaggctttgcgcgacgcgaagatggacaagtcccagatccacgacattgtgttggtcggcggctcgactcgaattccgaaggtgcagaagcttctctccgactttttctccggcaaggagctgaacaaaagcatcaacccggacgaggcagtggcctacggagcggctgtccaggcggccattctttccggcgacaaatcggaaactgttcaggacttgctgctgcttgacgttgcccctctctccctgggcattgaaacggccggcggcgtgatgacttcactcatcaagcgcaacacgaccattcccgacaaagacgtcgcagacattcaccacctattcggacaatcagcctggtgtgctgattcaggtctacgaaggcgagcgcgcgatgaccaaggacaacaacctgctgggcaagttcgagctcagcggcattccgccggcgccacgaggagtgcctcaaatcgaagtcactttcgacatcgacgccaacggcattctgaacgtgtcggcccaggacaagtctaccgggaagcagaacaagatcaccatcaccaacgacaaaggccgcctttccaaggaggaaattgagcgcatggtgcaggaggcggagaagttttccaaggaggacgaggtgcagcgtgaccgtgtgtctgccaagaacgccttggagtcctactgcttcaacatcaagcagacaatggaggactcaaatctgaaggacaagatcagcgaggacgacaagaagaaggtgctggagaagtgcggtgaggtgctggcatggctcgacgccaaccaggcggcagagaaggaggaatttgagcaccagcagaaggaactcgaagggatctgtaatcccatcatcaccaagctctaccaagccggcggcgcaatgcccggcggtccaatgcctggcggagggatgcccggaggtggcggcgctgctggtgcgggaggagccggtggaccgaccatcgaggaagtggactaagcgagtcgatctcttcgcgatcattttttgtttgatcgattatttaattttatttttttctcgcgtaaattgtttgacatataaattcattggttgcttaaaaa

SEQ ID NO: 50004 - DNA, 1140 bp, Heterodera glycines
  SCN-specific regions: Sequence locations=1-116,138-397,420-1140
aattgtgccaaaatgcgctgctcccactcccttccgctgttcctatgttttgtgctcttcgctgggttggcatcgctaatttcggcccgacttgcgcacgaatcgttcgccaaacaccgccaccactcgcgcggcggtgccgccgctcggccagaagcagcagcaggcgatcaaccgcagaagcgcaaaagcatttacaactcgaacaaatgctaccggcaaccgtcggacgcggaacgcgtccaaaaacgaacttcgatgcgtctttatgagttcgacgactatttgtttgacgagttgccagagacttgggattggcgcaatgtcaacggagtcaactacgcgtccactgatcgcaaccagcacatcccacaatattgtggctcatgctgggcaatgggtgccacttcttcgctggctgatcggatcaacatcaagcgcaaaaacgcgtggcctcccgcctatttgtcggtgcaggaagtgatcgactgcagcgaggccggctcatgcgaaggcggcacgccggacaaagtgttcgagtacgcgcacaaaaatggcattccgcacgaaacgtgcaacaattaccaggcgcgagacggaaaatgtgacccgtacaaccgttgtggttcgtgttggcccgacaaatgtttcaccgtccaaaattacactttgtacaaagtcggcgacttcggctcggccaatggaatccaaaagatgaaggccgaaatttaccaccacgggcccatcgcttgtggggtggcggcaacgccgcggtttgacaattattcgggcggaatttacaaagagcgaacgaatgaggatattaaccacgtcatcagtgttgtcggatggggcaaagatgcggcttcgggtgtgccgtactggatcggccgcaacagttggggcaccgcgtggggagaacaggggtggtttcgtgtcgtgacgtcggagtaccgcgacgcgggaaacaaatacaatctgaaaattgaggaggattgcacctggggcgagccaattatcatctgaatgaggagcgaacaatccgagcactgttcaagccgatgccaaaattttttccatttttgtccaagcatttttaagccaaaataattacggaatttgacaaattaggcaaatatc

SEQ ID NO: 50005 - DNA, 615 bp, Heterodera glycines
  SCN-specific regions: Sequence locations=1-5,27-268,292-331,353-615
gtccaattaagatttattgtaattttgtcacgcatttaaggtaggctgaaccaccgaatcatcccatccctcctaaaaaaatttggacgcaaaatttttaaatggccgaatccggtgaacatgaccatgactttacatctggcgagtcgggtgcagctgccacttacccaaagcaatgctctgccttgcgcaagaatgagttcgtcatgatcaaaggccgtccttgcaaagttgtcgagatgagcacctcgaagaccgggaagcacggccatgccaaggtgcacctggttgcgttggacattttcaccaacaaaaagttggaagacatttgcccgtccacccacaacatggaagtgccagtggtcaagcgcaaggagtaccagctgctctcaaccaacgaggacgggttcatttcgctgatggatttggagacttgcgacaccaaggacgacctgcgtctgccggaaggcgaaattggtgaccaaatcaaacaggcctacgaaaaggacgataacggcattcttgtgtcggtggtgactgcgtgcggtgaggaggccatcctcggctggaagttcatgccaaacaaatagttggaggacgacgacggcgatgacg

SEQ ID NO: 50006 - DNA, 1071 bp, Heterodera glycines
  SCN-specific regions: Sequence locations=1-17,54-1071
atttattttagttttccaaaataatttaaattttctttattttaataaaataacaactaaaatatggataaaaatataggaaataaaaacaacaatgaatttttattgcttggaatgggaaatccattgttggacctgcaggtcgcaactttggacacacaaattcatgcaaagtatggacttgcagaggacggcgcggacctaatcaatagtgaaaatagtgcctcacttttgccaatttttgacgatatttccactcttggcaataagattgaatttgtacccggtggttcagcacaaaacacggtccgagtttgtcaatggatggtcaaagcattcggcgtaaacctcaagtcctgctacttttttggtgccgttggcaaggacaaatatggtcaaattttgcacgagaaggcccaggctgcaaacatcgaagtgcgttaccaggaagtgccaaccgaaaagacgggtacctgcgcggttttggtgttcggcaataagaggtctttggttgctcatcttggcgccgctgaacatttcacccctgtccatcttaacattgaggccaaccaatcactgattgaaaagattagcaatttttacgtcgagggatactttctaaccgtctctttggaatcgattctttttctggcaacgcatgtcatctcttccactcggcccaaacatttcgctctcaatttgagtgccgaatacatttgtcagttttttttccgaccgacttgaaaaagtgctcccctatgttgacattttgtttggcaataaacaagaagcattggcttacgcaaaaactcgagaaatcggaaaaacggacgttggggacatcgcattgtatttgagtgaaaaggagaaagtgaacggtgagaagaaaacggatagtcgtgataacacagggccctttgccggttttggtggcccatgactgcgaactcactcagtttccagtggagccaatttcggaggacaaaattgtggacaccaatggggcgggcgatgcattttgtggaggctttttggctgcattttccaccggccgctctttggatctttgcg

SEQ ID NO: 50007 - DNA, 555 bp, Heterodera glycines
  SCN-specific regions: Sequence locations=1-555
gagctccccgcggtggcggccgccctacaatagtggatcccccgggctgcaggtatcagagcacgagggtccaattaagtcggcagaaaaaaaagacatttttctgctttcggcccaaatacgaataatgagtgtcggtttgtcctcaattgtcgatgattctcaccagcgacaaagtcacttttgggctgagattctcccgcccggcgttggtcacaccaacgacatttcgggagatgccatttggacactttcgagctgtaaggagggccttggggtgcatcagttgttgaacgaccgcgaagacacttattggcaaagtgatggtcttcagccgcactcaatcaccatagaattccaacggaaaacggaagttgactttctgctgatgtttttggactacaaactcgacgagtcgtacactccctccaaaattcaagttcagaccggcgcttcggtgttggatttggacgagcccaagtccctttccttcacagagccttcggggtggcaaatgatcgaccttcgccatgccgggacgaagcgaccggcgaa

SEQ ID NO: 50008 - DNA, 773 bp, Heterodera glycines
  SCN-specific regions: Sequence locations=1-267,291-315,342-345,379 -595,649-654,676-773
attgctcacacccagatgaaactgatgaagcaccgcaacaagaaggcacacataatggagatccaaatcaatgggggtaccgttgccgaaaaagtggactgggctcgtgagcactttgagaagcaggttcccgtggagcaagtgtttgagcaggacgagatgatcgactgcatcggtgtcaccagaggaaagggtttcaagggagtgaccagccgatggcactgtaagaagttgccgcgcaagactcacaagggtctccgcaaggtggcttgtatcggtgcatggcatccgtcgcgtgtctcattcacagttgcgcgtgccggtcagaagggctaccaccatcggacggagatcaacaagaagatctaccgcattggcaagtcgtgtttgacggccgacggcaagaaaaacggaatgaccgacttcgacatcacttgagaagaacattaacccgatgggcgggttcccccactatggtctggtcaatcaggactttctgatgatccgtggctgttgcattggttgcaagaagcgtccgatcacattgcgcaagactttgatcaagcagaccaaacgttttgctttcgagaagataaacctgaagttcatcgacaccagctccaagtttggccatggacgcttccagacgagtgcggagaagaaaacattcatgggcaaattgaagaaagactttctggcggaatcggcgtaaaattggccaatttcattgtttattattttgttgaaagtataaagaattgttgtgttaaaaa

SEQ ID NO: 50009 - DNA, 512 bp, Heterodera glycines
  SCN-specific regions: Sequence locations=1-512
gctctcttccgtcttcctcttccgttatcttccaacaattcacgatcgatcagcgacactttgtggacgaggattacttcagtctcgagagtattttcgccaccaatacgaatatttgctgcactttcgagtctaaaacgccccccgcgctttttcctctgctcggccggaaagtttttgaggtcatttctgagaagggataccgtgccaatgttcccgcttggctcgtccccgccgtcgaccacatttgctcgtttgccgtgcccaccgtttacaattccgtcaatcgcgacgtaatccacgcgggtgcccaatcggtcaacttggaacagttgcaacgccactactacacattgggcacgttcatttgcagattggtccccggcgaacaggcgcaacacatcgccttggcattgctttccgcgttcacccaacgcatcggtcgaattgtgcgcgactgcaccaacacgggggcaaagccgacgcggctggacgagacggagaagcggatt

SEQ ID NO: 50010 - DNA, 472 bp, Heterodera glycines
  SCN-specific regions: Sequence locations=1-368,391-472
gccatcgtcgccattctttcgtatggtggctataaccaggaggactccgtgattatgaatcaggctgggattgatcgtggtctgttccgttcggtgttttaccggtcatatcgtgattcggaacaagagattgacaatgtgaacgagcaactgattgagaagccgacgcgcgacaaatgcaaagggatgcgaaacgccatttatgagaaattggacgatgacggcatcacttcgccaggcactcgagtgtcaggtgacgatgtgatcattggaaaaacaattgctttaccagaggtggaggacgagttggaagccagcacagcgcgctattctaagaaggatgcgtcgacaacacttcgaagcagtgagacaggcattgttgaccaggtgatggtcagtgtcaacgcggagggcaacaaattcgtcaaaattcgcgtccgttcaattcgaacacctcaaatcggggacaaat

SEQ ID NO: 50011 - DNA, 670 bp, Heterodera glycines
  SCN-specific regions: Sequence locations=1-670
gtaaaggaagcgatacccacccaaaatggaaatgtcgacttcatttcttgactctttgcctggattttctgttgtagattttaatggaagtcatgagaaaagaacttgtgctcctggtgaacaattattttcagtctcaagtggatatcatgcgggaaatggctgttatgaatttcatggttcaatatgtgcttctcttgcaggatttttgcacgtttattcacttagagattcgcaaaacaccgagacaaacattgtcgaagtgagacgcaacattgacgagagaagcaatgtgctgccgtcacagggaaagatagtcactgcaagggttgagcgtattacgacaacatttgcaaaatgtgcaattatctgtgtagaagacacacccctcgccaacgaatttaactcgactttgcgcaaggaggacatacgtgataaagagcgcgataaggtggaactgcacaaatttgttcaacctggtgacatcattttggctcgtgttttgggctatggcgaggcgcacacttcttatttgctcacaatcgctgaagctgaattgggagtagtgattggccggagccaaaacggcgaacggctgttaccggagaattccgaaataatgaaagtgccgggaagcgaataccgagaaacaagaaaagttgcacagctt

SEQ ID NO: 50012 - DNA, 467 bp, Heterodera glycines
  SCN-specific regions: Sequence locations=1-467
gttggattaaatcgaaaagattcaagcgaaagtcaggagcccggtcttcatcctttccagtatgtccaggccggtttctttacgggtgtcgccacaagggcgattatacaaccattcgatgtgctcaaaatccgactacagcttcaagaagaacctttacgtgggaaaagtcgtggaaaatacagtggaatttttcaatctgccaaattgatttaccacgaagagggaatcgcagcattttggcgtggtcatatcccagcgcaaggcctctcaattgtctatggtctggtacagttttgcactttcgagctgctcaccaaacaggccggcgacttcggctttcacaatttctcaaaatcagtcgattttgtctgcggtgcctctgccggctgtttggccaccacttgtgcaatgccttttgatgtcgttagaacgcgaatggtggcacaaggcgcccatcggaccta

SEQ ID NO: 50013 - DNA, 635 bp, Heterodera glycines
  SCN-specific regions: Sequence locations=1-635
gtccaattaagagattaatatataaaatggccgtggtaagccgaatgtggtatattggaaaggagacttgcaaattcttccacggtgctgtgaaagtcttttttgacccaaattggcaaatcccaaagaccaagcttgatccaagaatgcccgcctatccaacccaacttcatgaatggcttcgcatgttcccctggcgtcattactgggcttactacccaattctgcgcaatttttgctacgtcttcgcctcagcttttgtcgttacgagcattactcaaccgacaagcgttaaaatcaccaaagaacacgtgatcaaccacgaattgcatcacatcgaagcgaaaatgctccacgcgtacacccaacggaaggaggacctgaagtacttcaaggagaacgacgtcatggccaaactgcgcccgaaaaactttgccagggatttgtcaatgggcgacttcaattacttcccctgggggtattccttcggagcgcactgatttctgcggagtacagaaaacgaaggtggacaacgcatttgcgatgccaagcacagattaggacaatgtttgttgaaaatgtaccattgctattatattttgtgggaagtaagagaaataaaaggctagccttaa

SEQ ID NO: 50014 - DNA, 446 bp, Heterodera glycines
  SCN-specific regions: Sequence locations=1-63,85-226,248-446
aaataaatgcgatgcttttccgctattttcccctgctaaacgaatatagcgcccataagcttttcctcactcttttcccctccaccggcagcgaaatggtgcgtggaaatccgcacttgccaataatcgtcgggaaagagcattgctccaacggaaccaaatggattctcaatgtgttcggcgattgtgtcgacactccgatgaaaatgtgcggcttttgggtcggattgatgtccttgttcttgtggctgatccctctgtttcctcaactgtacgaaaactttcggaacaaacgctgtgaaggcctttccatcttctttctgatgttttggtttatcggtgacagttgcaacatgatcggtgctgttctcacccatcaacagcctctgcaacagatcatcggcgtgtattacattttgcaagacttggctttgcttggtcagttc

SEQ ID NO: 50015 - DNA, 3306 bp, Heterodera glycines
  SCN-specific regions: Sequence locations=1-11,63-63,97-163,191 -208,240-1045,1067-1184,1210-1664,1687-1837,1860-1884,1906-2025,2047 -2067,2090-2179,2202-2509,2531-2543,2566-2897,2922-3144,3179 -3233,3255-3269,3292-3306
ctgaacatggccattttgcagaatctgaacgaaaaggaggccaaaatcccaacttcggtcggtgtgcagttgcgcattctcaactcaatgccgattttggccaacatcgaaggccaaatgaagatcaaagcggagtcggcaagtcttatgtctccactcggcatccaattcgacgtcaacacattggcatccgcccgcctttcgcaaatccagaaaatggaactatggactccgttcgcgtccagtgtgtgtggaaagtgtgcgctcggcccaagtcaatctgccgcttcaggccgaactgaacgccaactcggaccagggcatcagcctaaaggcgaacctgcccaagcagaagacgcagttggccagtgtccattccctacccatcaccttcactgcaaaagtggaccaaaacaccaaattggtcgcgcgagccgcgccaaatcgtcaccatccacgaccctaagctggagagacagcagtacgagctgaactcggtccagggacagaagaacttggccatgccattacacttccgcggacattaccattggccagccgagccgaccagctaccagcagttcgcgcagctccttttggccactgaaaacgcggtgaacattcactaccagccgagccgggaaagtccacgcgaggccatcttccgcgtcaccggccaacacttcgaacagttggcacagagtgaacagccggacgcacagctgcgcaacttcttctccgagaaattcgccaatgcgtacagctgcgacgacgagcagtgccaacagaggggcgattgcgaacaatgcgagcaaatcgagcagcaacaacgagaggacgcgcaggagttggaggaccaacagatgcgacagcagtcgctgcacagcttcatcagtgcgtacaagccgcgccagcaatacaaacactcgctgaaaatggtcgcgcagacgaacggcggggcgaaagacgcgaaagcccagggcgacatccaagccatatgcgacgagcagaccgcgtactgcaaagtgctggtgaaggtggagcgaccaccaatcggcaatgagaaccaaaaatggatgctgaacgcacaagcgcacgttttgatgccggagaccgccgcatcagtggagcagctgcagacacagcccaagcagttgaagcagttcatcgcccaggcgaaagcccagtggggacagcagggacagcagacgcagcaggtaaacatccgcgtgcacggcgcccaggcgcacacgcagcaggtgcgggcggtgctacagcaacaacagggcagccaactgatcagcgcgcagcatttgcgcaacatgcaacgccgcagcgccttcctgaacaaattccaaatcgaggcaatttactcgctgaaagccaacgcccaaaatgcgatcaaccgcgtgttggagctgttcaaatcggcctacttctggaacaccaaatcccaactgatgagcggacagagtgcacagaaagacggaaagatcgccgccacaattctaatcgacccggtgactcagaagagtgccaacattaccatccgaacgccggcgcaacagttgcgcatggagcagatcgaagtgccgtacaaagtgcgccctttcgctttgattcgccagcggagtgcgcaacagacgcattcgctggctcagctgttccaccaattcagcatcaaataccgcccccaatgcaccgttgacgggcgcaaagtgaacactttcgacgaattgatctacacggcccccctctcctccaattgttactccgtcgtggccaaagactgcggctcagaccaaccccaatttgtggtgctgatgaagaaggtcgcgcagcagcagcagcagcagcagacgaacaaaagggcccaaaacgcggctaaggtgctgaaagtgatcacaccagagcagcaaatcgaatgccatccgaagacaaacgccgctggcattccaacgcaattgatttgcaaagtgaacggacaacaggtcaccggagatgagcagtgccaggacagttcttcatgtgtgcagttcaacaacaaacaacaggatgacgtgaccattcagacggaggcaatcgcagtgcgtttcaacggacgcaaggcgtggctgaaggtgtcccaggcatacaaaaacacccaatgcggactttgcggacactacgacgactcggacgaccagggggaggagctgcgcatggccaacggccagagagcttccgacttggccgagttccaccgctcctacgctttggaagacgcggaagaatgcccacaacaggtgatgaacaacttctacagcgaacagcagcagcagaacagcgagcaggacacattctacgggcagttcaaccaatttgaggacgaagacgaagcggacgatgagcagcaacaacagtctgaaaaggacgaatggcagaatgagcaattcaatggccaattcgaggagcaaaacgatggccaagtcactgacggaggcaatccgttcgaaggaattttcaacgaccaacaacagcagcagaagtgttgctgctgctgtgacgacgacgaggacgaagagggcaccaacgaacagagccaatgccgacaaaactgccaaaacggcggggaatgcccagagaagtgcaacaaaaacgaccaaaagcaatgccgaaagtcatcgccaccacagccgcaacaacaacaaaattgcaaaggcagcgacgacgagcagtgcaaagggatttgcaacgacggagacgaagcatgtgccgagcagcagcagcagtggaaagcagtttggccgattttgagaaccaaaacccacgagcagaaccacgcggtgtgcttttccactcgcccggtcaaacactgcccgccggatgcctacccgtacaatccgatgaacggttatgagcagcagcagcagccgaagaccaagaaggtcagcttcgtgtgcatggagcgggcggagccggagacgcgtcggctgttgcgctcgttgcgacgcggacagcgcgtggtggacgtaaacgcacgcggcgcctccttcacggagaatgtgagcgagccgcatcagtgctggcgcagacgctactgatggatgaacggacgatttggtggatgacagaggagtgaccccccaacggagtagaaaagcacaaagcgtagaccaacccaaaaacaaaacaataatcaccctctgctgatcaatgccattactcaaatgatcagcaccacaactccgccatttcctataacaaattgtatttttgtgatagtttagaataaaaaatttattaataaaagaaaaaacaaaagaa

SEQ ID NO: 50016 - DNA, 906 bp, Heterodera glycines
  SCN-specific regions: Sequence locations=1-177,199-652,675-759,781-906
gaatggcttcatttttacgcagtcggctgcgctgaaaacaaaaaaaaattataaggcaaagaggcggtggatcaccccatttctcaccaccaatcagtccaacgttccatcattaacaaagcagcgttcctaattttgccaatttctaagggtctttttcaagtcgaggatgtcttcgcctccttcctcagtccttccccaggatgttttcattctgtccgctgtgcgcactccgatcgcttcttttcgctcatcctttgccagccttaatgccgttgatttgggcactttcgttgctaccgaagcgatccaaagggccggcttaaggcctgaccaagtggaagagacggtgactggctgtgtgctcagcgctgggtcgggccaaaatgtgtcacgccaaatcgcgattaaatccggtatccccgaggcgaggcaggcgtacactgtgaacaaagtgtgctcttccagtcttaaggcattgattttgggtacccaatctgtgcagttgggacaacgttccatggttttggtggttggcgttgaaagtatgagtcaggcaccattttacttggcgcgtggtgacaacaattacggggatatcaaacttttggattccatccaacgcgatggcatttcggacgcaatgctcggccaaccgatgggtgtttgtgctgagaaaacggttgctgaatttggcttcacgcgtgagcagcaggacgcgtatgcactcgcctcctatgctcgtgcgactcgcgcgtgggcgggcggcgcatttggtgcggaaattgtgccggtgaaagtcaaacagcggaagggcaccgagttattggtggcagaggacgaagagtatcggcgactaatgcccgacaaagtgccttcgctgcagccggcgtttgtcaaggacgg

SEQ ID NO: 50017 - DNA, 885 bp, Heterodera glycines
  SCN-specific regions: Sequence locations=1-154,179-254,276-711,734 -740,762-885
cacattctcttctcgccaaagccttctccgcatttgttaagccgccgttctcctcaacaaataacacacaaccatcatgtcggaaaagaaggtcaaaaaggtgaagaagaagtccaggaccggctccgaggcgagctccttcgaccagaagaccatccaggagttcaaagaagcatttggcattatggaccaggacaaagacggagtgatcagcaagcaggacctgaaggacttgtacgccacactcggagttgtggcgagcgactcgcagatggacaacatgctcaaggaggcaccggggccaatcaatttcaccgttttcctgacactgttcggagaacgactgactggcactgaccccgaggcgacaattatcggcgcctttcaaatgttcgacaaaactgactgtggcgaaatcacagaagagacattgatgaaaattctgaagaacaaacggggggagccattgacggaggacgaagtgcaagggatgtacaaagggaaccctccaattagtggaggcaaagtggactacaaggcattcgcgcatttgatcacgacaggcgcagcggaggagttggccaaagtgggctaagcggggccatggacggacgggggaggaaggagtggcggggccgaggccaacgagtgacctgccgattcgggggaaaaccgatcatccatcccgtcgttctttccatccttacgatcgatcacccttttccccctcgcccattgtatctccttttgttctctttctaatcgctccctctccaaaatgtgtgtcccggctggcgagaatggcagcaccttctaattctataaaatgcatcgtttgttttcgcttcactcagtgcacttccaaataaaatcgaatggatgggt

SEQ ID NO: 50018 - DNA, 868 bp, Heterodera glycines
  SCN-specific regions: Sequence locations=1-125,147-374,396-563,585 -774,809-821,857-868
acgaagcaacaaaatatggccatttttgttacgaggacgacaaagaggaagacgaagacccgttcagtttcggcaaaatgatttcggcacaaaagaagggcagcgaggacgacagtgattgacggttgaatatttttgctattgtgctaaaatccatttttgtcagtgcttttacatggtttggtgtttgtttaattaatgcaaatttaaattcgaggcaaaatttcataaatcacattttaattgtttcactgtcttgtccaaaaatttttttgttttgtcttttctgaaaaacaatcacttactctccgccatttcattttcgcaaaacgaacgaataaatcacacatttaacaaaacttgctcattattttgtttgtaacaatttgtattttcatttgctgattattcaataaaattccatttcattttttcggccttcttgaatatgaatactcctgctgcctatgagccgtttctgttggctgatggagagaaaaaggtggtcattgagaaggacacaaaagtgccgaatgcggcggtgtttacttttaacaaggaggaccacaccctcggaaacctcctcaaacatcagctcctcaaagatccgaaagtgctttttgccggctaccgaaacccccaccccttggaacacaaaattttgctccgtgtccaaacaaatcccgaaacaacgccaatggaagcattgaacaatgccattgaggatttggtggcggagttttcattattggaagagcgatttcgagacgcgataagggaaaaacgagaagaatgagaaattgttcttgtttacggaactgattattttatttcatttttcaataaataaataaaagtagcaccgaaa

SEQ ID NO: 50019 - DNA, 430 bp, Heterodera glycines
  SCN-specific regions: Sequence locations=1-430
ctgcgcaagaagcaacatttgctggtgcaggcgcgggagaattggacagcgaaagatctgaaaagagtggtggagggcattctgaaggtgccacccgagaaacagtctctgtacaagccgaccaatgagcagcggacggaatgggaggcaatggacgagaagcaaacgttgcacgaattgggattcacaatgaaaaatgcgcgagcggatggcccggctgtgttggcgttggttttgccagaggatggcaaaagtcccgacatagtgccgatgacagtcgcaccgccggtgcccgaagcaatggcacagaacaaacagtccgaagttgaaatggtcgaggagtgacgacaccacaacattttagagggcagtgattttctcagttgacttcgccaaattttattggaaaataaataataccgaaagcatt

SEQ ID NO: 50020 - DNA, 500 bp, Heterodera glycines
  SCN-specific regions: Sequence locations=1-500
gtacccggcacgaggtaaggatacaagtattaaaataatatgccgccaaaagcctcgaagaaaactgacccaaaagggggaaaagcggcaccagcgaagaagaaagagggcggaggaggagggaaggccaagaagaagaagtggtcgaagggaaaggtgcgcgacaaactcgccaacatggtcttatttgaccaagccacctatgacaaattgtacaaggaaatcatctccgtcaaactgatcactcccagcgttgtctccgaacggctcaaagtgcgcgcttcgctggccaaggcgggcctggaagagttgcaccagaaggggctgatcaaatgcgtggtgaagcacggttcccaattggtgtacacacgggccaccaaagcggaggaagcctaagaaaagggggaaacggggcgatttggtttttcctttttttttagattgttgatttgttgaatgaatatgtttttttaatttttaaaatcatttgttaatctgtc

SEQ ID NO: 50021 - DNA, 666 bp, Heterodera glycines
  SCN-specific regions: Sequence locations=1-533,580-633,665-666
gagctctataacacatatatttcataaacattcatcattgaaaatgggcgagaaatttgttggcaaatggaatttggagtcgtccgaaaactttgacgacttccttaaagagattggtgtcagttatttgacgcgaaaggctggcgcatgcatcaagccggtgctcgagtttgaagtgaacgggaacaagtggaagatgacgtccacttccacattcatcaccatctcatgggagttcgagttgggccaggagaaggaggtgaagacggccgacggacgcattgtaaagacaaccttcacctttgtggacggcaaactcattgagaaccagaagaagaccaaggcggaggaaaaggacagttactatgagcgttatgtggacgcggatggaaagctcatgatcaccatggactgcgacggagtgaaggccaaacgagtgtacatcaaggcatgattaaaaactaattgatgaggaggaagaatggacgaaaacggagggactgagagggacacaatgccaaacaaattgcgccaaaaataaatttaaaaaataattgttgtttgtttttgagaccaaatttgatagaccaaagaatgcctagatacaagttggatgattttgaattgttgtagttttttggagtgaaaaataaaacaatttaaaat

SEQ ID NO: 50022 - DNA, 1086 bp, Heterodera glycines
  SCN-specific regions: Sequence locations=33-110,132-193,215-1086
cctcgtgccgaattcggcacgaggtaaaatcactgtttgactcgcattttaattcgctgccaaatagcaaattcaagtgcatgatttcaagaatggcctcctcttcgtgttcctcgccgtcttcctcctccaaatttggaccacaaatgaaatgttcaacgccaaaacccgtgccaatggatgatgacggcacggaggagggcgaccacggcgaacagttgctgttggaccggcacgagttgcgcattctgtgcgacgagcatttgcagagcggtgactgtcagacggccgcattttgggccgaaaaattgttggcattgagcatcgggaggacactgaacgaacggttgccggacattgcgcattatttgtcggtgcttacggcggcccaattttggcagacaatcatcacattaattgaacggcatgacctgttccccaagcatttggtgttcgcctttttccacatcaatgcgctgttccatcgcgagttgtactcggaaatcattgcactgcccgtcggctatttgtgccattgggacgacgtgccgttcattcagccggacagtgccacgtacatttgtgccgaaaatgacgcggtccgtgagcccggcattcgccaacagttggacacattgttacgtgaaaagaaatacgaaagtcgaatgctgttgctgctggccaaaacgtatttgatggtgcagaacaggccggccgccgccggctgtttaaagcctcccgaattctcgaaggccacttcgagccgttgttgtacattgcggtggagtactgttttgccaacaatttcaagctggccgccgactttctgacagacgcggcccaattgctatggatgcccttcgtctgctcgtcggtgccaacaatacttcaaatttgagtgccgttgttgacgaacaacaaaatgccatcgacgattattcggacggtcagcaacaaccgccgcaacaacagcatcaaacggttgaacaactgatggcccccggtcatcgacttcgggagccgttgttttgatcaattttcatgatttttgttttttttcattttgtctttcctcacctttgtttt

SEQ ID NO: 50023 - DNA, 1080 bp, Heterodera glycines
  SCN-specific regions: Sequence locations=1-284,306-776,798-1080
gtccatttaagcgaaaaatgcacttgggagaataaacaaggagagaaacaggcggagacgcgggcgcaactcaaagacgacgcctttctcagggaaattcactcgcggctgaaacccggcattgaaaattcggagcgtcgtttcgatgtgcacaaattcacttgcgccgctttggaattgcccgacttttcggacttcgcccgactccgtccgttaattgacgcactcattgctgaattggatctcaacgatttcctcggctgcaccgcggcgctcgaaatgctggcggagacggccgccacggcgccaaagtgtgtgcccttttttggccaaattggcctcctggacaaagtgtacgcgctgttcatccgaaccaaggaggagccggacatgggcatcattcacattgcgtgcattcgcttcttcgcctatctgtgcaccaccgatgacaacgcattgaccaaatttcccaaattcacggccgatgttttcgacgcggtgttcagatttgatgcattcgacgtcacgcgtcgtcagttggccttcgaaacgttggcagtgatcagttcgaccagcggggccaagcagatattctcgcagaacgaaactctctacaacatgcaacgggcgatgagcaatttggctgtggcggtggcaacggccgccgagccgtcgctgaaggcgcgtcatttggaagcagttcggatgttttttgatcggattgccgacgaaagcggttgccaacccgaacagaaatgcaccaccgcgtccgctgaggctgaagagcagctgctccaccggtggttccgctggttgggcgaaccgttcccccggctgttgctccaatgtgtcagggatcccatctccgaagttcagttggccgctctccgcgtgctgatggcactgacgcgccaccaatgggcgtatgcccatttttgtgccataactgatttcgtcaatttgctggtcgaccgttccgtcaatttcgacgccgacgcgatgcagctcaaatacgcgctcatttgtcgcttggttgaggccgcgccgtccgcgctgaacgacggacagatggaaatgctg

SEQ ID NO: 50024 - DNA, 640 bp, Heterodera glycines
  SCN-specific regions: Sequence locations=1-640
aaatatggttttggacccgaaatcgaaagacaaggcgcgggaacttggttcctaccgcgatatgcggttcgaggggtcgttgcccgaacaagaacgtcggcttgcacagtccaccactctctacattggtaatttgtcttactttacttctgaagaacaggtatgggagctgttccgccgcgctggagacgttcgtcgggtgattatgggcctggaccgttttaacaaaacgccatgcggtttctgttttgtcgagtattatacacgtgaagatgcagaaaatgcactgagatacataagcgggactcgccttgacgacagagttgtcagatgcgattgggacgcgggttttaaggaaggtcgccagttcggtcgtggtaaacatggcggacaagtcagggacgagtatcggcagaattttgattcgggaagaggcggatggaacaaaacaattcaaaaacgaaatgaccaattcacccagcgaaatatcaaagcctgacattcgacttcgttggacaaaattcaatttaaaatctcattgcttattattattgaccgttgttttgttatccatttaaaatttgctcttatactttcatttcattacatttttggtgtatcagtgaacgcattcattcat

SEQ ID NO: 50025 - DNA, 1144 bp, Heterodera glycines
  SCN-specific regions: Sequence locations=1-3,25-785,808-930,952-1144
agattttcaaaatacaatttttatgtgtaataattttcaacgcattggcttttcgattcgcggttaaatgaatcgcgaagaaacgaataaacacccattgattgtcacttacgccggccgtcactatgacatctccggctttgtcagccggacatccaggtggtgagcgggtgcttcggatggttgcgggtgctaacgtggacagttttatcgacggcacttcggagttgttgggccctaaggcacgaacattccgccgccgcttatggaattttggcccgttattctttggaccaggagtttaagagagaccctttggtcgatagcaaagcgccgatgctttggagggtgggcgaattgagggaacgctattggacatggattcaccacccttacgacggagtgcttcggcttttcgagtccgaccttttggagcaattgactcggactaaatggtggcttattcccctcatttggcttccaatcgtttcgtattttttcttcaccggcctttcccttctgcgggaggacttcggcttttccggtggtcctttgctggccttcggtctgttcgccttcggctgtttggcgtggactcttctcgaatattcgcttcaccgtggccttttccattggcacccaaatgcccattcctaccgccaaatcactctccattttctactgcacggtctccaccacaaaactccgatggattccgaccgtctcgtctttccgcccgccgccgctgtgcttatcgtcggctttttctacaccatttaccggtccctcctcccttttcccattttttgttgcttcgcgagtggaaaactcttcggttacattgtgtacgacatcacccattattatttgcatcacggaaggcccgagacgaacagcggatggcactaccgaaaaatttaccaccacaaccaccacttcaaagactccgattcctcctttggcatttccaccactttttgggactacgttttcggcactgtgggcactttcaactgaatccgtgagaatgcgatgtccatgtgaaatgtcaaattgagcaattctcatcagtcatttatcccggcgcttctaattgtaaaaaagctcccatatttttgaaaacatttgcaaatttttacttgac

SEQ ID NO: 50026 - DNA, 1010 bp, Heterodera glycines
  SCN-specific regions: Sequence locations=1-1010
acgaggcaagtttgagctttgatcccgtattttcctctcttttcccatgccaatgttggcccatttcggctctttccaaggccaagatgttttcgagtgccaactccgctcagaaagcggagtggtcgtcaaagtgatcagcttcggtgcaattatccgcgattggctggtgccaacgcctcaggatcagctgcggtcggtggtcctcggatttgacagtttcgagaattacgtcgagcacagccctttcttcggtgccattgtgggaagagtggcgaatcgaatcggaagagcgagattcacggttgatggaaaggaatttttgctggcaccgaacgaagggaaaaaccaattgcacggggggacagagacatttgggagaaaagtgtggaagatggaaccgttgtgtgacaatgccgcggccaaatggccctcgggcgtccgtctctctttggaaagtgccgacggagagggcaccttccccggaaatttgcgagtgtccgtcacttatcggctgaccacaaataaattacgaatggacattgaggccacttcggatttgccctgtcctgtgaatatcgtccagcacaattatttcaatttgtctggccacggggacatccgcgaacattcgctgaaattggccgccgattggttcacgccgacttcttctgatcagattccaaccggagaaatactcaccgtttcaggcacagaattggactttcgggaagagaaaaaactccaaacgaaagacggaaaaccgattgaattggatcataattttgtacttaccaagggaaaaggaacggacgcacaaattgcagcagttttgagagctccggacaattcattggcacttactctgcgctccaatcagcccggtctccaagtgtacacgtccaagtcgctgtccgtgcccgtgcccggcctttacggccaacgctatgccaaatttggcggaatttgcctggaggatcagaactttccggacgcagtgaaccacgaaa

SEQ ID NO: 50027 - DNA, 853 bp, Heterodera glycines
  SCN-specific regions: Sequence locations=1-85,107-853
gggtttaattgtgtgattggtttaagtaaatttctcctcgtccgtcatgttttatcacgacttgcacgacaacgaaaatagtcatgataaagagttaaaacagttggtacaaatggacgaccttgcaattcccaaatttgtaatgcctccgctcggcattaagccaaaaaaatttgtgcgcaaacattttgggccgaacagtcggcttccaatggcacagtttctgaagggcactaccacactgtcctttgtgtacaagccgaagacaccgcaagacaaaggcggcgttattgtggcggtcgattcgcgtgcaacgggcggaacttacatcagctccaaaacggtagagaaaatcattccgatcaacgaccaattggtcgcgactatggcaggcggtgcagcggactgtcagtattggacgcgggtggtgagcaaatattgcaatcttttcgaacttcgcgagggtacgcaaatttcggtggctgcggccagtaaatattttgccaatgttatgtacgactatcgtggccaagagctgggcgttcactcgatggtttgcggggttgacaagttcggcccttccatttacatggtcgaagctgaagggactcgcgtgaagattgacaccatttgttcactcgggtcgggcatgttacacgccatgtccattttggacaccaaatacaaggaggcgatgactgacgcggaagcgttggagttgggcagagaagccattgtgtacgcgacattccgcgacgcggcttccggtggccattgcaatttgtgtcatatcacttccgaaggaaagaccatatacccgccattcgatgtcaatgataagtattatgaattc

SEQ ID NO: 50028 - DNA, 482 bp, Heterodera glycines
  SCN-specific regions: Sequence locations=1-78,101-224,294-433,456-482
gaccaggacagtctttttttctgtcataaaattggtgagcaaatcatctgtgcatgatgcagaccatcaaatgcgttgtggtgggcgacggcgcggtgggaaagacttgtctgctcatttcctacacaaccaacaaatttcccaacgaatatgtgccgacagtgttcgacaattatgcggtgactgtgatgatcggtggtgagccttacactttgggactgttcgacacggcgggacaggaggactatgacagactgagaccgctctcctacccacagacggatgtgttcctcgtttgtttttcagttgtcacgccggcatcatttgagaacataaaagaaaagtgggtacccgaaataacgcaccattgttcgaagacaccgtttcttttggttgggacacaagtggacttgcgcgaagacgccggcacctgcgagaagctggcgaagaacaaaatgaggccaatttcggcggagacaggc

SEQ ID NO: 50029 - DNA, 878 bp, Heterodera glycines
  SCN-specific regions: Sequence locations=1-482,505-776,800-812,834-878
attaagataactgtgggcactaaagttttcatttttactgctattcactcaaaatgactcaaaatgggatgacaacagccagcaatgagttcaacgagctcaatgatttcctgtcaacgcgtgcttatcttcacggttttctgccgtcccaagaagaccaatatgtgttcaaatgcattgcggctgctccctccgccagcgaatatccgcacattgcgcgttggtacaagcacatcaaaagctacgaggatgctgaacgtgccacttggccaaagaaggctggacagccgccgcagaaagtcgtttcgaaagacagtgcaccaccggcaaagaaagccgacgccgaggaggacttcgacctgttcggcgacgaggacagcgatgatgaggagaagaagcgcatcaccgaggagcgcctgaaagcgtacgcggagaaaaaggcgaagaagccgggcccggtggccaagtcgaacgtcatctatgacgtgaagccgtgggacgacaccattgacatcaaggacattgaggccaatgtgcgctccatcgaatgtgacgggctcgtgtggggcacgtcccgaattttgccggtcgcattcggcgtgcagaagttgcagattggatgctgtgtcgtggacgagaaggtgtcgacggattggctcgaggaacaaatcacaggcttcgaagacctggtccagtcggttgacgtggtcgcctttaacaaagtttgaatgatgacagacgaatatattgacaatgactatttcacacacacacaaatattattattatgatgatgatgcccattgttattttgttggtggtggctgttttgtccattgttgttgatgttgtatagtaagtaaaaatggttgacactc

SEQ ID NO: 50030 - DNA, 1282 bp, Heterodera glycines
  SCN-specific regions: Sequence locations=1-202,226-281,304-403,430 -439,463-499,523-549,578-647,675-740,764-767,810-1037,1062-1120,1145 -1282
gtccaattaagattattttctcaacaaacttccgcttaatcttcagaccttcactattttcttgtttaaaaaagttgcaacgatggtgaaaccaaaggttggcatcaacggttttggacgtattggacgcttggcattgcgtgcagcgattgaaaaggacactgtccaagtggtggcggtcaacgacccgttcatcgaactcgactacatggtgtacatgttcaactacgactccacccatggccgtttcaagggcaaaatttccacaaacgccggcaatttggtggtggagaaggaggggaagagcgcgcacaccatcaaagtgttcaacctcaaagacccggccgaaatcaaatggggcgaagcgggcgcggaatatgtgatcgaatccaccggagtgtttaccaccattgagaaggcctctgctcatcttaaaggcggtgccaagaaggtggtcatctccgctccgtctgcggatgcgccgatgtacgtgatgggcgtcaacgaggacaagtacgacccggctaagggacgacgtgatcagcaatgcgtcgtgcaccaccaactgcttagctccgttggccaaagtgatcaacgacgagtttggcatcatcgaaggactgatgaccactgtgcatgcggtgaccgccactcagaagacggtggacgggcccagcggcaaacagtggcgagacggacgtggtgcggcgcagaacatcattccggccagcaccggggccgccaaggcggtgggcaaagtcatcccggagttgaacggcaaactgaccggcatggcgttccgtgtgcccactccgaacgtgtccgtcgtcgacctgaccgcccgtctggagaagccggccccgttggacgccatcaaagaggcggtgaagaaggcggccaatgggaagctgaagggcattttggcgtacacggaggaccaagtggtgtccacggactttcttggagactcgcactcgtccattttcgacgctggcgcttgcatttcgttgaacccgcactttgtcaagctggtcagttggtacgacaacgagttcggctactcctgccgtctggtcgatctgatcactcactgtgcttccaaggcatagaaagacgacgcgcaaaagagggaggaggaaaagagaaatatgctaattttgactctgcgtttattccatttctcttttttgatgccgtccaatgacttgtttctcctgaatttttttaggaattagagcgcacttttaatcacgttatacgtaaataaagttttgtttggcta

SEQ ID NO: 50031 - DNA, 790 bp, Heterodera glycines
  SCN-specific regions: Sequence locations=1-669,691-694,721-736,763-790
gtttgagtttccgccttaatttgcccttgataatttgttatttctctctgctgaccaaaaacaataatggtgggcatcacagagctggctgaagcgaccaaaaaggcgtttggcgccgggccactgatcgctgcgaactgtgcgacagcagagaatgctaagagcggcaatgaagtggagtttggctcgatgaagttctacgggttgtgcggcattggcggaattctctcttgcggtatcactcacaccgccattgtcccgttggatttggtcaaatgtcggattcaggtcgaccctgccaaatacaaagggatcatcggcggcttcaaagtcactctccaagaggagggcgtccgcggcttggccaaaggctgggcacccaccgccattggctattcaatgcagggccttggcaaattcggactgtacgaaatgttcaagaatgtgtacgccgggatgatcggcgaggaattggcttacagctgccgtacctatttgtacttggccgcctcggccagcgcggagttcttcgccgacatgatgctgggcgccgatggaggccaccaaagtgcgcatccaaacatcggccggagcgccgccaacgctgcgcggctgtgcgccgttcatttaccggaccgagggactgatgggcttctacaagggactgccgccgttgtggatgcgccaaatcccgtacacaatgatgaaatttgcctgcttcgagcgcaccgttgaactgctctacaaacatgtggtgcccaagccagagccgaatgcacccaagcctgac

SEQ ID NO: 50032 - DNA, 508 bp, Heterodera glycines
  SCN-specific regions: Sequence locations=1-174,196-451,473-485,507-508
ctccatggaaattgattcgcacccatccgcagcagttcagcccgaaccggcaccaattgagcaccaacagcaaaataacacgagaattttgccaaaatcgaaaaaatggtggaaaaaagcactgaacattaggccgatggccaacagcagcacaaagcccaggtcaagttgggagcgcaaaatgcagaagaagggcgagcgcgagcagtgccgtgcggtggaggccgaaatccggcaacggttggcagacgaacggaacgcgcgggcacaggcgttgaaggagcgcgagcagcgccgaaaaagcaatgagcggaaggcggaagttgtgcaagtgatccgaaacagtgcaaagctgaaacggatgaaacgcaagcagttgcggacgactgtgcagatgagagacaccaccgcgacaacttccgatggaaaacagaaataattggaggaaatcaaattttatttttttaattttgttgctgtttgatgaagaaataaaaaatttgtttcc

SEQ ID NO: 50033 - DNA, 1299 bp, Heterodera glycines
  SCN-specific regions: Sequence locations=1-284,306-1299
gtccgttcgatgccccctctctctccgcctcagctttttttccccgcttttctgctccttggccattttttgccgccgtttgcccatggccaattgccctcggcgatgcttcccgccccctccacgtcccaactccaagtcaaaatctcgaatctgcccgtccatgtggccactgcgcagcacttgccccaattggtgtggagggtcgtcggcagacaggcgacagaacgcgttttttgtgtcagcgaagcgccggtcagccaactgcgctttgtctgcgtggattgtgtgcagaagaacatcacggatttggtcgactatctgaacacggcgcaggactccaccagaattgccacatcgcccgccgtcgaattgcctccggtcgatgccaatccctcgtggaccggtgccacgatcatttgccaagccgcggtcaatggggggacaaaagactctccgccgtcggttgtcgacgtgcaatatttgaggggagtgcacgtggtcgactccaacgggcagggccccgtccacattcccaaccagggcttccgattttatgtggaatgcgtgcgcgggacggacggacagtgtcagcaaagtgcggcccgacggaagacgctccactgcgcggtgcaggcgaaccccgcggcgaactctttccgctggctgaagaacggcggaccgatcagcggcggaaatgggcccgagtttatgatcggcacggacatgatcggacactcgctgcagtgtgccgccaataatggcctttacggtgaagagctccaatcgcccgccgtttacatcgattcgtacaccgccgcccggctaattcaggacaattttcagcaagtgcagagcagcgcgcccttccaacagggaaaccgcgtcgaaatgggccagcgagttcagatgagttgcgtcgtcgaaggcaatcctcgtccggcggtgttttggaagttgcgaaggagcaatggccaagtggtcgacgcgccttgtccccagggtctgaacggtcagtaccgggaagtgcctccgacccaattgccgacgggcgcagccgccgtcgcaaattcattggcggcacaacagtctaattcgttgatccgtctgcaagccatttgcgacctgcaagtggccaactattccttctccggacagtattggtgttctgcctgttcctacgtgtcccagggactgcccgagtgttctccgggacaagacgcgccgggagatcgccttctgaatatccaagtgcagggaccgccgcaacagtccgagacggaaccaagcgtggagcag

SEQ ID NO: 50034 - DNA, 992 bp, Heterodera glycines
  SCN-specific regions: Sequence locations=1-26,50-132,154-941,963-992
ttctgaatctataagtactacttccctattttaaaataataattattaagtgaattttcgacttacctataaatgtttctgacccgcagcgaatacgacaggggagtgaacactttttccccggagggccgtctgttccaagtggaatatgccatcgaaactgtcaagcttggttccacaagcatcggaattcacaccaaagaaggcgttcttttggctgcggaaaggcgttcaatgagcaaattggtggtggacgactcaatgagcaaaatttcggaagttgagaagcacattgccgtcgcctcggccggtctcatcgcagattcacgcacttgggtcgaacacgcgcgggtggaggctcaacacttttggtttacttacggtggcaaaattcgggtggaagacattactcaaaaggtctcaagattggcactgcattttggagacgacgactcaactatcagtctcggccgtccgtttggagtttctatgctttttgccggcattgatcacacgggtgcgcatctcttccatttggacccgtccgggacgtacattaaatgtttggccaaggccatcggtgccggctccgatgcagcggaacaaacgctgcaagagcactgtaaaaactgcgacaaaaaaatggaaatggccgaggcaaaacaagtcgcactgaacacactcaaacagctgatggaagagaaaatcaattccaaaaatgtggaaattgttatgattaagccgcagacggacaaggaaggcaaaacgttgggcaaaattgtgtggttagaggaatcggagttgcaagaaatcatttcgcgattgtagtcgaaggggacggattagagaaggaaaatgggctttgcactgccccttttatgattggatgaccttttgttattctctgcctttttgtgacttttcagtgtataaggcaaatgaaagcaattaattgagaaattggctaatatccaataaatgtttcaattctc

SEQ ID NO: 50035 - DNA, 1128 bp, Heterodera glycines
  SCN-specific regions: Sequence locations=1-395,431-578,601-959,983 -1063,1097-1128
caagtttgagcgcaaattgtctggaaatagccaattagccatttaataattgaaggatgggcgaacaaatgaaattggagggttcactccgtggccacaacggatgggtcacgcaaattgccaccaacccattgtataagaatatgttggtgtcggcctcaagagacaaaaccatcatcgtttggatgcttgatgagagtgggtcggtgctaaacggcaaaccgatcaaatcattgcacggacatggacactttgtttccgatgttgtcatgtcctcggatggacagtacgcactgtccggctcctgggacaaaacattacgactgtgggacttgaacacaggacaaacgactcgtcagttcgtctcccacacccaggatgtgctgtccgttgctttctccgccgacaaccgtcagattgtgtctggctcgcgcgacaagaagatcaaactgtggaatacacttgcccagtgcaaacacaccatcgtagaggagtgccattccgattgggtgtccaccgtgcgcttttcgccttctcatgcgaacccagtgattgtgtccgccggctgggacaaaattgtcaaggtgtggaacttggccacttgccgactgaagaccaaccacttcggacacaccggctacatcaactcggtcaccgtatcacccgacggctcactttgcgcttccggaggaaaggacggctcggcaatgttgtgggacttaaacgacggcaaacacttgtacacattgggcggcaatgacgtgatcaacgctttggcgttttcgcctaatcgctattggctgtgcgccgcggttggcccggtggtgaaaatttgggacttggagaacaagacggtggtggacgagctgaagttggacattgccagcaccagcgccgcaaatccgatgcgtgtatccaaaaaatcgtgtccccaatgcatttcattggcatggtccacggacggacagacgctgtttgccggttacaccgacaacatcatccgagtgtggcgcatagcttaagcgaaatgttatggacagagaaatcggcactgatcgtccttttgatcagtttttgttgttgttgttgtacttcttttctgccgatttataaaagtttggttttaaa

SEQ ID NO: 50036 - DNA, 629 bp, Heterodera glycines
  SCN-specific regions: Sequence locations=1-146,169-532,554-629
tcaaaacgtacgggccaaggcccgagtcgttcacgcttgacgacggtgaacgttattatgtcggtgcggacgtgggccagtacttgaaataccatcgcggcacgctgtacaaacgctacccccaactgtggaagcgaatggcatcggtggaggagaagaagaagatccaggagttgggctgtgccacctcctacatcaactcgaacattatgctggtcaaagcgaacgaggttgaagacatttttgacggacaagaggagaaatatcgcgcgtcggtcagcggcggcagtgcgtacggacgcgcggagggtgcgcaaacgctgcgaagtcggggcagtgctccgtggctgaaccagcaggtgaccagcggttcccaccacctcgagtccgtgccctgctccaccccttcggcgcacgggcgaggccatttcaaaaatcgcgactacgcttacgtggcggatgacctcgagtcgtatcgccgggtgatggaaaatgcgcaggccggcgaatgtttggtgcccattcggctggacatggaattggacaatattaaactgcgggactgcttttgctacaacaaaaatgacaaactgatcacacccgaaatggttgcagaagtgttgtgtgaa

SEQ ID NO: 50037 - DNA, 652 bp, Heterodera glycines
  SCN-specific regions: Sequence locations=1-169,192-652
cttggtttttagcccgagaatgttcaaaacgtacgggccaaggcccgagtcgttcacgcttgacgacggtgaacgttattatgtcggtgcggacgtgggccagtacttgaaataccatcgcggcacgctgtacaaacgctacccccaactgtggaagcgaatggcatcggtggaggagaagaagaagatccaggagttgggctgtgccacctcctacatcaactcgaacattatgctggtcaaagcgaacgaggttgaagacatttttgacggacaagaggagaaatatcgcgcgtcggtcagcggcggcagtgcgtacggacgcgcggagggtgcgcaaacgctgcgaagtcggggcagtgctccgtggctgaaccagcaggtggcccaaaaaacaaatgtgaccagcggttcccaccacctcgagtccgtgccctgctccaccccttcggcgcacgggcgaggccatttcaaaaatcgcgactacgcttacgtggcggatgacctcgagtcgtatcgccgggtgatggaaaatgcgcaggccggcgaatgtttggtgcccattcggctggacatggaattggacaatatttaactgcgggactgcttttgctacaacaaaaatgacaaactgatcacacctgaaatggtt

SEQ ID NO: 50038 - DNA, 1179 bp, Heterodera glycines
  SCN-specific regions: Sequence locations=1-457,481-864,891-1179
gtccaataaagatttaacaaataaatgtccccttctctttccgtcgccaactcaaatgtttctcgacagcttggccaaccaaaagtagcgggcttcaaagataaggataagccggaaagtgttcgtaccagcaacatcgtggcagcaaaggctgttgcggatgcgttggtcgagctgtccaaagcgcaggacattgaggcgggcgatgggaccacaactgttgtagtgttggccgggtccttgttggacgctgcagaaaaacttcttgccaaaggaattcatccgaccaccatttccgactcattccaacgggcggccacattttctgaaaaagttctcgaggaaatggccacacccattgacattaacgatgacgacgagttggtaaagctcgccatgacgagtttgaactcgaaggtcgtttcgcaacattcccatcttttggccccaatggcggtgcaggcagtgaagaaactgatgagttcaccggaggactcaagtgtcaatctgaagctgatcaaagtcgtgaaaaagttgggcgaaacggtggaggagtcgcagctcattgagggagcgctgatcgatcagaaatcgatgggccacggaggccccgcgcgggtggagaaggcgaagattggcctcatccaattccaaatctcaccaccaaagcccaacatggaaaatcaagtggtcatctctgactatgctcaaatggaccgtgcgctgaaggaagaacgaaattacattttggaactgtgcaagcaaatcaaaaaggccgggtgcaatgtgctgctaatccaaaagtccattttacgcgatgccatcaacgaaatggcgctgcattttttcgcaaaaatgaaaattatggtgatcaaagacatcgagcgggatgacatcgaattctatgccaaaatcctcgggtgtcgcccggtggcatccgttgaccattttgtcccggaatcgctcggaacggccgatttggtggaggaaattgagacggctgatgggaaagtcctcaaagtgaccggccttaaacagagtgggtgcgctgtgtccattttggttcgcggctccagcaaattggtgttggacgaagccgagcgctctctgcacgacgcattgtgcgttattcgctgtttggtgaaaaacacgcccttctgaccgggagaggtgcccccg

SEQ ID NO: 50039 - DNA, 637 bp, Heterodera glycines
  SCN-specific regions: Sequence locations=1-407,430-599,634-637
gtttgagatagcactttttgattaccatcgctgtacgcaatgaagacagagacgtgcgtttattccggctacaaaatccacccgggccatggcaagcgagtggtgcgcgctgacggaaagatccaaatctacctgagcaagaaggcacagcgtggtgcagcactgaagcgcaacccgcgtgacgtgccgtggaccgtgctgtaccgacgaaagcacaagaagggagtacacgccgaggagggcacgcagcgaaagcgcgtgaagcgcaccgtccaaattgcttctcgacccatcgccgacctcaccgtggaggcactgttggcccagcgcaatcagaagcctgaattccgtaaacagcaacgcgatgcggccatcaaggctgccaaggagtccgcccgagtcaaaaaggacgagaccaagaagaagcagcagaagattgacaaaaaggcagcgccaacgaagacgaaggcggccaagcaggtgaaagcgccgaaacaattcgtgggcggaaagcgctgattttgtgacgaaaagatgggatgtgcttgtgtgaattcggggcgggaattttgtttttgttcgagttctttgtcctcctcatttttgttgttgaaaattaaaaaacaaacaaattctt

SEQ ID NO: 50040 - DNA, 638 bp, Heterodera glycines
  SCN-specific regions: Sequence locations=1-413,436-638
caagtttgagatagcactttttgattaccatcgctgtacgcaatgaagacagagacgtgcgtttattccggctacaaaatccacccgggccatggcaagcgagtggtgcgcgctgacggaaagatccaaatctacctgagcaagaaggcacagcgtggtgcagcactgaagcgcaacccgcgtgacgtgccgtggaccgtgctgtaccgacgaaagcacaagaagggagtacacgccgaggagggcacgcagcgaaagcgcgtgaagcgcaccgtccaaattgcttctcgacccatcgccgacctcaccgtggaggcactgtttggcccagcgcaatcagaagcctgaattccgtaaacagcaacgcgatgccggcccatcaaggctgccaaggagtccgcccgagtcaaaaaggacgagaccaagaagaagcagcagaagattgacaaaaaggcagcgccaacgaagacgaaggcggccaagcaggtgaaagcgccgaaacaatttgtgggcggaaagcgctgattttgtgatggttgacgaaaagatgggatgtgcttgtgtgaattcggggcgggaattttgttcgagttctttgtcctcctcatttttgttgttgaaaaattaaaaaacaaacc

SEQ ID NO: 50041 - DNA, 763 bp, Heterodera glycines
  SCN-specific regions: Sequence locations=1-184,208-627,661-763
cctacttctgatcaatcccgttatcctctcccaattttgtctgcaaaatgtcggacgactatcgcagttcgattggcccacggcctgcgttcaaccgcaactcaacagcctattcaagtacgggcggacctgtctcgggcggcaaccgcgtgctgaaaattgtcacggagacaatgtcatcgagcaccagcggcggcggcggtggcatgtcaccgtttggcgccaacgcggctcaaatccgtgactcccgtgatcgcgagaagaaggagctgagtgatttgaacgatcgattagccaattacattgaaaaggtccgcttcctcgaggcccagaaccgcaagttgaaggcggacctggacatgctgcaaggacgccgcggcaaggacaccatcaccatcaagacgatgtacgagagcgagattcagacggccaaaaagctgatcgaagacacgggccgatcaaagcacgagttggagcaggacgtggccaaactgcaacgtgacttgtttttagcagcgccgcaaatacgaggaagctgttcgctcacgggccggtgaccgtgaaaagttggacgatttgctggtccaattgagcaatttggaggccgaaatcagcctgttgaagcgtcgcattgccctgctggaggaggagctgagcaaactgcgcaaggagaactcacgactgcaggccgacctgcagcgcgtgcgtgccgagttggatcaggagacgctgaaccgcattgactaccaaaaccaagtgcaga

SEQ ID NO: 50042 - DNA, 669 bp, Heterodera glycines
  SCN-specific regions: Sequence locations=1-669
gtccaataaagatttgtttttctgtttaatttctcgaaatgcatgcaattcgcacaatttcccgcacattttccaggtcgaccaccgcgccagtgggcattccattcgtggtggacaatgacgggaaaacagaacgcgtctacgacatttattcgcggctgctcaaagatcgcatcgtttgcgtcatgcaacccgattgatgacttttttgctgcctctgtgatcgctcagctgctttttctgcaaagcgaaagtggcaaaacggcgattaacatgtacatcaactgtccaggtggcagtgtgacggctggcctcggcatttacgacacaatgcagcacatttcggcccctgtcgccacttggtgcattggccaggcgagttcaatgggcagtcttttgttgacggccggtgccaagggaatgcgcacttcgctgcccaatgctcgcattatggtccatcagccgagcggtggcgcttacggcacggcggcggacattgtgatcagagcggaggagatcaaccgaatgcgaaaacggctcaacgaaatctatgccatgcacacgggccaaacggtggaaactattgaccaggcattggacagggatcgtttcatgagcgcactgcaagcccaacaagttcggttgttcgaccggtacgggacgcgttcg

SEQ ID NO: 50043 - DNA, 301 bp, Heterodera glycines
  SCN-specific regions: Sequence locations=1-301
caagtttgagtgaatagctttgctttatctaattttgcgtaaagatggacaagccaatcaaactcgcgaaagtcacgcgtatccttggacgtactggtagccaaggccagtgcacgcaagttcgtgttgagtttttggatgacacaaatcgttcgatcattagaaatgtgaagggccctgttcgggagggcgacattcttaccttgcttgaagctgagcgtgaagcacgtcgcctccgataaatcaacactaccattttgttgcgtatttctgaattgttgataaagaatgttgttaaaaa

SEQ ID NO: 50044 - DNA, 1122 bp, Heterodera glycines
  SCN-specific regions: Sequence locations=1-134,158-191,213-686,708 -801,827-878,905-1122
gaagaataagacttataattgctattattcaaaggatgtcggattcaatcaaacgtatttttgcacgttatatttatgactctcgtggaaacccaacggttgaggttgatttggaaacggaaaaaggtcttttccaagctgctgtgcccagtggtgcatcgactggagtctacgaggccttggaattgcgtgataatgacaaaactgttcatcatggaaagggcgttttgaaggcggtcgataacatcaattcaaaaattggtcctgctttagtcggacaaaactttgccgtaatgcagcaaaaccaaattgacaaatttctcatcgacttggatggcactgacaacaaagggaaacttggtgcaaatgccattttgggagtctctttggcggtgtgcaaagctggcgctgtgcacaaaggccttcccttatacaaacacatcgctgagttggctggaacgcggaaggtgattttgcctgtgccggctttcaacatgattaacggtggatcgcatgctggcaacaaattggccatgcaggagtttatggtgctgcccactggagcgaaaacattcaaagaggccatgcaaattgggtccgaaatttaccaccatttgaagaaggtcatcaaagaacgctatggattggatgcaacttcagtcggagatgagggaggatttgcgccgaacatccaaaacaacagagagggattggatctgctcaaagaagcgttcgccgcatctggacaccaggacaaggtcattattggtatggatgttgcggcaagcgaattctataaagagggaaaatatgacttggacttcaaaaatccaaacaccgataaagcgcagtggttgaccggagaacagctcgccgatatgtacaagtccttcatcaacgactatcccgttgtgtccattgaagatgccttcgaccaagacgactgggaaaattggagcaagttgcaggctgccatagacattcaacttgtcgtcgacgatttgacagtcaccaacccgaaacggattcagaaggcggtgcagaaaaaggcatgcaactgcttgttgcttaaggtcaaccaaattggcacggtcactgagtcaatcgaagcttcaaaactgg

SEQ ID NO: 50045 - DNA, 652 bp, Heterodera glycines
  SCN-specific regions: Sequence locations=1-64,86-652
ccaagtttgagcaggcaaaatggcctccaaatttgtattcagtcttcgcttttcctacccgaggcttttaaccagcagtgccctcaacaacaaaaaatcgggcccaaatttccttcagtctcgatcaattgtaaccaaatttgacctggaattgcctgacgattacccggagccttggccctacaaacaatggggcttcaaccaatttatgcaacattttgacaaaacgctgaagcgctggcacatcaactcgaaactgatcgttttcgaaagcaacattggcgtgggccggtcgtcgatcgcaaaggaattggccgatgcgttgggcttttattatatgccggcctttaaaatggacgacattttggttgaccgttacaacaatgacatgcgcgactattatcatttgtttccgaaacgctttcggttcccggacatcaacatgttctacaaggacccggccgacgaccaaacggctgtcatgcaagatctgatgtacgactgccgttgggagcagtacctgaacgcacaggcacaccttttcaacacgggccaaggcgtcgttttggagcggtgcgtccacgcggactttgttttcgcaaatgcaatgcgtgccaaggattggatcagcagagaatacctcaatttttac

SEQ ID NO: 50046 - DNA, 669 bp, Heterodera glycines
  SCN-specific regions: Sequence locations=1-564,586-669
gtccaattaagcaggtaaaatggcctccaaatttgtattcagtcttcgcttttcctacccaaggctcttaaccagcagtgccctcaacaacaaaaaattggtgccaaatctcattcagtctcggtcaattgtgaccaaatttgacctggaattgcctgacgattacccggagccttggccctaaaacaatggggcttcaaccaattcatgcaacatcttgacaaaacgctgaagcgttggcacatcaactcgaaactgatcgttttcgaaagcaacattggcgtgggccggtcgtcgatcgcaaaggaattggccgatgcgttgggcttttattatatgccggcctttaaaatggacgacattttggttgaccgttacaacaatgacatgcgcgactattatcatttgtttccgaaacgctttcggttcccggacatcaacatgttctacaaggacccggccgacgaccaaacggccgtcatgcaagatctgatgtacgactgccgttgggagcagtacctaaacgcacaggcgcaccttttcaacacgggccaaggcgtcgttttggagcgggggcgccacgccggactttgttttcgcaaatgcaatgcgtgccaaggattggatcagcagagaatacttcaatttttacatgtacaagcgcaagca

SEQ ID NO: 50047 - DNA, 705 bp, Heterodera glycines
  SCN-specific regions: Sequence locations=1-227,249-328,353-375,398 -545,567-705
agacgtcttctgattggcaaattcagacatcctataaaattgttcttcaacttccgtcattggtggagcaacaactggaggacgccaagttttaaacaatgccaatcaaagcatccggagaaactttaagaaagtacatcgttgttggacgtaaactcccaactgcaaatgacccaaatccgacactgcatgaaatggttatttttgccagcaaccacgtcgttgctaagtctcgcttctggtacttcactagcatgttgcgtcgtgttaaaaaaacacacggagaaattatttcatgtcaagaggtcttcgagaaaaagcctggctccgtgaagaactttggcatttggctccgctacgattctcgtactgggcaccacaacatgtaccgcgagtatcgcgatgtttgtgaagcgggtgctgttacgcagtgctatcgcgacatgggcgctcgtcaccgcgctcaagcggatcgcattcagatcatcaaagtgcaaaccatcagtgtggccggactgcaagcgagccggggtgaagcaatttcagaactccaagatcaaatttccgcttcctcaccgtgtgaattccaagcgacgcaatatgactcctttcacgacacagcgtccgagaactcattttgtgtagagaaagaaatgagacgacttgtatttccgatttgttgattaaagttgttgtgttaaaaaa

SEQ ID NO: 50048 - DNA, 818 bp, Heterodera glycines
  SCN-specific regions: Sequence locations=1-21,47-818
gtttgagtttggttttcaacattaaatttttacaatttaaatttacggatggacgcggaaacaaaaaattataaactcacttatttttcgtcgagaggaattgcggaacccatccgtcttatcctccattacaaaggcattccgtttgaagacgtcactttcagctcaactcttgccgatgagtcatcgcgagaaaaatggctgaagcagaaacaaaactatctttacggccaattgcccaacctcgaatgggacgagggaactgagcacaaagttttggcccagtctcaaacaatttgtcgttatttgggcaataaatatggtttggccggaagcgacttttgggaagcggcaaaaactgatgaaattgcggaatggttcaaagacatttgggccgcgtttctgccctttttgaaagtggcggtgggagccgaggcgggcgataaggaagccatgaaaaaggaaattttcgtgccgctgatttatgaccgtttggtgacgacgctggtggaaatgctgaacaaatctggctccggctttttgcttccgtccggcctcacttggactgactttgtctttgccaatgccttaaccacttttaacaacatggacaaaggccttctgttcgaaagtcacaaagtgttggccgactacgaaaagcgcgtttattcggccaacgaatcgataaaaaaatatgtggaggggcgcgaggccaaagaattttgacggctcgcaattcgatgatgatttgttgatgacaattaatgctttttttaatgtttttgactttaaggacaagtaaaaattttctaagcttt

SEQ ID NO: 50049 - DNA, 659 bp, Heterodera glycines
  SCN-specific regions: Sequence locations=1-263,292-306,328-340,363-659
gtttgaggtagtgtaataaattcttattgtagtaaaaatgttcgaaaataagtccgaaggtggcgctgaaaagaagaagagcggtggattcaacacgaagaagtttttgttggacctcgcatccggcggaactgctgctgcagtctcaaaaaccgctgttgcacccatcgagcgtgtcaagctgttgttgcaggtgcaagatgcttccattcacatcaccgcggacaagcgctacaaaggcatcatcgatgtcctcgtccgtgttcccaaggagcagggctttctgtcgttgtggcgtggtaacctggccaacgtcatccgttactttccgactcaggcgctgaacttcgccttcaaggacacttataagcgagtcttcacgcaaggagtggacaaggagaagcagttcttgaagttcttcgccatgaatttggcttcgggcggtgccgctggcgccacttcgctgtgttttgtgtaccctttggactttgcgcgaacgcgtttggcagcggatgttggaaaggccgatgcccgtgcaattcaaaggtttggcggactgcatcctgaaaaatcctcagtccggacggtccccatccgccctcccacccgggttcattcctcctcatcaagggcattcatcattttaccgcggccccttt

SEQ ID NO: 50050 - DNA, 675 bp, Heterodera glycines
  SCN-specific regions: Sequence locations=1-226,297-675
gtttgagataattattttttgctttttttgaaacttcgattgcattgattgtgaaccgtgtcccttaaattcctttcttcctcgacgtgtctcgcgcgagttcggctaaaaataccgaaaaagctgaatatcaaagagcaattcaaaacagtggcaaagacctttctgcacatcaattcgagtgaacgtttcttccatccgttcgtccgttttcaatgaatttccgtccctttgcctttctctccctccgcttttcctcctcctcttccgcctcttcttcgtcccttcttccctcttaccggaaggcaattgtccatccaattgttcgtgtcgaccacgcgggcgaattggcggctgacagaatttatgccggtcaactcgccgttcttccgaaaacccatcgtctcgttccgataattgaacaaatgcgacgcgaagaaagacatcatttggacgagatggagcgattgatagtcaaatacggagtgaggtcgactgcgttggctccgatttgttcggtggccggttttatgttgggtgttggcaccgctttgcttggcgaaaaggcagcgatggcatgcacaattgccgtgggaggaagtcattggcccacattacgatgaccagatcaaagaattgatggcggatgatgccaatgccaaccgcgaattaatg

SEQ ID NO: 50051 - DNA, 1129 bp, Heterodera glycines
  SCN-specific regions: Sequence locations=1-298,320-1064,1086-1129
catttgttcactttaatattttgccatgtcttttcttgtcacattagccggctatttgacaattgccatttttctccagaaactctttcgctctctgtacaatgtggttttcccctatttgttcgctgttcctcagaatatcaaggtgctcgcgggtgccgagtgggcagtggtcaccggcagcactgacggcattggcaaggcgtacgcgctcgagttggccaagaaaaacttcaacgtggtgctcatctcacgctccatggacaaactgaacgcagtggcggaggaaatcaaacagaaatatcccaatgtggaagtgaagtgcatctcatttgacttcaccaacgcaaatctgaaggactacgagcagacaattttctcccaactttccaccatcgaagttggaatgctcgtgaacaatgtcgggatgagctacgagtaccccgagcgattggaccgtattgagggcggactgcaacgcgtctccgacattaccgtgatcaacaccctgccgactacggtactctccgcttttgtgctcaaacagatgagggaacggggacgcggcgtcgtcgtcaatttggcctcctcggcagcgtatttcaattggttttacctggccgcttattccgcgtcgaagaaatacgtgtgttggttgtcctccattctgcgcatggaatacgccgacaccgacattgtcatccaaacggtgtgcccgatgatggtggccaccaaaatggccaagattcgcaaggcttccttcttcacgcccagccccgaggaatttgccgcccaagcgctccgcagcattggcttggtcgacgagaccaccggctgtttgtcccaccaaattcaggcggagctgatgttcggctacgtccccgccccgttgctgaacaaattcgtgcgcgacaactcactgcagacgcgcaagcgcgccctgaagaagaaggaagcgacggtggcgaagagtgaatgatgagaaaaaagaaagaaaagtgatgtgaaatattgacattcattgaaacaaccaaagtaaattaaagttatttaataaccaattctaatgccatttttgttattttatattcgtataggatgggaacacacagataaaattctaaagtgc

SEQ ID NO: 50052 - DNA, 541 bp, Heterodera glycines
  SCN-specific regions: Sequence locations=1-247,283-325,347-397,419-541
aggattattcgcctgattctttataatgggaaagccgaagggaattagaaccgcaagaaaactgaaaaaacatcgtcaggagcagcgctggaatgacaagcgttacaaaaaaaccaatcttggaactcgttggaaagccgatcctttcggcggagcctgtatggccaaaggaattgttctcgagaaaattggcgtcgaagcgaaacagccaaattctgcgattcgaaaatgtgtccgtgtgcaacttatcaaaaatagcaaaaagatcactgcttttgttccaaacgacggttgcttgaattttatcgaggaaaacgacgaagtgcttgtgtctgggttcggacgaagtggacatgccgttggagacattcctggagttcgtttcaaagtagtcaaagttgccaacacgtcattgctcgcacttttccgtggaaagaaagagagacctcgttcatagaaactgacttcgcatgataaaggattttttcctttcattgtttttgttgattgcgattccgaaataaattgttgttgaagctaa

SEQ ID NO: 50053 - DNA, 328 bp, Heterodera glycines
  SCN-specific regions: Sequence locations=1-234,262-328
agacgcttcaattgccgattccgtttgaaaatggttcacgaaaacatccactggtcccggccgcgcaaatttgggcgccggctcgcgttcgtgtcgcgtctggcttcaaccaccatggactgattcgtaaatattcactgaacgtttgtcgtcgctgcttccgtgaatatgcctccgacattggattcaaaaaactcgactgaatggcgaagaggaatttatgagcagtcattggagggttgttttttgtttgttctgttcgttattttatgttgataaaaaattgcgttaagaaaaagaatgaaaaaactcgagactagttctctct

SEQ ID NO: 50054 - DNA, 672 bp, Heterodera glycines
  SCN-specific regions: Sequence locations=1-672
caagtttgagatcaattttctgtttaaacataacgaaaaatgaagctgattgaatccagcgacatcgtcaaattcccagacaatgtcactttcgcgctcaacaaccgtgttgtgactgtgaagggaccgcgcggtacgctcaagcgcgactttcgccacttaaacattgaaattatgcgagaaaacccgaagctgctccgtgtgcggaaatggtttggcatccgcaaagagttggcagccattcgcacagtgtgctcacacattgaaaacatgatcaaaggtgtgactgttggatttcggtacaaaatgcgctcagtctacgcgcattttccgattaacatcacgcttcaggagaacaacaccgtcgtcgagattcgaaacttcttgggcgagaaatttgtgcgccgtgtcggactaccgcaaggcgttagcgctgtaatgtcgaccaaacagaaggacgagttgatcattgacggtaccgacatccaaaaagtgtcccaggccgctgctcgcatccaacagtcgacgaccgtcaaaaacaaggacattcggaaattcctggacggcatttatgtgtcggagaaggtggccattgccgatgaatgagcacacaaagataaaaacccattgttaccccttttttgttggtcaaatggataaagaaatgttgtt

SEQ ID NO: 50055 - DNA, 825 bp, Heterodera glycines
  SCN-specific regions: Sequence locations=1-1,32-288,333-678,702-825
gtttgagataaaatttgaagcaattaaaaaatggctgatcgtgcggggttccaaagtggatttggtggtgctgctccaccgtcggcgcgtgggcgtggtgggcctcgcggtcgtggccgtggcgctgccagagggcgaggacgtggaaaggacgccgagaaggaatgggtcccggttactaagcttggccgtcttgtcaaggatcgcaaagtccttacgattgaggagatttatctccactcgcttccgattaaggagtttgaaattatcgaccttttgctttctggactgaaggacgaggtgctgaaaattatgccagtgcaaaaacagacgcgagcaggacagcgaactcgcttcaaggcttttgttgcaattggtgaccacaacggccacgtcggactcggagttaaatgctcaaaggaagttgccactgcaattcgcggagcgattatcgccgctaaattagccatcattccagtgcgtcgtggctactggggcaacaaaatcggaaaaccgcatacggttccatgcaaggtcactggcaaatgtgcatctgttctcgttcgactcattcccgctcctcgtggtaccggcattgttggtgcgcctgtgcccaaaaaattgctccaaatggctggcattgacgattgctacacttccgccgttggccagacggcaactctgggcaactttgccaaggcgacttactacgccatccaacggacatattcctacttgacgcccgatctttggaaagagaacgaattgccgagaaatcctctggatcacattgggcggtggcggggcgcaataagcgcagcgagg

SEQ ID NO: 50056 - DNA, 501 bp, Heterodera glycines
  SCN-specific regions: Sequence locations=1-24,46-446,469-501
caagtttgagctcataaattgtcttgcagaagtatttaattaaaatgattgaaacactcgagacgagcgaagtgttgaagcgggtccttaagtctgcgctgattgtcgacggagtggcacggggtttaaacgaagcggcacagactttggacaagcgtgaagcgcacttttgtgtgctggccaaaagctgtgacgaggcgtcctttgagaaattggtgcgctcattgtgcaaagagcacatcattccgattttggaggtggaggacaaagccgaactcggtcaaatggttggccagtgcaaatacgacaaagacggaaaagcgcgcaaaatcgtcggctgttcggtggcggtggtcaaagactacggacgggacgaagaggcgaagaatgacttgcaggaagtgctgaagaaaatcagcgactgatgaggttcctatgtcatcatattgttgtttttgtttggttgttaccgcggctataaaagactcttctgtttaaaaa

SEQ ID NO: 50057 - DNA, 671 bp, Heterodera glycines
  misc_feature (603)..(603): n is a, c, g, or t
  misc_feature (605)..(605): n is a, c, g, or t
  SCN-specific regions: Sequence locations=1-6,34-302,332-400,422 -566,588-644,667-671
ctccgtgaagaattcggcacgagggtttttgatttgctttcaaaatgaagctgaaccctttcgtctcctcctcagcgcgcaaatcgcgcaaacgccatttcaacgcgccctcgcacatccgtcgtcgcattatgtccgcgccgctgtcgaaggatttgcgcaataaacacggagtgcgttctacgcccattcgcattgatgacgaggtgactgtcacccgaggccactacaaaggcaatgccggccgtataatgcgtgtgtatcggaagaaatatgtagtgcacgttgacaaaatcactcgggagaaggccaacggaacaactgtccacgttggaattcatccttcaaatgtgcagatcacaaagttgaagatggacaaggaccgacgttcattgctcgaaaggaaagcggccggcagagcgcgagtgacgggcattttgaagggaaagcacacggaagagaccattgaagagtgagagagcggcagggggaggagagggacagagaaaacgaattgttacgccgaaattggacatcatttgttgttatttgttgtttgcaaatacaaaaagcaggcagttaaaaaacaaaagagcaggaggngnggagcccccctccgggggggggccccgtgcccaagttcccccagaaatggggccgtttacacaacc

SEQ ID NO: 50058 - DNA, 786 bp, Heterodera glycines
  SCN-specific regions: Sequence locations=1-364,387-761,783-786
gagttcgtgatgatggttaaatcggcactttctaattcattgagtattctcaatggtttcactagtcgcgctttcaccacctccaacattaggagtttgagattccgttcgcaaaggcctcaaaatgagctgaggacagttggaaaaatggtcgcccaatcggacagtccgtacgaaaagggacaatgttttgttcacagattgtttgcttacaggggagttattatccgatcgaaaaattgctcagtctttacgaaacgaatcagcgacacgcaaactgtgcaacaggaagtcctccccttttaccaagtgctcatagacaaagatgattggtcggaaatgaattttgagacggacatgaccacctttttgaaatccaccgggaatcgtgaagaaaccgccatcagcggaatggacatcgtttcccacgacgaaattctgccctttgagccatccgtcagtgaattgaagtcgctaagtgatgggagcggcgaagcagctcccataaaacattatctttacgaccaactgttcaagaagaaaacaggcgaagagacgaaaagggacgcgggcgtcaatcggcaaaggcctgaagaggaaatgtgctggatatttccaattgctgtgacgaaacagactacggattgttttgaagtgcaagtcagcactttcaacttgggttcaaataatttgaacagaagtcatagccctcacaattggcgcattgttttgcgggttgagaattcacagaacaacaccatgtatttgagaaataccgtactgaaa

SEQ ID NO: 50059 - DNA, 396 bp, Heterodera glycines
  SCN-specific regions: Sequence locations=37-176,200-396
cctcgtgccgaattcggcacgaggatttttctcatacaaacgaaatgcctttggctgaagatttgttgtatcctgatccgcaaaaggaacgtcaaaagcacaagctcaaaagactcgtgcaacatccaaattctttctttatggacgtcaaatgccctggctgctataagattactacagtgttcagccatgctcaaactgttgtggtctgtgttggttgcagtacagttttgtgtcagccgaccggcgggaaggcgcgacttgtcgaagggtgttcgttccgaaagaaaggacactaagacaatgagacaattataacggaaggcgatgctatcatttatttgttctgatttacaatatttgttgttgttggaattgaagaaccatcaatttgct

SEQ ID NO: 50060 - DNA, 772 bp, Heterodera glycines
  SCN-specific regions: Sequence locations=1-50,116-129,164-170,284 -306,336-400,425-431,455-479,502-533,604-659,681-772
gaagtctcaactctcagacgagcctgtcccgcacactttgccttccgcccttcaccatgcaaatcttcgtcaagaccctcacgggcaagaccatcacccttgaggtcgagtcctcggacacgatcgatgccgtcaaggccaagatccaagacaaggagggcatcccccccgatcagcagcgcctcatcttcgcgggcaagcagctcgaggacggccgcacccttgccgactacaacatccaaaaggagtcgaccttgcacttggtgctccgtctccgtggtggtggcaagaagaagaagaagaagacctacaccacccccaagaagatcaagcacgtccacaagaaggtcaagcttgccatcctcaagttctacaaggtcgacgacaacggcaagattacccgtctgcgtcgtgagtgccccgccaagacctgcggcgccggtgtcttcatggcctggcacgtcgaccgccagtactgtggcaagtgcggcttgacctacaagctcgaccccgccaccatcaagaagaacatggccgctgccgccaaggcctccaagcccgccgctgctgccaagcccgctgccgaggctgccgctgccgctggcaagggcaagggcaagaagaagtaaacctttgcttcccactcccttggttctctctggtgtgtgcccttggcacctccacgattgttgctcggttgggtcggtgttgtttcttggatgtcaactttgtgtgttcaaggaatgtatatatcgcccatcttggtttcttg

SEQ ID NO: 50061 - DNA, 535 bp, Heterodera glycines
  SCN-specific regions: Sequence locations=1-61,83-240,266-465,496-535
gtttgagattaaaagaattgatttgtgaaaaatgacccgcgtgaagacccatgaacttcgggccaagaagaaggaggagttgatgaaaatgttggaagaacagaaaacggagctggccagtctgcaggtgtccaaggtgacgaacggggcggtgtccaaactgtccaacatccacgtggtgcgcaagaacattgcccgcattctcaccgtgatcaaccaggcgcagaagatgaacttgctcaagttctacaagggcaagaagtatcgtccgattgaccttcgcttcaagaaaacgcgtgccatgcgcagagagttgaccaagcatgagctttcattgaagacacacaaacagaaggtcaaagaacgccgttgtccaacgcgtatttatgcgcttaaggcgtgaagcggccacagcctcggcgatgtgtttcgacagagagggaaatgtgacgaggattttgatggatcaaattttttgttgttgttgaccaacttttaaatgatttaaaaaaacaaaaaagttgtgttaaaaaaa

SEQ ID NO: 50062 - DNA, 481 bp, Heterodera glycines
  SCN-specific regions: Sequence locations=1-301,325-481
gctttatttacatttcacttttgtcaattcgtccgtttattcaatggccaagcatcatcccgacctcatcttttgtcgcaaacagcccggcgttgcgatcggacgcctctgtgacaaatgcgacgggcggtgcgtcgtctgcgattcgtacgtgcgcccgtgcactctcgtccgcatttgcgacgagtgcaactacggaagctatcagggtcgctgcgtaatttgcggtgggccaggcacaagcgacgcgtactattgcaaagagtgcaccattatggagaaggacagggacgggtgtccgaagattgtgaacctgggcagtgcgaagacggaccttttctacgaacggaagaaatacgcgttcaaaaagacgtgatcatagccgggggttggactgtcagggtttttgtctgttttttccgaccgttcgacctccgtttaatttaccatcgtttctttttataaaataaaaccgcgttct

SEQ ID NO: 50063 - DNA, 652 bp, Heterodera glycines
  SCN-specific regions: Sequence locations=31-255,285-652
ccgcccctccgtccgtccgtccatccgtcccccgttttaaccccttcctcccccctttctcgcccatcttttcatccaattctccgtcttccgcctgcccattcttctccagcaaattatccattttgacgctcaatgggtggggaagggagcggcagaagcggtggtgtatccccggaatgcctttacgctgtgctgggagtgcagaaaggcgcggacgaagcggagatcaaaaaggcgtatcgaaggttggcattaaaatggcacccggacaaaaacccggaacggaaggagaaggcggagaaaatgttcaagcgggttgcacaagcgtacgaagtgttatcagatgagaaacgtcgaacggactacaaccggcacggaatgtgccggccagcagaggcggcgttcgcctcggcacaccgacggcggacagcgccggccgattcccactacgcccaccaccagtcccaccctttccatgctcatttccgttcccctttcgatattttccgtgaatttttcggcgaccctttgtcatcgtccgactttcatcgttcgccgtttttcgcttttcccgccaacggcggaatgaaacagaggagacggcatacgacaaatctattcggagacggggcatttggagcgcattttg

SEQ ID NO: 50064 - DNA, 482 bp, Heterodera glycines
  SCN-specific regions: Sequence locations=1-482
aattaatccgcgcattgccattaaacaattttctcttttggattaaaataccgcaaattatgcgtttgttttgaatgaaaagtgcgtaaagaacatgcaatcacagcggggaagcagcagccggtcgaagacgacgacgacactatggaataatttatatttgaagcttaaaacactgcctaatcacataacataaaatgtgtaattaaggctaatggccgctcaattagcctcggctctatcctcgcccgactattacaattgccaaatgcagccgggattgacacggcgccaacgcgacatttgcgtccgacatccgtccgccatgcgatcaattagcgatggcctacgagcggcgattgacgaatgccacgcccaatttgaaagggaacgatggaattgctccgccacttttaacgtcggagtcccctcggaagaagattctacgcctgaaacagcttatgttttcgccatttcttcgg

SEQ ID NO: 50065 - DNA, 559 bp, Heterodera glycines
  misc_feature (556)..(556): n is a, c, g, or t
  SCN-specific regions: Sequence locations=1-46,75-378,408-416,444-559
gttctacatgataattaattaattatgagcagcagcgatttgttggcccacaacagcagcaccagtggctccagcagtggcgcaaccgacaaattggcggtgttcggcggctgcgagggccccgacgcgtgctatgtgatgctggtgagcagtgacggacatgaatttgtcatccgcaaagagcatgccctgatttcgaagaccatccgagcaatgctttccggccccggccaatacgcggagagcgaaaccaacgaagtgcatttccgcgaaattccctcccacgtgctgcagaaggtgtgccattactttgcgtacaaggcgcgctacacgaacagcgcgacggaaatccccgaatttttcgtggcacccgaagtggcgctggaactgctgatggcggccaacttcctcgactgttgaccaaacaaacaaacaaaatttaatgcaaaaatggtagcaacaacagacagacaaaccgatggccagacaaaacgctgactgattgtgattggcaccgatttggaatttttgtgccaaagataaagccaattattantta

SEQ ID NO: 50066 - DNA, 777 bp, Heterodera glycines
  SCN-specific regions: Sequence locations=1-130,154-516,538-777
gtccagttaagttccttcgccttgtgaatttttgctttgacttttttatggagagattgttcaataccccgatttcctccctttctacgaacacatcaaattgcacacgaaacaccatttgtcttggctttttggatgggtccatccaatgtttttcctttgacacacagcgagggatcactccatcgatggaaagttcggtaaaactcggtggaatgtggcgcaaacggatgaaacggtccgtcagggcaatgcaaatttctgaggatggcacttcgctttatgcgaccagttcgaacagggccgtctgtttgtatgacgttgagacggggaagagagtgcgctgtattcgcgaagggcacaaaagtcgggcccagtgcgatggcactgctgccgggcgaaagacggcattttgcaacgggtgccgaaaacggcgaaataaaagcatgggactttggacagcccaagccgaacgtgcacacatttggcgagcaggcggacataatcaatgcgttgcacatttggcgcaataatttgctggccgcgagtggcgacggcactttggccgtttacgacacgcacaaaggcaaagtgcgaattcagtcggagacaatgcacagcgaattgctcagtttggcggtgactgaaagattcacttacgtcggagcggccgatggacacattgaagtgttcaggcatggccaatttgggaacatccgcgaacgtatggaaaccccctttctgatgggcgtcgagcaaatggtcgtcttgcgcaac

SEQ ID NO: 50067 - DNA, 849 bp, Heterodera glycines
  SCN-specific regions: Sequence locations=1-295,324-512,534-645,667-762
gagaacttaatttgaggattacattgaaaataaattaattagacttcaaaatgggcatttccccaagacagatggcacaagcggcgaaagactggggggaagcgaaaccccattcacaaaaaacgaaagttcgaaatgggacggccggcagcaaatactaagattggtcctaaacgaattcatttggtgcgttgtcgtggcgggaacattaaacatcgcggacttcgtcttgataccggaaactttgcttgggcttctgaagggtgcactcgcaaaacgcgtatcatcgacactatgtacaacgcttccaacaacgaattggtgcgcaccaaaacattggtcaagggaatgatcgtctcaatcgatgccattccgttccgccaatggtatgaagcgcattacgcactgccattggcgcgcaaaaagggacaaaagttgaccgaagatgaggaggcgcggattggaggagcacaaaaacgctcaaagtcgactctgaagaaatacacggaacgccaaaaaaccgccggggtggagccgcatcttctggaacagttccaggccggacgacttctcgcttgcataagctcacgaccaggccaaagcggacgctgcgatgggtacattttggagggcaaagaactcgagttctacaacaagaaactgaaggctaaaaaggcgaagtgatgccgcaccgaagcttggaattgcgtttccaattttgttgtccgttccttttgagtgaatgataaattttgttgttttaaaaaaaaaaaaaaaaaaaaaaaaaaaaaaaaaaaaaaaaaaaaaaaaaaaaaaaaaaaaaaaaaaaaagaaaaaaaaaaaaaaaaa

SEQ ID NO: 50068 - DNA, 434 bp, Heterodera glycines
  SCN-specific regions: Sequence locations=1-402,426-434
ttaatccatttattcaaccaagcgtgcaaataaataatggcttcttcaattcgactcgctggcggtgctttgcgagaactccgaattcatctttgccagacaaccgcagcaagcaatggagttcgggaattcatccagaaagattatgtggacctgaagcagaacaatcgggatttccccattcttgtaagagaatgctccggaattacgccacgaatttgggcaagatatgagcatggagttgagacaagcgtttcggttgagaatcagccgcgtcagaagataatggaagtgatcaaagaaatggcaacgaaaaagatggaaacgaaaaaaattgattgatttgaatttgtttttggctgccgtttgtaaattctttgataggataaataattgtctcccattttatttatttaattaaaaatgtttccgta

SEQ ID NO: 50069 - DNA, 703 bp, Heterodera glycines
  SCN-specific regions: Sequence locations=1-33,71-703
gttgtctttctattgtaaaaatgccgaacattatgggattgcatggtggctccatgattgccatgagaagcaaagatagtgtggtgattgcatgtgatctgcgcttgggagagcaagccatgaaaaacattgctactaatgcgacgaagatccatcccatttctgacaacgtttttatcggattgaccgggtttaacgcggacgccaccactgtgcttaacaagttgcgcacacatcaggccatttatgagatgcgcgagcagcgtccaatgtctcccaaggcgttgacttcctatctcgcttggatgctctataagcgcaggttcggcccgttcctgatcgaacccatcattgtggggctgaatcaacaaaatgagccgttcatttcccacatggacgtggtcggtagcgtaagtgagcccgaagactacacggtcggtggcactggtggcgacttggcgatgtctctgtgtgaagctctctggcgacccgatatgacctccgaagaaatgacggtggcggtcggtcaggcgatgcttgcggtggtcgaacgcgacgcatccactggatgggggcgttgtcatccacacgatcactgcggaaggagtgaccacaaaaatgattaaatcgcgcatggattgatttgatcagctcctgtcgcttttgttgtattcgaaataagcgataaattcatatgcaaaac

SEQ ID NO: 50070 - DNA, 548 bp, Heterodera glycines
  SCN-specific regions: Sequence locations=1-346,368-548
aaaagttaaaagccgaccaacaaaagaatgccgtgaaggaaatgcgccgtattttcggcgttctcaaaaggtccgtgtaattatgcttgcgcgtcgtccgcttctgtgctgtgcattcatccgcccttttttcccctccgccatttgcttcttcctcaatgtcgtcccaccatttgtccggaagttcccttttgttaatgcgtgccgcatttcgcaaaatttggtcagcttcgacgtaacgcttttgagagacgagccaacggggactttcaggcacaacccttaaaagaaaaggaagatttggggaataaacaatgcttaatagagatggattaaaagacgcaccaccaataaaagaggaaaatggtggcaaaagcagcaattgaagcatgaaggtattgataattccgaataaaaaaagccaaaaggccgagtaaaacttggccaacagcaaagaaaacgccggtgaacagcgaagcgattttccttttgcttgggccaaccaattccattcctttgataaccgtaaattggggttaaaagaaacg

SEQ ID NO: 50071 - DNA, 735 bp, Heterodera glycines
  SCN-specific regions: Sequence locations=1-735
tgtttttattccatttgttgatctgtgtttattcattggtttcctatttatttcgcctttgattacggaatgcctgagaaaaaaccgacgaaatgcctttcaaagggcaaagaattgccttgcggacgtgagattattcaggattttgtaatgatgatgcccggctccatggacaaataccatcagttatgttccattctcagctcattcgaattgtggagtgaggaatcgcgcacttccttccttagccaatttttggattcctacgatattttggacgtgaattgttcagacttggtgcttaaattatgcaaaattcgttggcataccgttcctccccaaatgctttcgcaatttgctgactttttatgcgctttggccatcaaccatgtccaccatatcaattcagtgttcaattgcttcgtcgaccatttcttgccaattggcaatgcgaaagatccttcaaattttgaggcgcatcgtccgccagcggtggtggacgaccatttccaagagtcgctgtacgccttggccaacctttccatccaaaacgttgtttcctgcaaccctttgacgacgcctcttctgctcgaatgttttgtgaaacgctttccgcacatcaaacagccgtctccgaaactgctcgcctttatgcgaaatgtgctccgttttgccgattggattagggacgaggaaatctctgccgaaatttggtcgcttatcgtcgagaaactc

SEQ ID NO: 50072 - DNA, 529 bp, Heterodera glycines
  SCN-specific regions: Sequence locations=1-51,110-119,141-529
aaagattctaaaaataaatattaaatcgccatgacgaaaaagagacgcaacaacggacgcaacaaaaagggacgcggccacgtgcagcccatccgttgcaccaactgcggccgctcatgtccaaaggacaaagccatcaaaaagtttgtcgtccgcaatattgtcgaggcggcagccgtccgcgacatcactgacgcgtcggtttacgatcaatacgcactgccgaaactctatcacaaattgcactattgtgtctcgtgtgccattcacagcaaagtcgtgcgcaatcgttcgcgtgaagcgcgtaaggaccgaaacccaccgccacgttttggccaacggtctgccgtcgatcgtccgcaacgtccggggggagcggcccctggaggccccggaggcgttgggatgatgcaagcgattcgaacttaaagtgggcgaccgaagatgcatccttcgctgttttgttgttaccgttttttgtctttgtcaaaggataaaagttgttgaaacaaaataaatttaccaaaaa

SEQ ID NO: 50073 - DNA, 721 bp, Heterodera glycines
  SCN-specific regions: Sequence locations=1-251,274-721
gaaatgctttacaacttccgcaatttgaattctttgtcttcgcggcacttttcgctcgcttcggccttacttcagcagcaaaaagtcactgctggaacatcaatggccaataaacgtgtgctcatcgatgctgtgcgatgcaagtcgactggctcctcccagcagtacattctcgctgcgcatgggccaggacagccacgggtatggacatcgcgcattttcgacttcaggtgctgcacaagaactgagcagcgcgttggacgaggagatcaatgcggagaaggaactcgttcaggacaaattgggtggcacttccgcgccttcagtgcccggcttcaaaatcaccacgaaaggggccgaagtgcgactgagcaaaacgcacggaaacgaaaagattgaagtcattctgaacgtgaatcattcggtcgacatcgaagaggacgaggagtacgaagacgagccacaagcagaaatggagccagagtctgtgcccgtctcgttgccacacttcaccattagcatcacaaagaacaaccagagtatgttcttcgctcttgaaatggtgaagacggacgacggcggatttgacttcaccgtcgaagagtttttcatcgcaccgtcggtgaatggcgaacccgtgaacgaagttggcgacgacgtgtacagctcgtccggcaaatacattgacccgaaattgcacgatttgctgttcgtcagatat

SEQ ID NO: 50074 - DNA, 1043 bp, Heterodera glycines
  SCN-specific regions: Sequence locations=1-278,300-675,698-1043
ccaagtttgagggtatacacgcttcatcaatctttcgaaggtcaaatatgccagaggcaattccggaaggcgattacgagagaggaaagaagattttcaagcaacggtgcttgcaatgccatgtgattgattcgactgctacgaagactgggccaactctcaacggcctttggaataggaagagtggctctgtaccaactttcgattattctgctgcgaacaaaagcaagggcgtcatttggaacaaggaaacgctgttcgaatacttgctcaaccccaagaaatatattccggggaccaagatggtctttgctggactgaaaaaggctgaggagcgcgccgatttgatcaaattcatcgaagtggagagtcagaagccgccttcgtaaagtgattgaatcgaacctccgattattagggcaatggttgtttgacggtctataataatagagtctgttattgtcgtaacatttctgtccggttagtctcaaataaaatgttggatgtctaattctgttttttggttaattatcaaaaacataataatcaacttaagcttcagtctcatttcttttttgccatcttacttatgtttgaatgttttatatactcgagcaattattagctctaaaattatttcttatttgatatgagtgcctaagcagtttgttctttccatttttggccctcttgttaacacatgagatttgactgccttagtgccgtgtaatactgcggggaggggtgaatacggcacacaaagcaaacacttgatgaaagagggagaagcggggggggcatcgcccgaaggattgcttatgccgtgcccagcccaatgcccccggcaattcccgtcgcttaattgcatttccattcccttctcatgtctctctctctctctctgtccttttcctccgtcaattcaatggcaaattctgatcaaacacaaataaactttccttaattgggcgtgtcttttcattgccttgtccttttgcaatttcggtctctcattaattaattccattgatttgcctttccct

SEQ ID NO: 50075 - DNA, 640 bp, Heterodera glycines
  SCN-specific regions: Sequence locations=1-640
gtttgagccaaatgttcgacttccatcaattcatgggtttgggcggtggtgctgtcgccacttattcagtgcaattgcgtgccttttctgcgccatttttccagcgacacgatgaacgaagaatcaacgaactcaattacggcggaaagattctgttgccaaattcgtgtctcgacaatttgatgcgtcgcaacattcagtacccgatgctcttcaaattgactaatgtcggcccggcccttcagaggggcacccatgccggtgtgctggagtttctggcggaagaaggccgctgctatttaccttcctggatgatggcccaactcgctctgagggagggcgacctcatcaccgtggagtacaaagcgctcccgaatgccacttacgccaagttcaagccgatgtccaccgacttttacaacatttcaaatccccgtgccatgctcgaggtcgaactgcgcaagttttcctgtctgaccaaaggcgatgtcatcgcagtgcagtacaacgaacaagtgtacgaattccaagtgaaggcactgaagccggaaaatgcggtgaccatcgtcgagtgtgacataaacattgaatttgacgctgcggaaggctacgtggagccgaacagaacgcatcaacaacg

SEQ ID NO: 50076 - DNA, 414 bp, Heterodera glycines
  SCN-specific regions: Sequence locations=1-414
gaacattgcttgcggtcttgtcggaggaccgggccttgtctctggaatgaatattggagaagaatatgccgtgtttgaaacaggcacacgaaacacgggaacctcattggctggcaaagacattgccaacccaactgccttcatcagagcttccatcgacatgctgcgttaccttgagctccacgattatgctgacaaactttctgatgccctttacaaagcattgacggagcagagaacgcatactcccgacattggaggcacgaatcatagtacagaagttgttcaagcagtcattaacaactacagcgagacaatcagtaacgcttgaaggaaacttctgatagtacgatatcaatcgagttttagtcttgtaaatgtttcattaaactgtcaaataaagagcaaaagtag

SEQ ID NO: 50077 - DNA, 621 bp, Heterodera glycines
  SCN-specific regions: Sequence locations=1-577,600-621
atggcttctccgttgcaacgtttgatcacgtgtaattccccccaaattggctttgttgcgggtcgaattcgttttgtgccacattttgaaaaattagcggtgagttggtcagcgaattcgccaaaaagtgagggcgcggaacgttttgtgaaggaattctggccgattatcagagagaacaacccgaacatcgaatacctactcacccgttcgcacaccgaatgcgaccctttcgtcgtgggcacattccgttgggatcgtactcgaaaacagagactttgttggaaacacccgcaccaaattttggcaataattgaacaatggtccatcggtggcgattatcggcccggacgaaagcgcaaagtggcgacgataatcccacggggaatgcaaatcatagacaacgaaacgaagggacacgaagtgttcaaagtgttcagtcggtggaagggcgaacccacggggaacgccatggacccgaagaaacacccgaattacttgtaccatctgattaacgaagctcggaaatgaggaaaaaagtagagcaacatcatttgtttattcgaatttcaaatggattttggaattttaaaatttttcgatgaaataaatataaaaaat

SEQ ID NO: 50078 - DNA, 641 bp, Heterodera glycines
  SCN-specific regions: Sequence locations=1-462,484-641
gccaattgattgacggcggtcattgaattcctgttatttgtgttgtttctatcgtttttttgtgacaaatgaaatacgcccagctagttgtcggccccgccggcagtgggaagtccacttattgtgcagctgtgcaactccattgcaaaacggtcggacggacggcgtttgtggtcaatttggacccggcggcggagcaattcaattacgattgtgccgtggatatgcgagaattaataagtgtggaggatgtgctagaagatgaggacatggccatgggaccgaatggggcattggtctattgcatggaatatttggccgacaatttggactggctccactcgcacctcaacgagggcgaagacgactactttctgttcgattgtccgggtcaaattgagctgtacagccatctgccggtgatgtgtcaaattgtgcaggcgctgcgcgagtggaacttcaacgtgtgcagcacctttgtcatggacaccaccttctgcttggactcgaccaaattcatgtcagccactctcaccgcactgtcaacgaccgtttcgctgcaaacgccggcagtgaacgtgctcagcaaaatggacttactgaggccggaggaccgacggacagtcgaagaaattgtggac

SEQ ID NO: 50079 - DNA, 1116 bp, Heterodera glycines
  SCN-specific regions: Sequence locations=1-18,40-77,118-230,254 -315,344-442,465-470,494-704,737-1088,1110-1116
acttgttggcaccttattcaaaaggaggaaaaattggtctcttcggtggcgctggcgtgggaaagaccgtacttattatggaactgattaacaacgtggcgaaagctcacggcggtttttcggtatttgccggagttggagagcgaacacgcgagggaaacgacctttatcacgaaatgattgagggaggtgttatcgatctcaaagggaagaactcaaaggtgtcgcttgtgtacggacagatgaatgagccaccaggtgctcgtgctcgagtctgtctcactggtttgtccgtcgccgaatacttccgtgacaaggaaggacaggatgtgctgctctttatcgacaacattttccgtttcacccaggccgggtctgaggtgtctgccttgcttggtcgtattccatccgctgtcggctaccagcccaccttggcaacggacatgggcagcatgcaggagcgtatcactaccaccaaaaagggttccatcacttctgtgcaagctatttacgtgcccgccgatgacttgaccgatcctgctcccgcaacaacattcgctcatttggacgccaccactgtgctttctcgaggcattgctgagcttggcatttaccctgctgtcgaccctcttgactcaacttctcgtattatggacccgaacatcgttggaaaccgtcactatgatattgcgcgtggtgtgcaaaaaattctgcaggactacaaatcactgcaggacatcattgcaattcttggaatggacgagttatctgaagacgacaaactgacagtctctcgcgctcgtaaaatccagcgttatctctcgcagccgttccaagtcgctgaggttttcaccggacacaaaggaaaatttgtgactctcgagcagaccattgacggatttgaatccattcttaaaggtgagatggaccacatccccgaagtggcgttttacatgcagggagcgatcgacgatgtgcacaagaaagcggacgagttggccaaacagagttaaatagagaaataataatcggcacatagacctgattgtttaaatttcgttataggctgtttttttgtttaaatgcgtgtctttttggtaaattgttttcaaatgt

SEQ ID NO: 50080 - DNA, 1176 bp, Heterodera glycines
  SCN-specific regions: Sequence locations=1-1138,1165-1176
ggtggcgatgtccatggcttcttgcaaaagaacaaacttcgcgtgctttcccgacccactgaactcgtaagtttggggcgctgatttttggcagacaatacattcaacggtgacccgaacggcgtgatgccgaaacaccttgtgtggctcgactttgttcgtttggtgtgccaaaatagatgcgtttgtgcatatgtaatttgtcgacaaatcgctgcacatcgacgcattgtaccactgggataacgaagccgtatccggattgctgctgtcagaggaagtagaacgagaacgggccatttatcgaataatgaccacgggctcggaccgaacacaactccaactgcaattacattttaacgcaaataattcttccgaggcatcccaatcacaaaattcctccgaacaaatgcaaaattgttcaaccaatgaaagagtctctggagaagattcggtgccattcatcgacagagagacttttggagacgcggagagtgacagaggaaggggaccgccgcccgatcggtttcgactggtctatctgatcgtgcttctacatggaatgggcatgttgctgccgtggaacactttcattacgatcgcaggggattattatttgcaattcaaattcgcaaatgtgagcaatgaagacaattacaaagtgtactttttcaattatctgacggtttgtgcccaaattcccaatttgcttctaagttttctgaatttatttgtcgtcataagaggcggcttttaccgtcgcatttacttcactttggccgtcatttttggcatatgtctcgtcacaattgcgatggtttacgttccaaccgataactggactttcggctttttcctcttcacaatgctatccgttgtgcttctgaatagcgccagtggtgtttatcaaaacagtatttggggattggtcgctgattttcccggggaattcgccggtgccattattcttggcaacaatttatgcgggattctgatggcagtgctagacatcctcatcattgtgttaggtttgcgattcgtccacttcgcttttgttcggttcgcttttagtcggtgccaatgccgcactcgccgcaacagtttacttcggtctcgctctgtttaccgtcgtcctttgcattttttctttccattttcttcaaaaattggttctat

SEQ ID NO: 50081 - DNA, 383 bp, Heterodera glycines
  SCN-specific regions: Sequence locations=1-252,274-383
gtttgagaaaatttcacatttaacagaatacaaacaaaatgtccaccggcgttatccaaccattaaatcctaagccgtttttgaacaatttgactggaaagccaatcatttgcaagctcaaatggggaatggagtaccgtggcattttgatgtccattgatggttatatgaatttgcacttggccaacacggaggagtacattgacggaacaaacactggcgcattgggcgaagttcttatcagatgcaacaacgttttgtggatctctgctgctgaagagggtgaacagtgaacacaccaagcacaaatggttgaacatttttgttgatttcacttttaatcgatctgtttttcctatttttcaaaaaatccatcaaccatg

SEQ ID NO: 50082 - DNA, 569 bp, Heterodera glycines
  SCN-specific regions: Sequence locations=1-569
gtttgagaaaaaatgttcgtaaaaacattttcgaataaaaccgttgttttcaatgtggacccgactgaactgtccgtcgagcaactgaaggcactgatcgctgaggaggaggaaattgctgtgccggaccaaagacttgtctttgctggttgccagcttgtggatggaactctgctcaggacttatggagttgatgctgattcaaccatccaccttgacctcagattgcttggtggtgggaagaagcgtaagaagaagcaatacactggcccgaagaagcagaagcatgttcgcaagaaggtcaaactcgccgtgttgaaactttacaagattgatgacaatggaaagattcatcgacagcgtttggaatgcaattcggccagctgtggagccggaattttcatggcgaagcacaaagatgggcgtttctactgcggcaaatgtcatcaaacattgaaggaaaagaaatgagtgcttgttgagaattattgaatggatagccgttgatgctattttggtttttcgttcggttgttgttatcttgttgcttaaaaatatttttgaaaaaa

SEQ ID NO: 50083 - DNA, 551 bp, Heterodera glycines
  SCN-specific regions: Sequence locations=1-10,32-174,197-229,251 -253,275-406,428-551
ataagattttgtagttcttgttgtttattttcttggtaatatggctgttggaaagcagaaaaaatccgcggagaatatcaatgccaggttgggcatggtaaccaagtcgggcaaatactgcctgggctacaaacaatcgctgaaaacgcttcgttcgggcaaggcaaagttggtgatcatctccagcaacacgccatctctcagacgcagtgaaattgagtactacgcgatgttgtcaaagacgggcgtgcacgagtaccatggcaacaacatcgagctgggcaccgcgtgtggcaaactgttccgcgtttccatgctgtccatcactgacccgggcgactcggacatcattcgcagtatgccgacggaggcatgagcaatcaaatgaaatgaacggatggacgtgatcagtgatcattcattcattgatcggatcatttgtcatcctttttttcaaatattttgttgttgtttcacccggaagtgtttcatgttttcggtgaaacgaaagacattctcgttgttaagaggcggttggtttttcaaaaaaa

SEQ ID NO: 50084 - DNA, 486 bp, Heterodera glycines
  SCN-specific regions: Sequence locations=1-10,45-486
attaagaaaattttctctttgcttctctctcctctgtttttcatttccttaaaagcggcaatgaccagtcgaattttgagctgcaatttgcgaaggtacttctccaagatgaaccaacacatcgagttcggcacaacgaagagcgcttcgtccgacaaacaatcgccgccttcccctacaaacaatcaaacgcaacacgagggaatgagtcaggaatgtcgggagcaaatcgagcagatggaaaagctgaagagcgacaacgaaatgctgaccgacaaatacaaaagaacacttgcggacatggaaaacttgcggaagagaacgcagcggcaaattgaggaggcaaaactttttgcaattcagccattttgcaaggatttgctggaggtggctgatgtgcttgacttggcgttgaattcgttggaaaaaatgaaaacggaggacggtgccgcctccttggacagtggagtgaacaaagggatcaaa

SEQ ID NO: 50085 - DNA, 832 bp, Heterodera glycines
  SCN-specific regions: Sequence locations=1-832
gtccttaagagcaataaatgcttcgcaatttgtccaaatttggcaccattttgaacggtgttgccgacccgttgtccgccctcgtggtgccttccgccgccgcgggtgacgcatcctccctgctgttgccgtgcagtgccggcgctgtgcagcggcagagtcggcgttggggtttcccccgtgggcacaaacatccgccacgtctgttcttcgactttgcacatctcaagcagatcactggcggcgaatacaccaccaaaccgttacaaatcaatcggttgggcggacggtgtccaattacgaggaaaaagctgtgcatacacatcggtggcggtgtaaagtttgactatttcatgctcaatttgcacccgcgcggtccaaccgttgcggacgaaacgtacgacgagcgcgtgatcgaagtgcgccgtgaccccaaccgaacgccgtacattgcgctagttgcgggtgtcaagggaaagcgttggatatacgccacgcagaacatgcaggccggccaaatcatacaaacgacgtgtcacattccggaacggccggtcattggctgtgagggcaactcatacccattgggcgctttggtcgaagggacaatggtgaattcgattgagcttcatcggaacaaccctaactcgcacgtggtcatcaccgaagcaggcggttgtgccgaaattattcgacacatggacgaattcactgttgtccggatgccgaacaaatatgaatacgcggtgcgcaaggaatgcatggcggttgttggaaaactgtcacacgtggactgggataaaaagcattggggctctgcccaaatgcatcg

SEQ ID NO: 50086 - DNA, 448 bp, Heterodera glycines
  SCN-specific regions: Sequence locations=1-417,440-448
cggacagtttgcgccggttggccttcttcggcgtggcactgtccaccgtcagtacgctgatctgcgttctctccgtgccgatggtgtatagttacgtgcagcacatcaactcacaaatgatggccgaagttgacttctgcaaaatgcgttccggcaatatttggcgcgaagtgacgcgcactcagggaatgcatgctgctgactcgccaccgcgtggcgcgtaatgctgacgcgtgctgcggctgtggcgaatccccgcgtggtccgcccggccctcccggcccagatggaaatcccggcggcgacggacagcccggcggacctggacagcctggcgcaccggcacaggctccgccgcgtccgaaaccgagcggcacaggatgtcaaacatgtgctccggccgagaacggacatcccggcccccagggcccacccggccaacctggcg

SEQ ID NO: 50087 - DNA, 1157 bp, Heterodera glycines
  SCN-specific regions: Sequence locations=1-530,552-769,804-1126
aagagacacaaattgttgtgggagtggcctccgtgtgctcccttttggccattgtggccacgttggtcgttgtgccgtcattgtactcgcagatcaacgaaatcagtctgaaggtgcacgacggagtgcaggcattccgcgtgaacaccgactcggcatggaacgaactgatggaagtacaaattacggtcactcctccggcaaaaccccgcgagaatcctttcgtctccatcttccgctccaagcggcagctgcctggacattgtcaatgtgctggcgtccaacagccccaatgtccgcctggcccaccgggacccgcgggggcacccggacagcccggataccctggacaagccggagagccaggacagccgggagtgcctggacagcccggagcgccatgcccggatgttcctcacgtctgccagcattgcccagctgggccgcctggaaagcccggagatcaaggacctgccggccaagccggtcaacctggcaggccaggccagcctggacagagcggaggagtgggcccacccggacctcctggcccgcaaggacaagccggaagcccaggacgacctgggggatcgggacaaccaggacaacccggacaaaatggagttgtgtataagaccgttcctggaccgaagggacaacccggccaacctggagcaccgggacagcctggcgcacctggacgacctgggaagcctggagaccaaggacaacccggagccccggggcacccaggacagccaggccaacccggagcaccgggacagcctggtcatcctggcgctgctggagcacccggcaaagatgcctcgtactgcgcctgcccgccccggtcgggcggcggttatggcgtttccgggggaggcggaggcggtgccaaagtcgaacacgcgcccttgcccgctgaacaggcacctgtgccggaacaaccggcagaaagcgtcggcgtagcgcctgcaccggccgaagtggcgtcaaacgccgccggtggccaaggcgaagcagaagcggcgaaaggatacaggaagaaaatgtgaaagatcggataattattaatgcagaataaagtgattgttgatgagaggaagggacaaaccaaaattcattgaaattaaataattaataacattttaataaac

SEQ ID NO: 50088 - DNA, 420 bp, Heterodera glycines
  SCN-specific regions: Sequence locations=1-47,71-119,149-420
gcgaagtgcttaaacaattgacagaagagaaattcatagtcaaagcgaccaatgggccacgatatgtggtcggatgtcgtcggaccattgacaaggagaaactgaagcagggcacacgtgtggctttggacatgaccacgctgaccataatgcgccaacttccgcgcgaggtggacccgttggtgtacaaaatgagccacgaagaccctggcaatgtgagctatgccgaaattggaggtctctccgatttatcagagaactgagagaggttgttgaactgccgctgatcaatccggagttgttcaaacgcgtcggcataacaccgcccaagggctgtcttttgtacggaccgcccggacctcctggcgcgcccggtcagcccggccagcctggaaactctggccagcctggacagcccgg

SEQ ID NO: 50089 - DNA, 537 bp, Heterodera glycines
  SCN-specific regions: Sequence locations=1-60,84-537
gtccaattaagttgtcagttttaatgtctaacataacacctggaaacacaacacagactcagagaggagagggaggaggtgacctcagcgcagataaacttagggaaatcaactctctgattgcggcatttccgagttccattggacaaacgccgcctgattccgcgcttggcacagcactgaacaatatgatggtgcaatggaactcactgctctcgcaggtggtcacagaggttgaccacccacagccaatcctggagcacatcaaagaaacggcggaattctccgtcaaacagtttcgtgacgcatgcttgggtatgatcagcgaattgacacgcacttcggtcgattggcaactgaacttcccaaacgaaatggcagaacaggaaatttccgaatatgagaactcaatccgaagacaagaacaattgttgggtaaaatcagacagaaattggacgacgaaattttgtcgggagaaaattcgaattttgtaccttaatgtttggattatcacttggatgaatcgcttatcatta

SEQ ID NO: 50090 - DNA, 650 bp, Heterodera glycines
  SCN-specific regions: Sequence locations=1-650
gtgcatattcgatattcagttattgcaaattgttactcaaaatggcctcttttctccgttttttggcctgccgtcacttttctatgtcgtccgttttgcgcaaagaggcggaacaacttaccaatgaacacatcgacaaaattcggcagaggacccgtttcagtgagacgagcgcttttcacgggcgcggcagcggcggacggacgaacggcgaaagtggcgaggacgcatttaccaacccattttacattgccagttactacgacagtaaacgattcgaagcaatccgaggcgtttcaatcttcgcaagcatttcgcttctgttgatttatgtcgcatggttcagggagccaaacgaagtggacgaactttgggattacgacatgcgtttggtgtactttgtggccaaaaaacgtgtgctaaaggaccaaattgaacaggcgaaaaagggcggccacggaacagttgatttggaaaccgatctcatcaacattgaggtgcaagagcaaaaaattcgcgaagaagaagagaagaaggcaaagaaagtggcggcaaagaaaaaagcggaacagaagaggacgacagcttaaaaagcattaggaaaatttccatttttttaaattttctgtttttataaattgttttccgtt

SEQ ID NO: 50091 - DNA, 790 bp, Heterodera glycines
  SCN-specific regions: Sequence locations=1-25,47-790
gtccaattaagattatacgacttattttctgcctccaacatgtcaagcacgccttgacgtcttcaaactgacggacgatgacgcaatgaaatttttggtgtgcgaatcgcacatcggcaccaaaaagatggactaccaaatggagcattatgtgtggaagcgtcgatcagacggcattcacatcatcaacattcgcaaaacgtgggagaaactgttgttcgccgcccgtgccatcgcggccattgaatatttcgtccgatgttgtggttgtctctgctcagccgtacgcccaacgcgctgtgctcaagttcgccgctcacatcggtgccactccaatcgttggccgttttacgcccggctctttgaccaaccaaattcaaaagaatttcaaggaaccgcgtctgctcgtggtgtccgacccgcagttggaccaccaggcggtccgtgaggcgtcctacgtgaacacgccggtgattgcggtggccaacacggactcgccgctgaaatttgtggacattgccatcccggcaaacaacaagcaaaagcactccgtcggactgatttggtggctgttggcccgtgaagttttgctgttgcgcggcaaaatcagtcgccagacgggctttatggtggacgacaagctgatcatgcccgacctgtacttcttccgtgacccgcaagagcaggagaaggagggcaccgagggtgaggccgaggcggacatcaccgtcaaggagggcggctggggtgccaccggaggcatggacactatgggcggcgacttccccgg

SEQ ID NO: 50092 - DNA, 895 bp, Heterodera glycines
  SCN-specific regions: Sequence locations=1-895
ggtttttcgagaaatgacaaatgagcgtgatttttctcacgatgaccacattaacaacgctgttgggaccaatggcgacagtaaagacgcagccaaaagaaaggacatctgccgtgattttctgaataatatttgcagcagggggaatcgatgcaaattttatcatccggaagacagtgtcgaaaagaatcaaaactcggcggatgagccttatcagttctgcattgattttcagaaccagggctgttaccgcgaaaattgtcgttatgttcacgcgtttcgcgaggatgtcgatcgttacaagcgcagcggcgacgtgacgcttgggttggcgcgagctttggcagcgctgttgaaaggcgatacgataaatggaattccgctttgcaaagagttccaaaatggacactgcgcgcgcggcccgcaatgtcgctattggcatatcaatcgcgacgaagagcgacgcaaacgctttggcggcggcaggaactgcggcggttcgccttcgtcgcttgcgttcggcgcttacccggcggtgcctccggcaggagcgcaactcagcagacgaagaggtgacgagttcgtcagtgaagattttgcaccgccctccaaacgatcttttgctcacaatcagccgtttgcaacgattcccggacagatggctccaacgtcagcaccaaccgcaccgtctcacccgtcacctcaattagtaattgagttggaacgtcgaaacgcggaattaaccactgaagtggaaagtctgaagagggagcttaaccgggaaaaggagcgttacgatgaccttatgtcgctttttcgagccgcccaaggccaaccgacggttcaacgttcggtgatttcgactccgtctttggtacccgccaatttgcagcca

SEQ ID NO: 50093 - DNA, 597 bp, Heterodera glycines
  SCN-specific regions: Sequence locations=1-597
gtccaattaagctgacaaatgttttcaattgttggaaaaaaggtcttcaacactacctcgtgcaattttctttcgaaggcattttacgctcatatgagcaaagatgaaataatgtggcattggcctgcgcagaaatttgaccaacatttcatcgattacttgaacaagccggacattgacgggtgggaaatccgaaaagctctcactgaactcgggaactttgacgtggtgccagaccccaaagttgttgaagcagcgctcagagctattcgccgtgtcaatgactttgcgcttgccatccgttttctggagcagattaaatacaaatgtggtggacccaaaagccgatccattgtgtatccgtatatcattcaagaggtcaaaccggtgatggatgagttgggcattccgacgcttgaggaacttggctacgacgagcccgaattcttcactcccgaccccgagtggtactgggagaagtcctggtacaagctttacgggttcgacaaactgcctggatacaaacacttggcctgaactgtttggccggagatggcgtgtgcatagaataggaaagaaattgttggacggctcttt

SEQ ID NO: 50094 - DNA, 606 bp, Heterodera glycines
  SCN-specific regions: Sequence locations=1-606
gttaagccttcactttcagtaattcttattgttaacataatgacgcaatttctccccgacaatttgttggctctgtttgcgcctcgtccgccgattcaattcaaaccgccgccagatgatctattcatccaccgaaaacacatgcaaatggggggcatggccgagtgtgtccatggttttgaggatccgaaggacactcctccaaaacccaaaattgagacccgagaggagaagagagcgcgaaaacgcaaggaaaaggaggagctaatggcctacaaaattgagcaaggcattgccacttggacacctgcggacaatccgaaggcgaccgttgacccgtacaaaacactttttattggccgaattaattatgaaacttcggagtccaaactacgccgtgaatttgagaagtacggcaaaataacgaagattattatggtgcacgacaaaaacagcaaaccgcgcggttacgcctttatcgaatatgcccataagtcggagatgtcagcttccgcggggctcaggcaaatatgtgcatgcattggcacacattttttgctgtgctcacctaaaaattactcaaaaagtccttagccgcttacaaga

SEQ ID NO: 50095 - DNA, 659 bp, Heterodera glycines
  SCN-specific regions: Sequence locations=1-659
tgagaatgcggccaccggttgacgaggattatcgcccgatccgcgtacttggccaaggcgcgtacggcgaagtttggttggtgaccagcaaagaaaatgagagagagcagttcgccatgaaaaaaattcccgttaaagcgacggaggagggaattccgcagagtgtcgtcagagaggtcgcttctctcgtcgcactcaaacagatgaaacacccaaatattctcaggctccacgacgcattcattcgccgaaagggcggcaccatcagtttgaacatcgtctgcgaaaagtgcgactgggacttgtgcgactttttgcgaaaaattccgaaaaatatgtgcgacgcgcagtgcaaatattttgcacgtcaaataatgacgggcattgatttccttcatgccaacagtattattcaccgtgaccttaagcctcaaaacattttggtgaacaaagaccacactttgcggatcgccgatttcggactgtctcggaactacggtctgcatgccaccttcaccaccgaggtggtcaccctgtggtaccgtagccctgagctgctgctccagtgcaagtacggtactgcggtcgatctttggtccgccggttgcattttggcggagctgtacacgcgcgacgcgctcttcagaggggatacggag

SEQ ID NO: 50096 - DNA, 731 bp, Heterodera glycines
  SCN-specific regions: Sequence locations=1-60,84-544,566-731
ggagctccccgcggtggcggccgctcttcactagtggatcccccgggctgcaggaattcggcacgaggccaaagtggaggaaatccgacgcactgtttatgtgggcaatttgccaaagggatgcgacggcgaggaggtgctcaacttctttaacgcgtgcattggcgaggtgatgtatttgcgaatggcggccggcaacgactatttgccctgtgactacgcttacgtcgagttcagtcagcagtcgtcggtgccattggcactgcaaaacagcgactcattggagtttcagggacgtccattaagaatccaacattccaaagttgcgatcataaaaccgcaacgcaaaacggctgaccaggcacttgaggaggtggaggaagcgatcaaaagcggcagcgacggacgcacaacgacggacactggccgtggctattcgccgttccgtcccggggtcagcgccccgcgcgttgtgccgacctcaccgcgtccatccgtcaaacgctccacccgctcacgttcaacgtcctccagtcacagtcgtcgttcccgctctcgttctcgccgacgtcgttcccgttctcgctccacccggtcgccgtcccgttcgcgtcgccgccgttcgcggtcacgcgatcgcaaacgctcgcggtcgcgtcgccgttctcgctcgcgcgataaagaccgcaaaaaggccagcaaacgctctcgttcacgcgaccgttccacca

SEQ ID NO: 50097 - DNA, 673 bp, Heterodera glycines
  SCN-specific regions: Sequence locations=1-140,162-340,363-425,464 -551,573-673
caagtttgagcattgttttgaatttcgaaaaaatgggcaaaattcactactgcaagcgtccggacaacagcacaaagtcgtgcaaagctcgtggttcagatcttcgtgtccatttcaagaacacacatgagacggcgcgtgccatcaaacatatgccgttgaagcgtgccatccgctttctggagaatgtacgggagaagaaggagattgtgccgttccgccacttcaacggcggcgtgggacgcaaagcgcaggcgcaagcgtggggcacaacacagggacgttggccgaaaaagtccgccgagttccttctccaacttctcagaaatgcggagagtaatgccgaggtgaagggcctggacgtcgaccatttggtcattgaccacatcgtcgtgcaagcggccgccaaaatgcgtcggcgcacttaccgcgcgcacgggcgcatcaatccgtacatgagttcgccgtgtcacatcgaagtgattctgaccgagaaaaaggacgtcgttgcgaagccagccggcgcattggtcaaagtgaagaaagagtcgaagaaaaagcagcgacggcaattggcacgtggcgaattctgagtgacccgaggacatccccgaaccacactctctttgtgcggcttgttttgttatttggtggcgataaaatttgttgaacc

SEQ ID NO: 50098 - DNA, 414 bp, Heterodera glycines
  SCN-specific regions: Sequence locations=1-216,238-414
gccgctctagaactagtggatcccccgggctgcaggaattttgcacgagggtttgagcaatcgctatgttttcatcctccaaaagtgccgcagttttgcgaatgcgcggcgccaccggcgcaatggcacggcggtggaagggcggtgacgagcagaaaaatgtgccggtgccgagccccaaagaaatggcccagcggccggcggagtttgacgagctgacgcacacgggacaggcctgggacattgccgattggcgccgttctcgtttcgagtacatgccgaagcaagtgaacccgagcattgcggcccatttgatcgccgagctggcgcccgtgcccagcgaggagcgcgtggtgcgctgcgacgggggccaccgcgagttggggcacccgcgcgtttacatcaacttggaca

SEQ ID NO: 50099 - DNA, 466 bp, Heterodera glycines
  SCN-specific regions: Sequence locations=1-60,90-118,149-151,178 -255,277-466
tcacattgttctctggattgcctcggtgtgctctctggtgaatatcatcgccacagtcggcactctgccatctctgtactcagagatgaggcaaatgaacaacaaagtgcgcgacggagttgaggccttccgcgtcaacaccgactcgaggctggactgacttgatggacgtgcaagtggtcgtgacgccgccgtcgaagccccgtgataaccccttcaactccatcttccgtagcccacgtcatactgcgcggactctgccattgcgctggcctccaacagccaagctgtccccctggttcgaccacgaccgaccggaccgcctggacagaccggacaccctgcaggtgctagacaccccggacaggctggactgcctggccaacccactcctgattgttctgcggaaatgctccactgtccgcgattgcctgttagcccggcctgacgacacgaggggacaggg

SEQ ID NO: 50100 - DNA, 1001 bp, Heterodera glycines
  SCN-specific regions: Sequence locations=1-81,103-141,169-293,315 -699,722-1001
caagaaactcacattgtcctcggcattgcctcgctgtgctctctgctggcaattatcgccaccgtagtcactttgccatcgctgtactcggagatgagccaactgaacaacaaagtgcgcgacggcgttcaagccttccgtgtcaacaccgactcggcctggactgacctgatggatgtgcaagtcgtcgtggcaccgccgtcaaaggcccgtgacaaccccttcagctccatcttccgtgccaagcgtcaattgcctggccactgcaattgcggtcccccacaacggccaaactgccctcctggcccacctggtccggccggaccgcctggccaacccggacagccgggaggcgcaggactgcaaggacagccgggagcacctggccaacctgctcctccgtgcccgccccagaacatcccttgtccacgctgcccggctggcccacccggcagccccggagggcagggaccgcccggacagcaaggagcccccggccagcctggtgcgcccgctccgggcggaggacagggaccgcctggcccatccggaccccaaggacagcctggacagcccggacgcagcggaacacccggccaacccggacagcctggaaataatgctgttattttcaacaccattcctggcccgaggggagctccgggagcgcctggccaacccggaagccctggcagccaaggccaacccggacagcccggaggccaaggaccgcctgggccctctggtgcgcctgggctgcccggcctgtctggcaacagcggtcagcctggacagcccggggcacccggccaacccggcaaagacagcggctactgtccatgcccgccccgctcttccgcgatggcactcaaaaagaaaatggcggcggtcaaaatttttttagcgaaaagagcagcttcaaactgtgatgctaaagataatcccattattggatgttggcgaaattaaattcaccttcttcgtaaataaattgcattttt

SEQ ID NO: 50101 - DNA, 575 bp, Heterodera glycines
  SCN-specific regions: Sequence locations=1-575
gtttgagcattccttgatggttcgtcatgtgactgcctcctgctttcgtgcgccatggcgcttttgaaaaaaagggctcaactggatggcggaagaatgggccggttgttattgaatcgcacaaatggcccggtcaacaaaaggaattccccgagctctcgccaaaatttctaggagcaaactttaaacagctatggagatacaccggagtggcgcccacaggatttaatgaccccaaaactgacgattttgttcatgttcccgaaatggtgcccgaattggtcgtgccggacctagccaatttcgagctgaagccatacgtctcttacaaaacagatgcaaaaattgaagaaaggctacgcaattttgacaaaaaattgacaaaattcggtgggaatgagaaagcagcgattgccaattccaaagagacggaactatggccccctccgccaatcgacgcgaaaattctcttcgactttttctacgctgagaaaattcgtcaggcatttgaaaaagggaagaagtaaaaaaagattagcagacgatggaccaaagcagacgattgacgccttatt

SEQ ID NO: 50102 - DNA, 801 bp, Heterodera glycines
  SCN-specific regions: Sequence locations=1-6,31-108,131-571,593 -666,694-801
ggccatggaaattaaggaaaaatcaaagaatacttccacaagtgcggtgcttccattaacggcggaagaacggatgaaacgtcgacaaattatgaggacggaagtgttggaaaatgtggaaccttttctcaaaatgaagaaaaaaagtttggaagatgcgcaggaggacgagcgcgagaatttccgccgttttaaaatgtttgagacgagcgcacttcagcaaaaggcaaagattgaggaaaatattcgagactaccgcaagagtttgaccgctctcgaaatgctctcaggacaaaattgaaaaaggcgttgactcggtcgagatcacttacaaattggacgagaacctttactcgagggcattggtcgaagagatggacaaagtttgtattcggctcggtgccaatgttatggtcgaatacgaattggacgaagcgcgacaattgttgcgcgaacacctggaaaatgtggaaagaagctccaaagagacggaggaggacatcgcatttctgcaggatcaaatcactaccactgaaatcaaccttgccaacctgtaccactacgctgtgcaaaacagaaaacagatgtccatgaactccgaactttcagtgggacaaatcggattggacgccgtggaataaaaacagaaattcatgagttaaattctttttgaaataaaactatttttgctatttaaataacaacagtcctccactatgtccagtacctattctttttcttttcacttctttcttttcgaccataatcgtttttcttttcgttcataaaattgactttctg

SEQ ID NO: 50103 - DNA, 654 bp, Heterodera glycines
  SCN-specific regions: Sequence locations=1-221,243-654
gtttgaggtaaattttttgtcgcacacaaacttgagtaaaaatggcatttcgcgcactttctttcgcccgtcgtccgtttacaacttcgtccatttgccgtaaagaaattgacctggtcgccggtgtttatctgaacaaagttcgggaagtggttggcaaacaaagtgagattctcaattcgcctcagttgaagaaggagttgaacgaccaactgaaccgtttggcccaaaaattccatttgccggatgccgacgcggttgccaagttgggccttcagtttaagggagcaagtgttgtcagttcggtggaccaattggttgatgggggacagtcggtggatgcccagcttaatgcgcttaatgacagtcgtgccaaatatgaagcggagcagaaggggaagagacaggctgaacaggagcggatcggcgcaatttctggtgatgcggactatgcaaaagagtttttcccaattccgccgcctcatatcgaagcccagcaattggccgccgccgccaaagctgcgcaatgatattagaagtgatcagcggaatgagtgaccaaaatgacaaaaaacaaatagcgattttctttgcctctttttttgtgtgaaaatttttgtagaatccgtctccgtataaaaatgtgttgttact

SEQ ID NO: 50104 - DNA, 671 bp, Heterodera glycines
  SCN-specific regions: Sequence locations=1-312,335-387,409-548,580 -592,614-671
agatttaattgaaaacaatgactcgtgggtcaagcgccggatacgaccgtcacatcacaattttctcaccagaaggaaggatttaccaagttgaatacgcgttcaaagctgctaacactgcgacactctccgctgttggcattgctcttgatgaaactgccgtaattgccgtacaacgtcgcgttcccgacaaattggtggacccatcttcagttaaaagcatttataaattgtcctcaaccgtcagttgcggtgttatcggcattgtcctttaagcggatgcgatgttccaagtgcgccgtgcacaatcggaagcagccagatggaagtatgagaatggctatgaaatgccaatttcggaactcgcgcgtaaaatggccgagatcaaccagtactatacacaggttgctgaacttcgttcattgggcacactgatgcttatgatctcgtacgacgacgaaaaaggcgcttctgttttttccatcgatccagcaggacattacatttctgttcgtggttacggcattggagtcaagcagcagcagatcaacggttttctggagaaaaaactcaaatcaaaagaccgaaaattcggtgacacggaagtgattcaactggcgcttgaggcactgcaaaccgggctgggaattgacttaaatgctgaccaggtg

SEQ ID NO: 50105 - DNA, 679 bp, Heterodera glycines
  SCN-specific regions: Sequence locations=1-679
gtttgagcaattacacagctaaataccgctttaaaccatggcaaatccttcgattaacgctaaggcggcagttttggtggacaatccgcgggttgaatttgtgcaactcgactcattggtggtcatgaaaattgtgaagcacggggacatcgaattctatgccggaatgtccaaaattgctggcgaaacgtgccaaggcattctcaccggactgatctccgtcgaggacaagcggcttgaagtcacgaattgtttctcgatcactcgtccggatgctctgcacgaaagtgaagagagtgccgctggtcccgagacgtccctttcagacgagaacaaacagggcgagattctcgacatgctgaagcgatttcgaatgatgaacatcgattacgagtcggtcggcttttaccaggcgcacccattcggcgcctgtttcagccacgaactgctcggttcattggtggactaccaatcggacatttcagacgccgttgtcattgtttacgacccggtcaaaacccgtcagggatgtctgacccttcgcgcttatcgcctctccaaaaaggcgttggatttggccatcacttgcgacgacagttggtctcctgaacagaccaaattggctggggtcaactttgccaatttcttcgaagaattgccaattgttgtgaagacagcc

SEQ ID NO: 50106 - DNA, 674 bp, Heterodera glycines
  SCN-specific regions: Sequence locations=1-674
gtttgagacaaagactcaaaaatgactagcaaaacttcgcctaaaatgccgcgcaattaccaaattgcatccgggctccagcgtttctccaaggcccgtatgtttcacgccaaagggatgtgggtcaagctgaagaagccattcgagaagaaagcaaagcatgcccaaaaagcagaaaaatttgttgtcaagaaaattggcggagagaaaaacggaggcgagaggaaagtgctcaagaagaaggagccgaagcttttgccacaagtgcccagtgttcaaatcaagaacaaaaacaggccgaagaaagttccattgcgcaaatcgatttcgcccggaaccgttctgatcattttggctggccgtcaccgtgggaagcgcgttatctttataaagcaattgccaaaatcgggtcttcttcttgtcacaggcccactgaagttgaacgcgacgccgttgcgtcgcatcgcacaggcttttgtcatagcgaccaaaacaaaactggacatttcgacgatgaatgtgccggagcatttggacgacaaatattttaaacgacaaagtggcaaagtggcggacagatcgaagggtgggatttttgcggagggagcgaaccagcagtacgctgtgaccgaccagcgcaaggaggaccagaaaactgttgactcgcaagttat

SEQ ID NO: 50107 - DNA, 375 bp, Heterodera glycines
  SCN-specific regions: Sequence locations=1-323,349-375
gtccaattaagcatttctctgcataatttattccaatgctaataaaagtgaaaacgctgaccggaaaagaaattgagttggacattgagccgacagacaaagttgatcggatcaaagaaaaggtggaagaaaaggagggcattccgccgccgcagcaacggctgatttttgcgggcaaacaaatgttggacgagaagacggcgcaagactacaaaatccagggtggctccgtgcttcatcttgttcttgcccttcgcggcggatgaatgttcgccatttggacgcttttgttggataaatgatttgattgtctaatgtctcactgactttttaaaaatatttaaatacaaacataaattgagttccacttaaaag

SEQ ID NO: 50108 - DNA, 584 bp, Heterodera glycines
  misc_feature (578)..(578): n is a, c, g, or t
  SCN-specific regions: Sequence locations=1-584
gaaaaattattattacaaaggaaaaatggctgacgcagctgctcaagaacaaaaaaagaaacgcacttttcgtaaatttgtctatcgcggagttgacttagaacagcttctggaaatgaatgagaagcaattcaaccaaatgattcccgcccgtcaacgtcggaagatgaaccgcggattgaaccgaaagcacaaatctttgctcgttcgtctgcgtaaggcaaaactcaattgtcccgagctgatgaaaccggagtgcgtgaagactcatttgcgtgatatgatcgtgctgccggagatggtcggctgtgtggttggcattcacagtgggaaggcatacaatcaggttgaaattcgagctgagatgattggatattacttgggcgaattttctattacgtacaagcctgtcaaacacggtcgtcccggaatcggcgcaacgcacagttcgcgtttcatcccactcaaatgattctttttgcgatcatcggaaattgttgtttaccgatcttttgttattgaattgtttggattttgttggaagttagcggactcaataaagtgaaaatttgttaaanaaaaaa

SEQ ID NO: 50109 - DNA, 610 bp, Heterodera glycines
  SCN-specific regions: Sequence locations=1-38,60-210,232-610
agataaaataagccaattcaaactgttctaaggaaatggctcaacttcttgctggagagaaagttgtgctgagtgacggttcgaaggtagaagcggaagtgttccttaaggacaaagtggtcgctgtttacttctccgccgggtggtgcccgccgtgtcgcgcgttcactcccaaacttaagaaattctacgaggagctgaaaaaggcaggcaaaaacttcgaggttttgttcgtctcgcgcgaccgtgctgctaaagacctcgtcgaatattaccgtgaccaccacggcgcttgggcctacctcgagttcggaaacccgaaaattcaggaacttctcgagaagtacgaagtgaaaaccattccgacttgcaaagtgataaaacccgacggaacgatcgttgtcaatgacgcacgaaccgaagttcacgaaaagggcgtggagaatgcacttggtctttgggaggaatggctgggattctatgaagcttgaaaaagcccattggcaagcgaaccgacgaacgaaggataatttgataaactttcctcaatgcttatttatatagccttaggcatttcaacattccccgataaagtaatcgcgtgacaaaa

SEQ ID NO: 50110 - DNA, 566 bp, Heterodera glycines
  misc_feature (521)..(521): n is a, c, g, or t
  misc_feature (526)..(526): n is a, c, g, or t
  SCN-specific regions: Sequence locations=1-253,278-316,339-566
aaagctggagctccccgcggtggcggccgcttactactagtggatcccccgggctgcattacctcagcacgaggggacacttatcaaaatgaccaaggtcaagactttcgaactccgcaccaagtcgaaggctgagctttccaagcagctcgacgacctccgtcgtgagctcctttcgctccgcatcaagcagcaatctggccagtccaaccagaagccgctcgagatccgcaacgtccgccgctcgatcgctcgcgttctcaccgtcatcaaccagtccaccaaggctgaggtgctcaaggagtacgccggcaagaagtacatccccattgacctccgcgccaagaagacgcgtgccatccgtcgcgccctcacccccgccgagcgcaagatcaagacgacccgcgccctcaagaaggccaagcacttcccccagcgccaattcgccgttcttgcgtaagttttggatgttggaatcttgtgttacacggaatcaatgcatggttgacttctgctgaacnaaagnatgaaaagaaaaggaacaaaaaaacctcgagggggggccc

SEQ ID NO: 50111 - DNA, 880 bp, Heterodera glycines
  SCN-specific regions: Sequence locations=1-165,197-676,703-880
gtccaataaggcattgattaagacattgcagaataaaacaaattaaagtgaaacatggcaaccgaagttgatgaaaatacagcagttgctgatccttggagcactgttgaagatgtgagcggtggagagtcaatgcaccaattggtcaccctggacgttcccgagattaaactgttcgggaagtggtctcttaatgacgtggacgtgtccgacatttcactcgtggattatgttgcggtgaaagaaaaggcggccaaatatttgccgcacagcgtcggtcgttaccagcagaagcgcttccgtaaggcgacctgtccggtggtggaacggttggtctcgtcaatgatgatgcacgggcggaacaaccggcaagaaactgatggcggtgcgcattgtgaagcatgccttcgaaatcattcatctgctcaccggagagaaccccgtccaagtgttagtcaatgctgtgatcaacagtggacctcgcgaggattccacgcgtattggccgtgcgggcacagttcgtcgacaggcagtcgatgtgtcgcctttgcgtcgtgtcaatcaggcaatttggttgctttgtaccggttcccgcgaggccgctttcagaaacatcaaaacgatcgcggaatgtcttgcggatgagctgatgaatgccgctaaggggtccagcaattcctacgcaatcaaaaagaaagacgaattggaacgggtggccaaatcgaaccgttgaggaaaaaaagcacagaatgcaaaagaggataaaggacacaaagggatcaatttgttcaattgttgttgaattttatgttattttgttcctcataaaacaaagagacaaattctaatcggattgtctgaataagatttgttttgttga

SEQ ID NO: 50112 - DNA, 646 bp, Heterodera glycines
  SCN-specific regions: Sequence locations=1-294,375-491,513-593,615-646
gtttgaggcaggttaacaaagttggcattttttgtgagatcgggccgctttcatgcttcatttcaaggcattgtattccaccagacatggaatttgagccgaacaacatcccaccttgctacaaaactgcggacgaaagcatagtgataaaacaggatgacgagattcgtttaaaattaattggaattcgagtggacgcgaatgacatttttgcaattggaactttgatggatgattatttgggtctttgttcgactgaatgaatgaatttttccacgaattcttttagttgcctaatttattaaaaaaattaacttattttaacattagttgttttttcattatatctaaacaatttttacttttttattaatcttataaccaagaatcacagaaatgggccttttcgatttgtcaatttttgacgagttccgtcgcatggatggtcgtcagattctgtatcaatttttaaatttcgccatgattgtcagttcggctctgatgatatggaaaggtcttatggttgtgacgggctctgagagtccaattgttgttgttctgtccggttccatggagcctgcgttttaccggggtcgtgacatcccaattgtgcacagagtaatcaaagtgcacgagaagaacgacg

SEQ ID NO: 50113 - DNA, 571 bp, Heterodera glycines
  SCN-specific regions: Sequence locations=1-571
cataaatgttttatcatctttcacttgagcatgaaatccaactacatcctaaatattttggccaaaatttaatggagacagtaaaacagaaactttttagtgaagtggaaggcacttgtacgggaaaatatggctttgttattgcggtgacgacaattgatactattgggcatggaatgatacaaccgggacgtggctttgttacttatcctgtgaaatataaagcaattgtgtttcggccattcaaaggacaagtgattgacgcggtagtcagtcaagttaacaaagttggcattttttgtgagatcgggccgctttcatgcttcatttcaaggcattgtattccaccagacatggaatttgagccgaacaacatcccaccttgctacaaaactgcggacgaaagcatagtgataaaacaggatgacgagattcgtttaaaattaattggaattcgagtggacgcgaatgacatttttgcaattggaactttgatggatgattatttgggtctttgttcgactgaatgaatgaatttttccacgaattcttttagttgcctaatttatta

SEQ ID NO: 50114 - DNA, 759 bp, Heterodera glycines
  misc_feature (752)..(752): n is a, c, g, or t
  misc_feature (756)..(756): n is a, c, g, or t
  SCN-specific regions: Sequence locations=1-142,164-267,289-396,418 -607,632-759
ctttatttccttttgccatttaattccactttgttctcccggttcgatattcaatattatgtttaacctgcaagaccgttgtaagggcgttgaccaggaccgcgattaccacgcgactcgcatttcaattcgggacaaattgctcagccaagagaccaaagagttggaacagaaccttcgcgatttgcccacttgcaaattgattttcccctcaacgtcggcgctgcacgaaatggagctgacggttaagccgaacgtgggcctttacaaaggcggcgctttcaaattcagcatcaccgtcccaccggagtacaacaacgtgcctccaattgtgaagtgtctgacccgcttttggcatccgaacattaacgaagacggaagcatttgcctgagtttgttaaggcaaaactcattggacggatatggttggatgcccacgcgccgcatccgtgacgtcatcctcggccttgaccaattgttcaccgatctcatagactttgacgacccgctcaatgcccaagcggcgcagcagtggcaaaccaacaaagatggatttgcccaaaaagtcaaggaatacatgaccaaatactgcccaagaaactgacaaaaagacggagaaagggaaaagacgggcgataaattggcaaggattctttaatgatggacggatttgactaaagtttgttttgatcggacattatttcaactcgtttacatttgatcgttgttataaattttctattctttaaaanaaanaaa

SEQ ID NO: 50115 - DNA, 757 bp, Heterodera glycines
  SCN-specific regions: Sequence locations=1-757
aatctctgtaatctttttttggtgttaatgatgtcgtcaaatgaacaagaagaatccggcggttcaaatgatgaccaattttcctctccgatcagtccggttagccccattcaaccgatgagcaccgattggagcaacgcaattgacgcgcaggaaattggcgccggaggtgttggaggagggatcagcagcggaagcctgcatgagagcctgcacgaactttcgccaatttgggccgacagcgatttgattggtgacacactttcggccgtaccggactcgcccagcgatgaagacccatatgccagcacaatttatcgcccagtttccatggtcacgcctgtcgctgcactgccgaatcccaatccaccgtcctgctcatttggtggaccgatggaaagcattgaggcgaaagggccgttggaattgcccaccaaaacgcggcttaaggtgcgtatcaaacggttggacattgtcggctcgtggcgttgggtggacggcaaagaggacgcgtgcggcatttgccgtactccgttcgagacctgttgcatggactgcaaattcccgggcgacgaatgtccattggtgttgggccagtgcaaacatccgttccacatgcattgcattgtgaagtggacgaacacgcaaagcgggcagaagcccgcctgtccgctgtgccgtcaggagtggaaatttgcgaccagctgattttttgcggggaaggcgaagaagactaataatgacttaatgtttttgt

SEQ ID NO: 50116 - DNA, 514 bp, Heterodera glycines
  SCN-specific regions: Sequence locations=1-514
aatggccgtttttgttaaagaccaaaattttgtgccggaaaaacgagtcgacgaagctgggcatattttaaatgatccgagtaaaagtttggccgatcgtttccgtgcgcttttccttctcagaagcgtaaaaagcgacagggctgtccattggatttgcaaatgcttctccgacccatcggctcttcttaagcacgaacttgcgtattgtcttggtcagatgcaaaaccccgcggcgattcaaaaattaatcttcgttttgcaagacactgaacaagaaccaatggtccgtcatgaagcggccgaagcgctcggagccatcggcgacccgtcgaatgagcacggactcagcaaactgttcgagcagtacagcggtgacgcagtccgagaagtggcggagacatgccttttggcactgcgacggacgcaatgggtcaaagagaagggaaaggacgacacggaaagtcggagcatttacgattccattgaccccgcgccagcagcggacggaggg

SEQ ID NO: 50117 - DNA, 566 bp, Heterodera glycines
  SCN-specific regions: Sequence locations=1-96,121-339,363-522,544-566
caagtttgagtcaggctttttgattatttttgtgactttattcccgtcctaatgccaccaacgagtaaaaaaacaggaaaggctgtcgcaaaggctgtggaggccaagaagaagctggccaaaggccagcacattgtgcgcaagaaaaagatgcgcacgtcggtgcacttttaccggcctcggacgctgaagctggcgcgttcgccgaagtttccgcgcaaagcggtgccgaaacggaacaaactcgactccttctccatcataaaacacccattgaccaccgaatcggcgatgaagaaaattgaggacacaaacacattggtgttcatcgtggacgtgaaggccaacaaacatcagatcaaaagtgcggtcaacaagctctacaacatcgaagcacagaaggtcaacactttggtcacaccagatcacacaaagaaagcgtatgttcgcttagccgccgattatgatgctttggacgtggccaacaagattggtattatttgagtatattctgcgctttgttttgttgatttttgcgaataaattgttgctgtttttctgtaaaa

SEQ ID NO: 50118 - DNA, 625 bp, Heterodera glycines
  SCN-specific regions: Sequence locations=1-299,321-460,482-625
atcattaatgctttgcaatttccgcaacttcaattgttcgtcctcgcggcacttttcgctcgcttctgttttacttcagcagcaaaaattcgctgctgtttcttcaccgcccaataaaaattggaatgctgtgcttatcgaagcgatgcgtttgaagtcaaccagcatcgtccaggatgatgcaatcactgaacatggccatgatgaccacgggcatggacaccacgcagtcaattatgggccgccgattacctatgactacactcctataccatctcaaccttataagaaggtctataaggaactgaagcagaaattcatcacgtatttggcgatgagcttcgtctttttcatgttttgctgttacgttggctattccactgatgtgctgggacactccgcttggaaacttccgggcagctaccgtaacagaaaagcgattaacgcgcgtttggacgcggaggaagcgaaggcaaaggccggggaaggcgagcaataggaagaaagattgtcaaattgtaggctataattttgttctaattccgagatgtattgtaatagtgcgatcattaattcgttttcgaattgtatttgtttgttgaatgcaacattggacttggtaaaa

SEQ ID NO: 50119 - DNA, 454 bp, Heterodera glycines
  SCN-specific regions: Sequence locations=1-412,434-454
ctaatccttggaaaacagaagaggactttggccggcttcagctcctccgtgatccttcccaacaccggcttcatttaccaccacccaatcgtccaaactctgccgcccgaccttcgcagaaaagctgcgcgattggtcgctgcaaaatgcacattggcttcccgagtggattcaattcattcttcgttggacggacgaattggggagcgattgtcggtagaaatcaaagggaaattggaaaaaatgcaagagccaccgccggtcaaaaatgccaagcccctaccaaaaccacttgacaaagccagcaaaaaaaggggtgggaaaagagtgcggaagcagaaggaactgctaaaggcgaccgaactcagaaggaaagcgaaccgaatgaatttcggagagttgcaagaagatgtgatgcaggaccatttgggcttcactttgggacaagcgaaca

SEQ ID NO: 50120 - DNA, 592 bp, Heterodera glycines
  SCN-specific regions: Sequence locations=1-48,70-136,160-400,422 -500,528-592
gtccaattaagttaatctagaaaaagtaatggcttcacgaaaaggaaaggtcaaggaagagcagccggctgtttctctgggtcctcaggttcaagaaggcgaaaatgtctttggtgtggcgcacatttttgcgtctttcaatgacacttttgttcatgtgaccgatttgtctggacgtgaaaccattgtcaaaatcaccggtggaatgcgtgttaaggccgaccgagacgaggcaagtccgtacgctgctatgctcgccgcgcaggatgttgcggaacgttgtaagcaggttggcattaatgctcttcatgtcaaattgcgtgcaaccggtgggaccaaaaccaaaacgccggggcctggtgctcaggcagcgcctgcgtgccctcgctcgttcgggtatgaagattggtcgaattgaagatgtcacgcctattccttccgactcgactcgccaaaaaggaggccgtcgtggacgtcgtctttgagttgattcaaatgcgtcccgatttttgttgttgtttgagttctctatcgcttttcttcaaataaactttttggttgagaacaaaaaaccaccttgagactagttctc

SEQ ID NO: 50121 - DNA, 719 bp, Heterodera glycines
  SCN-specific regions: Sequence locations=1-719
ccccctagagtactctttttgaacgacggcctcgcaatttttcccttggacaggacattcaaccgaaacgggacttaactcgctttgttcgttggccaaaatacattttgctccagcgacagcgtgccgttcttgaaaagcgtctgaaaattcctccaccaatcaaccagttcaaatttgctcttgacaaaccaaataccaaccagctcttcaaattgcttaacaaataccgtcctgaaactcgccaggcgaagaaagaacgtcttcgtcaacgagctcaggatcgagcagatggaaagcaagagaaactgacgaaacgtcctcctgttgtccacttcggcattaaggatgttgtcaaagccgtggagaacaaaaaggccagcttagttgtcattgcacacgacgttgacccaatagaaattgtgatttgcctgccggcaatttgccgcaaatttggagtgccgtatgccattgtgaagggaaaagcatttctcggtcaagttgtctaccgcaagactacttctgccgtgtgtctttgcgacgttaatccggaggacagaaacgcgcttaaaaatttggctgatgttgcggtcaccaatttcaatgaacgcggtgatgaacttcggaagaattggggaggtgcgatcatgtcccagcgttcgcaagcacgacaggctaagattgaaaaggctcggcagagggatgttgggcagaaagtt

SEQ ID NO: 50122 - DNA, 1033 bp, Heterodera glycines
  SCN-specific regions: Sequence locations=1-145,167-422,459-616,646 -798,825-1033
gtccaattaagatttgtttatctttactcaacaatttgcggtttaataattaaagacgctaaaaaatggcacaacagcaagcgataacgaagaagcgtaaagctgtgcaagacggaattttcaaggccgaattaaacaactttctcatgaaggagttggccgaggacggttattccggtgtcgaagtgcgtcgtgcaccttcccgtactgaagtgatcatcatggcgacgcgcacccaaagtgtgctcggcgagcgcggcaagcgcatccgcgaactgaccgcactcgtgcagaagcggtttggctattccgctggacaaattgagctctatgccgagaaagtgtccagccgtgggctttgcgcggtggcccaatgcgagtcatagcgttacaaattggtcggtgggctcgccgtgcgtcgtgcgtgctacggtgtgctgcgcttcatcatggaaagtaatgcccgtgggtgcgaaattgtggtcagcggcaagttgcgcggtcagcgtgccaaggcgatgaagtttgtggacggagtgatgatccattcgggtaacccggtcaccgagtacatccaagaggcggttcgccacgtggcaaatgcgacagggcgtttttgggcatcaaagtgaagatcatgttgccgcacgcaccccaagggacagatgggaccgcgcaatccgttgcccgaccacatccaggtcaaagagccaccgattgacgtcgcgccgaccacgccgtactcggagcaccgcgaaccgatgaccactggcatgccgccccagacacaaatgccgcccgcccatcagcagcagcagctgccgatggttggccaagtgccgcccccggcacagttttaattgtgaggaagaaccgctgctgatggtcctgatggatgagtgggagatgttcaattaaaatttgttatttgtgtgtcatcggcacagaccacccatttttgttccgttaaaaattctttgttgttgtttttgttttcaatgatttttgttattgctgatgaagcatcgtattg

SEQ ID NO: 50123 - DNA, 504 bp, Heterodera glycines
  misc_feature (490)..(490): n is a, c, g, or t
  SCN-specific regions: Sequence locations=1-136,158-504
attcagacggtgccccctttctttaccgtaaagcgacttcgagaaacgatgtctcgtttcgatgggcttggccgtgtttatcttcagtcggagaagaggggcgcacagcgaaaaaagcgctatacggagggatgggttgagtttaaaaacaaaaaggtggccaaggaagtggtgagacttatgaacggccgagtggtgggcggaagacggcggagtgcggcgtacgacagcgtttggacgatgaaatatttgcacggtttcaaatgggaacatttgatggaacagctcaactacgaacagcgcattgagcagcagagactacgcacggaaattgtacaggaaaaacgcaaggccgatttttttgcgcaacaggtagagaagggcgaaagtttaaaaaaattggaggaaaaaatactgaaaaagtgcggactttgggagcagtaccaacgccagcacaaacagctgaaaaattgtgggaggggaggagcanaaattggaggagga

SEQ ID NO: 50124 - DNA, 483 bp, Heterodera glycines
  SCN-specific regions: Sequence locations=1-483
ggcttttccaaactcaatgataaaacctgtgaatacattaaagagtttaatgaggacaatgactgattgtcgctggatggcgtcggtgccaatggcatttgagcagaaagtgtcgatggcacaaccacaacaatccatggcatatctcccggacatcgaaactctgaggaagggaaaagtcagtccgacgattctcaaaccttacattgacccggctctgtgctcttccgacccaaattcctttgagagtgaagtgaccgtcggaagaatgctcgacgcgcgtgtccatttgggccataaggttggcactctcaacgataatatgaaatgggcattgtatggagaacgtcttggcatttgcgtctttgacttggaaatcactcggcattatctgctaaaggcgttggaatttgtccgatctgtggctttttttgggcggtcgctttctcttcgtctcgaccaataagtcctcaatgctaatgg

SEQ ID NO: 50125 - DNA, 682 bp, Heterodera glycines
  SCN-specific regions: Sequence locations=1-114,138-235,259-316,349-661
gtttgagaaaatcatattaaactaaaaatgggacgtcgtcccgctcgttgctatcgctacattaagaacaagccttatcccaagtctcgcttttgtcgcggtgtccctgacccgaagattcgcatttttgacttgggtaggaaacgcgcaactgttgacgagtttccatgctgtgtgcacatgatatcgaatgaaagggaacatttgtcgtctgaggctctcgaagctgctcgcaatttgtgcgaacaaatacatggtgaagaattgcgggaaggacggctttcacatgcgcgtccgaatccacccgttccatgtgattcgcatcaacaaaatgttgtcctgcgctggtgctgaccgtcttcagacgggaatgcgcggcgcctttgggaaaccccaagggttggtggcgcgtgtcggcatcggtgatatgctgatgtcggttcgtgtccgtgaccagcatcaagcccacgctcttgaagcattccgtcgagcaaagttcaaattccccggccgtcaatacatcgtcatttcgcgcaaatgggggcttcaccccttttgaccgcgaagtttacgagaagcaccgccaaggaagggcgagtcattccggacggagtcaactgccgattcctcaagcaacacggaccattgacggaatggctcaaaaatccaatctgatcaattg

SEQ ID NO: 50126 - DNA, 543 bp, Heterodera glycines
  SCN-specific regions: Sequence locations=1-169,204-308,348-543
gctctttgatataagcgttgctattgaattgcgatttctatcgtctcttttaattgttttacgccacaacaaacgacaaaaacaacatggcttttccttataaggatgacaaaccgcaagaggcagcgcccgttgaggaccgaattcgcattaccctaacatcacagaacgtgaaatcgctcgaaaaagtctgtgagcagcttattcgcggcgcaaaggacgagaatttggtggtcaaaggcccagtgagaatgcccacaaaaattctgcgcattaccacacgcaaaacgccgtgcggagaggggtcgaagacttgggaccgtttccagatgcgcatccacaaacgcatcatcaatctgaacagctccagcgacgtgctgaagaaaatcacgggcatttccattgagccgggcgtggacgtggaggtgacaattgcggagtcgcccagcaattaaacagcgcgtgccgaggggcggacggagagatttcccttttttgtcgttgcgttcgttcgttctattgttgctttatgccacaaaattg

SEQ ID NO: 50127 - DNA, 772 bp, Heterodera glycines
  SCN-specific regions: Sequence locations=1-71,113-116,149-155,178 -272,302-310,332-344,416-614,638-661,747-772
attgctttctttcaatcaaatctctcaaaatgtctgaacaatccggggaaacctttgcgtttcaagcggagattgcgcagttgatgtccctgatcatcaacaccttctactcgaacaaggaaatcttcctccgtgagctgatctccaactcctctgacgctcttgacaagatccgttaccaggcgctgaccgacccgtctcagatggagagtgggaaagagctcttcatcaaaatcgtgccgaacaaagccgataagacattgaccatcatcgacactggcattggcatgaccaaagcggacctcgtcaacaaccttggcaccattgccaaatccgggacaaaagcgttcatggaggctcttcaggctggtgcagatatttcgatgattggccagttcggtgttggattttattcggctttccttgtggccgaccgtgtcacggtcacatcaaagcacaatgacgacgattgctaccaatgggagagctcagctggtggctcgttcatcattcgcaattgtgccgatcctgaagtcacccgcgggacaaagatcgtcctccacctgaaggaagaccaaacggattatttggaggaacgtcgtgtgcgcgaagttgtgaagaaacactcgcagttcatcggttacccgatcaaattgttggtggaaaaggagcgtgacaaggaaatttcggatgatgaggcagaggaggagaagaaggaagatgaagcaaaggaggaggagaagaagccagaagatgacgtgtcagatgacga

SEQ ID NO: 50128 - DNA, 618 bp, Heterodera glycines
  SCN-specific regions: Sequence locations=1-149,171-523,545-584,606-618
tgagttgggacgacctcttttcatgaatgctgaattgcatgtccttccataaatagtcattaattaacgcaaaaattaacgacagcagcaaatctctgttataataagcgttttgagtgcaaaatggccggtatcgcagcaggaagactgacggaggagcggaaagcctggcgcaaagaccacccattcggtttcatcgcacgacagtgcaaaaaggaggacggcacattggacctgtacaattggatctgtgccattcccgggcccaagtcgaccatttgggagggtggcctgtacaaattgcgcatgatcttcaaggacgacttcccatccactccgccaaaatgccgctttgagccgcctctcttccatccaaatgtttatccgtccgggacggtctgcttgagtctgttagacgagaacaaagactggaaaccgtccatcaccgtgaagcagttgctgctcggtatccaggaactgctggtgtcgcccaacccggaggacccggcacaggcggaggcgtaccaaatttatgtgcaaaatcggcccgagtatgagcgtcgagtgcgcaaacaggcccaacagttctcagaggaccaggtgctgaagcagttgttg

SEQ ID NO: 50129 - DNA, 755 bp, Heterodera glycines
  SCN-specific regions: Sequence locations=1-27,51-755
caataaaggtgccaaatcttatatttttaaattattcacattctttcctccaaaattcgttctttcatgtcccttttgagctttgagggtcgcgttgccctcgtgaccggcgcaggcggaggaattgggcgtacttatgcacttgaatttgcacgcagaggtgccaaagtgatagtgaatgacttgggaggggaccgccacggaaaatccgcgtcgacttcggcagcagacaaagtcgtagcctaaatcctagcggcaggaggaaaagcggtgccaaactatgacagtgttgaaaatggagacaaaattgtgaggactgccatcgataattttggtcgaattgatatcgtgataaacaatgctggcattttgcgggatgtcagttttggcaaaatgtctgagttcgattgggattcggtaatgaaagtccacgtgaagggtgccttttcggtgactaaagcggcgtgggaacacatgcgggcgcaaaagtacggacgtttggtgtttacttcgtccaattcgggcatttatggaagtttcggccaggcgaattatgcagcagcgaaaatggcactgattggtctatccaacactttggcgttggaaggagcaaagtacaacatcgccagcaatgttttggtgccaactgctggttcgcgaatgactcaaacagtgatgcctgaagaattgctgacggcgatgaagccagaatttgttactccgcttactggttgcctggcacatgaaagttgcaa

SEQ ID NO: 50130 - DNA, 543 bp, Heterodera glycines
  SCN-specific regions: Sequence locations=1-81,151-192,239-311,338-543
gtttgagtgaatacgtaactgaagatgcaaattttcgtcaaaactttgaccggaaaaacagttactttggaagtcgaggcgagtgacactatcgaaaatgtcaaagccaaaatccaggacaaagaaggaatccctccggaccagcaacgtttgatttttgccgggaaacaattggaggatggacgcactttggctgattacaacattcagaaagagtccactcttcacttggttcttcgccttcgtggtggaaaggtccacggatcattggcgcgtgcagggaaagttcgtgctcaaacacctaaagtggagaaacaggagaaaaagaagaagaagcgtggccgtgccttccgtcgcattcagtacaaacgtcgttacgtcaacgtcgctgcagcgggaccgggccgccgtcgtgggccaaactcgaatgctgcataaatttctggatatgcaaaatgatacggatgctaaacaatgttgcgtcttttgatatgttgttgttttttttatgaattgaaaaaagtaaattgttgaaagctaaca

SEQ ID NO: 50131 - DNA, 857 bp, Heterodera glycines
  SCN-specific regions: Sequence locations=31-519,541-682,706-857
aaataaaacaattaattttaattaaaaaatggtccaacaatacaaattgtattattttgacctgcgtggtttgggtgaacccatccgccttttgcttcactatgttggccaaccatttgaggacatccggtttaaagacatggaagaatgggagaaaacgtacaaacccaaatttttctacggaaaggccccagttttggaggttgacggaaagccattggcacaaagttcggcaattttgcgctaccttgccgaaaaatttgacttggccggcaaagatgaatgggaaaaggcgaaggctaacgaaatcattgactttctgaaggatgctaccactgatttgctcccgtatttgatggtcaaaatgggacgccaagaaggcgatttggacaaattgcgtggcgaagtgttcgagccgggagtcaagcgcatttttccactttttgagaaacttttgaaggagtccgggtcagggtacatgctcaagtccggcctctcaatggtggactttcaagtggccaactttctgtacagctttaccatgttggagccggacaccatcaatgcgtacccggagctgatcaaatacgttgaccgtgtccatgcgctgccccaactgcagcagtatttgaagcagcgcccgcaggaccgctgatcagtgatcagaaaagtcgagattgaatgagaaaagaaaatcaatcataattaccgattttttaatgagaaaaatcaataattgagaataattatccgatcagctttttgatgagacaaaatgcttattttgattgttgcttcttactgtttatcaacatttagtttgaccattattttatgataaaaatcagtttgaacta

SEQ ID NO: 50132 - DNA, 734 bp, Heterodera glycines
  SCN-specific regions: Sequence locations=1-41,64-321,343-686,708-734
gaggaaattactataagtaataattgtcctaaaaaatggtccaatacaaattatattattttgatgggcgcggtttgggtgaatccatccgtctgttgcttcactatgttggccaaccgtttgaggacatccgaattaaagacatggaagaatgggagaaaacgtacaagccgaaatttttttacggaaaggtcccagttttggaggttgacgggaagccattgggacaaagtgctacgattttgcgctaccttgccgaaaaatttggcttggctggcaaagatgaatgcgaaaaggcgaaggctaacgaaatcatcgactttcaaaaggatgctaacactgatttggccccctatttatacgtcaaaatgggattccgccaaggcgatttggacaaattgcgtgccgaagtgttcgagccgggagtcaagcacattttgccactgtttgagaaacttttgaaggagtccgggtcagggtacatgctcaagtccggactctcaatggtggactttcaagtggccaactttctgtacacgtttaccaagttggagccggagactatcaatgcgttcccggagctgatcaaatacgttgaccgtgtccatgcgctgccccaactgcagcagtatttgaagcagcgtccgcaggaccgctgatcagtgatcagaaaagtcgagattgaatgagaaaagaaaatcaatcattgagattaattcgataagttatgataa

SEQ ID NO: 50133 - DNA, 980 bp, Heterodera glycines
  SCN-specific regions: Sequence locations=1-639,663-980
tccaattaagctactattagatgagcctatgagcaaccaatcgaatagcaatagccaatcgaaacaacagcaaaggagcgaacattttatgtccagtgtttttgaggagtgcgacgccctaaaacaggaatacgacaagtgctttttgaatttcttcaaaacttttgtaaaggaagacgaacgacacgaaaggacagtcaatccgtgccaacaattgcaaaacatttatcacaagtgtttggaaaagaatttaaagacacataagccatacgacatcgatttggacgagttgaagaaggaagtgtccatcagcatcgaggagaacatcgactggaaacaacgcgggaattgatggaggaaattgtgcaaagtgcggcgaacggcggcataagttcgacagcgccggaccaatccagcgaaagtcgtttcaaccaattggaacggaatttggagctgttccaggaaaatgcgcgtcatatgggagtgatcgccagtgacttcacttccaaaagtcaggagccgttgaatcagaaaattcacactctcatctcgggccttcaggttcttgaccaactcaaaagccaattcaccgatgttcgtgttcccattgaattgttggactatttggaccgtggtcaaaaccctcagctgtacaccaaagaattgttggaacgcacgcgacagaggaacaaagaactgaacgggaagacggagatgtacaggaagttccaggcgtgtcttctgcaggaactccaccgcgaaatgccttcggacgtggaggaatacgtgtgcattcgaaaaccgagcggaatgaatggggcggcagcggggaacgcaatggcaaattcggcgatggcagcggaggaaacacagcacgcgatggagtgacggactgcgtgcaaatgacggggtgggaacttttccggacaaatttgttcatttttctttttgcattgtcatccaatcgttccccatttcag

SEQ ID NO: 50134 - DNA, 1074 bp, Heterodera glycines
  SCN-specific regions: Sequence locations=1-884,906-1001,1025-1074
ctgaagtatttttttgttataatgatcaacaaccacgtcaatggggcgaatgacgtcgacatggaaaggaccgaaaacgaaagttttggtgaacttaaccagcgactgattgcgcttaaagcggagaagaacaacaaagagagtgccactttggcggtcaaagtgttggccttttttgtcaactgcgacaacctcagtgctgcccaggattttgtggaggcgttgaagaatttgcccgagtcggcctcaaacagcgattgggcccggtggttttattatttgggacgcatcgaagcgttgaagggcaccgacgccgagacgtacaaagcggcagagaaacattttgaggtcgcacttcgaaaggccccacaaaacggcgccgtcggcttcaaacaggaagtgaacaaatgggtcgtgctggtcaaattgctcatcggcgaaatccccgagcgcagtctcttccgcacggccgaacttcgccacgtgttggcgccgtatttgctgctgacccaaactgtacgccttggcgacgtggccggctttgaccagacgaagcgcgagcacgggcccatctttgtgaaggaccgcaccgctgcgcttgtcgagcgcatccatcagagcgtcattcggaccgcaattcgcaaaatttcgacgacatattcgcgcatttacgtgtccgacgtggccaccaaattgaattttaccgagcaggaggcgcatcgcgagttggtcaaggcgatcaaagagggcattgttcgtgctcagttggtcgccggcgacccgttggcgggcgggcggcactacgtcaaatttgggaccaccgatgaccaataccgcgggattgagccccgcagggagttcgacgcgcgggtcaacgaactgttggagctgtaccaccaggcggtgaaggcactgcggtacccggacatgcgcaacccggaggtggagaccattgacgagcagcgcaggcgtgaacagttggctctcgaaatggcagcagcggaagaggaggatgatgacgatttttgaccaaaatgatgtttttgtttcacaaaaattttttatatgctgcga

SEQ ID NO: 50135 - DNA, 334 bp, Heterodera glycines
  SCN-specific regions: Sequence locations=1-26,48-143,180-297,319-334
atggaaaaaagggtcacagaatctttggtgtttcacgacgaagtggaaattgaagactttgaatttgacgatgagtttcagctgtatcacttcccatgtccgtgtggcgacagattcgaaattacgcgagagcaactcgagtcaggagaagatgtggcgacgtgtccgagctgctcgctaatgttgcgcgttatctacgacatggaacagttcgtcaaattggagacactgcgcttggaaccgacaaacgctgttgaagcggtcaaatgaatggaagttaatttattaacaaaaaccatatatttattatttaattaagtcatttatcattgat

SEQ ID NO: 50136 - DNA, 475 bp, Heterodera glycines
  SCN-specific regions: Sequence locations=1-475
gtcaaatttcgtcaacatgggtatcgacatcaagaaccaccacgtcaagaagacgcagcgccgcgaggccgcttcccgcaacccttacttgttgctcctcgtcaagctctacaagttccttgcccgccgtaccgatgccggcttcaacaaggtcgtgctgcagcgtcttgtcaagtccaagatctacaagccgcccgtgtccttgtccaagctctccgtatccatgaagggccgcgaggacaagattgccgttgttgttggtcccatcaccgacgacaaccggttccacgaggtgcccaagttgaccgtggctgccctccgcttcaccgagtctgcccgtgcccgcattgtcaaggccggcggtgagtgcctcacgctcgaccagctcgccctccgtgccccgactggcgccaacaccgtgctcctccgcggctcgcgccagcgcgttgccctcaagcacttcggcaaggccccc

SEQ ID NO: 50137 - DNA, 568 bp, Heterodera glycines
  SCN-specific regions: Sequence locations=1-259,288-444,466-568
gtgactctctttttcgtttctctccgttttcccatgtttacccctggcgacgatttctgcgccgcctgcggttccatcatgcaaactccgaatgaattgaccgccggctccggtgtcaccaatttcatcaaatgctccgtctgcgatgcaaaatggccctataaaattgtccacggccaattgcttagtcggcacgaaaggaatttcgagcagcgaaacgccgtgggggaagagcggcaaaaacagcagagaaaagagacggcgagggaagaggaggaggaggacgtaacggtggaacacgtgtgcccaaagtgcgagtggaccacggcgacttacaccacacaacagacgcggtcagcagacgagggacagacagtgttctaccaatgtgtgcgatgcaaacaccggagcatcgaatattcatagagagagggcgaagataagagaagagagaccaagaaagggcagacggatggacggacaaattgccacgcttttgagtctgtcgtctacgacaatcgcacaattttctttgactttttattggcaaaaaagttgttgagttgct

SEQ ID NO: 50138 - DNA, 484 bp, Heterodera glycines
  SCN-specific regions: Sequence locations=1-484
ccgccacaatgatgttgctgcccacaaaaatcattaccaaactttgggagtgtctcgtgatgcgagcgcaaaggatatcaaaaggcattttttgagctgaccaaaaaacaccatcctgacatgaaccctacggataaaacgaaagcagccgaggcgtttcaaaatataactgatgcatacgaagtgcttggttccgaagagaaaagacaaatttacgatacgctcactgctccgaaaccgcaagcccatttcggcagaacgccaaatttcagacggactcgttccaaccatataaacatgggacctgcaggagggcataaagattggaccgatttggacatcgatttcagagatttcgagcacttccaacgagaaaaccggagacggcagacgttcaaagactgggcccgggcgaatacaaaatccgaattttactggtcatctcaccaatcttcgaaatcatataaaagcccgctagcgttgg

SEQ ID NO: 50139 - DNA, 674 bp, Heterodera glycines
  SCN-specific regions: Sequence locations=1-593,615-674
gtttgagttattttactgccatgcacaacatactcaaaaggttctttgcgcatgtttcgccttcgcttttaaagaagcccctcaacgacccatttccgattgctgcgtggcgctcgcacccggccaacatggccaaaggtgtgaagttcgatcacgacaacgcgttcgtgcgattctgccgctactatctatggcattactgttggagtgggcgtcagtacggtcttcaattctacgaccaggcattcgaaccgcatcccgtagtccaagaggcactgcgccggctccgtcttaaggacccctaccagtacgaccttcgtctgcagcgtattcttttggccagtcaattgggctcaaagaatgagcgactgccgaagaacatgtggacaaaatgggacgacgagacattctatctgaacccgtattttaacgaaattgaggaggaaaagctggagcgtgaagccagcacgggcatgaagccgggataccaactcaaagagcagatttaggggacagacattgtgttgtgaacgattaggcgcggaggaaaagcacattgcgtttgttgatactgttgccggagagaaattgatttgatgagtgattgttcacaacttttaggacgacatgtgttatgttcatttaacgtgaagtaataaaaccattttcttttc

SEQ ID NO: 50140 - DNA, 701 bp, Heterodera glycines
  SCN-specific regions: Sequence locations=1-150,172-191,213-616,638-701
ccaagtttgaggtattattaaaataaaattccataatggacgtggcaacggttgtcgatgagtacattgattcatcggatttagagcgttttcgaaagacatacgaagaacagagtcgacgcggatttccaagtgccatggccgtatttaattatgcgcacgctttaataaaatcgacgaaagacgatgtgagcactggcatttttcttcttgagagtttattgaaacgatcggaagaagacattcctaaacgcgactacgtttattatttggccatcgctcacacgcgaatcaaagagtacgaccgtgcgctcgaatacatcaatttgcttctttctgcagaatcggataaccaccaagcattggacctgaaggaattgatcgaaaagaggatgaaacgggatggattgctcggcttggcactgaccgttggctttggcggtgctgcggtcgttggcgttctcggggcggcgctgttggctcggaaaaaatgagtggtgaaaaatgtgatgcccctaatttttaacttatactgatgagttgactgtatttatccgcatcgattgggtatctttgacactgataaaaatcgcttttccgttacactcattacccttacaaaaaattatttttaatttcgcgctcactaaatattcaccacttttgagcaaacttttgtattgagcgatcactgtgaactg

SEQ ID NO: 50141 - DNA, 572 bp, Heterodera glycines
  SCN-specific regions: Sequence locations=1-572
caagtttgagaaatcagctctaataatcttttcacgtcgtcatgggtcgcatgcacaacccgggaaaaggcatttcgcgctcggcgttgccttaccgtcgctctgtgcccacctggcagaagctgaccaaccaagaggtggaggagcaaattgtgaagttggcccgcaaagggttgcgtccgtctcaaattggcgtgattttgcgtgattctcatggcgttgcgcaagttcgtcgtataaccggcaacaaaattgtgcgcattcttcgatcaaaggggatggcaccagaaattccggaggatctttaccatctgatcaagaaggcggttagcatccgcaaggcatttggagcgtttccgcaaggacattgactcaaagtaccgtctaattttggtggagagtcgaatccaccgtctcggcccgttacttcaaaaccaaacggatgctcccgcccacttggaagtacgaatcggcgaccgcctccgcactcgtctcttaatttggcgatgaaggctgctgctaacgcacatttttatttgttgatgattgaattaaactgttgatcttttgtt

SEQ ID NO: 50142 - DNA, 1328 bp, Heterodera glycines
  SCN-specific regions: Sequence locations=1-655,678-701,723-1328
aggtaatatttatttgcttacagcaatttaaaaaaatggctgcatttttgaatggcaatgctcacagcagcattgaatgcaatggtgtcgtccatgacaaaaatggcattgatcagaatggcaccaaattggctgatcgcttacaacattcggtgcaaattgggaccaaaaaagcgccggtgtcaaaggggagcatcaatgtcaacaaatatgtgctggaagtgatcagtgacactgatcagctgcacacattggaacaatatgccattgactacgctcattcaattggtttggtggccccactttcggacccgccggagggaaaattcaccaacatttatgccgttccgcctccaatcgcattgcttccatccccgttcccgcgcgaactgtacgaccacgcagtgaacgtgcaacaagcgatgaacgagctgtactttcgtgttgcatcggaccatgactttttgatggatgcatttaaggacgtggtcaaaggcgacccatttatggcacgccttgtgcaaatcgcccaagtggtccacgacgagggcattcatcagccattggctgttcaactccaacgttcggattatatggcacattgggacccgtcagatgggagcatggcactcaaacaggttgaagtgaacatcggaccaattgggggccctggctttgcctttggggtttccaaattgcatcaaaaaatgctggacaaacttgcgattgcgcatgatggaaagccagcaattttggccaattcggaagcgcccctgaaccgctctcgccaaaacattgcctacacactttatcagtcatggaaattgttcggtgacccaaaagctgtgcttctttttttggacacgccgaacatcacgcattttgagcagttgcaattcattcagtttgaagtggaaaagttaggcaaacaacaaggcaattttgtgaaggtgttggtgctttcgctgaccgaagcatcgaaaagaatttcgcttgacgaaagcggcgacttttcattgtatttggacggcacaaaacgtgtggcattggtgcacattgctgacggcaatgtgccgcatgagtacccaacggagcacgaatggacggcacggacaacgatcgagcgatcaaatgccattttgtcgccaaacattcgcttccacctgagcagcaccaagaaaattcagcaggtgttggccaagcctggcatggtggaacgcttctttcccaacgatccgaaacgtgtggcactgatccgcagcacattcaccggactgtggggccttgaggttgaagacgaggcgacccgagaagtgattgaggatgct

SEQ ID NO: 50143 - DNA, 576 bp, Heterodera glycines
  SCN-specific regions: Sequence locations=1-576
gagtgctgaaatattgtagacattcaaatggtttactacaacaacgcctccagctacattcagtggcaagtcattcgcaaaaacagcgccttcctcaaacgtcagcgtggcatcccgaaacacttcagcaccgagccgttcaacatggcgcgtctgaacagcattcgacacaacggaatgatcaacaaaaaggcggtggacatttctgctgcgaaggacggcaaaggagtggttatgagtgtaaagaagcacaaaaatgtggcgaaaccattgcaggcagttgccagcacagcgttgacaagagacagtcgccgggtgatctccgccgtcggaaatgcggtgaccgcctacaaaccgtcgcacgcgaagctggcgcagcgacgcgcctcgcaaatcctccgctcgcaaaaaaccaaggccaaaccagcgacagtgcgcaaaggaaaggccgaatgaacgaggggattttgtggctgaaagacctttaaatgatcgaaaaatgttgttgtttttgttgaaattaattggaaaagaaccattcccgtgaaataccaatgtttagctcggaaagaaccg

SEQ ID NO: 50144 - DNA, 536 bp, Heterodera glycines
  SCN-specific regions: Sequence locations=1-95,165-205,266-361,390-513
gttttgctttgcttcctgaagagaatacgcaactgaagatgcaaattttcgtcaaaaccttgaccggaaagaccattactttggaagtcgaggcgagtgacacaattgaaaatgtcaaagccaaaatccaggacaaggaaggaattcctccggaccagcaacgtttgattttcgctgggaaacaattggaggatggacgcactttggccgattacaacattcagaaagagtcgacgctccatttggtgctccgtctgcgcggagggatcattgagccgtcgttgcgcatgttggcacaaaagtacaactgcgacaagcagatctgtcgcaaatgttacgctcgtctgccgccccgtgccaccaattgccgcaagaagaagtgcggacactccaacgacttgcgcatcaagaagaagctgaagtagaggaccaaatgtttgctggacgaatgggattattgttgatcgaattatttgattttgtttgatgtcgtgagaagacaattttatgttgaaaaaaaaaaaaaaaaaaaaaaa

SEQ ID NO: 50145 - DNA, 548 bp, Heterodera glycines
  SCN-specific regions: Sequence locations=1-159,181-320,343-429,452-525
gtttgaggtaacttatggcgcaaaatactgcacaaattgaagagttcgttcgtttggtgctcagttcatggccttcatatcaatttgcgattaaaaatcagttggcgggatcattaacaagtgccaaggatgcatggtttgtcgaagagctcagtgcgcatttgctgaagcacaaggacatttgtccgtttgcgctgtccgattggatggaggacattttggacacggagttcagcctgatttcggacgatggcactttggagcccaccgccaaattgttggttgagttggccgatttgactgtcggaaggggcgcacacaaaggggcggaggcggcagcaaaactcgaggagcatttgcaaagactgcgaacactttccgctaaatcttgcacaaattcaacaacgccccgtttggacagttcttcaagtgaaagtgaagaaaacaatggaagcgatgaagagaacgattggcagtagattgttgatgagacgactgctttttaatcattgttgttttttttgtaattaaatttgttaattcaaaaa

SEQ ID NO: 50146 - DNA, 669 bp, Heterodera glycines
  SCN-specific regions: Sequence locations=1-191,216-669
gtttgagactaaccatcctttcattgactctgtctttttcatcttaatacgaaatggactctcccgctggtgctcagccgtcgaacccaaacgctcaacaacaaggtggagcccgaccatcgaacaaacgactccagcaaacgcaggcacaagtggatgaagttgtcggcataatgaaggtgaacgttgagaaagtgttggagcgtgaccagaagctgtcccaattggatgatcgtgctgatgctcttcaagaaggtgcgtcgcaattcgagaaatctgccgcgacgctgaagcgcaaatattggtggaagaacataaagatgatcgtgatcatgtgcgcaattgtcatcctgctgatcatcatcatcgtcatttgggctggaaaatgaacgacgtgtgctgcggtcggatgctcgagaatttccaagtcttcgtgaattgaaaagatccatttacaaacaaaacccgcgaatctaatttgaccagagttcttgaccaacaattcctaagtctgtttctcatctcctgtttgtgtaccacccaaaaatccgagtacatacgacacttacttcggtcccttcccacattcctaattttcaaaactgtagagtacgcttggaatgcgatggattgacacattttatgtgatgtggataaactgaatatgtg

SEQ ID NO: 50147 - DNA, 310 bp, Heterodera glycines
  SCN-specific regions: Sequence locations=1-256,278-310
gtccaattaagattgtgaaagaatggctgcgcacaaaacatttatcatcaaacgaaagttggccaaggctgccaaacaaaatcgtccgcttccccactgggctcgaatgaagacgggcaatcgcattcgctacaacgcaaagcgtcgtcactggcgccgaaccaaactgaagttgtgagcgatggaccccgagaaaacatcggaagacgccggacgggcgttgattttcgacttttttgtttgttcatggagttaattttcatacatttttgtgtggactattgttggtaaaattgttgaatttgaaaag

SEQ ID NO: 50148 - DNA, 540 bp, Heterodera glycines
  SCN-specific regions: Sequence locations=1-12,35-379,401-461,483-540
gtccaattaagatttttctcaatttttatttttggaattccaagagccaacggtcagtaagcgcgatgaagcttgtccgctttttgatgaaattgtcccatgagtctgtgaccatcgagctgaagaacggcacacaagtgagcggtgctattcagggcgtcgacgtggccatgaacattcatttgcgctcggtaaaaatgacagtgcgtggacgagagcaaatcagtttggacacactctccatcagaggaaacaacattcgctatattgttcttccggattctttgccattggacactttgctcatcgatgacgagccgcgcaagaagcccactcaacgccgatttggtggccgtggaggacgcggtgggccgcgcggacgtggacgaggccgcggagggcctccacgcggcggcggcgggggacgacgctgatgatggaccacaatgggagaagggatcagtgtctattgttgttgttcatttcaaaccactggctgaacatctcatttatttttctgatataaaatggggttactcg

SEQ ID NO: 50149 - DNA, 860 bp, Heterodera glycines
  SCN-specific regions: Sequence locations=1-214,279-437,460-521,544 -597,621-752,781-860
gcaaaaataacgatttaatattttcacagtgaccagaaactttaatttggtgtgcttccaaatgtcatattcctatttgttcaaatacatcattatcggggacacaggggtcggcaagtcatgtttgttgctgcagtttacggacaagagatttcagccagttcacgacctgaccattggcgttgagtttggagcacggatgatcacaattgacggaaaacaaatcaaattgcaaatttgggacactgcaggccaggaatcctttcgctccatcacccgttcctattaccggggcgcggctggcgctttgctcgtttacgacatcactcgacgcgacacgttcaaccatttgacctcgtggctggaagacgctcgtcaacactccaattccaacatggtgataatgctgattggcaacaaaagtgatctcgaagcgaggcgtgaggtcaaaaaggaggagggggagcagttcgctcgcgagaatggacttgtctttatggaaacgtcggcgaaaacggctgccaatgtggaggaggcattcattgatacggccaaggaaatttacaggaagatcccaggagggcgtgtttgacattaacaatgaggcaaacggcatcaaactcggtcctcaacacccgcccagttcgccaagctctcccggtggtgcgccgttaggacgtgcgagcaactgttgctgaatttgaccaacggaatgcgaaagtgaaaaaagaccgcaccgtcagaaactcacgccctcccccccccccttcccctccctctgtggataaatcaaagatttctcacaaatctgtatctttgacaaatttgtcgatcaagtcagcatcataaatacctattaa

SEQ ID NO: 50150 - DNA, 639 bp, Heterodera glycines
  SCN-specific regions: Sequence locations=1-7,29-639
gtccaattaagctgtccaaaatgatgagtgccaaattttttacgcatttgattaattcggcatcggtacgacccatctccacttcatgctgcagaaaagaattgcgtgaattgtggaaattggacaaacggaacccttttcaagaaattcccgaagcatgggtcacttccctggacgatattgagcagaaaaattgtggactcattcaactccatccagacattttccgtgtcaaaccgcgcttggatttgcttcatcgaaacatcacatggcaatccaattaccggaatttgacgctcctcaaaatgttgtcccgcgccgaaatgccgggcggtggccggaagccgtggcctcagaaaaagatgggccgtcaccatgcaggaagcattcgttcaccgcatttcattcgcggcggttttgcgcacggcgttcgcggcccgtgcacccaattttacatgctgcccaacactgtccgaattcacgggctccgcaccgcgttgaccctcaaacatgcgcaggacgacttggtcattgtggacagctacgacacgctgaacagcgcggaaccacaatttttgaacgatttggccgacgcacgcaattgggggctattccgtgctgtttgttgatctcactgtc

SEQ ID NO: 50151 - DNA, 1851 bp, Heterodera glycines
  SCN-specific regions: Sequence locations=1-904,927-1141,1163-1851
ccacccgaaaaatgtcggcgtcaattccaaggcgttcttctcaggattcgctggcagaaaaagtgaaaagcaaggagctgatctacgaggccagaatgaagatccaggaacgactgaaggaactcggtttccccgtccaaaacacaacggtcaaagggccaagtggcagcgaacgtttcagagaaactgtgctcaaacccgaggaggcgagcgcattcactcagttgcacatggagaagataaagcgacttaacgaggcaaggagtcgggctgccaaaggcctttccactctgaatttaaagacaccgtcgttagtttttgacacaatttctgccgaaaagcaaatggtggcgaagcgtgagccctcggggcctatccgccaatccttggagaaggccgattcgtcgactatagaactgaaaaaatctgctgcttctccacatggccaacaaattgaacccgattccagcacaagtgccgctcagcaagaatttttggacccgcgaatttacataaaaccggccgctcgccaaaaacgacactttgaattcaaactccctggagagtatgaaaaactggccaaaatccagcggtcaaaagccaaattggagcgacttcagtctgaaattgaaaaggcggcaaaacaaacgggcatttcctctgcggtcaaattggcaattgtgacgcctagcggactgccggagacgagcactggcgaatacattccgttggtggagtggtgggacgaagtggtgctcgggaacaactgcaaagactacaacgaaatgccctcgcaggagttggccccggttgaacgttacgcggattctgtcaccgatttggtggagcatcccatccaactgaaaccaccggacgaaccattgcaaccgcaatacattaaggcttctctaaccaaaaaggagaggaaaaaattgcgacgccaaaaccgtcgcgaggcattgaaagaaagagcggagaaaattcggcttggattggaaaaaccgccggatccaaaattgaaaatcagcaatttgatgcgcgtgttaggcaccgatgcaattcaagacccaaccaaaatggaagcgaaagtacgaaagcaaatggctgaacgggcgcaaaagcacgtggaggacaacagaagcagaaaactgaccagggaagagaaggccgccaaggccatccggaagattggggaggacacaactttggcagtgcacgtcaccgtttttaagatcaaatcgttggcaaaccctgcgaagaaattcaaagtgatgatgaacgccaaacagttgcaaatgaccggtgttgtcattgtgttggaagacataaatgttgttgtgatggagggaggtcccaagcagcaaaagttcttcaaaaacttgatgctcaacagaattcgatggtctgctgaaattgccgggcaaaagcacgaccgaagggcgacgcataacagagcgaatgaaatgggagaagggacggaggatgggccagcggaagagaagaggaacgagtgcgttttgatttgggagggcgtcgtgcaaaagcgagcattcactggtgagccacgcttcactcctgtgaccaatcataagcaggcccgtgaactgctcgaaaagtacggagtgccacactactgggacctgtgttactctacgactgtccttctgaatgacgagacctgatgagagtgaacggctaaatgagactacaaattgactcaaattcattcagtttttagtgattttgagtttaatcgtgtaaatctgctgaagtgatgagatttatcggtttttatatttgagttgttcttaactgtcgacagaaaaatgtatcacagaaattggaccaaag

SEQ ID NO: 50152 - DNA, 541 bp, Heterodera glycines
  SCN-specific regions: Sequence locations=1-462,485-541
ccaagtttgagtcaccgcaatgggcgtacacaatgaattacaattggaaggatgcaattttttgagacagcacattgttttttcactactaactggtaggacaatcacaattacaaagattcggtcttacgacgacaatcctggactgaaggaatttgagcgcatttttctttccatgatcaaaagattgacgaatggaactgagctcaaacttagtaaaaacggtacggaactcagttttcggcctggtctaattcatggaggagaattggagttcgactgtggggttcaacgttgtatcagttactttttggagcctctcattctcatggcgcctttttgcaaaaaacctttgaatgtgaatctgaccggtgttacaaattccgtcgatgaactcagcatcgacgccattcgggctacttggctcccggtcttttcccgctttgttcttgccgaccaatgcacagaaataaaaatcaaagccagaggtttcaagccgagtggcggtggttcagtgactttctccagtcccatcaaaaag

SEQ ID NO: 50153 - DNA, 1326 bp, Heterodera glycines
  SCN-specific regions: Sequence locations=1-261,283-483,523-556,580 -607,629-715,755-772,795-1326
aagtttgagtatcgtttaatccacataaatcaattgcgcaaacgaagtccaaatggcagaagtcggaaactcgtacagaccgccgctaagcgaagagaaacaaaacgaactccgcgcaattgctcagaaaattcttcagccgggcaaagggattctcgctgctgacgagagcacaggttcgattggaaaacgcttcgatactattgggttggagaatacggagaacaatcgccgtcgctaccgccaacttttgttcaccacaccgagctttggacagaatcttagcggcgtcattctttttgatgagacattccgtcagtcaaccgacaacggagtccgatttgttgacgtcatcaaaaaggcgggagccgttgctggcatcaaagtggacacgggagttgtgccattggccggcactctcgatgaggggacgacccagggactcgacaaattgtcggaccgctgtgccgagtacaaaaagggcggctgtgactttgccaagtggcgttgtgtgctgaacatcggtgcccacaaaccgtcccatttggcattgatggagaatgccaatgtgctcgcccgatacgcgagcatttgtcagcagaacggacttgtgcccatcgtgggagccggaggtgctttgtgacggcgaacacagcttggaacgatgccagaaggtgactgagttgactttggcctacacctacaaagcattggccgaccaccacatttacctggagggcactctgctcaagccgaacatggtcacccccggccaatcccactcgcccaaggccacgcccgaccaaattggtctcgccaccgtgactgccctccgccgttctgttccgattgccgtccccggcattgttttcctctccggcggccaatccgagatcgaggctacgcacaatcttaacgccattaacagtgtgcccgggccgaagccgtggacgctgtccttttcctacggaagagcgctgcagtcgtcagtgatcaaaaaatggaacggcaaagacgagaatttgggcgatgcgcagaaagtgttgctgcaccgtgccaaggccaacggcgacgctcagcaggggaaatacaccggcgaggaggcagccgcgtctgccgctgaatcactttttgtggcaaagcacgcctattgaacagaagtgtggaatatgcgatgaataggcgcgaatccgagaatcactcatcatatattttagctggaggaattggcagaataatctgacaatgaacacaatgataattttgtttcatatttcattgttgtcactttccgtttggtgcacttaataattaacatatagtgat

SEQ ID NO: 50154 - DNA, 599 bp, Heterodera glycines
  SCN-specific regions: Sequence locations=1-372,394-599
tttagatattaaaatttgaaatttgccatagaatttcgatattgaaaatgctatatgtttttcttttctatgctggtgctgcgaattattgggctaagaagggcatgccgaaatcaaagattattatcggaatcccaacatatggccgtggatggacactgagcaacccgcaacaatttcgtgacatcgaagcaccggcccaagtggcaaaagcgacaaaatttgtcaaattggcgggcatcggatcatactttgagttctgcgaaatgctggcaaacggtgcgcagcgttacgtggaccgggaaacgctggtgccctttttggtggcggacaacgaccagtggttcagctacgacgacgtggagagcatcagaaacaaactcagttggattcgccaaaactctttcggcggcgctttcgtgtggactttggactttgacgatttcaacggacaatgccccggcagccaactcggccgttacccgctgatccgcacaattgcccaagaattgggcggcatccaactctcacagacacccgtctcggcactttcgaattcgccttcgccgtctacgggcgcagctttgccggctgtcaca

SEQ ID NO: 50155 - DNA, 622 bp, Heterodera glycines
  SCN-specific regions: Sequence locations=1-622
ttataatccagcaaattgaaatgccggaacagagcagcggtgccgatgagtacgaatcgttggctcccacttattcgctttgggttcatttggcggcgggcgcagcggcgggaatggctgagcattgtgtgatgttcccattggacagtgtcaaaacgcgtctccagtcgctgtgcccttgtcccgagtccacgtgtccgactcctatccatggcgttgcttcaatggtccgcagggagggattttggcggacgtttcgcggagtcaatgcggtcgctgtcggctcagtgccagcccacgccctttacttcacggtctacgaaaagttcaagtcttcactgactggcaacactcatggccattcgaattcgttttcgtacgcattggccggcatggcggcaacagtggtccacgatttggtgatgaacccggccgaggtggtcaaacagcgcatgcaaatgctgtacagtccgtacggcggttcgttggaatgtgtgcgttgcatctttcggaacgagggaatggccgctttctatcgctcttactccacccaattgtttatgaacgttccgttccaagccgtccatttcgtatgctatgaattctggcaagagcaatttaa

SEQ ID NO: 50156 - DNA, 728 bp, Heterodera glycines
  SCN-specific regions: Sequence locations=1-728
gtccaattaagatacaaaatgtccaattcttttcgaattctttccttattctgtccgctgtttctgcttctctttgttcctgagacttcacgagctctctattttcacatcgctgagactgagaaaaaatgtttcattgaggaaattccggacgagacaatggtgatggggcggtacaaagtgcaactgtacgacccgaacacgaaggcatatggggactatccaacaatcggaatgcatgtcgaagctaaggacccggaagaaaaggttattttgagcaaattgtacacgagcgaaggcatgttcacgttcacatcccattcccccggcgaacatctcatttgtctctattcaaattcgtccgcttggttcagtggcgctcaattgcgcgttcatttggacatccaagtcggagaacatgcccaggactacgagcaggtggcagccaaagacaaattgaacgaacttcaattgcgtgtgcggcaattgttggaccaagtggaacaaatcaccaaagagcagaattaccagcgctatcgcgaagagcgtttccgacagaccagcgaaagtaccaacagtcgcgtgctttggtggtccgtcggacaaacgattgtcctccttttgaccggtgcttggcaaatgcgccacttgaagggctttttcgaggccaaaaagcttgtctgaatcgatgcttttttcctggcagatatttatttgtctccgaattg

SEQ ID NO: 50157 - DNA, 621 bp, Heterodera glycines
  SCN-specific regions: Sequence locations=1-283,324-357,379-393,420 -486,516-621
cctgattacgccaaagctcgaaattaaccctcactaaagggaacaaaagctggagctccaccgcggtggcggccgctctagaactagtggatcccccgggctgcaggaattcggcacgaggactacggacgttcaaataaccccacaacgcccatcaccatgaagttctccaaggacgtgtcctcgtcgcgccgcaagtcccgcaaggcccacttcacggccccctcgcacgttcgccgtgtcatcatgtcggctcccctcgccaaggagctccgtgagaagcacaacgtccgctccatgcccatccgcaaggacgatgaggtgctcgttgtccgcggcaacttcaagtcgcagaccggcaaggttgtccaagtgtaccgcaagaagtatgtgatccacattgagcgcatcacccgcgacaaggtcaacggcacctctgtccccgttggcatccacccctccaacgtggtcatcaccaagctccacctcgacaaggaccgcaaggccctcctcgagcgcaaggctgctggcaaggctgtccaggccgagtaaattgtcttcacgcttgtgtggaactctgggactcgtgcgtgtgagttgttctcgtctatgaatgcaatt

SEQ ID NO: 50158 - DNA, 847 bp, Heterodera glycines
  SCN-specific regions: Sequence locations=1-182,204-579,603-847
aagatttgacaaataaaatgtccccttctctttccgttgccaactcaaatgtctctcgaccgcttggccaaccaaaagtagcgggcttcaaagataaggataagccggaaagtgttcgtactagcaacattgtggcagcaaaggctgttgcggatgcggtgcggacgagtcttgggcctcggggaatggacaaaatgatccaatcgggcaacggagaagtgacaattaccaacgatggggcgactattctcaaccaaatgtcggttgtgcatcccaccgcaaaaatgttggtcgagctgtccaaggcgcaggacattgaggcgggcgatggtaccaccactgttgtggtgttggccgggtctttgttggacgctgcagaaaaacttcttgccaaaggaattcatccgaccaccatttccgactcattccaacgggcggccacattttctgaaaaagttctcgaggaaatggccacacccattgacattaacgatgacgacgagttggtgaagctcgccatgacgagtttgaactcgaaggtcgtttcgcaatattcccatcttttggcaccaatggcggtgcaggcagtgaagaaactgatgagttcaccggaggactcaagtgtcaatctgaagttgattaaagtcgtgaaaaagttgggcgaaacggtggaggagtcgcagctcattgagggagcgctgatcgatcagaagtcgatgggccacggaggcccggcgcgggtggagaacgcgaacattggcctcatccaattccaaatctcaccaccaaagccctacatggaaaatcaagtggtcatctctgactatgctcaaatggaccgtgcgct

SEQ ID NO: 50159 - DNA, 659 bp, Heterodera glycines
  SCN-specific regions: Sequence locations=1-121,143-626,648-659
gctatttgcgaatttattggaaaatgactgaagctaagaagttgcccgaagtgccggagacgctgttgaagcgacgcaaaatcagagccgcacaacgggctgccaaggcgaagaacagcttgaacaccatcaaaaaagtgaaggccaaaaagacggaaatcttcaaacgggcggaacattacttggttgagtaccgccagaagcagcgccaattggtcgcgttgaaacgcgaagcgaagaaagtgggttattactacgtgccggacgagcccaaactcgcatttgttgtccggatcaagggaatcaacaagatccatccacgccctcgtaaagtgttgcagctgctccgtctgcgtcagatcaacaacggcgtgttcgtcaagttgaacaaagcgacaatccagatgttgcgcattgctgacccgtacattgcgtggggctacccgagtcagaagatcattcgccagttggtgtacaagcgcggctatgccaaggagagtggccagcgcattccgatcacggacaatgccattgttgagcgaaacatgggcaagtcggacgtgatctgtgtggaggacatgatccaccagatttggacagtcgggccccacttcaagcaagtgaccaactttttgtggcccttcaaactcagcaacccc

SEQ ID NO: 50160 - DNA, 844 bp, Heterodera glycines
  SCN-specific regions: Sequence locations=1-628,650-716,738-844
gagctttttaagaatttattgaaaaatgactgaagccaaaaaattgccggaagtgccggagacgctgctgaagcgacgcaaaatcagagccgcacaacgggctgccagggcgaagaacagcttgaacaccatcaaaaaagcgaaggccaaaaagacggaaatcttcaaacgggcggaacattacttggttgagtaccgccagaagcagcgccaattggtcgcgttgaaacgggaagcgaagaaagtgggcaattactacgtgccggacgagcccaaacttgcatttgttgtccggatcaagggcatcaacaagatccatccacgccctcgtaaagtgttacagctgcttcgtctgcgtcagatcaacaacggcgtattcgtcaagttgaacaaagcgacaatccagatgttgcgcattgctgacccgtacattgcgtggggctacccgagtcagaagatcattcgccagttggtgtacaagcgtggttatgccaaggagagtgggcagcgcattccgatcacggacaatgccattgttgagcgaaacatgggcaaatcggacgtgatctgtgtggaggacatgattcaccagatttggacagtcgggccccacttcaagcaagtgaccaactttttgtggcccttcaaactcagcaaccccgtgggcgggttcaagaagaagtccaaccattttgtggagggaggcgacctacggaaaccgcgaggaccaaatcaacaaattgcttgaaaaaatgatctaatttcggaaacaattgcgatgagttgatgtgcagcggacggcacgcttttgttgttgttattttacagataaacttttttgtta

SEQ ID NO: 50161 - DNA, 395 bp, Heterodera glycines
  SCN-specific regions: Sequence locations=1-95,117-340,362-395
tcaaaatgacgctcgcggtcgatctccttaacccctcgctcgagtccgagaagcgcaagcacaagctgaagcgcttggtacagtcgcccaactcgtacttcatggacgtcaagtgcggtgcctctggctgctctgccatcaacaccgtcttctcacacgcccagaccgttgtcttgtgctcgtcgtgctcgtcggtgctcgccacccccaccggtggtaaggctcgtttgaccgagggctcgtccttccgccccaaggctcaataagcgcagctcaacgtttacttgtaatgtgggagtcgtcgtcgagtcgacacggacgtgtgtgtttgtcgtcacggttgtcaatcttttcgtcttgcctgcccgccaaatgcaacagtcgtttcccgaacc

SEQ ID NO: 50162 - DNA, 709 bp, Heterodera glycines
  SCN-specific regions: Sequence locations=1-159,186-424,450-522,546 -547,569-644,666-709
gtttgagcagtgcctttatttattgaatccgacaaaatgtcatccagctcgaaagctttcattggtaagccggcgccaaatttcatggcggacgccgttgtgaacggcgacttcaaaacaatttcgctggaacagttcaaagggcaatatgtggtgctgttcttctacccactcgatttcactttcgtttgcccaaccgaaataattgccttttcggacaaggcgggagagttcaaaaagatcggtgtccaactcatcgcgtgttctaccgactctaaattttgccatcttgaatggatcaacaagccgcgaaagcagggaggacttggcgagatgaacatcccggtgctggcggacaccagccacaaaatcagccgtgactacggcgtgctgatggaggaggcgggcattgcttatcgcggattgttcatcatcgatgacaagggcgttcttcgtcagatcaccatcaacgatttgcctgttggtcgctcggttgacgagacgcttcgtctcgtgcaagcgttccaatacacggacaagcatgggcgaggtgtgcccggccaactggcagcccggcaccgacaccattaagccgggacccgaagggctcgcaggcgtactttgacaagaagggctgaacaattgagggggagagaagaaaggaggatgagacgtatggaattgctgatgctgactctgtgttgtgatc

SEQ ID NO: 50163 - DNA, 652 bp, Heterodera glycines
  SCN-specific regions: Sequence locations=1-86,120-143,168-191,215 -320,344-495,530-542,566-583,605-652
ttgagatttaatttattgtgcaaagctcttaaatctccgacttcaacatgggcaatatgttcgctaatctgttcaaggggcttttcggcaaaaaggaaatgcgcattttgatggttgggctggacgctgccggaaagacgacaattctgtacaagcttaaactgggcgagattgtcaccactattccgacaattggtttcaacgtggagactgtcgagtacagaaacatttcatttaccgtctgggacgttggtggacaggacaaaattcgaccgttatggaggcactatttccaaaatacgcaaggactaattttcgtcgtggacagcaacgaccgcgagcgtgtgggcgaggcgcgtgaggaactgatgcgaatgctggcggaagacgaactgcgcgacgcggtgctgttggtatttgcgaacaaacaggatttaccaaatgctatgaacgccgcagaagtgacggacagactcggactgcacactcttcggaaccgcaactggtacatccaggccacctgtgccacgtcgggcgacggactctacgaaggattggactggctgagcaatcagctcaagaacagaggatgaacagcgagcggaccatgcgaattggaagatgacggaagggaatttgtttttgcgcgcag

SEQ ID NO: 50164 - DNA, 430 bp, Heterodera glycines
  SCN-specific regions: Sequence locations=1-24,46-318,340-430
gtttgagtttacataaatagaaaattgcattttaactgttattccgaaattaaatgttcgcccatctgacaagagcagagcgttcaggctgtatttttaacaggattctcggcttgatcattgctggccatttgaaatgggaacaacggccgctttggttcgacgcttatgtcgcccattcaccgcattacgagccaaaatgggacatcaaaatgccgaagcgtgacgaaccgttgccacaaattttctaccaagaggaccttatcagagccaagaaattgctggagatgcgcaacgaagaaccgaagtatgagcttgatcagcaacaacagcagcagcctgatcagcttaattagttttccgattttgatgaatttgtgttttctattattattttttgtttattttcgtttgagattttagagaaaaa

SEQ ID NO: 50165 - DNA, 790 bp, Heterodera glycines
  SCN-specific regions: Sequence locations=1-790
ttgagcaattcgagtgctacaaatagttcgaaatggtaactgcggaagataccgttaaaacaaaggaagaagaccccaaaaaaacgacaacggacgacggatcgagttcagaggaagaagtgcccgagctcgaagagggcgacgttactgaagagcagaaaaaagttgctgaggcggccggactcagtgagcaggttgccgaaaagggctccaaacaatcgcgttctgaaaagaaggctcgtaaactattcagcaaacttggcgctcaagcaagtgcacgggcgtttcgcgcgtatgcatccgtaaatcgaagagcattttgttcgtcatcaacaagccggacgtgtacaaaagtccgggctccgacacatacgtcgtttttggcgaggcaaaaattgaagatttggcacaacacgctcaaatcactgacgtggagaatttgaaaccgccctcaatcattcgcgatgttcgcaaccgaatcacaccggcggaggaggaaagcgatggcgaagaggctgatgctactggaattgaagaaaaggatattgagttggtgatgtcgcaagcaaatgtttctcgaaacaaagctatcaaagcattgaaaaaggctgacaatgatttggtgaacgctattatggcattgacaatgtaggaggaagccagaggaattcagagaaaacattgttgaccttcgaatttttgcttcaatatttttcctacgggaatcagttcttttaccattgctgattatgttactttacgaattttgcttataaaaattaaaaagcgt

SEQ ID NO: 50166 - DNA, 549 bp, Heterodera glycines
  SCN-specific regions: Sequence locations=1-478,522-549
gtccaataagcaatactccctttttcccaaatcttacaaatgaacatgaatcaacttttggttggccgttcgctgttcccaaaaatcatccgccctttctcgcacaccaaaccccttgccaagtctgaggctgacccggatgattacggctacttcccggacccaattgaacactcatggggtttggagaggaaaatgctcatcgctcgtctgaagggtgacgaccgctatgagccgaaggtgtatttccgcgctgaacataccacccgggactatccgaatttggtgccggtccatttgcaggacaaagtcgtcgggtgcctttgcgagccggacgcggagtacgtgaactattggcatattaggaaaggccagatgaagcgatgcgagtgcggacattggtttaagggcgtgcaagccgaccctgacagtttcgcctgaatgcgatggatacgaattggctttgaagtgataggagatcatataaaatgatcagttattttaattgtatttctaagttggttggataaatgtaaagcatagttaaaa

SEQ ID NO: 50167 - DNA, 426 bp, Heterodera glycines
  SCN-specific regions: Sequence locations=1-211,234-426
ttaagtgctctttgccttccttttggcatggcttcctcctcctctgatcattcggcttattccaagcaggtcctggaggagttttggcccggccagaatgtgaagatcggccatatgacaatgaattcttttcgagaagtgaacagacattcagaattgccaattgcacgcataaagaaaataatgaaaatcgaggaaggcgtgaaaacccagatgatcagtgccgaagcgcctgtactgctcgcaaaggctgccgaactttttatcgaagaattgaccctccgcgcttggctgaacaccaacgacaaccgccgtaaaaccatccaaaagtcggacatcgccgccggggcggccaaaagcgaaatgttcgactttctcattgacatcctcccgcgcgacgagctgcaaaaagaacaatcggttgac

SEQ ID NO: 50168 - DNA, 1170 bp, Heterodera glycines
  SCN-specific regions: Sequence locations=1-190,216-300,322-395,425 -448,470-473,500-503,542-548,571-652,674-719,755-772,808-1053,1075 -1170
gtccatttaaggcaaccaattactatttgcgttgaaaaaggcattggcagtaacgacattttgtcaaacatttcgtccgtctttgtcggtgtgatcgatcacccaagtccaacccatcagaataacaacaattaaacggtcttttcaaattcccaactcattcggctgactgattcgataatcgcgagtcgtcatcttttcccttttcttttccatcgacatttttggctgggttaaactaccaaccaacaaaaagagagcgaaacgaagggaggcaaaaccaatcaatttagtcgagaaagccgagtgaaggaaacagcctcaacatattccatttgtcttataagttataacggaactacaataaaatggcggatcagctaaccgaagagcaaattgccgagttcaaagaggctttctcgctgttcgataaggacggggatggcacaattaccaccaaggaattgggcacggtcatgcggtcgctgggtcaaaaccccacggaggcggagttgcaggacatgatcaacgaagtggatgcagacggaaacgggaccattgactttcccgaattcctcacaatgatggcacgcaaaatgaaggacacggacagcgaagaagagattcgggaggcattcagagtgttcgacaaagacggcaatggcttcatctctgcggccgaactgcgtcacgtgatgacaaatttaggagagaaactgacagacgaagaagtggacgaaatgatcagggaagcggacattgacggggatgggcaagtcaactacgaagaattcgtaacgatgatgacgacgaaataatcgcttcggcacagccctcaacaccgtcactgcatcgatcttttcatttccttcgttcatttaaattatctcctctccacccatccattcattcaccgaccatttttcccgtggattcgattgattttatgtattctataattttttatttgcttttccgtgttcttttgagcagatactgagaatatttgtattgcgttttcttggtctccatcccatcaatcgtctcgtacacctttaatttgtttgtgtttctgtcgggaaacatcgctgggggccaattcgatgagacacattcaaaccagacgatcattgattgtatttcgttttctcaataaacgatttaaaagtt

SEQ ID NO: 50169 - DNA, 788 bp, Heterodera glycines
  SCN-specific regions: Sequence locations=1-529,572-788
ctgatttgctaatttgtccgtcctgacgaagaggcatgaaatggctctttgcatgtggcaacacggagaagaggcactggccaaggcgttggtggcatgtcgcatttacaaaagtttggccaatgaggcagcggaggattacttggaagtggaagtatgtgaggaacttaagacgtatgccgaagagtttcggcaactttcactggaattgctcgaccattgctataaagaagatgacgcacaaacgcttcagttgctgacatacgaacttagctattggggccaccagacatgcttgtcactggccgtcattgtgaacaacaagcaattcctggcacacccttgctgccaaattttgttggccgacctttggcacggcggtctccgtattcgaagcaactccaacatcaaagtgctcatgggcattctgtttcctccctcaatctttctgctcgaattcaaatcccgcgaagaattgctgcttcagcctcagaccgcagctgaacatcagaaggacatcaacgaatcgtcgtcgtcctcctcagattcctcctcttcgtcctcgtcttctgacagtgaaagcgacggcgacgagtcggacgcgggcgaaagaggcggtgccacagccgaagagcgccgacgcacgtcgcattcgcacggaagcatgcagtcgttgaacttcacctccatttttaaaagtaagcgcaaacgccgtcgtccttcccactcgcgttcttccaccacggccaaagaggacattgagatgggcaaacagaggaaccgagtga

SEQ ID NO: 50170 - DNA, 458 bp, Heterodera glycines
  SCN-specific regions: Sequence locations=1-458
caggatttgttcaccgtcaaaaacattgaccccgatgggaaaaagttcgacagagtcagtcgtctcttttgtgacagcgaatcattcaaaatgggcctcattttggatgtgaacacccaactctacgccatgggaatcaacgacaaattccggttgatgctttgctcttcgattcgggacgacggactcaccgaagagggcgaatacgacaaatcaatagaaaacattccccgggttcgaatgttcgaatatgtgatgtacggcaaaatttaccggattgagaacgacgagggcaccgcagaaacgagtcgactgaccgcatacgcttctttcggagggcttctgatgcgaattcagggggaggcgaacaatttgaccggatttgagcaggacaaaaacatttatttgttgttaaagaaagttcctaattgataaagagaggaaatgtgtgttaaaaa

SEQ ID NO: 50171 - DNA, 425 bp, Heterodera glycines
  SCN-specific regions: Sequence locations=1-425
acgaggattgactttgggaatttgacttgttacatggctgtggcgcggaacaaaggaatcgaaattgttgagaatgattactctttgcatgccacgccttcgtgcgtttcctttggacaattcgctcggatgatgggtctcggagccaagcagcagctgaacatcaattacgggaacagtgtcgtgaatttcaagcacatcctcggacgcactttcaatgacaaagtcgtgcagacatttcgtcagcacattccctgcggacttatggggaagttcaccgatgaccaaattgagataaaagtcactcatttgggaacgacgcgagtgctttccccggaacaggtggtcgcctgtctgttgacacatttgcgggttcagctcagctgttctctcgggacggatgtcactgaatgcgtcattaatgt

SEQ ID NO: 50172 - DNA, 525 bp, Heterodera glycines
  misc_feature (3)..(3): n is a, c, g, or t
  SCN-specific regions: Sequence locations=1-525
ggnggcggccgctctagactagtggatccccgggctgcaggaattcggcacgaggccttgccttagaggtccccacgagggtccaattaagcttaataccctctttatggctgggattgattttgggaatttgacttgttacatggctgtggcgcggaacaaaggaatcgaaattgttgagaatgattactctttgcatgccacgccttcgtgcgtttcctttggacaattcgctcggatgatgggtttcggggccaagcagcagctgaacgtcaattacgggaacagtgtcgtgaatttcaagcacatcctcggacgcactttcaatgacaaagtcgtgcagacatttcgtcagcacattccctgcggactgatggggaagttcaccgatgaccaaattgagataaaagtcactcatttgggcacgacgcgagtgctttccccggaacaggtggtcgcctgtctgttgacacatttgcgggttcagctcagccgttctctcgggacggatgccactgaatgcgt

SEQ ID NO: 50173 - DNA, 659 bp, Heterodera glycines
  SCN-specific regions: Sequence locations=1-7,45-401,425-479,501-659
gaagaatttgcttttttaattttgtctttggattcttagttcttacaatttgagaaatgtctgcgagaccaaaggtttttttcgatgttatggttggcggaaaatcgacaggtcgaattgtgatggaattgtttagtgacatcgttccgaagactgccgaaaattttagggctctgtgtactggcgagaaagggatgggcaaaagtggcaaaccgttgcactacaaagggtcgaagttccaccgcgtcattccgagtttcatgcttcagggtggcgattttactcgaggcaatgggaccggcggcgagtcgatctatggcgagaaattccccgacgagaatttcaaagagaagcataccgtcccgggactattgtcgatggccaatgccggccccaacactaacggctcgcagtttttcatcaccacagtgaaaacggagtggcttgacggcaaacacgtggtgtttgggcgagtcgttgagggcatggacgtggtgaagcaagtcgaagcccagggcaatcagagcggaaagacagcgaacgaaattaccatcgccgattgtggccagctttcgtgaaagcgacaaatttgtgcatcgttacagctcagttttcgaaatattaggtattgttttgtaagtttttgcactttgttgctc

SEQ ID NO: 50174 - DNA, 724 bp, Heterodera glycines
  SCN-specific regions: Sequence locations=111-116,138-724
agagagagagagagagagagagagagagagagagagagagagagagagagagagagagagagagagagagagagagagagcctcgtgccgaatcggcacgaggaaaaatcagaagcgaaaatggtcaacccgaagggataccgtcgcggcactcgttacatgttcgcccgcccgttccgcaagcacggcgttgagccgctttcaacattctaccgcgtgtacaaacggggcgacattgtcaccgtcaagggcaacggcgccttccagaagggcatgccgttcaaggcgtaccacggcaagaccgggcgcgtgttcaatgtgaccaaacatgcgctgggcgtcgtcgtcaacaagcgtgttcgccatcgcatcatcccgaaacgcatcaatgtccgtgttgagcatgtgaaaccgtccggctcccggctcgagtttctgcagcgatgcaaagcgaatgacttgcagaagaagcagcacaaggagggcaacgcaccgtttgtggcgctgaagcggaagccgaaggagccccgggtggcgcacttggtcaaagtgaagagcaccaaagttgagcggctggcgcccgtcaaattcgaaattgtcgcctgaggcgttgtcgggggcaaacgaatggacgagcacagaaaaccaaccgacaattgttatttttaatttgttgatccgtttcgtgttaaagaaaaagttttgaaaaggttgggctgtccac

SEQ ID NO: 50175 - DNA, 1155 bp, Heterodera glycines
  SCN-specific regions: Sequence locations=1-124,146-1108,1130-1155
taccagattaattctacagataaatgacaagtattcgaggtttgttgttcacgctcgcttctcccttgaaggcattttatgcaaatgtggcagtgaaacaaattgatgttacagggatgtccagcagtgttggaattcttcctacccatgtgcctacaattgcagtcttaaagcccggagttgtcaaagtccacgaacttgatggaaacgtctccaagtttttcgcttcttctggtaccctttcaatgaatattgacggctcgtgtcaagtgctcgctgaggaactttgttctcttagcgaactcaacgaacaggccatcaaaaatttgattgatgtcagccaaaagaaagcttctgacctcaatgcaactgatgtgcagaaggccgaggcgggaatttccattgaagtggccgaagccgcgctcagagccatcagcgaaaaataaagacaattgttgacgtatgaaaaatagatggtattgctgtttattgtcgtaatagttttataaatctaatggaaattcccttttctttcatttctcatttgttttttttttcaacaaattatttttgcttgaaatatttgaactttttttcacaaattaatttcgtagcaatggcattattaaaatgcgctatcatccgggggttgcttcatacattcaatggtcgacatttgttttcaacagtcatcgaacggagaggagaatttgccgaacttactgaagatgatctgcggaattttcgtggaattgtcggcgaccgttgtgttaagacagaagagattgacgaatacaacactgactttatagcaaattagggagcgcttgcgtttaccaaaggctttaccccttcatttatgaaacagtggcctcaacaggcgggagcatttcagcagagcatgggataggactgttgaagcgagaataccatcacaaactaatcgaccaaaaacggcgaatgtttagttctggtattgagcgactgtttgaccctcggctgatattgtctccttacaaaatgatagactaacattagagatggtattaaccttgtattaaccaattatcatgcggaaatatattttttattgttccccacttttctcttgcctaaacatatcaaacttttattgtcatgtaatcatgaacaatt

SEQ ID NO: 50176 - DNA, 715 bp, Heterodera glycines
  SCN-specific regions: Sequence locations=1-715
gtccaattaagaatcgtacgtatttttgctgaaaatgggaatagacataaaccacaaatatgaccgcaaggttagacgtacggcacccaaaagtgaggatccgtacctgcgcgttttggttaaactgtaccgcttcttggccaaacgtgtggacaccagcaaacgctttaatgctgttgtgctcaagcgtttgttcatgtcgaagcgcaaccgtccaccactttcaattgcgcgcattgtgcgctatgtgaaaaagccaggtaatgagaagaaactcgtcgtctgtgttggctccgtgacggacgacaagcgcatttacaccgttccggcgatgactgtctgtgcgttgcgcttcaccgacgcggctcgcgcgcgaatcatcgctgcgggcggcgagtgcatcactttcgatcagttggcattgcgtgcaccaaagggcgagaacacgctgctgttgcagggacgacgaaaggcgcgcgaggcggagaagcacttcggaccgccgccgggagtgcctggcagtcatgcgaaaccgttggttcgcgcgaagggaaggaaattcgaacgtgcacgcggtcgccgaaagtctcgcggttacaagaactgaggaattcctgtttcgctttgttgagatatattcccttgtcatgttacctttttgttatggaaatgaaatctttcttatccataatcaaagaaaaaattgttgattttc

SEQ ID NO: 50177 - DNA, 1565 bp, Heterodera glycines
  SCN-specific regions: Sequence locations=1-47,71-83,150-191,237 -240,263-299,323-326,354-541,566-571,593-657,680-746,770-812,858 -881,906-917,941-1037,1074-1286,1308-1319,1342-1565
acgagtaagcaatgggcaaggaaaagatccatatcaatattgtggtgatcggtcacgtcgattccggcaaatcgactaccactggccatctcatctacaaatgtggtggaattgacaagcgtaccatcgagaaattcgagaaggaggctcaggaaatgggcaagggatcatttaagtacgcttgggtgcttgacaagctgaaagccgaacgcgagcgtggtatcactatcgacatcgctttgtggaaattcgagacaagcaagtactatgtcaccattattgacgctcctggccatcgcgacttcattaaaaacatgatcacagggacttctcaagctgactgcgctgtgctggtggttgcttgtggaacgggagagtttgaagctggaatttcgaaaaacggccaaacgcgtgagcacgctttgcttgcgcagactttgggggtcaagcagctcatcgtcgcttgcaacaagatggacaccactgaaccgccattcgccgaggcccgttacacggaagtgatgactgaagtgtccaacttcatcaagaagatcggttacaacccagccaccgttccattcgtcccaatctctggcttcaatggcgacaacatgttggagccgtctgacaggatgccgtggtttaaggggtgggccatcgagcgcaaagatggcaatgcatctggcaaaactctgctcgaggctcttgactccattcttccgccgcaaagaccaactgacaagccattgcgtttgcctctccaggatgtgtataagattggaggtattgggacagtgccggttggccgtgtcgagactggtgttctcaagcctggaatggtggtcacttttgctccgcaaggcatttccactgaagtcaaatcagtggaaatgcaccacgagtccttgccagaagcgcttccaggagacaatgtgggcttcaacgtgaaaaacatctctgtgaaggacattcgccgtggttcggtcgcgtccgactcgaagaacgacccggcaaaggagaccaagagcttcacagctcaagtcatcatcatgaaccacccgggtcagatcgctgctggttatactcccgtgttggactgtcacaccgcgcacatcgcgtgcaaattcgccgaacttaaggagaaggttgaccgacggtctggaaagaaagtggaggacaacccgaaggcgctgaaaaccggcgatgctgggatcgtcgatttgattccaaccaaaccgatgtgtgtggaggcattcacggactacgctccgcttggtcgtttcgccgttcgtgacatgaggcaaaccgtcgctgtcggtgtgatcaaggcggtggagaagactgaaggcggtggaaaggttaccaagtcggcgcagaaggctgcagcccctggtggaaagaagaaatgacctatggagagagcggtcccgggagggccatttgttgacgaaaaacccactccatccctttgttttatcgttattttttgcaattccttccacctccgtctctatccatattgtcgttacgttggataatgttcatttttttgttgttgttctggt

SEQ ID NO: 50178 - DNA, 965 bp, Heterodera glycines
  SCN-specific regions: Sequence locations=1-965
cacaatcattcatccacaggcaataataataatataatgcttttttgtccgatggcatcgcagcggacgcactgcgccctctttcagcagcgacatttggccacaaaatacgtccgatttccgctagttcctcccgacaacaaaaatagcgtgcaaactctgcagcagctgatcgcctcgcaaaaggacccaaatgcctttgtttttggcacaaatatggcgggccgagtgggccaatggctgacgaagcgttcctttgagaaaacggtggacaccgaactgcgcattctgctgttgaagtcggccaaccaaatgtacctttgctgtgccaacaaatacccattcattccgttgttgaacgaatttggccttcccgaccattactcaagctggtacaggctgacactgttgcatatttggatggcattgtgccgtgtccaacagtcgctggaggcaatggcctacatttacttcatgcaccaagtgttggaggtgttcaacacggactggtacactcgcttggacaaagcagcgaaagaaatgggcatgtcggtgaacaagcgcaaggagggcatggcattgcacgccatttacatcagcacgttgcacgactatgacgagggatttttcggagatgaccgcgtgttggccgccgccgtgtggcgctcatttttccttcagctgccggacgtgtgcccggcacaaatcaaccgggtgggccgttacatgagggcaacgatggcctcgctggcacggatggacgacacgcgcctgttgaccgacggcattgagcgctgggatgtggcggaagagttggcacgtctggtgagcgcggaacagtttggcaccattccggcagcgccgccttcatcctcgatggatggtgatggccgcaactcggcacaaccggcgccaaaagtggcggcatcaaattaattcattacttttaataagcagacccattt

SEQ ID NO: 50179 - DNA, 535 bp, Heterodera glycines
  SCN-specific regions: Sequence locations=1-173,195-195,225-535
agcttgacctgattacgccagctcgaattttcctcactaagggaacaaagctggattccccgcggtggcggccgctctagaactagtggatcccccgggctgcaggaattcggcacgagggtccaaatcaccgcagctgttggtcctttactgtgatcagcttttgcgcaaaagtgcacgcaacatggaggacgagaagatggatgagaacctggagcaagtgatgaccgtcttcaaatacatcgacgacaaggacatgttccaagcgtttttccacaagtttttgtgcaagcgcctcgtctacgacacgtcagccagcgaggagcaggagcgatgcatgatcgcaaagctgaagcacatgtgcgggttcgagtacacctccaagttggagcgattgctgactgatgtcgcgctgagcagggaccactccgagcaattcaagcagcagccgaggacatccaacgttgacttctccgtcattgtcgtcatgtcgaacgtgtggccactgcagcagccggtcaaattcgaaatcccg

SEQ ID NO: 50180 - DNA, 886 bp, Heterodera glycines
  SCN-specific regions: Sequence locations=1-557,579-886
gtgacaaggtgatatgttgtcaaagtgtctccgctcgtcaatttttggctgctttaattgtgcgctccaaaatgtgtcttctgctggcgttttaatgaattcggttcgccatgcggggaccgcagagcattggagacgcgcctatctgaaggatttgtacaacagacggcaaatggtcgggcccgaaccgctgagaggcagggcatccgaggacaattggaattatccctccgaaatttccgcgctttctcatcgtcttcacatccccgacatggacaacgcactgattgtgcaagcgctgaccgacaaaagttattttacgcgcaatgatttggacgacgaagcgatgggagacgacggaccattgacgacggaagttgcgagagacaaatccaacgaccaattagtggagaaaggaatgcccctctttcgtcatatcgtactcacttatttgcgcgcccattggcctttggctcccgaggaattcatcattgccgtggccacccgaatcgcccccacttcggcgctggccgagttggccacccaattaggcctccaccacgtggtcagaaccgcggagtttcctcccactcagcaaacgctccagtcgacactgttggcccttgtcggtgccatggacgtggcaaaagcgcgcgacttcgtccgccgttttgtgctgccgcgactgtacgaagtgccgttggaggatgtgctgccgttccggcatcccttcgccgtgttgggcgattatttgcgcacatggcaaggggcaactgacatccaaccgcgtacaattgggtcgggtgctgttatgaaagcaacgcctttttaccaaggcgccgattacgtggacaaacagcaaattgttggaccatcgggcggtgaa

SEQ ID NO: 50181 - DNA, 571 bp, Heterodera glycines
  misc_feature (552)..(552): n is a, c, g, or t
  SCN-specific regions: Sequence locations=1-373,395-571
agaaatttaccgcaaaatcatcagagagagaatgtccgccggtcgtgccaacattggcaaaccggcgccgaatttcagcgccgaagcggtggtggactttgactttaaaacggtgtcgttggacgactataaaggcaaatatgtggtgctgttcttttacccggaggatttttcgttcgtttgtcccactgaaatcatcgctttttcggaccgttcgaatgaatttgccaacataaacacgcagcttttggcctgttcaactgactcaaaattctgtcattttgaatgggtcagcaaaccgcgcaaacaagggggacttggcgaaatgcaaatcccaattttggctgaccgaacccaacggatcagccgcgactacggcgtgctgaaggaggacacgggaaatgcttatcgcggtttgtttatcatcgacacgaagggcattttgcgtcaaattaccattaacgacacgccagttggacggtcaatcgacgagacgctgcgcttggttcaagcgtttcaatttacggatgaacacggcgaagtgtgcccggncaattggaagccgggcgaa

SEQ ID NO: 50182 - DNA, 420 bp, Heterodera glycines
  SCN-specific regions: Sequence locations=1-420
atgaacagaggcggtggcttccatattacgattcaagcaccagtgaacatcgcactgatcaaatattggggcaagaggaatgaggaactcgtccttccgctcaacgattccattgctatcacaattgatgagctgagcgccaccacacacatcacaattgggcccgatgtgagcacggactcggtgacattgaacggagtcggcattgacatcgccggcagttcgcggtttcgaaacgtttttcagcaaattcgtgaatactcaaacagaaagcgaaaactgaagggcgagcatgcttcaaagggttggcacaccaagattgagtcgagcacaaattttccgacctcggcaggactcgcttcatccgccgccggttttgccgccattgcgtttgggcttggcaaaattttccgcttgccg

SEQ ID NO: 50183 - DNA, 1051 bp, Heterodera glycines
  SCN-specific regions: Sequence locations=1-150,174-978,1018-1028,1050- 1051
gtttgaggttattatgatattaaaattgaaagttccaattctgctgtattgttttgttcaatgtttaagtgctgtcaaagtggacaatgccgagcaatccgaccaaccaactggcgattcttcctccggacaattcccaatttcgtatcctccaataaaatatgaaaacgatttggcctatgtggagaaaccgagtggcaacgagcgttgtctattctacgcggaaggactttctgtcgtcgtttttgccactaaaaaaagtcaatcggcgtgggcggactatcgctctgacaccaaagaaagtccgaagtataccgcgtcaattgaatgccaaggcaatatgaatgtgggcagcagctttgatgtctatttgaaaattgacggcaaagcggaaggagttgtgagagctgacattggaaaaaaggacgcaaaaagtgtcttcactgttgaaggagccgaatttatactcaacttcaacgtcacacaagtcggcttttggcaattggttggtgccaccgtggaaagaattgaagtgaaaggctcttcggatttcctgaacaaaaatttgaatgtcgacaaaaaatggactttggagccttcagttgttccatccacaaacattaacggcttcaaagactacagctttgcttgtggtcagaccaacccgatagtgtgggccctaaaggactcaaatgattacgcagtcggaattacgctgaacaatgtgcagttccaaccattcaatgcaacttacactgccggtggaaaagaagctgaccgtttaaaatttgggtggaaagtcaacgattgccagggggctggtcagcattggcacttggatgggcttggtagttgccactctgctcatctgcgtgcgctttttcgtctttctcatctgtaattctgtgacatacaatgcacagcattccatcataccaaaccaaaaacagattataattagtctcgaaaactcaatttcatcattttcttttattacatttccctcaaaatttttcattctttgtagctttataaatataaatttatttcc

SEQ ID NO: 50184 - DNA, 616 bp, Heterodera glycines
  SCN-specific regions: Sequence locations=1-616
agtccgttttctgcagcgtttcgtcaacaacaatccgcgcaatttggaaagagtgcgcctccaggggaagcccagcgggtgggaatttgagaagaatcgagcgcaacataacttcatttacagggtcgacttttgtccgacaaaaaatgcaattgctgcccgagtcgtccattacgaagatggaattgtgatcgaagcgtcaactcgtgagaagactgtccaaagtcaactatacagtcagacggatgtctccgccgcttataacattggtcggctgttggctcatcgatgcaaaatggcggggattgagcattgcatgtcgagtttgacggagaatgaattggagggcagcaaaaagcgagaggcctttctgagggcactgaacgaaagcggacttttgctggaggagcccgaggccatcccccacactcaccttaacgaccccaatttggtatgggaaacgtttccaattcagcacaaccgagctgacaaattggacgagttggacttgagtctggaaccgggcaaaggcgtttgctgatggcacaaataaaccttttttgtcttgtttccattttgtttctatgtgaaagatggcaaatgaaattttcgaacg

SEQ ID NO: 50185 - DNA, 476 bp, Heterodera glycines
  SCN-specific regions: Sequence locations=1-476
cttggacgcgatgaacaaccggatgccgattctggacagacgatggagttcaactacgttgtcatgtcgttggttggccgtccaatggacaaactccttcacgaatccggtgaccgcttcagccccggaactgcgatcggcacttcaattcaacttctcaaagcgcttaaggcgttgcacagcgttggatacctccatcgtgacattaaaccagcaaactcggccatcggcacgcctgagacgaacgaacagcgccttctctacctcctcgactttggaatggcgcgcaaatatgtcagagaggacggcacacaccggcgccaaagggacaccgcccgcttcagagggacgccaatctacgcaccaatctctgcgcacatcaaacgcgactacagccgccgggatgacattgagtcgtggttctacatgctgattaaattctacaaaggctctgtcccttggaatagccttcgcga

SEQ ID NO: 50186 - DNA, 764 bp, Heterodera glycines
  SCN-specific regions: Sequence locations=1-128,151-313,335-487,517-764
gtccaattaagatacataaatcaaaaattagcatttgccatttctgccgagcgaaatgggtgcctataaatacatgcaggaattgtggcgcaagaagcagtcggaggtgatgcgctatttgctgcgcatccgctgctggcaataccgccaaatggaggccatccatcgctgcacgcggcccacgcggccggagaaggcgcgccgcttgggctacaaggcgaagcaaggctttctcatttaccgcgtgcgcattcgccgcgggggtcgaaagcgccaagtgaccaaagggcaaacgtacggaaagccgaaaacgcacggcgtcaaccagctgaagaacacgcgcagtttgcaagccgttgcggaagcccgtgccggccgccgtttgggcgaacttcgtgtgctcaattcgtactgggtgggccaggactcgacctacaaattctttgaggtcatcctcgtcgacccgtcgcacaaaaccattcgtcgtaacccggacacccaatggatcaccaaacccgtacagaagcatcgcgagcagcgcggactcacctcggccggccgcaaaagccgtggcctcggcaaagggattaagcacacgaagaccattggaggttcgcgcagaaagtgctggaaacgccaaaacaccgtcgaattccatcgcaagcgttgagcaattcattcatttattatggtccattggacagaacggagattctgctgttacttttttctttttttgttgataaataaagcaaaaaattatt

SEQ ID NO: 50187 - DNA, 660 bp, Heterodera glycines
  SCN-specific regions: Sequence locations=1-47,74-166,192-479,509-660
gagatacacaaatcaaaaattagcatttgccatttataccgagcgaaatgggtgcctacaaatacatgcaggaattgtggcgcaagaagcagtcggaggtgatgcgctatttgctgcgcatccgctgctggcaatatcgccaaatggaggccatccaccgctgcacgcggcccacgcgtccggagaaggcgcgccgcttgggctacaaggcgaagcaaggctttctcatttaccgcgtgcgcattcgccgcgggggtcgaaagcgtcaagtgaccaaagggcaaacgtacggaaagccgaaaacgcatggcgtcaaccagctgaagaacacgcgcagtttgcaggccgttgcggaggcccgtgccggccgccgtttgggcgaacttcgtgtgctcaattcgtactgggtgggccaggactcgacctacaaattcttcgaagtcattctcgtcgacccatcgcacaaaaccattcgtcgtaacccggacacccaatggatcaccaaacccgtgcagaagcatcgcgagcagcgtggactcacctcggcccggccgcaaaagccgtggcctcggcaaaggaatgaaacacacgaagaccattggaggctcgcgcaaaaagtgttggaaacgccaaaacaccgtcgaatttcatcgcaggcgt

SEQ ID NO: 50188 - DNA, 481 bp, Heterodera glycines
  SCN-specific regions: Sequence locations=1-64,87-481
gtccaattaagaataatctgaatcagatttgtagttctcactattcaatcctacaattagccttattttgcaaaacatccatttttgaacttcaacaaatgtctacgtggattcattgcaaccattgcttcatcgtgccaacaaatgactgcaacaaaacgcgattttggttcacttcgtgcggtcatttgatgtgcgcagagtgtctgaaggcgaagcgatccaacaacaacaacgggcagcactttgagtgtttgctgtgccatcaacagaatgtgcaactcgtggagctcaaccgccatctgaggcccgagctgctggcgctgtttcgtccggcgaaggatttgatagacgaattcaacgccaagttgaagcaagtcctcacatttcagcagtcgcatcagaagcgacttgtcgaccatttgacggacaaggcacaaagggccacaaaatgggcacagtcagttcagaaggacatgca

SEQ ID NO: 50189 - DNA, 783 bp, Heterodera glycines
  misc_feature (708)..(708): n is a, c, g, or t
  SCN-specific regions: Sequence locations=1-198,221-413,436-783
cctgtcgctgtgctttgtactatcatttccttatcaaatgcctcccccaatttcctctcacagcccaaaatatgagaaaaacgagttgcacacacagaacaaaccgtcgaatgttgttgaggcattgacactctctctctgcccatggcttcgtcgtccgctgccagcgatgactcatccgccgtttcttcgcctcctccgccgcttctctcttctcccatccgatcggaaatggtcgctgctgccaaacagtttctggccaacccgcgagtccgcaacactccaatcagtgaacagaccgaatttttgcgtggcaaaggactgacagagacggaaatacaaaaggcaatgaaattgacaacggacggagggggagagcaggtgccgtccacttcgctttcgtcccttcctcccgcgtccgctccctctccctccgctcgtgccgtcgtcgacttggcacgttccgcgcttctcttcggcactgccggttacatggtctacagatttgttcgttcgtggctgctcccgcagcttctcaatgtgccggacccggccgaggagcgtatgcaacgacttgagcaacaggtcgaaaggctgagcgattccacgcgatgcatcgccgaatcggtgacacaaacactcgttgcggtgacggaacagaacgagcagctgagccgaacgatgatgatggtgcagggagggacgaangggacggtttgcaccgccgacattgaccgtgtacataccgaaattggcattgtcaagtcgctgctactcaaccaa

SEQ ID NO: 50190 - DNA, 610 bp, Heterodera glycines
  SCN-specific regions: Sequence locations=1-198,228-610
aagcaaaaaaaaaagccaatggaattcaaaggcgaagaatggtcggacaatccgataagcgaatgccgaatggccgagttggtccggcactttttcgccttgggttggatgtgcgacaacggcagcggaatggcggtccgagtgaaagacgaacggacgggcgaacatttgattctgaactcgtccaattcgttggagaaggaaattttttcggaaaacgatttatttgtgatgaaaatgaacggcgaaattttgaaaagcccgtcaaaatcggaccgatctccgacggcgccgttttatttactgcgcgacaatccggatttggcctgtgtcattcacactcactcaaaatgggcaaatctgatcacccaactgatcagaggagacgagttcaaaatttcaaaccaggaaatgattcagggttgtgaaaatcgtctcacaaaaggccgtctggataacattgacgtgctagtggtgccaattgtgcagacagagatcaatgagcatctgctttatccaattctgctgaggacgctgaagcaaaacgcgggggcaagtggcattttagtgcgtgggcacggctttttctgcttcggcagcaacagttggc

SEQ ID NO: 50191 - DNA, 762 bp, Heterodera glycines
  SCN-specific regions: Sequence locations=1-257,279-762
cttctattctcttgcattttccgtggaccttcaacacataacccacataaacaaatgaaccgaattcgaaaagcattgacagtactcagcggcaatgaatcaaacattccggagaagatcgcaaaggccgagcctcaacaccatgacattgagaagccggtgtcctccttgaaattcggtggtggcgcaacattgttccccgctgaatacgccgacgacgtggacctctacttgcgacaactcgaaagacgcaccccgctggacttcgactttctgtccgtgcacaaaaccgttgacggacgaatgcggcaaattctcgtcgactggcttgtccatgtccaagtccgcttcaagctgaccattgaaactctcagcctatccgtgcacattctcgaccgcgttctattggcactcccggggattaacaagacaaatttgcaactgttgggcgtcacgagcattttcatcgcagccaaattcgaggaagtggtcatgccgaatgttgacgactttgtctatgtggcagcaaacatgttcaagagggaggacatcatgcggatggaaccgcgggtgctgtccgggctcaagttcaacctcagcgtgccatacgccgtgcagtttctgcgtagctatcgcttctacgcttcgccgtcaaagagtgtgtgggaatttgcgaagttcgtcagcgaagttgccatggtctgttacgcgttggcccacttccctccctccgttgtggccgccgtgtcgctccatttggct

SEQ ID NO: 50192 - DNA, 956 bp, Heterodera glycines
  SCN-specific regions: Sequence locations=1-199,233-257,292-292,346 -397,420-422,450-467,490-638,660-956
cgggcgatgggccccgggggaagaagcgtatttaagcggagagaagtgggggaagggcatcagttgcagttcaaccaacagcagcagaagcaaaaatggctgatttcgacaaacacgctgcccagcgcgaggcggagtcgctccgcactttggccttcttcggcgtgtgcctgtccaccgtggccacggttatcgctgtgctttccgtgccgttcgcctaccagcacttccagcagcttggcacccaaatgcagaacgaagtggacttctgcaaaatgcgctccggcaacatgtggcgcgaggtcacccgcacccaggcctactccaaggtgtcgcacgacagccgtcacaagcgtcaggcaggcggttgctgtggctgcggagtgtcgcccccgggcccgcccggaccccctggcccatcgggacaacccggcggagacggacaacccggaggctcaggacagcccggagcaccaggccaggcagctcctcgcccgtacccgccaagcggcggatgcgtgccgcaatgtgaggccgcccagcccggacttcccggcccgcccggaccccccggacccgagggacagaacggccaacccggacagtcggcaccgcccgcgtctcctggccgccccggaccccagggacctcctggacccgatggacagcccggcaaccccggagagtctggccaacccggccagcccggcaaactcacccagggcccgcccgtcgtcggaccgcctggcccagcaggaccccctggccagcccggacagcccggcgagaacggacagcccggccagcctggaaaccccggcccgcaaggataccctggcgacggcggaagccccggccaacccggcaaccccggaggcagcggcgagcccggacagcccggagcacagggatccagcggccaatgctaccactgcccaccgccccgcaccgccccc

SEQ ID NO: 50193 - DNA, 465 bp, Heterodera glycines
  SCN-specific regions: Sequence locations=1-32,76-465
tggttttacaaatgggtcaaaaccaaccgcagggaggtgggcgaaagccaggcgatgacaaaggacaggaccctgaaaaaaaaacggaaataccatggaccgccggttccaacgcgaattggaaaacgcaagaagggctctcgtggtcccgacacagcaaacaaaatgcccaccgtgactccgatcactcgttgtaaactcaagctcctcaagtatgaccggattaaggactatcttttaatggaggaagaattcataaagaacatggagcgtttgaagcctcaggacgaacgtcaggaggaagagcgtgttaaagttgacgaccttcgtgggactccaatgtctgtcggatcattggaagaagtcattgacgatcaacacgcaattgtttccacgaatgtcggcagtgaacattacgtcaacattttgtcatttgtggacaaagaacagcttgagccgggctgt

SEQ ID NO: 50194 - DNA, 1133 bp, Heterodera glycines
  SCN-specific regions: Sequence locations=1-191,214-1133
gttgaggatggctgtgccaaatccaaaatccatttcaaacaattggataagcgttcaccgattgctcacatcgtcgagaatgagctcatcgtcgccgcactgcagcaatgcattcgggaccgatgtgccaatgtggaagtgcgccaaggcgcggttgttgaccagaatttgagtgttcctgacaatctcggccaaaatgtcaccattcagttcgaagatggcacaattgaagcttcattgatgattgccgccgatgggtccaaaagtacggcacggaaaagggccggcattgattttgaagaaacggcctatgagcagcgtgccgttgtgggcacattggccctccagcacaattcggagtccgatgaatccttcgcttggcaacgctttgtgccgtcgggccccgtcgcgcttctgccgcttggccgtgaactgtgctcgttggtttggaccgtgtcaactgccgacgcggcacggcttctccaactgtcgcccgaacactttgtggaagagctgaatgggacacttcaatttgacaactcttcggctaattccctcgtcaacaattcgttggattgtcttggcaaggcactgaactttttgccgtccaaagaatcgcctgccaaatgcacaattccccgcgttttgtcgctgccttacgatgaccgtgccgtgtttcctctgtcccttggctacgcttacgactacattcggccgcgggttgcgcttattggagatgctgcgcatcgtgtccatccgctggcggggcaaggcgtcaatttgggctggtccgatgttcgcttcctcaccgctgcgcttcagcgggctttctacgagggaggcgatttgggttcgttgacatatttgcgcgactttgacagtgcgagccaaaggcgaaatgggccgattatattcgcaattgactgtctgaaccgactttactcgaccgaccaccccttttgcacgttgttccgttccgttgggctcaacattttggaccggattcttccggccaaggatttgattgttcatctggcctcatgatttgatttggtctttactcgatttatgacgaatttcgttgatttgtactgccttttttattttgagtaaatttttttatttcaaaaaaa

SEQ ID NO: 50195 - DNA, 965 bp, Heterodera glycines
  SCN-specific regions: Sequence locations=1-818,840-898,920-965
tttatttttgactttccaaaatggtttccgttggacttgcaaatgctcagcgacttgttgcgattgtgactggcggtgcttcggggcttggctgtgcgactgttcgtcggttggtcgccaaagggttcaacgtttctctgttggatttgccaatgtctgaaggagcgaaagtggtggaagaattgggcaccactgacaatgtgcttttctctccggtcgatatttcgtctgatgatcaagtgtattttgccatggacgcaacaacggagaaatttggtggtctcattgttttggccaattgcgctggaatcgctttcgcgcacagattgtacaatccgtcgagcagagcccaaatggacctcgacaaaattcggcgactcatcgacgtgaacatcttcggcaccatcaacgtgatcagacacgccctcccgctgctgattgacaatgtgccggacgaaaacgaccagcgcggagtgatcatcaacacttcatcaattgcagcctttgaaggacaaatgggacagaccctttattccgcttcaaaaggtgccgttgcatcattaaccgttccattggcgcgcgattattccaacaatggcattcgcgtgatggcaattgctcccggcttaatggacacgccattgctttcctcgttgccaccaaaagtcaaaaagttcctttctggcactgttccgtttccgaaccgattggggaagccggaagaatttgccgcattggtggagcatatcatcgacaaccattacttaaacggcgaaatcatccgattggatggtgggattcggatgaatgcttgagaaggacagcagcagaagggcacaattggctctttgatcacttttgttgactttttatctttgcattgttttttgttgtgcgtccattcccacaaccctttggattttataaattgccaaaagcaatcggtggggtaatttgtcttttat

SEQ ID NO: 50196 - DNA, 838 bp, Heterodera glycines
  SCN-specific regions: Sequence locations=1-444,466-786,808-838
gtccgtgctgtggaaaatgcttgctctgaagtcgcttttgggtaggagccctctggtcaatcctttggttttgtctttgcggaacagatccatcaaaaaagtgaagaaaaaacttgctgcaggggaaacactcggcggtccggaggattatgcgtataattatgttgaaaaaaagagaggatttatcaaaccgatccacacacttgaggaacagatagaatacatgaacagcgaagtttttgccgaaacttacaaaggacgtccaatttgttttatgtggaaacgtaatatgaaaggccagtggaaattgcaaccgccgcctcgacttttttgcattgaccgcaatggtcgtttcaacgttggaaatgcgtgtacggtgtgtcgtgatgagtatttgttcttcgattatagaaatcccaaattgcttgagcatttcctttaccccggcactgatcagcccctgcccataattcaaaccggactttgtcaagaacagtacgtcaatttgcaagcccaacttctcaaggccaaagagcacggtacgtttattttcaacgtgcccttccgtcacttcaattatggtcaatggtatccaaaagatgcgaatgcattaataagcagtgatttggaggaggaccaaccgagcagagacttgacaaacgtcgaatacatttatccgaatcctcaaatcgcatttgaaacacacaaccgggacaaacacaatgcttgggatgaatggtggatgagacaagaaagattcattaaaagactcaaataatcgcacatttgttactattgtctgtttgttgcattcacttcgaaaaatatttcaacgcga

SEQ ID NO: 50197 - DNA, 854 bp, Heterodera glycines
  SCN-specific regions: Sequence locations=1-567,589-854
tggatccccgggctgcaggaattcggcacgagggtttgacatagcggatatttagatacaatctaaagcttcgtttgcatggatttagtttaccacgaaaagcaagttggacgtatgtgtgctcaacatgcactgaacatgcttctgcaaggcgattacttcacgcccgattctctcgcttcaattgctcaagaattggaccaaagagaacgtgcgatgctaagggacgaatctgagtttcaaagtcaaaattacgacgattcgggatacttctcaattcaggtgataactgaagctttgcgtcgtcaagcgaatttgagtctggagcctatcataagcccaaatgctatgaaggttttgcaaaatccgagtttggcacatgcttacatttgtcacctggaggaccattggttcacaattcgcaaaattgggacgacttggtttatcctcaattcgctgttcaaagcaccgcgcattgtatctgaaacgtttctcgaattgtacgtccatcagcttaataccgaaggttggtccctttatgttgtcgaaggcgaattgcccgcttgtgcagcggaaactgtgccaagagaattttggaatgagacgcgacggacaaaaaagtttgaaaatgacatggaaagggcaatcgcattgagcctaaatgaagcacggccgtttcttgttacaaagactgccgatgaagaattgtttggagcggcgacaccggtgatcagccaagccgaggagttggacatccagcgtgctttggaggacagtcttcgtgaggcgaatagggccacttcggtaagcactgccgaatcgtttctcgtcggagaagcgatccgcaacagtgt

SEQ ID NO: 50198 - DNA, 518 bp, Heterodera glycines
  SCN-specific regions: Sequence locations=1-36,58-281,304-354,376 -381,403-467,490-518
gtccaattaagattaaatttactttcctatccattcttttctaaattgaaaatggccgacgaaagtggcacgaacgcaggaggagccggtgccgctggtggcgctcagcccgccgagtacatcaaactgaaggttgtgggccaggactcaaatgaagtgcatttccgggtcaaatacgggacatccatgggcaagctgaagaaggcgtacgctgagcggactggcgtccaggtgacttctttgcgctttttgttcgatggccgccgcgtcaatgacgacgacacccccaaatcacttgaaatggaggaggacgacgtcattgaagtgtaccaagaacagctcggaggctacattgtggaggaataatgaagattgtgaacatttctccgtgtttctttctctgacgatgatcttttgcggatgttatatttatacttcgctttgtttctttttttgtttctttgaaagaattggattccaaacttttgttgtttaatttatcacacttgtaaaaaaaa

SEQ ID NO: 50199 - DNA, 459 bp, Heterodera glycines
  SCN-specific regions: Sequence locations=1-396,418-459
atgttgcgacagcttgactctgtccgtgaatacatccaacaattgcatgcgcgactcctttcactgaccgacaggtttgcccaaatttcaccgctttggcaacgtggcgaacccatttcaaaaccgctgccggtgatggcactttgcgagtacaagagcaaggacaaaattcacatcagacaaggggacaagtacactctgttggacaaccatgaccaaattcagtggcgcgtgcgcggcatggacgacgttgaggtggtgtcaactccgggaacaagcggcgccacgggtgccaccgctgtgtcacaactcattgaagaagacgaggaaaaatgtgcccgttgtgccacagcatcagccactgtacgaaagattgcaacaagcgttgaatcggaagaattatttttattatcatttgtgcgtttgttttgatgtgttaagcataaaaatttttcaatt

SEQ ID NO: 50200 - DNA, 484 bp, Heterodera glycines
  misc_feature (481)..(481): n is a, c, g, or t
  SCN-specific regions: Sequence locations=1-77,99-484
gtttgagattatacattgaaattgcgatggacactttgtttgacgtgcgtaacaacttttatttgggcgcttttcaacagtgcatcaacgaggcacagaaagtcaaatgcaagtcggaagaggagaaggagctcaaggacgcgttcatgtaccgcgcttacattggcctgaacaaatgttccgtgccgttgggcgaaattgacgccaccgatggcaatgggtcggccgcccttttggcaatccgacggttcgccacgtttatgagcggtgcgccggagaagaggtcagagattgttgaccaggtggccaaagaatttgaaacgaaaaagtacgctgacaacgaaatttgcctgctgatcagcacactcattttcatgcacggagaaaaaactgaggaggcattgcgcgtgctgaaccgcacggcgtccgattcgttggagtgcgccgcgttgcgcgtccaatgtttgctgaagctgaacanggg

SEQ ID NO: 50201 - DNA, 541 bp, Heterodera glycines
  SCN-specific regions: Sequence locations=1-541
caattaagcgattcacattccgtattcaatcgatatacctttcaatttgcctttactatgcttcttgctttgacttctgtggacactcgcaacgcacttttgtgcgccgccgttccttccattggcgccttcgtgggctcgacgatggccatcaaagatcaggaattggttcaattcctcaagaaacaaaattttccttctttcgcacgttgttgcaaatacaattatttgctggccaacactgccgtcaccattccgttcggttacgcttcttatttggtctacaaaattggaggaggtgtcagttgcaccgactcaaaaatcgcattgggactgtacggtgcgacgctgctcagcggctgttttttggtgcccactctcaaaaagcatgacattaaggcgctgactgccaacgctgttgtccttgccggactttccgtcgctacttcagtggctttctacaacatcgataagatttccgcttattggaccatgcccttcactctttgggccattttatacgctggacttacggtgaagg

SEQ ID NO: 50202 - DNA, 701 bp, Heterodera glycines
  SCN-specific regions: Sequence locations=1-212,234-701
tggtcaatccttgattttgcatgtttactgattgaaataaaaagttcaaaaaatgcaatcatatcattacatttatcatatcagctaatacaaattccctttgcctaactatgcctcttcattggacttctgtggacactcgcaacgcacttttgtgcgccgccgttccttccattggcgccttcgtgggctcgacgatggccatcaaagatcaggaattggttcaatttctcaagaatcaaaactttccttctttcgcccgttgttgcaaatacaattatttgctggccaacactgccgtcaccattccgttcggttacgcttcttatttggtctacaaaattggaggaggttttgattacacggacacgactgttgcattgggactgtacggggcgacggtgctcagcggctgttttttggtgcccgtgctcaagaagcaggatactaaggcgctgactgccaacgctgttgtccttgccggactttccgtcgccacttctgtggctttctacaacatcgacaagatttccgcttattggaccatgcccttcactctttgggccattttctgcgctggacttacggtgaaggcttgaaatgtttgaagtcggctgcctttttctggattgtcattttatgttaactcatcttttgttgagttaggaatattttacttccaagtaaattgtctcgacatt

SEQ ID NO: 50203 - DNA, 1035 bp, Heterodera glycines
  SCN-specific regions: Sequence locations=1-360,383-556,579-769,791 -851,873-949,972-1035
gacctttaggggtcccttttttcaccctttgacgacaaacagaagcagcaatgagtggttgggatgcgtacattcagtcattgacttccagttgtgcggagattactcgcgtggccataattggcaattcggacgcgagtgtttgggccaggactgaaggggagaacgaattcaaggcgagtgaacctgagctcaagaaacttgtcggccaattcgatgatctttcgcaagttccgtccgtcggtgccgacctcgagggaattcattacattgtgccgcgaacggatgaaaatcttatctttgggaagagggacaaaacgggctttttcgctgtgaagaccaagtccgccattctgatcgccatttacaaggacgaggaaagtgtcgtcggcgccgacgtgcgaggggcggtggagaaaatggccaaataccttgaggacgccggttactgagccgttgctcggtttcctaaacgacttttgtgttgccaaacgaaaagtgctgagaatggctttgacttattcttccaaatgcattccttttccatcccaaatgatcacttattattttattattacacattctgtgaagtgcgcgtgccgatttcttttttattatttggcctttggatgtgaataataaaaaggtgtaaccgctgagaaccaaaaactgcttttgcttttcgaaaaccttttccatcaatccgttggcgggcaaatgtctccgccaatccaattctgtaattgatacgggcagtccctttaattaatctgacccacaggtgccatgctttttgtttggcttggccttgcgtttgtaattcgagctcacctcgggggggggggaggaatgtccgttcccttttgccttggcaacattcgccttatttcgcgatgctttttgtctcctttttcgtcttggcattactttttccccttggtgactccgttctgtccgtcgttgcccctcctccgtctccgttgtctatcagtgcgtttcctccgtcactttccgccgatttcgtcacttttcagc

SEQ ID NO: 50204 - DNA, 472 bp, Heterodera glycines
  SCN-specific regions: Sequence locations=1-8,40-437,461-472
cttaagaaatttattgaattcacttttttatttggtttcgtccgacaacaagaaatggcaaagcgcacaaaaaaggtcggcattgtcgggaagtacggcactcggtacggcgcctcgttgcggaagacagtcaaaaagatggaggtgtctcaacatgccaaatacacatgtgcattctgcggcaaggaggccatgaagcgagtgtgtgtcgggatttggaattgttccaagtgtcacaagaaagtggccggcggcgcctacgtgtacgccaccaccaccgcggcaacagtgcgaagcaccatccgccgtctgcgcgagaccaaagagtgatttgccgaatcccaacggcggagaacaatggtggtgacgacgacttttgcaccccactgccactgttttttgttgttatgtgttgtttttgaatgaaaatgggaattgttcttcttttgggaatgcaatatccaaaaaatgg

SEQ ID NO: 50205 - DNA, 1163 bp, Heterodera glycines
  SCN-specific regions: Sequence locations=1-330,353-556,590-729,751 -1163
ttggctgcttttcccagaaccgccgttgcctttatgcagcaatgttctcgcttaatgagtgtcaggatgaaaagcagttctattaaggtaactttaatcggcgcaagtggaggcatcggccaaccgctcggattacttttgaagaagaacccttccattgcacacttggcactttacgatcttgtcggcactcccggagttgcggccgacctttcccatataaacaccccggcaaaagtgactggccatttgggaccagaccaacttgttgcagcgttggaaggtgctgacgttgtcattattcctgccggtgtgccacggaagcccggtatgactcgtgacgaccttttcaccacaaatgccggcattgtgcgggacatggccgaagcagccgcaaaaacttgtccgaaagctttcatgggcattataaccaatccggtgaactcgacccttcccatcgcctgcgaagtctacaaaaacaatgactgtttcgacccgcgacgcattttcggcgtcactcttcttgacattgttcgagcacaggcattcgtttcagaactaaaagggatggattgtttcccaaacaaaagtgtcggtggtcggtggccattccggagtgaccattgtcccacttctgtccagatgtacgcccaaagtcagtctgagtgacagtgagacgaaggcactcaccgaacgcatccaagaagcagggacagaagttgtgaaagccaaggctggcgcggggtcggccactctttcgatggcacttgcagctgaatactttgtttcggctttgatcaacgcgctgaagggccagaagagtgtgcagtgtgcgtatgtcaaatccgacgtggtggaaggccttgattactttgctggaccattggagctgggacccaacggcgtggagaaaatactgccattgggtgacctgaccgcttacgaaaaggagctgatcagcaaagcggtgcccgaactgaagaaggaaattgcgaagggtgtcaactttatcaagcaagggtagaagccagccggtagtaattagccaatcatttttgtgtcgagaaatgcattggcactgttactgtttgtcaaccgatgattttcatattatatgtagttttggttcttaatatcccaatcatgttttgtcctgctaccat

SEQ ID NO: 50206 - DNA, 867 bp, Heterodera glycines
  SCN-specific regions: Sequence locations=1-13,35-56,133-134,193 -604,626-843
ctaaaatgcaagagactcacattgttctcgggattgcctcggtgtgctctctgttggctatcatcgccacagtcgtcactctgccatctctgtactcggagatgagccaaatgaacagcaaagtgcgcgacggagttgaggccttccgcgtcaacaccgactcggcctggactgacttgatggacgtgcaagtggtcgtgacgccgccgtcgaagccccgtgataaccccttcaactccatcttccgtgccaaacgtcaactgcccggacactgccagtgcgctggcctccaacagccaagctgtccccctggtccgcccggccccgtccggaccgcctggacagcccggacagcctggaggcgcaggacagcccggacagcctggacagcctggccaacccggacagcctggagcgaacggagttgtctcacgcccaattcctggcccgaagggaccgcctggagcgcctggccagaacggaaaccccggaagccaaggtcagccaggacagccaggaggccaaggaccgcccggacctcctggcgcgcccggtcagcccggccagcctggaaactctggccagcctggacagcccggagcaccgggacagcccggcaaggacagcggctactgtccgtgcccgccccgctcttccgtgttggcagtcaaaaagaagatggcggcagccaagaaagcataagcgacaagcgcagggagaagagaaccgaaagacaaaggaccgacgcgaaagcgaagctgaagatgatcataattgggtggaagttgttgtcggaatttgtgttcaccagcgcatttcccacacgaataaagggcattcactaaaaaaaaaaaaaaaaaaaaaaaa

SEQ ID NO: 50207 - DNA, 484 bp, Heterodera glycines
  SCN-specific regions: Sequence locations=1-301,341-344,378-484
caattaagagccagtttatttactcatttcaacaaacagcaatgaaatacgtcgccgcgtacatgttggcatcgctgggcggaaatggcgacccatcgccaaaggatttggaaaaaattctcgcagcaggcggactcgaggtggacatggacaatgtgaaggccgtcctcaacgcagtgaaaggcaagtccattgaggaggttattgcggcgggccagaagaaattggccaccatgcccactggtggaggcgctgcagcaccaactgcagcagcagcggccactgctgcacccgctgctgcggagaagaaggaggaaaagaagaaggaagaagtgaaggaagaatcggacgacgacatgggcttcggactgttcgactgatcaccgaccgattgatcgatcggacggaatattgtttttgcttcttaccatttcatcaaattaaaacgacgaacggaaaaacggagataaatttgttttttgtt

SEQ ID NO: 50208 - DNA, 620 bp, Heterodera glycines
  SCN-specific regions: Sequence locations=1-16,38-538,560-620
taagggtttaaaatatttctgaatttgttgtggtattttgtccaatgtctgtgctaatcaccgagagaaatcaggatgcgacaatttatgttggtggtctggacgagaaggtcaccgaggcgatcctctgggagttgttcgtcaacgctggtccggtgaccaacgtgaacatgccgaaggatcggatcaccggcactcaccagggcttcggctttgtggagttcatgagcgaggaggacgctgattatgccataaaaatcatgaacatgatcaagctgtttggcaaaccgatcaaagtgaataaagcgtctgcgaatgagaagaacatggacgttggggcgaatttgtttgtgggcaatttggacccggaggtggacgagaagttgctgttcgacacgttcagcgcgttcggtgtcattttgcagcccccgaaaatcatgcgcgacgtggagacaggcagcagcaagggctacgcgttcatcaattttgcatctttcgaagcgtccgatgcagcgctcgaggcgatgaacggccaattcctgtgcaaccggcccatcacgtgttcgtacgcgttcaaaaaggacaccaaggggggagcggcacggcacaaccgcggagcg

SEQ ID NO: 50209 - DNA, 776 bp, Heterodera glycines
  SCN-specific regions: Sequence locations=1-38,60-134,156-566,589 -668,690-776
gtttgaggatgtttttttctaattttgtggcgctcactttctgcattttctccatcttcattctgatcccaaatgtgtcagctgctgcctgcgagtcgcccaaatactccgccaacggttactccacgcaagacggatttttccactacaaaacttcttacattgttgaatttgcgatccaatgctctaacaattacaaggacgcgccattctacgcactggtcggtgaaaaaacgctccaattggctgtgtctgaggagaccaacaagtaccaggtgtcctggcaattggaacatgccgattctggtgcacaaacattcgatattcgcgtttatgacgaagacaaattcgcggagcacaaaaaggccgatgagtccggctcaagttctgtccaaccattgttcactgtccagcattaccacggcggcacctctcacaaaacgtggatttcctcagagtccgtcttccttttgttgggcgtcgtggcgctgtactttacgatgaatttacgccaattgttggccaaaagagactgactgaccaattggttgttgcccattctcccgaatttcacccttttaatccttcaatctgtgaaatgaccattttaagttattcctgacactttgggcttactcaatttatttgtaaccttttttggtggggtattttcgttttaacaacattttcaaccgtctcttcgagccttgttttgtcatccaattgatgttttttgcctaacttcattctttcattgttgataaaaaaagtggttg

SEQ ID NO: 50210 - DNA, 510 bp, Heterodera glycines
  SCN-specific regions: Sequence locations=1-38,73-124,151-154,191 -316,338-510
gtcgtcttacgctcgacaaaaaaccgccataaaccgcgccatgcctcccaagttcgaccccaacgagaccaagatcatcaccctccgtgtgacgggtggtgaagtggctggtggttcggcccttgcccccaagatcggtcccctcggtctgtcgcccaagaaggttggtgatgacatcgccaaggccacccaggcctacaagggtctccgcgtgactgtgcagcttaccgtgcagaaccgtcaagccgccatctcggttgtgcccacggcctcgtcgctcgtcatcggcgccctcaaggagccgcccagggaccgcaagaaggagaagaacatcaagcactctggcaacctcaccttggacgccatcatcgatgttgcccgccaaatgcgccccaagtccatggctcgcaccttgaccggctccgtcaaggagattctcggcactgccttctctgtgggttgcaccgtcgacggcatgtcgcccaaggaggtccaggagaagattgacgc

SEQ ID NO: 50211 - DNA, 779 bp, Heterodera glycines
  misc_feature (504)..(504): n is a, c, g, or t
  misc_feature (685)..(685): n is a, c, g, or t
  misc_feature (699)..(699): n is a, c, g, or t
  SCN-specific regions: Sequence locations=1-365,397-526,551-779
ccccgcggtggcggccgccctccaactagtggatcccccgggctgcagtttacaaacacgaggcggcggagaaaggaggaaaagcgggcggaggagggaaaagtttcggccgcggggcggcacggtaccatcggggggatgagaattacccctacaaacaggagatttcattggcggttacgctggccatggcaatttgtctgatcagttttgtgtaccacagcacttgggtcacttctgaggcgtacagcagtccttccattgtcctttccgcgcgttcgggcgatggcggacgcataattttcgacgatttccgctaggcttattactggttacgaaaaaacacgcccgatgatgcgaaagtgatgtcctggtgggattatggctaccaaatttcggcaatggccaaccgaacgacaatcgtggacaacaatacgtggaacaacacacacatttcgcgtgtaggacaagcgatggcatcgaatgaatcgcatgcatacgaantaatgcacgaattggacgtcgactatgtgctggtcatttttggaggagtcaccggctattcatctgacgacatcaacaaattcctgtggatggtccgaatcggcggttcgacgccggaggggcgacacattcacgaaaatgattactacacaaagaatgggagagtttcgcattgacaagnagggttcctctacnatgctcaactgtttaatgtacaaattgtgctatcaccgcttcggcactgtgtacactgaacatggccgtgccaccggttt

SEQ ID NO: 50212 - DNA, 641 bp, Heterodera glycines
  SCN-specific regions: Sequence locations=1-5,38-263,285-641
ggtaatttcaagcacattatttttggaaagcttatttgatttatccatcaacagctgcaaaatgacgattagcaagaacaacaagatgatggcgcacctcaactacaaaatgaaggtgatcgtccaggattcacgcgtttttatcggatacttcaaagcattcgataaacacatgaacataattctggccgactgtgaagagatgcgccgcattaagcccaaacaaggagctaagaagtcaaacgtcgaggaggaaaagcgcattcttggcctggtgttgctgcgaggggacaaaatcatctccatttcggtggaaggaccgcctcaaaaggaggattctggtgtgcagttgccaaaggctggcggactcggtgggcctggacaaggacgaggtgccggtcgaggaatgccgatgggtgtggtgccgccaatgggagctgttcctccgggtttgcagggcgccgttcgtggaattggtggtcctgggatgggtgggcccatgcagcccggatacatgcaagggatgcccgcagggaatgccgccacgtccattttgatgctcgattttgttttctttgttcgaccattatttgttttcttacttttacacaatgatctgtttgtttgataaataagttatc

SEQ ID NO: 50213 - DNA, 484 bp, Heterodera glycines
  SCN-specific regions: Sequence locations=1-166,190-484
gttccacggatttttcttgtaatggtggatttcgacacatcgtctttatacagtgtcaaggccattcttatccttgaccaggacgggaagaggataatggcaaaatattacgacaaacagctttttccactcgaaaaggagcagaatgtctttgaaaagaatgtttttcagaaaacccacaaagctaatgcggatataatccttttggatggcctcgtttgtctttatcggtataacgtcgatttgtttttttacgtggtcggaagtgcaaatgaaaatgaattgattctgcaaagtgtgctcaattgcctttacgaagcgttttcgacaattcttcgaaaaaatgttgagaaaaaggctctgttcgagcacattgacacgtcttttctcattatggatgaaatttgcgatgatggcattattctggagaccgatccccaggcagtggtcgcccgttgtgcggtcaaagcggacgaattggcat

SEQ ID NO: 50214 - DNA, 530 bp, Heterodera glycines
  SCN-specific regions: Sequence locations=1-404,429-445,477-530
gaggatttggcggatatcgcggcggtggggcaggtggtatgggaatgaaccgcacgcaaagttctcgttatggaccgcctatacagacgcgttatcgaatgttggtgactaatttgtcaacacgctgttcatggcaggacctcaaggatctgatgcgaaatgccggcgaagtcacttatgcggacgcacacaaaaaagtgagaaatgaagcagttgtctgcttcgccacccatgaggatttgcgacgtgcagtcgaacgttatcagggcaaggatataaacgggcgcagaatcaaactcgtagatgactccgaaggctatgccgggcgcaaaagtcgctctcgttcgccccgttcgcgttcccgctctccgcgttctcgtactcgttcaccgccttctcgttcacgctctcctcgttcgcgcagcgcttcgcctgctgaaaatggtcggtctcgttcccgatctcgttctcgctccccaactccaagtcgttcccgttctcgttcgccaaatgatgaaaagtgaaccaac

SEQ ID NO: 50215 - DNA, 500 bp, Heterodera glycines
  SCN-specific regions: Sequence locations=1-397,429-500
ccaagtttgagatgaatctccgcgatcaattttccaccaacaaatatgttgcgcatcgcttcatgcagttgccaacgcacaacaaagtgcaggtggaatatgtgtggattgacgggtcgggcgaaaatgtgcgttccaaaacgcgaacagtggactttgtgccgtccaaagtcgacgatttaccggtgtggaacttcgacgggtcctccactggacaagcatcgggtgccgattcggatgtgttcatcaagccggttgccatgtacaatgacccgttccgtatgggcaaccataaaattgtaatgtgtgaggcattcgacaacaaaatgcagccccatgtgaccaacaaccgtgcgcgatgtaagcagacaatggacgcggctgccaaagagcacgcgtggtttggcatggagcaggagtacacactgctggacgttgaccagcatccgttcggatggcctaaggcgccgttcggcttccccgggccccaagggccttat

SEQ ID NO: 50216 - DNA, 484 bp, Heterodera glycines
  SCN-specific regions: Sequence locations=1-484
gtttgagttacctaattactagtaattagccggcaaaaatgtcctcttccaacacaattttgttggactgcagcgacgacagtgccgtcgtcgtcggcttcgagcagtgcgccaccagcgaaggcggaggggcggtagaaccgcagcagaaactgactaagaatcagcagaagaagcgcgcacgcatggaacggttcaatgcggggaaagcggaatggagacggaagcaaagggagcggcataaggagcggaaacgcgcgcggaaagcggacggacagacggcgacggttgtgcacaacgacaggccgaacaaactgaacacgatgaacgagtccaaatgtcgcgttcgcgttgctgtcgacatggcctacgacgacttgatggacgaacggtcggtgtgcaaaacggtgtcccaacttcgccattgctacgcgtccaatcgccgggcggcggaccctctccaattttatgtggtcaatttgga

SEQ ID NO: 50217 - DNA, 613 bp, Heterodera glycines
  SCN-specific regions: Sequence locations=1-613
atttttgccaaattttcgcaaatcaatctacaattacgatacctatttttaacttgcactaaaatttacgcaatatgtcgttgaacacggcgaatacgccggacggacgtggggttatcatttacagtggtgaaatgattttgcttttcgttcgcgaggttaatctttcttttgacaaattcactaacgccgcgttcaaaggcacaaagaagggcaacctttacctaaccacgcacagaatcattttcaataacactgaaacttcgtctcgcggcaatttcaagtcgttgtcaatgcctttcggatgcattcgaaatgtgaagttggaacagcccatctttggcgccaattatttggctggcgaattggtcgcacagccggacggaaattgggaaggagaagtgaattggaaattgacgttcaatcggggcggatgcatcgaattcggccaagctttgctgaaaaccagcgaaatggccaataacttttgtcctcggcccgcaaatgcgccgccgccgtacgctccgccgcctggcgcttattactcaccaccacccgcttattattggagcggaggccaattcaacggataccaggcgccggtccacgcgtt

SEQ ID NO: 50218 - DNA, 723 bp, Heterodera glycines
  SCN-specific regions: Sequence locations=1-96,121-551,591-723
ctggagctccccgcggtggcggccgctctacaactagtggatcccccgggctgcaggaattcggcacgaggagagaatttcgctgagtgttttgctccaaattttcgtttcattcaaaaattgctgtctgtgctgcgaaaagttgcaggaaaatgtcatctgagtcaaatatggagaatttccccgtcaaattggacatggattatatcaaacggttggcacgcatcgaacggaccggccctaacacttttaatgccaattttcttgtggcaggctatcgcaaggcggtgaatagggacgttttcgggggacaaatgttcgcgcaggcaattgccgcggcagaagcaacggtggacggcgacgaatttgcaccgaacgcggcccattcgatgttcattagaaaagcattcattgaccatcccatcgaatatattgtcaccagaacgcgcgacgggcgttcattttgcactcggacagtcgaagcgcgacagaacggcgaaaccgttttctgtgcgcagatttcactttgcgttaaggaacgctcttccattgaacaccaaacagaaatgccagcggaagtgccggagcccgaggagttggtgccgttcttcgagacggtccgtcgagtggtcaccgaacacgacgagggcaggacggagcgtaacggacggaccatcgctaaccttcgcgcggtgctcgaggacgagcagcaaccgtccgtct

SEQ ID NO: 50219 - DNA, 775 bp, Heterodera glycines
  SCN-specific regions: Sequence locations=36-291,313-565,588-775
cctcgtgccgaattcggcacgagggtttgaggttaaatggcaaggtcaccgctgtttttactttccatttttatttgcactgaatttgtcctttgtgcagtaaaatcgaagaatcttttgaatctaaatgaggaaaattggcgaaacattctcagcggcgaatggatgatggaatttcacgcgccgtggtgccctgcctgcaaagacctccaaaaatcatggaattcattcgctgattggtcaagggatttgaacataaatgttgcggaaatagacgtgaccacgaatccagggctttctggacgatttcttgtcactgctctgcccaccatttatcacgtgaaggatggcgtatttcgactttacgcgggaccacgcgacaaaaatgatttcatctctttcatcgaagacaaacgatggaccagcatcgaccccctcccgtcctacaaacatccggacagctctcaaatgggcgtagtcgccgtcttcttcaaactgtccatggcagtcagagacttacacggacattttgtcgaaaatgtcggtgttcccgcttggggcttcgtatgcattctttgccacagtgactctcgcgttgggctgtgtcctcggatttatcatcgtgtgcattattgactatgtgttcccaactggggcgcttaagaagaaggaagccgagcgaaggaaggagcaaccaagtgccaagaaaaatgcaaaagaaagcgctgagaaagcaaatgggcaaaaggaagttttatcggacgaaaagaaatcg

SEQ ID NO: 50220 - DNA, 831 bp, Heterodera glycines
  SCN-specific regions: Sequence locations=1-88,110-831
gtccaattaagatcaaaggaaatggtctgttttccgccttctcttatgccgtctttccaatgtttttgtgcttcctcttcccgtctcttttgctcatctgcttttgttcgacccgtccgcgtgcgcttcgccccttcccccacgggggaacttcatttgggctccgttcgcactgctttgttcaattttctgtgggcacgtaaatacaacgggaaatttgtgttgcgaatcgaagacaccgacagagagcgattggtggagggatcggagcaaaggattgagcagaccctctcccactttggacttacacccgacgaaagtccgttgcgtggtggccaatttggttcctattaccaatccgaacggttgcctctttaccgggaattggctgatcagttggttgacatcggccattcgtacaagtgcttctgcagtcaagaacgactcgactttttgcgtcgaaaagcgaactccgaacgcattccgttccgttacgatggcatttgtcgccagctttcgacagaagaaacgcgagctcgggaacgaaacgaggaacaatttgttgttcggttcaaatttgacgggagaagggccggatttacggacatcgtattcggcgattatgaacattattcggaggagggcgattttgtgatcctcaaaagggatggatttcccacttatcactttgccaatgtcgtggacgaccgacggatgaaaatcagccatgtaataagaggagcggaatggatatgttcaacaacaaaacacttgcaaatttacagtgccttcggttggtctccgccacactttgcccatttgcctctgatc

SEQ ID NO: 50221 - DNA, 561 bp, Heterodera glycines
  SCN-specific regions: Sequence locations=1-298,341-516,543-561
gtgtgctcagagtgagcgatttaaccaaagccaacgaaagagtacccttccgtttgctgaacctttccctcgcttctttggatgtgaatatgcgccccttttgcgactctgagggccattcggccgtccgattgcccggctttttgctcattttgtccggccaaattgtcctttcgcgccctttgcctccactgaatgcgtcgtcccttcgtttgtctctcactttggagcaaaactccgtttgggtgggccgaatttgtgacaaagggcgaagtcaaagtgcctttttatccgacgatttttgttctttttctctgtgctcccttctgccggacgcgtgcaattcgctggaggctttggcttccaaatatgctgagagtgatttccccctgcttttgccactgtccgatctgttcccgactgatcagccaattgctctcgtgccaatggccaatttcccattgctcgagggctattggaaggcgcctgcgcaaatccaagcggacgacggaaacgccatggaggaggaggaggacgaacagaatgagcagcatattctga

SEQ ID NO: 50222 - DNA, 475 bp, Heterodera glycines
  SCN-specific regions: Sequence locations=1-475
cagatgttgaaacagggcgactcaaattgtcacagcaaaaaagcgtcagggagccgttacagtgaattatttgaatgcattcgggacaatttgctgactttcatcaaggccaacatgcgccaaatgctcttcgacaagatttccgctgtccttgttcttgacactttggaagtcccgtcaccttcggatccctttcttcgtgaaattggcgacagcgatttggatgactgtttccgggcaattgctgagattgccactgacgaattcgtcccccactcgcccgatgggccgtcccatattgtgcagggcggttgcgctcgcttcgtgttccgcaaactgttgcaggcggacctgggacggtgtgacggacaccgcctcagcgacttcctggccgaccttccggccgacaatttgtcctcctggaccagcatggactgcggatgttacaccctggtggaggtgttcaagagcgggt

SEQ ID NO: 50223 - DNA, 481 bp, Heterodera glycines
  SCN-specific regions: Sequence locations=1-481
gacactttggaagtcccgtcaccttcggatcccttccttcgtgaaattggcgacagcgatttggatgactgtttccgggcaattgctgagattgccactgacgaattcgtcccccattcgcccgatggtccgtcccatattgtgcagggcggttgcgctcgcttcgtgttccgcaaattgttgcaggcggacccgggacggtgtgatggacaccgcctcagcgacttcctggccgaccttcccgccgacaatttgtcctcctggaccagcatggactgcggatgttacaccctggtggaggtgttcaagagcgggtcggacaaggcccgcaaggtgctcagacgggcgctcagtgtggccatgttgcagaattcgcatttgtccggcgccaagtctttgttggatttgctattgggcaaaggcaaagagcaaccgacgcgggaacattcggtggctaatggcggcggcgctggtcgaaaaa

SEQ ID NO: 50224 - DNA, 1286 bp, Heterodera glycines
  SCN-specific regions: Sequence locations=1-1146,1168-1237,1269-1286
gtcttttctttccgatgtctgaaattggtaatttcgaaataagaaatgtgtctaaagtcgaacgtatcggtgcacattcccatatcactggtctcggcttaaaggcaaatttcgaaccaatttttatttccgatggaatggtcggacaatgtgcggcacggaaggcagccggattgattgttcgcatgattaaagatggacaaattgcgggcagagctttgctaattgttggcgagccggggacgggcaaaacggcggtggccatgggaatttcgaagtcaattggcggcgatacgcccttcatttccatttcggccagtgaagtgttttccatggatctgagtaaacccgaagcattgactcagtcattccgaaaggcaattggagttcgaatcaaagaggagactgaggtcctttgcggtgaggtcgtacaactcgaaattgaccgtccccagtcgggtgccgggccacgagttgggaaattgactctgaaaacaacggacatggaagcaatttacgacattggaaacaaaatgactgaatccgtcatcaaagagcgaatcacggccggcgacgtcatccaaattgacaaggcaaccggtaagatttcgaaaattgggcggtcgcttgcccggtcaaaggatttcgacgcacttgggccccaggacaaattggtcgcctgtccgtcgggggaaattcagtcccgcgtggaaacggttaacacaatttcattgcacgacattgatgtgatcaattcgcgttcctccgggtatttggcggttttttcgggcgatacgggcgaaattaaaagcgaagtgagggagcaaattgacaaaaaggtgatgggatggcgggaggaaaacaaagcgcaaataatcccgggtgttctgttcgtcgacgaagtgcacatgttcgacctcgagtgcttctccttcatcaaccgttacatcgaatcggacctttcgcccattttggtgatggccaccaaccgcggcattgtgaacattcgtggcacttccgttgagtctccccacggcgtgcctttgttcttattggaccgcagccttatcatcaggacgtcgagttacaaagaaaatgaaattggagagatactgaaaatccgtgcttctgatgaactcgttgaaatggaggatgccagcatcgcagtgctcgtccaaatagcattggaaacatcgatgcgttactgcatgcaactcatttcaactgccgacattttacgacagagaagaaaaggcgaaaagacaaaatgtttacgtcactgaaga

SEQ ID NO: 50225 - DNA, 891 bp, Heterodera glycines
  SCN-specific regions: Sequence locations=1-563,594-891
gttccttagactgtctcccgctttttccattgtcgcgcgttgtcccctgtgaatttggtggttcatccgtttgtcgctaggaagtgcgcctttttgtctacaccatctttgtcttttccatttcggcgtcaatactcatcattggcatctgctacaacgacgggagcgagcaacgacaagctgaatgtggacaaactgttcgaaaaaataaactttgaagtgcgcggtcacgacttcacagtcctcaagtcgtattcgctttttgttatgaatgtgtgccgtgtgttggacatcgatttcacttctcggcatcgtgctatgatcaatacggatcattccaagagtaaccgacccaaataccagcgatggttccagtggctgctgagcgcaaaatttgcaaagaaaaaatacaaattgcactatgaaacgcggacttatttgatggagttcgatgtgcatcacttgacgggaagcactgcgagtgcttttctggaatatatcgaaaggaatatacccgagggagtggccatgaaagttacatataccgagatgtgctttctgccagaaactattgttaaaacagtgatggataattagttctttgtcgtacatgataaaacattttatgattttcaacagtttgttcatgagctgataaattcatttttcgtaacaatccaatactgattggcatctcgattcacttctgctccgtcctttttcttaagtgtggtggaatatacacatttccgcctccagctgccggagtctcttgcgaagtcggttgcggtgtcgccgctggctttgacacggttcgccaactgttctgggaatccgctgtgctagtgattccagtcggtttggttctccaatttgaatccccttcattag

SEQ ID NO: 50226 - DNA, 814 bp, Heterodera glycines
  SCN-specific regions: Sequence locations=1-327,350-616,638-814
agtcaacgtccaccgatattgagtttcaacatcatcgccatgtggcagtgcccgcctccgaattgacgccgtccccgtcgaccaccaccgcaacggccactgacgatggttcaacaacaacaaacgctgctgcggatatggaacaacacgaaaatgctgggcgtaaacggcacacaaaggaccggttccgctacggtaactacaaccgctactacggtgtgcgcaaccaaggctttgaccacgacccccgtgtcgacttgtttcccgtccaatggttccatgggcgtcgcgtgttggacattggctgcaatgttggccatttgacgcttgaaattgccaagaagttgggcccagcgcatattgtgggcattgacattgacgaccatttggtcggtgtggcgcgcaaaaacattcggcattattgtggcagcgcgcaaaagctgatcggcaaattccccgcctcactgttaccaccggcggaggaggcggaagcgtcgtcaacaaatgctgtcaatgacgacggcaaaagtgccacaaaaatggagtcggaaaatgggaaggaggaggggccatcttcgaccaccgcaaagcccgccgttctcccatatgggcaattcccaaaaaatgtgtggtttttgcgcgaaaattacgtgctcgactgtgacgagttccttgaaatggttcgcgaggagtacgacgtgattttggcgctgagcatcaccaaatgggtacatttgaactggggcgacgatgggctgaaacggttcttgcgtcgcacctttttgaaccttcggccgggcggacgactgctgtt

SEQ ID NO: 50227 - DNA, 1140 bp, Heterodera glycines
  SCN-specific regions: Sequence locations=1-53,89-89,146-154,184 -192,215-271,356-907,932-1007,1029-1140
ccaagtttgagcagagccgggcccaaacacattctctcccgtgagcagcaatcagcaaaagctgaacacactccttcgaactcactgattatttgatccatctctgagagcaacttctgatcagccaaagatgccggaaagcgaaaacgacttcgatgaggaggcgcccaacgccaccatggagaccaaagtggcgggcggcggcgcggcgccgaagcgcgtcgggcgctggacgttgtcacagctgcgccagacggacggcatcatcccgtcccaggccggttggaacaagggagactcgcagaagttgatgaccaactttggtacgccgcgtaacaccaccaccaaagtcaaagtggagaatctggccgagattccggaggacattttgctgaaaagccacggggaggtgcgtctgcagtccggtaccaaccggttcgcctcccagaagggctttgtttcgttcggtaccggacgtgatgtgtgtcgtgaaggtgtgaatgtgaacatcctggccggccgacttggagccgcttgccgggaggagaaaatccgcgccagtgacggccattgtgcgtctgcaagccggtacgaacaaattcgactcgcagaagggcatgaccctgttcggtaccggacgtcgtgagaccaccagaatgaaggacagccaagcacccggagtactcgcacgagcgcgacattgacaacacggagattccgcttcagatgggtacgaacaaattcgcctcgcagaagggcatgactggcttcggcacaaaccgtcgtgagaccaccaaaatgttggacacctcgcacccggagtacagccacgagcagagcatcgaccagaccagcatcccctaccaaatgggatcgaacaaatacgcgtcgcagaagggcatgaccggctttggacagccacgttgggaggtgcttgacccgtccatttcgtaccagaaccgcaagtcgcaaggcatggttcgtctccaatccggcaccaaccgattcgcctcccaggcgggcatgaccggctttggcacgccgaggaacaacacctacgaggcggaggcgggcgagctgccttacgaggatatgaagaagtcggaggcgatcatcccgtcccaggccggatgggacagg

SEQ ID NO: 50228 - DNA, 829 bp, Heterodera glycines
  SCN-specific regions: Sequence locations=1-11,35-178,204-829
gtttgccgtcctttggctgtggtaaaactgtcatttcgcagtcgttctctcaaatattccaactccgatgccattatttacgtgggctgtggcgagcgtggcaacgaaatgtcggaagtgttgcgcgactttcccgaactgacgatggaagtggatggagtgaccacgtccatcatggagaggacggcgctggtggccaacacttcgaatatgcccgtggcggcgcgtgaagcgtccatttacacgggaattactctggccgaatacttccgcgacatgggtctgaacgtggccatgatggccgactcgacctcccgatgggccgaggcgctccgtgagatttcgggccgtctcggggaaatgccggctgactcgggttaccccgcctatttggccgcacggctcgcttccttctacgaaagggcgggaaaagtgaaatgttttgggtcgcctgaacgcgaagggtccgtcactattgtcggcgcagtgtcgccgcccggcggagacttcgccgaccccgtcacatcggcaaccctcggcattgtccaagtgttttggggactcgacaaaaaattggcccaacgaaagcacttcccttcaatcaattggctcatttcttacagcaaatatatgcgtgcgttggacgattattacgagaagaattttgccgaatttgttccactgagaacgaaatgcaaagaaattttgcaggaagaggaagatttgtcagaaattgtccaattggtcggcaaagcatcgcttgccgaggccgacaaaatcactttggagctatgatcgcttctgtcccttctacaaaactgttgggatg

SEQ ID NO: 50229 - DNA, 1968 bp, Heterodera glycines
  SCN-specific regions: Sequence locations=1-62,85-252,274-697,719 -778,802-944,970-1968
caaaaagttaaacttttcctcaacccgcgacaaaaaatgccaccgacgacaagagaacacattaaggaatcccaatatggctttgtttacggcgtttcgggaccggtggtaactgctgagaaaatgtccggtgctgcaatgtacgaactcgtcagagtcggccattctgaattggtgggcgaaatcatccgattggaaggcgactacgccacgattcaagtctacgaggagacttcgtccgtcacaatctgtgaccccgtgctgcggacggggcagcctttgtctgttgagcttggcccgggcattatgggctccatttttgacggaatacaacggccattgcacgacatttcagaaatgaccaaatccatttacattccgaagggggtcaatgtgaaggcattaaaccgtgcaaaacgatgggaatttatgccgaggaaagatttgcgagttggggaccacgtgacgggcggagatatcatcggaatggtgcacgaaagtgcgttggtcaagcacaaaattatggtggagccgaaggcgtgcggaacggtcaaattcatcgcccccgcaaggccaatacaccgtcgaagacaccattttggaagtcgaattcgctggacacacccaaaagcttacgatgatgcacatttggccagtcagaaacccccgcccgtccgccgaaaaattagcggccaatttccctctcctctgtgggcagcgcgtgttggacgcgctcttcccgtgtgtccagggcggcacaacggcaattcctggtgcctttggctgtggtaaaactgtcatttcgcagtcgttgtccaaatattccaactccgatgccattatttacgtgggctgtggcgagcgtggcaacgaaatgtcggaagtgttgcgcgactttcccgaactgacgatggaagtggatggagtgaccacgtccatcatggagaggacggcgctggtggccaacacttcgaatatgcccgtggcggcgcgtgaagcgtccatttacacgggaattactctggccgaatacttccgcgacatgggtctgaacgtggccatgatggccgactcgacctcccgatgggccgaggcgctccgtgagatttcgggccgtctcggggaaatgccggctgactcgggttaccccgcctatttggccgcacggctcgcttccttctacgaaagggcgggaaaagtgaaatgttttgggtcgcctgaacgcgaagggtccgtcactattgtcggcgcagtgtcgccgcccggcggagacttcgccgaccccgtcacatcggcaaccctcggcattgtccaagtgttttggggactcgacaaaaaattggcccaacgaaagcacttcccttcaatcaattggctcatttcttacagcaaatatatgcgtgcgttggacgattattacgagaagaattttgccgaatttgttccactgagaacgaaatgcaaagaaattttgcaggaagaggaagatttgtcagaaattgtccaattggtcggcaaagcatcgcttgccgaggccgacaaaatcactttggaggtggccaaactgatcaaggacgatttccttcagcaaaatggctattccagctatgatcgcttctgtcccttctacaaaactgttgggatgctcaaaaatatgattggcttttacgactttgcccggcactcggtggaaacgactgcacaatcggacaacaaaatcacgtggaatcagatcagagatcacctcggggacatcattcacgaactttcttcgatgaaatttgaggacccatccgaaaaaaacggaagatcagatcaaaaaggattacgaagaactgtatgaacggatgcagaacaaattccgagcgttagaggatgaatgaacaaactgtgatcaatgataacaatttctcaaaattttccctcatttctcttagtgtagtgatggaaaaaacgtctcagtgagta

SEQ ID NO: 50230 - DNA, 1681 bp, Heterodera glycines
  SCN-specific regions: Sequence locations=1-464,486-552,575-1078,1100 -1616,1638-1681
aggcacattaaatgaaatttatggcctcgatggtggcgtcatttcctgtgtcatttttcctgtttttttctacggctctaatccacggcacaatgggaggccttttctggtcgaaaaagccggcggattcagcggacgattcgctgtggagccgataccatgatcaaaatgcaatggaagagttgttggagaaggtgcacagcaaatgccccaatgtcactcgtctgtacagcgtcggccgatcagtccaaggccgcgatttggcggtcattgaattttccctccatcccggacggcatcaaattttgaagcccgaaatgaaatacatcggaaatatgcacggcaacgaggcgatcggcagggaattgctgctgcgattggctcaattcctctgcgacggatggcggcaaggccaacggtcggtggtggagatgctcaattcgaccaacattcacattatgcccagcatgaacccggacggctttgagttgacgctgaagacaaagccggaacagcgcggatgggtcacgggtcgcacaaacgcgcacggggtcgacctgaacaggaacttccccgacttggacgcgatcttttacaaggccaacgcacaacggctgccgttctttgaccatttgctggaagtgttccacgactccgacaacggccaacagtttgagcccgaagtcactgcagtggccaattgggtgctttcgtggccttttgtcatttccgcaaatctccacgagggcgatttggtggccaattatccattcgacgaaagtctgaacccgaacgaacttcgcgcctattcaaagtcgcccgatgacgtcacttttcgatacatcgccgagacttacgcccgtgcacacgcgcacatggcgaagaatgaccacgcgccatgcgatgggacggcgggggacaatttcgcgagacagggcggcataaccaacggtgccaaatggtactcagtggcgggcggaatgcaggacttcaattatttgtccaccaatgccttcgaaatcactttggaattgagctgtgagaaaatgccggcgccggaacgactcccccaattttgggttgacaataaattggcattgttggaattcattcgtttggcacacattggcatcaaaggaatggtcagcgatgcacgtaacggtgaaccaattgcaaatgccgtggtgtgggtgagaaatgtgaccgacggagacggacaaacggccatcaaacacccggtgaccacgtggatcactggcgattatttccgtccgttggtctccggctgttaccaaatcgcggtggaagcggacggttatgaaattggcatcaaaacgctgaacatcagtcagaaggacgtgaaggaacgacgtccacacattgtgaacttccaattgcgtccgatcgaagttgaagtgccggaggcgcgaattggaagagaaatgggcgaggaagaacggggggaggaggagaacggaccactgacaccagaacaagcagccgaatttttgcaactcatccgaatgcaacagccggtgggcgtacggactgccaatgcgccgtccttctcacaatgaaacggaacaaaagagaaaagggatgatctcgacagaacaatggacagacaaaaagcagcagaaacgaagtgttggttgatatgatttgtgttgtgtgtacattt

SEQ ID NO: 50231 - DNA, 727 bp, Heterodera glycines
  SCN-specific regions: Sequence locations=1-506,529-727
gtttgagctaattatggcacggaatcggccaaatgctaatatcataacgagtgatctcggcgaggcacaaataaaaaagcacaaaccaaaagacacgaggttactacaacagagactcgttgcatggcagcctattctgaccgctaaaacggtcattccgttggttttcagtataagcattttgttcatcccaattggaattgttcttcttcgcataagtcaatctgtccaggaatatgtcgttcaatatgtaaacgatgccaacgagtgcaaagactaccatgcgaatggccaatgcgcagtgaacttcactctgaatgaggacttcaaaggcgatgtttacttttattatgctctcgagaatttcttccaaaatcatcgtcgttatatgaaaagcagaaatgatcagcaattatcgggcattgattttttaaataccaaagattgtactcccttcgagaaagctccggacggtcgtccgatcgccccttgtggcgcaatagcaaattcattattcaatgattcattccaactcaattatcttgggcgtaatggcaatggttatgcaaatatttcatggagtcacgaagggctcgtctggccggtcgatttggagtcgaagttcagaaaccccacttgtgatggccagccatgcaaaacaatcgctgaattgtgtcacaaattttccttaaccgtccgaccgcccaactgggaaaaggacctctgc

SEQ ID NO: 50232 - DNA, 479 bp, Heterodera glycines
  SCN-specific regions: Sequence locations=1-265,291-479
gtatgtatcagtttctttaaaatttgagaattaataattttgtgttcaaatgtccaacgacaacgacaaaagagatgcatcatcaattccaacgaatgcccttgttaacaaagaagagtctccggacggaaatgaagagaagaaaattttctgcggtgggataagctacgaaacatcgaatgaagatttggctgtttatttcgggcaatatggcaaagtgaaggaagtacaagtgaaatatgatcgagtgactggacgttcgcgcggtttcgcctttgtggagtttgatacggttgcagcatgtcaggcatcgctcgtacaacgtgaacaagtgataaaaggcaagcagtgtgagataaagccggccaaatcgagggaagttggctacatgaacaagaaggtatttgtcggtggattgcctggagatttcccagaagaagaacttcgaaagcacttcaaccagtacggcaaggtggagg

SEQ ID NO: 50233 - DNA, 964 bp, Heterodera glycines
  SCN-specific regions: Sequence locations=1-912,934-964
ccctcaatacggcgtttctcagcccatatgtacgaaggaaccaacagaaaaggatttgagactaacgaaagaactcgagagttatctaagaagctctggcattttcgagtcggacttggacatacagaagagatttgatgtcttgaggaggataaattcgttggtcaaaagttgggtcaaacaagccttttttttataggtaccgcccgaacagttggacactgtcggtggcaaactgttcaccttcggttcctaccgtctcggcgttcatacgcccggggctgacatcgattctctgtgcgtcgtcccccgtcacatcgaacgcatcgatttctttacttcattttaccaaatgcttaaagaggatgaaaaaacggcggacctccacaaagttgaggacgccttcgtacctctgatcaaactgcgctacgatggcattgaactcgacattttattcgctcgtttggcgttgaaagaaataaaggaagaccaggaactctcagacgacaatttgcttaagaacttggacgagaagagcattcgttctctgaatggttgtcgtgtggccgatgaaattttgcgattggtcccaaatcgactgaatttcattttggttcttagagccggtaagctttgggctaaaaaccatggcatttattccaatgtgttgggctttcttggcggcatttcttgggcaattctcgtcgcccggacctgtcaattgtatccaaatgcaacaccttctgttttattgcagaaatttttcctcgatttttctgcatgggattggccacatcccgtcattctgaaggatgtcgacgctaccccgcggattgacataccctatttcattgacatgatttgggatccgagaacacgcgcatcggaccgctaccatttgatgccaatcattacgccagccttcccagaacagaattccacatttaatgtgacaaggtcaacg

SEQ ID NO: 50234 - DNA, 815 bp, Heterodera glycines
  SCN-specific regions: Sequence locations=1-500,522-684,713-769,793-815
ataaaattcactgactgttctttttcaccttccttcaattcaacaaaatggcgaaatctgcaattgatgttaatcgcggcatcacagaagaccaaacagctaccataagaaattatttcacacaaccgcacttaatttacaaaactgtcactggagtgcgcgggcctttggtcatattgggcgatgttaaattcccacaatacgctgaaattgtgaaacttacactgcctaatggagaaaaacgcatgggacaagtactcgaagtaacgaaggacaaagctgtcgttcaggtgtttgaaggtacgtcaggtatcgatgcaaaaaacacaatttgcgagttcactggcgatattatgagaacacccgtttccgaggatatgcttggaagaatattcaatggatccggcacacccatcgacaaagggcccaatgttttggcggaggattacttggacatcgatggacagcctatcaacccatggtccagaatttatcccgaagaaatgattcagaccggcatttccgcaattgatgttatgaatagtatcgccaggggacagaaaattccaattttttctgctgcaggtcttccgcataatgagatcgctgctcaaattgtacgccaagggggcctcgtcaaacagccgaacagaaagaaggaaaatgaggtggagggtgacgacgactttgccattgtgtttgctgcaatgggtgtcaacatggagacggcgcgctttttcaaacaagactttgaagaaacggttccatggaaaatgtgtgcctttttcttaacttggctaaatgaccaaccatcg

SEQ ID NO: 50235 - DNA, 829 bp, Heterodera glycines
  SCN-specific regions: Sequence locations=1-175,199-829
aattttcctataaatttattaattggactgcttttgctgttgctcaatttcgatggcagaggaaccagtgaaactgattcttgtcaccggcggagtgatgagcggcgttggcaaaggcattgtgtcgtcgagcatcggtgtcctattgaagggttgcggttaccgagtgactgtgatcaaaatcgacccgtacatcaatgtcgatgctggcactttctctccattcgaacatggcgaagtttttgtgttggatgatggtggcgaagttgacttggatcttggaaattacgaacgttttttggacattcgactgacacgggacaacaatatcacaacgggtaaaatcttccaccaggtcatccaacgggagaggaacggcgactatttggggaagacggtcaaaacggtgccgcacataaccgacgcgatcattgaatgggtggagagagtttcaaagatttctgttgatggcagcggaaagacaccgcaaatttgcattgtcgagctcggtggcacaattggtgacattgagggcatgccgtacacaatggctttcagcatggcatttcgccgcaaaacataccgtaatcgttttctgactgtgcacgtgaccaaattgttgcacgagtcgggcgaaataaaaacgaaaccggcgcagaatgggctgcgcagtcttcgcgagacgggcctttaccccgaccttttgctctgtcgttctcaaaaaccgttgacccaagcgctgcgctccaaaattgccagctttgcccaattggacatcaacgaaatcatcgacgtgtacgactgtcacgacattcacagtgtgccgttg

SEQ ID NO: 50236 - DNA, 1432 bp, Heterodera glycines
  SCN-specific regions: Sequence locations=1-341,366-642,664-664,687 -695,722-779,805-931,984-989,1011-1012,1047-1221,1243-1432
ccaaaccgatttggactcgcaatcccgatgacatttcaaatgaggagtatgcggagttctacaagagcttgtcaaatgactgggaggaccatcttgctgtcaagcatttcagcgttgaaggccaactcgaattccgtgctctcctcttcgtcccccaacgcgctccgttcgatctctttgagaacaaaaagagcaagaatgccatcaagctttatgtccgtcgggttttcatcatggagaactgcgaggagctgatgccggagtacctgaacttcatcaaaggagttgtcgactctgaggaccttccgctgaacatttctcgtgaaactttgcaacaatcgaagatcttgaaagtcatccgcaaaaaccttgtgaagaagtgcatggaccttttcgaggagatttctgaagacaaggacaacttcaaaaagttctacgagcaattcgcgaagaacattaagcttggtattcatgaggactcggtgaatcgtaagaagctctcagactttctgcggtactacacttcggcctccggcgaggaaccatgcagcttcaaggactatgtttcgcgcatgaaagagaaccaaacatgtatctattacatcaccggcgagtccaaggacgttgtccaaaactcctccttcgtggagcgtgtgaagaagcgcggcttcgaggtcatctacatggtcgacccgattgacgagtactgcgtccagcagctcaaagaatacgacggggaagaagttggtcagtgtgaccaaggaaggccttgagctgccagagagtgaggaggagaagaagaaatttgaagaggacaaggtcaagttcgagaagctgtgcaaagtcattaaggacatcttggacaagaaagtccaaaaggtttctgtctcaaaccgtttggtctcttctccgtgttgcattgtgaccggagagtacggatggtctgccaacatggaacggatcatgaaggcccaggcattgcgtgactcctccacaatgggatacatggcgtccaaaaagaacctggagatcaaccctgaccattcaatcatcaagtctttgcgcgaccgtgttgagaaggagcaggacgacaaaactgcaaaggacctcgttgtgctgctgtacgaaacttctctgctcacctccggcttttcattggaggacccgcaacagcatgcgtcgcgaatttaccgaatggtgaaacttggacttgacatccccgacgaggaggagccggccgagcaacagccgagcacttcgggcgagccgacaattgcggagaaaattgctggtgccgaagaggaggcctcgagaatggaggaagttgactgaatggtgacatcgtctatccattcttggatctcggctattcaatattttgattcattgtttttttgttttcttgtttgacataaatttgaattaaattttc

SEQ ID NO: 50237 - DNA, 1068 bp, Heterodera glycines
  SCN-specific regions: Sequence locations=1-263,292-306,328-340,363 -620,662-778,814-1068
gtttgaggtagtgtaataaattcttattgtagtaaaaatgtccgaaaataagtccgaaggtggcgctgaaaagaagaagagcggtggattcaacacgaagaagtttttgttggacctcgcatccggcggaactgctgctgcagtctcaaaaaccgctgttgcacccatcgagcgtgtcaagctgttgttgcaggtgcaagatgcttccattcacatcaccgcggacaagcgctacaaaggcatcatcgacgtcctcgtccgtgttcccaaggagcagggctttctgtcgttgtggcgtggtaacctggccaacgtcatccgttactttccgactcaggcgctgaacttcgccttcaaggacacttataagcgagtcttcacgcaaggagtggacaaggagaagcagttcttgaagttcttcgccatgaatttggcttcgggcggtgccgctggcgccacttcgctgtgttttgtgtaccctttggactttgcgcgaacgcgtttggcagcggatgttggaaaggccgatgcccgtgagttcaaaggtttggccggactgcatcatgaagatcctcaagtcggacggtcccatcgggtctctaccgcggcttcttcgtctcccgtccagggcatcatcatttaccgcgccgcttacttcggctgcttcgacaccgccaaaatgctcttctccccggagggcaagcagatgaacttcttcgtcaactgggccattgcgcaggtcgtcaccgtgtcgtccggcgttctctcctacccgtgggacaccgtccgtcgtcgtatgatgatgcagtcgggccgcaaggacatcatgtacaagaacactttggactgtgccatcaaaatcatcaaaaacgagggactgctcaagggcatgttcaagggtgctttatccaatgtgttccgtggtactggcggtgcccttgttcttgcgttctacgacgaaatccagaaatatatccactgattgtgtgtgatcttcttagtatatttgtttgtgttgcgtcatattcggtcatttgggtaatgataaagaagataggtgtgttaaaa

SEQ ID NO: 50238 - DNA, 624 bp, Heterodera glycines
  SCN-specific regions: Sequence locations=1-35,61-624
gtgatttaagaaggacggactcggaaagagcaaagtttaaataatgaaagaagctaaaaaccttagtgcttccttcggccgggcttttttctttggattcgcctgaattgtttggtcacaattcgccttccctcaccgaaaaccttcgtccgtcggcatgtccaccaggtcggccgcctcgtcctccaaaaactttcggatcgaagctctgacggcgtcgtcgctctcctcgttggcggcgatgagcttattcttggagaattcatccagcagtttctccgtttgttcgtccgcctgaaaatggccactatttcgctgactttgagcaccaaactcactttaacattcagacgtttgtcgccgatggggaagtccttgaggacactcagtgctttctttgctccgtctgggtacataaagtcgcaaaatccaaacgctttaaattttccgcctgagtcttggagacgtttccaattgcacacggaaccgcacttcttaagtaataaaggttttaagagaattaatttttacgaaaaacaagacctttagaacttcctgtatgattcggtccggacatttatcggaaatgttcccaataaaaactgttgtggtcgttggtggccc

SEQ ID NO: 50239 - DNA, 956 bp, Heterodera glycines
  SCN-specific regions: Sequence locations=1-494,518-789,817-893,919-956
ttttgttttatttgtgctttttccacgctcaaagtcccattcattcctttgcttttgccgatcgattgatccgaacaaaacaaaatataatcgaagtccaagagaagacgacgtaaaggaatgccttcgggaggcgacgatgaacaacagtttgaggaggcggtcaaaccggcattggagtcccttttggcggatttgcaaaagaccaccgaagttcttcggcaaggcaaacatggcaaaggccgacggcaacagaaggaggacgaatccgccgctttgttggacttgaagaagcttcggaactctccccgccagcgaaaccaatcgccggcagcggtcgccaatttgcgaaacggaagaagcgaagagctgcagcctcgccgtgacccgatgcttgagggcgacaaattgggcatccacacgataccgaagggggactgtgcttcgtgcaaccaagcagtgattgggcccgtggtgatagcccttgggaagatgtggcatcctgaacatttttgctgcgctcattgcggagcattccattgaaaatcggaattttttcgagcggcaaggaaaggcgtactgtgaaagcgattaccacgatttattttcacctcgttgttcctactgtaacgggcccatcaaagaacgttgtgtaacagcacttggcggaaagaattttcacgtggagcattttgtttgcgccgaatgcggcaaaagcttcggagacggcggattccatgagaaatccaattccgcgtactgtcgcgattgtttctaccgtacttacgcgccccaagggcagtcctggcaacagccgatcactccccaaatcctcacggcactcaacacacattggcaccccgaatgcttttgctgccgggaggggggccaaacccttccctgggggcccccggttccaccattttgggccccccttctctggaaaaagggccctc

SEQ ID NO: 50240 - DNA, 600 bp, Heterodera glycines
  SCN-specific regions: Sequence locations=1-120,162-231,253-274,391 -461,485-551,573-600
cacagccgaaaagcgcttcttctcatcgccttcgccttcaaaacttagaagcaccaatcccaaccagaaaaaatgtgcgacgaagaagttgctgctctcgtggtggacaatgggtccggaatgtgcaaggccggtttcgcgggcgatgacgcgccccgcgcggtgtttccgtccattgtgggccgcccccgtcatcaaggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgcgtgtcgcccccgaggagcacccggtgctgctccaagaggcccggctgaacccgaaggccaccggagaaagatgacccaattcttggttcaaaagtttcacacgcccggccttgtacgtggccatcccagcccggcttgtcctttaaccctcgggccgaccacggggttctggttgaaccccggaaatggggtgcccccaccccggcccctttcacaagggttatccctttccccagggaatt

SEQ ID NO: 50241 - DNA, 446 bp, Heterodera glycines
  SCN-specific regions: Sequence locations=1-446
cttttttggcatttcaatccttccaaaagcgcactttcggtgccaattccgtctgtttggtggtcagctgttcagtgacgatgcttttgctgatttgtttgccgtgccgagtgtagatcagaacctgcgcccttcggctgtcattgccttttccttgcccttcccctaattacttgcacattgacattgttcgggaagcgaatcggtgcccggtaatgaagggcgagagtgatcagaaggtgaaggatggccacaatgtcctaaactttggtcaataaccatcattgagcaaccactctctggcgataaaatccattaatcactctaaacaattggatgagccgtcgtccctctgattaatctcccgtccctcctatctgataaactaattgtttgatcagcgttcctctgatcattaattggttctgatcagtcgttctcattcc

SEQ ID NO: 50242 - DNA, 1135 bp, Heterodera glycines
  SCN-specific regions: Sequence locations=1-234,265-346,370-1066,1088 -1135
gcaccaaatgctaacgcagcctcggctcaaacaacccaaccgcaggttatggcaccatcttatccgttggcttctctctatgtcggcgatcttcatccggatgtcactgaggccatgctctttgagcggttcagcaatgctggtcctgtgctctccattcgtgtttgtcgtgatgcaattactcgtcgttcgcttggctatgcctatgtgaattttcaacaaccggcggatgctgaacgtgctttggacaccatgaactttgacatgatcctgaacaagccaattcgcattatgtggtcgcaacgtgatccaagcattcgtcgctcgggtgctgggaacattttcatcaaaaacttgggcaaggaaatcgacacgaaggccatctacgacactttttccatgtttggaagcattctgagctgcaagattgccactgacattgagggaggaagcaaagggtatgggttcatccattttgagactgaggaagcggcgaacagtgcaattgcgaaagtgaacgggatgcttttggatgggaagaaagtgtttgttggaaaatttgtgccacgcactgctcgtgagaagcaaattggtgacccgtccagtcgtttcaccaatgtttatgtgaaaaattttggcgaggcaatggattcggagaagctgagcgaagtgttctcacagtatggcgaaatcatcagtgcaaaagtgatggaggatgacagcggcaaatccaaggggttcggctttgtcgcctacaaggaccatgaaagtgctgcgagggcggtggagaagatgaacgaggtttcggtgccaggcagtgagaaggtcgagcaaaagtttacggtgtgccgtgcgcagaagaagagcgagcgccaggctgagctgaagcgtcgttacgagcagtacaaagctgagcgcatccagcgttatcagggagtcaatctgtacgtcaagaacctgcacgataccatcaatgatgagacacttcgaagcaattttgaatcctacggaaacatcacaagtgcaaaggttatgtgtgatgagcatggtcgctccaaaggattcggttttgtgtgctttgaaaaggcggatgaagcaaccaaggctgttgtggaaatgaacaacaaaatcatcg

SEQ ID NO: 50243 - DNA, 2059 bp, Heterodera glycines
  SCN-specific regions: Sequence locations=1-23,45-390,414-483,506 -768,809-1110,1132-1667,1689-1757,1780-1933,1955-2059
ggaaaatccttaaaatggcgcaagcagttgctgctgttgctcccgcacctaatgcaaacgcagcctcggctcaggcaacccaaccgcaggttatggcaccatcctatccgttggcttctctctatgtcggcgatcttcatccggatgtcactgaggcaatgctctttgagcggatcagcaatgctggtcctgtgctctccattcgtgtttgtcgtgacgcgatcactcgtcgttcgcttggctatgcctatgtgaattttccgcagccggcggatgccgaacgcgctttggacaccctgaactttgatatgatcctgaacaaaccgattcgcatcatgtggtcgcaacgtgacccaagcattcgtcgctcgggtgctgggaacattttcatcaaaaacttgggcaaggaaatcgacacaaaggccatctacgacaccttttccatgtttggaagcattctgagttgcaagatttccactgacattgatggaggaagcaaaggatatgggttcatccattttgagactgaggaagcagcgaacagtgcaattgcaaaagtgaacgggatgcttttggatgggaagaaagtgtttgttggaaaatttttgccacgttccgctcgtgacaagcaaattggtgatccgtccagtcgtttcaccaatgtttatgtgaagaattttggtgatgcaatgaattcggagaagctgagcgaagtgttttcacagtttggcgaaatcatcagtgcaaaggtgatggaggatgacagcggcaagtccaaggggttcggcttcgttgcctacaaggaccatgaaagtgctgcgagggcggtggagaagatgaacgaggtttcggtgcccggcagtgagaaggtcgagcaaaagtttacggtgtgccgtgcgcagaagaagagcgagcgccaggctgagctgaagcgtcgttacgagcagtacaaagctgagcgcatccagcgttatcagggagtcaatctgtacgtcaagaacctgcacgataccatcaatgatgagacacttcgaagcaattttgaatcctacggaaacatcacaagtgcaaaggttatgtgtgatgagcatggtcgctccaaaggattcggttttgtgtgctttgaaaaggcggatgaagcaaccaaggctgttgtggaaatgaacaacaaaatcatcgaaaacaagccgctttacgtcgcgcttgcgcaacgtaaggaagaccgcaaagctcaactggcctcgcagtacatgcagcgcttagccgcgatgcgcatgcagaaccctgctggcctcatggggacaatgtatgcgcctgccagcggtggatttttcctgccacaggccatccagaaccaacgtgctgcgccgttcatgcaaacaccgaatctgtccggggcacaaatgcgtggcgctgtccctcgctggaacaatatgggcggtttcaaccatccaatgcaaggctacatgatgggtccagctgttggcggtcagttcggcggtgctaatcaaattgctcgtggaggacctcgctccggtggtatgggtggtggcggtggaatgcgtcagtacgggggacaaccccgtcagcaacagaaccgcatgccgggcatgggcggaggtcatcagcagcaagggatgcgctaccagggacagccgaaaggaatgcagcaacaacaacaccagcaggctcagcaaccacaaattgcctattcgtcgtatccgcagcagcagagccgtggcatggcaccgcaaatgggcggcggaggcggtggaggagtcaaagctggccatgcgatcactgcaacacaccaggaaccgttgaatacacagatgcttaccgaggctgacatgaccggacaaaagcaaatgcttggtgagcgtctgtacgcgatggttgcgcgttgcttccgggacggtgatgtcgagaaagttggcaagatcacgggaatgcttctcgagatggagaatgccgagattttgctgttgcttggagacgaggaaatgttgcgtttgcgcgtggacgaagcagcaacggtgctttaccaggctacggggca

SEQ ID NO: 50244 - DNA, 1326 bp, Heterodera glycines
  SCN-specific regions: Sequence locations=1-1326
gttccgtttagcagaactatgatatttttgacttcgttttccaaacatccgttgtccgctgcctttcggttcttttcttctgttaacgaagtgaccctccaaacgcgtccctacaaactgttcaaactcgattcgggtccttcgacggaggtgcgactgacgcgggatgaggcgttggattattacagaaaaatgcaattggtccgacggatggagacatcggccaataatttgtacaaggaaaagcgtattcgcggcttctgccacctttactccggacaagaggcgtgtgccattgggatggtggcagcgactgacccgaaggatgccgtgatcacggcttaccgatgtcacggatggacatatttaatgggcgcgacggtccaggacattttggccgaactgacaggacgcattgctgggaatgtttacggaaaaggcggatccatgcatatgtacgccaagaacttcttcggtggaaacggaatcgtcggcgcacaagttccgattggggcgggcattgcctttgccatgaaatatcgccgccagaaaaacgtttgtttgacactttacggagatggggcggccaaccagggacagctgttcgaagcgacgaacatggccaaactgtggggattgccgtgcattttcgtttgcgagaataacggattcggaatgggcactcccgtggaccgtgcctccgcctcgaccgattattacacgcggggtgactatgtgcctggcatttgggtcgatgggatggatgttctgaccgtccgcgaggccactcgctgggccaaggagtactgtgacgcgggcaatggcccactgatgatggaattggccccttaccggtactacggtcactccatgtcggaccccgggacgagttaccgtactcgggatgagatacaggaagtgcggaagagcagggaccccatcaccagcttcaaagatcgcattgtcacggcgggacttgtcactgtttgaggaattaaaggacattgacaagaaagtgcgtcaggaggtggacgaggcggtcaaagtcgcactttcagacgaagttttacctccggaagcgctcttctccgatttgtatgccaacactccgccgcttgcggtgcgcgggacgactgccgacgcaaccgtcacacagccatttgtgagcacggcggaagtgttgagaaaaatggggagggagccgaagaattattgagagaacgaatagccaaagacgcattgatagttaggagaagcacagaataattaattgtttcattatatttattcgaagcaaactctcagaggaagaaagagattcctttt

SEQ ID NO: 50245 - DNA, 420 bp, Heterodera glycines
  SCN-specific regions: Sequence locations=1-420
ttagattagagtgggttgagtgatatgcatatttacaaagatccttatgctcctccgttggctccaaaagtgcctgttgatccaccgccatggtttccttcgtggaaaagaatacaaagggcgaaccgaatggtgggcttctcttggatacaaagaccttgacctgaagcgtggcttgacaactggtttttatcctttttttgaggaaagggacattcgttatgttgattcgaaagtgcctgatggaacttcgatggtcgggccgcaagggaaggacagtcgctaccaccaaagtaaaatggtcaaatggggaattcccggaaagtttgaagacttccagaagcagatcagggagaactgttcgcaatacaaacaaatcgctgaaaaatgggacctcagtgacgagcacccgggcattgc

SEQ ID NO: 50246 - DNA, 1257 bp, Heterodera glycines
  SCN-specific regions: Sequence locations=1-872,899-1119,1143-1257
cacatttttacgggcgaatttggccgaattggggcctacgagaaacagaggccgccatttgagccgaagaatccgttcctggccacacttacgctcaatcgcgagttgcactcagtggccagcgatcgttcgtgtcggcacattgagttggcggtggacaaggcgttgatccgctacgagaccggcgatcacattgccattttcccgaccaatgacaccgaaaaggtggacaaattgggcaatctgttggtggttgagttggacacggtgttcaagctggtcaacacagacgaggagagtaccaagaaacatcccttcccctgcccgtgcacttttcgaacggccctgacccattacgtggacatttgctctccggtcaaatcgcatgttttgaaagcgctcgtcgaagtttcggcggacgaagagacaaaggcaaaacttacgctgctgagcacggcgtcggaggagggattgcgcgagtacgcccaattcatcgtgaaggagcggcgcagcattgtggacgtgttgcagcacttccccgcctgcaaaccgcctttagacctgctgcttgaactgctcccgcgtctccaggcccgctattacagcatttcgtcgtcgccccgcgtggacgcgtcactcgtcgcggtcactgccgttgtgctgcgctacaacacaagcgacgggcgactggtcaaaggcgtgtgcaccaacttcttggcggaccgtgccccgggcgtgtccaccgcgccggtgttcgtccgcaagtccacgctgcgcttgccccaccgggtgcagcagccggtgatcatggtcgggcccggcaccggcttcgcccccttccgcggcttcctccacgaccgattgtggcacaaacagcagggcaaggaggtgggcgagatgcacttgttcttcggctgtcgtcacccagaccatgaccacatttacaaggaggagatggaggaatttgttcgggtcggtctgctcacccaattgcacgtcgcttactcgcggttgggaagcgaaaaagtttatgtgcagcacaaactgtgggaggcgcgacaacaaatttgggagctgatccaagcgggcgcttctgtgtacatttgcggagacgcgagaaacatggcccgggacgtgcagaatatgttttacaaaatttttgccgaagttggaggactcagcgaccaggaatcgcagaagatgatgaaagacatggagagacagcgacggtaccaagccgacgtgtggtcatgagag

SEQ ID NO: 50247 - DNA, 483 bp, Heterodera glycines
  SCN-specific regions: Sequence locations=1-12,46-483
gttcggtgtatcaaagatcagaatgggaatcatgttgtgcaaaagataatcgagcgtgttcagccgcaccagctgcagtttatcatcgacacgatggtcaacggttttacggactcggtcacttccctctccgtccatccgtacggctgtcgtgtcatccaacgtgtgcttgaacactgcacggagggacaaaaacggcctgtgctggaacaactgcatgagaatgtgctcactttggtcaccgatcagtacggcaattacgtgatccaacacgtgattgagcacggactgtttgacgatcgggagcgcattgtgcgcgctttgcatggagacatcctgaaatatgcacagcacaaattcgcctccaatgtcatcgaaaagtgtctcatttgcgggacgacagaccaaaagaatgcgctgatcgacgaagtttgtgcggacaacggttcttccaacccacccctcttggagatgatgaaggac

SEQ ID NO: 50248 - DNA, 903 bp, Heterodera glycines
  SCN-specific regions: Sequence locations=1-49,73-459,483-903
caagtttgagatggcccgtcgctatgatactcgtacgacaatcttctctccagaaggccgtctctaccaagttgaatatgcaatggaagcaattggtcaggctgggacttgtcttggaattcgagctcccgatggcattttcattgctgcacaaaaactaacggcaaacaaattgcttgatgatcgaatcatgagcgagaaaatctacaaggtgtcggcgaacatcttctgcacggtggcggggatcaccagcgacgcgaatgtgctggtcgacaaattgcgcgaaatggcggtgatgaacactttggatttcggagagaacattccggtggaacagctcgtgatcagactgtgcaacaccaaacagcactacacacaagttggaggtaaacgaccctatggagtgtcacttctctatgccggttgggacacgcaccacggctttcagctctaccaatctgaccccagtggaaattacggtggttggaaggcgacttgcatcggaaagggccaccaaaatgcactttcaattctcaaacaagagtacaaggacgaggacatgacgctggaaaaggccaaggatttggcgatgaaggtgctctccaaaacaatcgaagccaaaatgttgcccgagcagttggagatggctcagctcacccttgacgaaaagggcagacccgagttgcgcatactcgaggaggcggaaaggaagcaactgaccgataaatgggaagccagcgaagaggccaaacagccgtgacgggaaaaattgtgttgtgctttggggcacctttggtcggactttggctcggctaatctatatgttttgtttatttgcgccttgatttgatagaaaatgaattctatgtagaacgcaaaaaccgatgggactgaacaatcaat

SEQ ID NO: 50249 - DNA, 622 bp, Heterodera glycines
  SCN-specific regions: Sequence locations=1-286,309-580,602-622
cttttttaccgtccatgcgtcgttttgataaccgtagcagtggcggcagattcgccaagatttcggcgaacaaaagagggtgcgcgctcaaccgagtcgacatatcgaagctgaacatcaatttcgaaagcccaaaatggcaggaaaggaaagaggcattggacgcactgcaacaattgttgttgcaatcgccgcgacttgctgatttgccaaattaccgggagctaatcggacgcttaacaaagattatggcaaatgatgcaaatatctttgtcgccgcaagtgccaccaaatgtgtgatgctgttcgccaaaggattgcgtgccgaattcacgcctcacgtgtcgttggttgtcccggtgatcttcgacaagttcaaagtggagaaacggttgctcagagatgctctcgtcgagtgcatcgatgtcatcgcagcatataccagtttcgaccacctaagcaaggccttgctcgaggctatgacctccaaacagaatccgagtcagaaatcacagacggatttgttcatctaccgcctgttccgttctcttccggccgaagacgttcccaagggtttgctgaaggatttggtggccattctgagcaaacatggctttgatgc

SEQ ID NO: 50250 - DNA, 503 bp, Heterodera glycines
  SCN-specific regions: Sequence locations=1-61,83-379,402-503
gcaatttgaaaacagaacataattcacttcttcttctgctaaaccctccgcaacagaagtcaaatttcagaaaagaaaatgcacgaagcgaaaattataggcggaattgcttccctttgttcgctggccgcgattttggccactctcgtggtgatcccgcaactgtacactcaaatcaacgaaatgaacaaccgcgtgatggacggtgttcaagctttccgcgtgaacacggattccgcgtggactgagctgatggaggtgcagatcagtgtcactccgccgacccgtccgcgagagaatcccttcaactccattttcctacgccaaaagcgccagggattgcctccccaatgcgtttgccaactgcagcagccaagctgtcctcctggtcctcctggcccgcctgggccccccggaacacccggcgagcccggcggcgccgggcagccgggaagcccaggacagcccggacaacaagcaccgccatgccctccgcccgtgtc

SEQ ID NO: 50251 - DNA, 482 bp, Heterodera glycines
  SCN-specific regions: Sequence locations=1-482
cgacaaccagcgcagcctctcactgatgatggcaccggcaacttcttcctgagcgcatatgccatgtcagcgcagaggatcgccagcaattcggagtggaagaaaacgcccctcggacaaactggcctcttcaatatgggaaatacgtgcttcatgaacgccactcttcagccactgttccatacgcccggattttctcaactgttccaagaaaagagcgcgcagcgattcgtcaatgggaacaactcgtttggcacgaatgggatgatctccggctcattctctgcgctcatcgacctgatctggtctggcaagttcaacgcacttcggcccaccaccttcctggaattcttcgctcgccgtgtcaacaccgaaatggccgaccgacggcagcacgacgcccaagaatttcaactctatctgctggacgcgcttcacgaggacaccaaccgggtcaacaagcgacaatcgtttgaacagaa

SEQ ID NO: 50252 - DNA, 931 bp, Heterodera glycines
  SCN-specific regions: Sequence locations=1-467,508-577,602-931
ccccgtagagcttgtcaattaattgcttgcaaatttgccgatggctgctatagacccgaaggatttcttcaacaagtttgccaaaccgagcaaaggtgccggagtcggcgctggcttgatgactgcagctgcggtggccggttatgcgctgtacaagtcgatgtatacgattgaggctggccatcgtgcgataatgttcaaccgaatcggtgggctcggcgacgaggtgtaccgggaaggactgcactttcgcattccatggttccaatatccgattgtctacgacattcgtgcacgtcccaaccaaattcggtcgccgaccggcagcaaggatttgcaaatggttaacatcgggcttcgtgtgctgtcccgaccggacccggggcagctgcagacgatctgccggatgctcggcaccaattgggaggagcgagtgcttccgtcaatttgtaacgaggtgctgaagggcgtcgtggccaagttcaacgcctcccagctgatcacccaacgtcagcaagtgtctctgctcgtccgaaagggtctgattgagcgtgcgttggacttcaacatcattctcgacgatgtggccatcaccgagttggccttctcgccccaatacagtgccgccgttgatgcaaaacaagtggcggcacaggaggcgcagcgggccagtttcatggtggagaaggccatccaacagcgccaggagaaaattgtccaagccgagggagaggcgcaagcggccaaattgttgggcgagtcgatgaagaatgaccccggcttcctcaaactgcgaaaaatccgtgcggctcagaaaattgcgcgtttcattgccaactcgtcaaaccgcgtctatttgccttcggacggacttttcttgaacttggccgacgaagactatttgagtttggcgaccaacaaagggcgccgt

SEQ ID NO: 50253 - DNA, 656 bp, Heterodera glycines
  SCN-specific regions: Sequence locations=1-557,581-656
ctgcgaccattaatcatatatctgcaagcaacggaaatgatcaaaaacggcgacatttggcaagtggaaatgagccgttgcaacgcttcggagaggcaaaaaaatggatgactgatatctatgggcaattggatggacatgttggagagttactcgaattctatttgggtttggttaaaaacggacaaaaatttgttcctcccgctcaaattgatgaaattggacattttcgcgactcagtaagggcaattcgtgaagtaatcgggcgggacaagatgaaggtcgtcttcttcgggagaacaagcaacggtaagagcagtgtgatcaatgcgatgttgtcatgccgagtgttgccccaggggatggggcacaccacttgctgtttcttacaagtggaaggggggtcggagcaggacaagtacttcatgatggaagacggggcgaagcactttccaattgctgaattggattcggttgggcatgcgttgggctcggaaggcatgggctccctgggacgcgactcgctcattcacattttctatccaaaatcggcgtccaaattgcttcaaaatgatgttttgatcgtggacagccccggcgttgacctcagtcccgagtttgacagttggattgacaagcactgtttggatgcggat

SEQ ID NO: 50254 - DNA, 645 bp, Heterodera glycines
  SCN-specific regions: Sequence locations=1-128,151-272,303-645
atcagagtgtcaggtgacgatgtgatcattggaaaaacaattgctttgccggaggtggaggacgagttggaagccagcacagcgcgctactctaagaaggatgcgtcgacaacacttcgaagcagtgagacaggcattgttgaccaggtgatggtcagtgtcaacgcggagggcaacaaattcgtcaaaattcgcgtccgttcaattcgaacacctcaaatcggggacaaatttgcttcacgtcatggtcaaaagggaacaatgggaatgatgtacagacaagaggatatgcctttcacatgcgagggcataacgccggacattatcattaatccacacgctgtgccgagtcgtatgacaattggacatttgattgaatgcctccaaggaaagctttctgcaaacaaaggcgaaattggcgacgccacccctttcaacgacacagtcaatgtgcagaaaataagtgctttgcttgagggctacggctaccaattgcgtggcaatgaaataatgtacaacggatttaccggggcaaaagttgagcacacaggtgtttctgggcccaacttactaccaacgggcttaaggcacatggtcgaggacaaaattcactcacgcgcccgagggcctgttcaggggatgaac

SEQ ID NO: 50255 - DNA, 632 bp, Heterodera glycines
  SCN-specific regions: Sequence locations=1-534,556-632
actgtaccggcttcacacttcgaccggtggccggccttctaagttcccgcgattttctggccgggctggcattcagggtgttccattccacccaatacattcggcattcgtccaagccccactacacacctgagcccgacatttgtcacgaactgttgggccattgtccactgtttgcggaccccgattttgcccagttttcccaagaatttggactcgcatcgcttggcgcctccgatgaaatggtggagaaattggctacgctctattggttcaccgtggagttcggcatttgcattcaaaatggggcaaaaaaggcgtacggtgcgggactgttgagctcatttggcgaattggaatatgcgctcagcggacagcccgaattggctgcgttcaacccgccggagacgtgccaaaccaaatacccgatcactagctaccaacccaaatattttgtggccgaatcgttcgcggatgccaaaaacaaactcgctacatggtcaacgagcataccaagacagttccaagtcaactacaacccatacacacaacgcatcgaaatgttggacaatgagagtgcagcaaacaagcttgtccgggatgtgaaaagccaagtttcaaagctcgaagaa

SEQ ID NO: 50256 - DNA, 481 bp, Heterodera glycines
  SCN-specific regions: Sequence locations=1-225,247-481
ctcaacccgtgggagaagcagcaaccgaacaacaacaacaggcaaaacaagggcaaggagaacggcacacgccaaccccaggctatgcctgtcggctgggtgctcggcgttcgttccaaaaccacgtccataaatgaagatgccggaccaagccatccgtcgacctccgacgctctctcaacaacggtcaagccaccggcatcgtcgtcgtcgattgccagcgttcttcctcctcatccctctttctcattgattcaagaaaacgggttcgaacagcgggtgtacactgattggaggagtcagtgcaaaaaacagcgtgaggcacttggctacgacattcccgagatgcatacgctctatcggttttggtctctgtttttgcgggacaatttcaacaggtcaatgtacaacgagttccgtaaatttgcactggaagacgctgaccatggccttcggtatggcattgaatcgcttttccgtt

SEQ ID NO: 50257 - DNA, 368 bp, Heterodera glycines
  SCN-specific regions: Sequence locations=1-123,162-368
gagaatccctgagtcgtttaataattgtagtcagtaaagacaagatttatttaacgaaggacaatgccgcgccaaataactgatattaagcaatttctgctgactgctcgacgcaaagacgcgaagtcagtcaagatcaagaagaacaaagagaacaccaaatttaaggttcgctgtacgcgctttctttacactctcgtggtggatgacaaagagaaagctgagaaattgaagcagtctttgcccccagggcttcaggtcaaagaattgaagtgattgacgcacgaaaattgcatatggttttttgttttgtttttccattttattctcgataaactgttgtgttaaaaatcagcttcccatcgacg

SEQ ID NO: 50258 - DNA, 637 bp, Heterodera glycines
  SCN-specific regions: Sequence locations=1-127,149-637
gtttcgaacggatgactgaaatccaagccaaaagcatcccgccccttctggagggaaaggatgtgctcggatccgcaaagacggggagtggcaaaactttggcatttctcattccgtcgattgaattgttgctgagaaatgggtggaaacagcaacaaggcaccggtgttcttattgtgtcgccaacacgcgaattgtcaatgcaaacgtacggagttctctatgaattgatggagaaacacccgaacatttcccacgggctcgtgatgggcggcgcaaatcgccaaaatgaggagaaacgactcgctggaggcgttgccattctcgttgcaactcctggccgactgctcgatcatttgcagaatacatccaattttgtcgtgcgcaatttgaagtgtttaattgtcgacgaggcggaccgaattttcgacattggatttgagcaggaaatgcaccaaatcgtcaaattgttgccaaagaaacggcagagcatgcttttctccgccacatgttcgcccaaagttgacgagttggtaaagactgcgctgaaaacggacccactgaaaatcggagtgatggagcagcaaagggacccaaatgacatggccacggttgaggggttggagcagggttacgt

SEQ ID NO: 50259 - DNA, 784 bp, Heterodera glycines
  SCN-specific regions: Sequence locations=1-220,242-784
gccattgtgccgttgctgactttttcagtctttttctaattagaattgcttggtcatcttccaattagttttaatggtcagaacatctctggaaaatacccacagattggataaaataccaaccacttggtgcaagcattgagggatcgaggatttttgcattcaaaacaccacttttgcccgagttgcaaacatcaatcccaaaggagtgtcgtttttcaactttaactttattacaacagttggctttctctaatcgttcattgggacttgtgattaactgcaataatactaaaagatatttttgtcgaagagacatcgaagggcttgggatttgctacaaagaaataccatgtccaggccgcggctttctgtatcgtactgatgccgtaaaaactttcataaaaacaatagacgactttttggaacttaacagtgacaatgatttgctaattgcggtttgttgtagcaatggaattaaccgttctggctatttgatttgtaactatctcatcaatcgacttggctggagttctcatgatgcattgaatgcatttgaaagtgccagaggttattccatcgagagagggtcatatgttcaagcattacacaaagtcgacagagaacgtcgttctaaaacgatgccgttcggtttggacagaagtgagcatgaaatgggaaatgacgaagcacttcccgcgaagactgaccaattattgcctggcattagcgacttcaacccacaattgacagcgcaaatgatgcaacaattcttcaacatgga

SEQ ID NO: 50260 - DNA, 471 bp, Heterodera glycines
  SCN-specific regions: Sequence locations=1-48,71-471
gagatggaatcgtatgtgcaagttgaagatcaagattcgagggactccggcatttcgttggctcaatccaccacctcgcagcaaagctgttttgccaaaatttattttccaactttgttcgacttcgggttcaaggttcgggaattgtattcgcttgacaccgttgaacggccccaagttccgcacaaagccttccgcagcattaacgccgatacgatggccaaccttttggggtcactaacagaagaacagttccaacggcggttcattctgatcgattgtcgctatccttacgaatacgatgcgggccacatttggtactcactgaatttgtgggagaccacttccattgagaagctcttctacccagaagaggaagaacggttcggcgaaattattgtgcgaactcccatcttctactgcgagtactcgcagaaaaggggacccaaaatggctcttgcactgcgagaa

SEQ ID NO: 50261 - DNA, 491 bp, Heterodera glycines
  SCN-specific regions: Sequence locations=1-43,66-491
tgacagaagaaatttcgggcacggagcgtgtgtatgcactgtcggtgaacgtcggcggcttcctgaaccacgtcatcttccgccgacacaagggaatgttttccgtggacctcaactccgacaagggcttccgaacaatcgaacgattcgtcgacaattatctgcgcaccggagtttccgtcaccactcaacaatacgtcgctctcatcagggccgtgccccgcgcgcactgggagctgtcgcacacttcaatcatcctgggcaatgaacttggccgcggcacgttcggggtcgtcaagagtggcgtctacgtggatcagcaggggactcgagcggcggtggccatcatagaggtgtctcagacgagcaccaaagagcaaatcaaggagttcatgaatgaggcgcgagtcatgcggcagctccgacaccccaatgtcatccagttctacggcgtcgcggttggccaggagcccctgatgatcgtcatggag

SEQ ID NO: 50262 - DNA, 884 bp, Heterodera glycines
  misc_feature (862)..(862): n is a, c, g, or t
  SCN-specific regions: Sequence locations=1-143,165-290,323-551,573-884
cattttgttcccaatcagcaaaccataatattccttgattctctacattttcctacacaaaatgggccgggagcatcgttctgaccgcaaacgagactatgagaaagagcacagtccgttggcggacgaatcgtcgagtggcagcagaaagaggacaaaaagggagaagaaccgaagtgtgagcccggcgcgttctcgttcccacacttacagtccgtcaccacgccgagaaatttcgccaaagcgccgcgctcgaagtcgttctcgctcgcgtgatttgccctcctcacgcggtggtggtggcggcggcggcggttactacggctcgcgtcgtttccatgacggacgcgacaacccaaatccgaacccatgcttgggcgtgtttggcatgagtttgcataccacggagcgcgacctgaagcatttgtttggccgctatggcgaggttgattcggtgcaaattgtgtacgaccgtctctcgggacgctcgcggggctttggctttgtctacttcacacacaccaaagacgctgcgagggctaaggaaaatttggtggatgcagtgattgatgggatgaaagttcgtgtggattattcggtgacgcgcggcggtggaccacatagccgtcatgtgcgcaaaagcttctcgcgcagtccggtgcgcaacaaccgtagccgcacgcgcagccgttcccggtccgagtcgcggtcggtgtcgcgttagaaaggtgaaaagtgctaatggtttggagaaatgaatgaatgatggatgaggatgaattgattgattgacaatgattttgatccgctttttgtggtttagtattattgggctgtcgaatcataaagaacacataacgtnaagaataaaacaccggagatat

SEQ ID NO: 50263 - DNA, 579 bp, Heterodera glycines
  misc_feature (314)..(314): n is a, c, g, or t
  SCN-specific regions: Sequence locations=1-162,186-241,264-363,389-579
ttcagaccttcactattttcttgtttaaaaaagttgcaacgatggtcgaaaccaaaggttggcatcaacggttttggacgtattggacgcttggcattgcgtgcagcgattgaaaaggacactgtccaagtggtggcggtcaacgacccgttcatcgaactcgactacatggtgtacatgttcaactacgactccacccatggccgtttcaagggcaaaatttccacaaacgccggcaatttggtggtggagaaggaggggaagagcgcgcacaccatcaaagtgttcaacctcaaagacccggtcgaaatcanatggggcgaagcgggcgcgggatatgtgatcgaatccaccggagtgtttaccaccattgagaaggcctctgctcctcttaaaagcggtgccaagaaagtaggcatcttccgctccgtctgcggatgcccccgatgtacttgaatgggcgtccacgaaggacaagtccgacccgggctaaggacgaacggaatcagcattgcggtcgggcccaaccacttggtttactccctttgcgcaaaagggaccacaaacgagtttggcatc

SEQ ID NO: 50264 - DNA, 1024 bp, Heterodera glycines
  SCN-specific regions: Sequence locations=1-143,166-1024
ttggcacaaacgcttggcctttcgctacgaccgcctcctccatctgacaaactttttcgtcttgtggcaatagctaaacaatttgtggaagatcccgagtctaaagaacgggagacaatcttgcaggtgttgttttgatgactgactttttccttttatgaccatttatttcattgacaaaaggtcggtgggtttgagtctgctgggcttgacttggaattcgatgctgatgttgtcccgacaagccctgaaccaagtttgtacgaaactgtgtacctcaccacacacaaggccccgtgtcgggcggctgctttctctccagatggagctcttgtcgccacggcctccaatgattgttcaattaaaattttggatgtcgataaaatcatttccaggattgacgtgactctgagtgagtccggccccgacgcccatcacccggtcattcggaccctttatgaccacctcgatgtgacaacaaaaacactttacgaagaatcgttggtctttttgctaggaagtcacttgcgttgctttccatccccgcgagtccgtcctcctttcgggcagcaacgattttacgctgaaaatgttcgattattcaaaaactgcggttaaaagggcaatgaaaacgatcacggaggtcgagccgatcactgcggtcagttttcatccgagcggagagttttttctatgcgcaactcggcatccgaccttgcgtctttatagtgccgaaacacagcaatgctttgtttctacaataccgaaggaccaacattctgattccattacggatgtgtgctattcggaaaatgcgcgaatgtttgtcacgggaagtcgtgatgggaatgtaaaagtttgggacggagtttccaatcgatgcattgagacttttacccgcgcgcatgacggagccccgatttgcagtgctcagttcactcgtaatggaaagtacgttctcacagtaggaatggacagtgtgcccaaattatgggaattgtccaccaatcgctgtttgatcgct

SEQ ID NO: 50265 - DNA, 928 bp, Heterodera glycines
  SCN-specific regions: Sequence locations=1-401,426-501,523-928
gaccaccagaatgaaggacagcaagcacccggagtactcgcacgagcgcgacattgacaacacggagattccacttcagatgggtacgaacaaattcgcctcgcagaagggcatgaccctgttcggtaccggacgtcgtgagaccaccagaatgaaggacagcaagcacccggagtactcgcacgagcgcgacattgacaacagggagattccacttcagatgggtacgaacaaattcgcctcgcagaagggcatgactggcttcggcacaaaccgtcgtgagaccaccaaaatgttggacacctcgcacccggagtacagccacgagcagagcatcgactagaccagcatcccctaccaaatgggatcgaacaaatacgcgtcgcagaagggcatgaccggctttggacagccacgttgggaggtgcttgacccgtccatttcgtaccagaaccgcaagtcgcaaggcatggttcgtctccaatccggcaccaaccgattcgcctcccaggcgggcatgaccggctttggcacgccgaggaacaacacctacgaggcggaggcgggcgagctgccttacgaggatatgaagaagtcggaggcgatcatcccgtcccaggccggatggaacaagggcgactcgcagaagctgatgaccaactttggcacaccgcgtgacgtgaagggcaaacatttgaagcgcatttgggaattggagtacccggaggaagccgaagtgtcgctggaccgtctctgatcagcgacacggattgaattgtgctgctgatcagcacatgaatacacacggaggaaggaggagtaggacaaatgccatcgtcctcatcaagttggagcagtacacacccaccacaccgtcatcctttgccgtccggagagtgatcgatccattgtttgatagattgattga

SEQ ID NO: 50266 - DNA, 609 bp, Heterodera glycines
  SCN-specific regions: Sequence locations=1-103,145-214,236-257,475 -534,557-609
tcttctcatcgccttcgccttcaaaacttagaagcaccaatcccaaccagaaaaaatgtgcgacgaagaagttgctgctctcgtggtggacaatgggtccggaatgtgcaaggccggtttcgcgggcgatgacgcgccccgcgcggtgtttccgtccattgtgggccgcccccgtcatcagggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgcgtgtcgcccccgaggagcacccggtgctgctcacagaggccccgctgaacccgaaggccaacagagaaaagatgacccaaatcatgttcgagacgttcaacacgcccggccatgtacgtggccatccagggcctgctgtcccttgtccccttcggggcggaaccaccgggtttcgggttgaactccggggatgggggcaccccaacccgggcccctcaacaaggggtatagccttgccccaagcattctttcgtttggatttggcggg

SEQ ID NO: 50267 - DNA, 468 bp, Heterodera glycines
  SCN-specific regions: Sequence locations=1-468
gtgatacatcgccaaccagtggagccggcttcttgcaacaactgcttgacttcttaagtgccgaaaactatggcgaattggcaaccattgttggtcgttattatgccatggaccgtgacaaccgatgggagcgaattaaggttgcctacgaggcattggttgccggagagggcgaaaagtgcgaaccggcgaatgctgtacaattggtgaacgagcgctacgcaaaccaacagactgacgaattcctgacgcccatcgtgttttcggacgaagcgcgtgtgaaagacaatgacacattggtctttttcaattatcgtgctgatcggatgcgtgagattaacaagtgcatgggtgatctgcaaaacctgcaggatttgggcaccaatgttgcattgccgaacggactgcacatcaaaacgatgacacagtacaacgcagagtttccattccccattctgttccctcccg

SEQ ID NO: 50268 - DNA, 453 bp, Heterodera glycines
  SCN-specific regions: Sequence locations=1-27,49-68,91-229,268 -376,403-424
ttagagcacttaaatggcactgaaacgtatacaaaaggagctgcaggacctcggccgtgacccacccgcccagtgcagtgctggccctgtcggcgatgaccttttccattggcaagccaccattatggggccaccagaatcgccttaccagggcggcgtcttctttctgaccatccacttcccgacagactatccgtttaagccaccgaaggtggcgttcaccactcgtatttatcatccgaacatcaacagcaacgggagcatttgccttgatattctgagatctcaatggtctcctgcactgactatctccaaagtcttgctttcgatttgctctcttctctgtgatccgaatcccgatgatccattggttccggagatagcacgcatctacaagacggatcgtgaaagatacaatacgttggcgcgggaatggactcagaaatatgcgat

SEQ ID NO: 50269 - DNA, 1247 bp, Heterodera glycines
  SCN-specific regions: Sequence locations=1-603,627-889,912-1076,1100 -1134,1164-1210,1232-1247
gtccgaccaaattttccactcattttgcgtccaaaacattccatccaaaaatgaccatttctgcgcccgctgacgttgacaagctccaggatgcggccaaccgaatgcgcatttcgtccattgagcagacgtgcgccgccaactcgggccacccgaccagcagttgcagcgcagcggaaattgtggccactctgttctttgccgaaatgcgttatgacgtgaaggacccgcgcagcgcatccgccgaccgtttcattctgtccaagggtcacgcttgcccaattctgtacgccgcttgggaagaggcgggcctgctcagccgtgaccaagtgctctccctgcgcaagattgactccgacattgagggacatccgaccccgcggctcaacttcatcgacgtggccaccggctcgctgggccagggtctgtcatgcgctgccggcatggcgtacactggcaaatatgtggaccattcgtcctaccgcgtgtactgtttgatgggcgacggagagagtgcggaaggctccgtgtgggaggcggcagcatttgcaagtttctacaagttggacaatctggtggccattgtggacgttaaccgacttggacaaagtcaggagacccaactgcagcacgacattgaagcgtatgtgcaacggtttgccgcgttcggttggaatgccatcggattggaggacggacacgacattacggcacttttgaatgcttacgccaatgccaagaacgtgactggcaaacccacggcaatcatcgccaaaacgctcaagggcaagggcattgacggcgttgccgacctgaacaaccagcacgggaagccggtgtcgaaggacaaggcggagcccatccgggcattgctcaaaagtgacaagccggcaaattggaccatcccggcaccgattcgggacgcaccggcggtcgacttaggcatcggtgccatcgcaatgagtgcaccgccgcagtacaaaatgggcgaaaaggtggccactcgacaggcgtacggaaacgccttgctgaagctggcggaggccaacaaacgcgtcattgccttagacggtgacatctccaactccaccttctccaacctggtgcaaaagaagctacccgagcagtttgtccagtgttacattgctgagcagaacatggtcggtgttggagttggcatggcgtgccgtgggcgtgtgcttccgcatgtcagcacttttgccgccttcttcacccgtgccggtgaa

SEQ ID NO: 50270 - DNA, 1041 bp, Heterodera glycines
  SCN-specific regions: Sequence locations=1-177,202-366,403-622,645 -1041
gtaatgtgcggcatcttcgcttacctaaatttcttttcgccgaagaaacgctccgaaatcatcgacattcttttgcaaggactccgtcgcatggaataccgtggctacgattcggcgggcattgccattgactgcagcaacgacgtgaatctgccgcatgccgacgtcgctgtgtatcgcaagacgggcaaagtggacaatttggacgacagcatcaaaaattccgaaggcgtggacatggacttcacctacaacgtccattgcggcatcggacacacccgctgggcaacgcatggaaagccaaaggacgaaaatgcgcacccgcaacggtcgaactttgacaacgattttgccgtggtacacaacggaatcatcaccaactacaaggagatcaaggactatttgctgaccaagggctacaaattcgagtcggagacggacaccgaagtgatcgccaaactcacgcaacacatccaccaacggcacccacactacggcctccggcaactcgtcgaaattgtcgtgcaacaattggagggtgcttttgcgttggcgttcaaaagtcgccgttttcctggccaattggtggccactcgtcgcggcagtcctcttttggttggcattaaaagtcagtccaagctgaccactgaccatttcccggtcttctacagcagaccacgccgtggccccgtttcgctggtgttcgacgaaagttgcaccactgcgatggaaacgccaaacaaactcaacgcttccgacatgttcgcctctttcagcgctccttttaatgacacaataaattctacggcacgtaaaatcgaatgcagcgattcgacgcgaagtgttcggccatgcgacttggcaaactttgaggtggaatatttcgtggcgtcggatgcgagcgccgtcattgagcacacgcgtcaggtgatctttctggaggacgacgacgtcgcatttgtcgaggacggcgctttgtccatccatcgcatcaaacgcagcgacgacaccgctgctttgacagaacagacgcgagaagtg

SEQ ID NO: 50271 - DNA, 782 bp, Heterodera glycines
  misc_feature (774)..(774): n is a, c, g, or t
  misc_feature (778)..(778): n is a, c, g, or t
  SCN-specific regions: Sequence locations=1-24,57-600,622-732,755-782
ccaagtttgagatgtttcagaaagttttcttggttcttttgtttttacttgcctttacagtctcaaatttgcggtccgatgaaggaattggggagatggatgcgaatcaaaaacctttgaattcggctcgaatactcgcttccaaattcactctttctcagtatgccgttgagagtatggaccttgtgatggagtacaatttgtttaatgttggcgaccgcactgcttttcgtgtcgtgctggacgatcgtaactcatttcccacccattcatttgacattgtgcgtggaatgcttcacatccgatgggaaaaaatctcaccgggagaaaatgtgagtcattcggtggtggtacgaccgcgcagttacggcattttcaattacacttccgccatggtcacttattatgtgaccgaagatgccaaacaagcgaccgtcgggtacagcacagcgccaggcgaagggaacatttaccggctaaaggattatgagcgccgattcagttccaaaatcggtatttggctcgtctttttgctgttagctttacccacgaccttgttgcctttcttcctctggtacaaattccaacagaaatatgcgacaaaaagcgggacatccggtcaacaaaattctaaaaaggctcaatgaaaactaaaggcaattatggagtgcgcaaatccatgccacctttatatttattaccattttgtttccatgcaaacttgtatttgttgtgttaaaccatttcattccttatgctgttggcgtaaacgtntggnaaac

SEQ ID NO: 50272 - DNA, 783 bp, Heterodera glycines
  SCN-specific regions: Sequence locations=1-24,59-783
gtaattcttactttttcattgtacaaagaatgagattgtgattgactctgtgccatctttttcttctgtttgtatttttggtgggcttttaaggaaatatggcatagaaaaatcagtgcagaatctttgtgtcgaatggatgacaaaagtcccgccgcaatttttgctcgagaatttgagcatcgtcaagcgcgcgatgtcgacgagttgcgcaggatattccacaggcacattgaagaggaaagtcgaagtgacgagcagcaaaggcacgagaaaacggcggcgccgatgctaacgacggcaccagcgatggcggcggcacttcccagtgcgcgcattgttcggacgccacacattggcacaaatgcccgcgagaatggcaccgcctcattgtccgccatcactccaatcgctgccgcctttcgatggtgcactccgctggccaacacaccaactgtaagtcgtctcactttgcccttccgtacgccatgttttgtccatatttctgtccatgtcaatcctggtcatttcttcgtccaattgccctcccatccgacattttcgtcgcttgcgctgctcaaccaatatatgctcaccgtatacacgcacaatcagccgggcgttggggcaccaggcttggccaagccgtacgacgtcggcgtgctttgcgctggcccggcgtgcgacggatggtgccgcgccattactgtggcatacgaccaggaccaggatgggatggtgggccgtttcgtcgattacgggggctttgcccgtttggcccgg

SEQ ID NO: 50273 - DNA, 908 bp, Heterodera glycines
  SCN-specific regions: Sequence locations=1-401,426-908
aaaccatcggaacatcgccaatttgcattttcaataaaaatctgtcgtcgacaatgagtgcttatcaaacaattgaaaagggttctcttcatacccttaactatcgcgtattttttaaaaattcggatggaaaattgatttctccttggcatgacattcctctctatgcgtccgagtcaaacaaattgttcaacatggttgtcgagattccgcggtggactaacgctaaaatggagattgccactaaggaagtgatgtctccaattcgtcaagacgagaaaaagggtcttccccgcttcgtcaacaatattttcccgcaccgcggatacatttggaattacggagcgcttcctcaaacgtgggaagacccaggacataaggacgagaacactggcgaaaacggagacaatgatccaattgatgtgattgagattggaagcaaagtgcagaagaggggcgccgtcattcgggtcaaagttttgggagttttggcacttttggacgaaggcgaaacggattggaagttggtagcaatcgacgaaaatgatgagttggctccgaagttgaacggaattgaggatattgaaaagcatttgcctggactgctaagtgccactcacgaatggttccgcatttacaaaattccaacgggaaaacccgctaaccaattccccttcaatggtcaattctgagaccggaacttcgcccaccaagtaatcgaacgaacgcatcaattttggaaaaagcttgtcacttccgctagtccgcatccattgaacactgactgtcacaaggaataggctgttttcaaagcgaatctttcggattgggaaagctttatatcgaaacagccaaagtttggtcatgcccagcaggtgccggaacatgtcgacaaatggcactttatt

SEQ ID NO: 50274 - DNA, 1218 bp, Heterodera glycines
  SCN-specific regions: Sequence locations=1-123,145-469,491-1218
tggaattgtgccttttatgggagatacgccggaggcgttatttgccaacataattaatgaagacgtggaatacccggagggggacgaggcattggattcggatgctgagtcgttgattcatcttttgctggagaaaaatccgctggaccgactcggaaccgtcggcggtgctccccaagtgtccgcgcatccgttctttgcaccactcgactttgacacaatcttgcggcagaaggccgagtttgtaccccaactcgagaatgacgaagacacttcctacttcgactcgcgctccgaccgttacaaccacgacgccaatgagtcagcggaggacgacgacgcggcggcggtgccaatgttttggtccttctcgacggcatcgcctcggcatagcattgtcgggttggaattgcccgccgggggaatggcaatgcttcaggccgcccatgcagcagcaattgaacggagtgggcagccgctgcagcaacaagaccgaattgtggacgatgaccgggtcgagagccgcagacgactcctttcctcggcaaccaccgcttcttccggcattggcagcgggccaaactcggcattcggtccattgtcctctacacttttaacgcgtggtggcaattgctccgactcccaagattcttcccacgaaagtgccgttggcagacgagcaaccgctgctgcttctgaattcgcttgcgatgtgatgccatcggcagtcattctgcgacggcgtttctccaaccagcggcaccatacaaatgattcgtcaaccagcagttcggctggtacaacaattggtacaacagcgggcggtggggtcggttcatcaacagacgactcgtcgtccttggacatagcgacgacgatgcatttagaacagccgagacggtcccagggacagttgccgagacttgcaatatcaccatgcggtaccactttcgactcttcaactgggggtgccattgtgacacaccaacgggaaagtgcgtgtggcaccggcggggaattcttgtcgccggtcaatgaacggcatatcactgccggaggcggaagcggtggaatgaagcggatggagaagcgtccttccgccgttgtacacgaattgataaccgatgtcgtccgtgtgtcctcctcctatgggcagtctttggcccgtcagtctcgctcctcttcatgtcgcgtcagtaacatgtctcccggggccgc

SEQ ID NO: 50275 - DNA, 640 bp, Heterodera glycines
  SCN-specific regions: Sequence locations=1-478,500-640
gaaataaataaatttaaaagcctcaatgctgataaaacgcgcattttcattctcttctcgtgcattgcaacagcacagtgtcgtcaggcctcccgtccaagtgacaggcattgagggaaaatacgcgtctgctctgtactcgtccgggataaaggagaaaaagctggaaaacatcgagaaagagttgcgtcaagtgaaggagttgtacgacaccaacaaagagtttaagtctttcattgacaacccaattctgaataagcaaaagaaaaaggaggccgttgaggatgtgctgaagaagcagggcgtctcacaacaagttcagaacttcttcggccttttggcggagaatgggcgaatcaacaaattgaccggtgtcgtgagctccttcgaaacaataatgcgagcgcatcgcggagaacttcacgtggaagtcgcaagtgccgagcccctcgacaaaaaacacgaacaatcgctgaacgacgccctgcaaaagtttgccacgcgtggacagaagctgaacttgactttcactgtgaagccggacttggttggtggactggtggtgaacatcggcgataaatatatcgatttgtcaatggcaacacgccttaagaaaatggacgcggtggtaaagggatcg

SEQ ID NO: 50276 - DNA, 772 bp, Heterodera glycines
  SCN-specific regions: Sequence locations=1-285,308-731,754-772
cattagctgtgttaagagatgccaaagaaacaaatgcacaacggaggaggaggagaagccgaaaagtgccgaagtgccgccggaagcacagcagacgacgacgacgagcagcagcagaagcagatggggcctgagaggcttcagctatacaaacgccgaattcccgaaacatgggctttttcctgtcttttctatggaaatgccaacaccgccgaccaacgcatcgcatcgcaaatcggcggaaggcatcggcaccaccctccaggcgggcatgggctatggcacgcagcaggcggaggcgggcgagctgccctacgaggatatgaagaagtcggaggcgatcatcccgtcccaggccggatggaacaagggcgactcgcagaagctgatgaccaactttggcacaccgcgtgacgtgaagggcaaacatttgaagcgcatttgggaattggagtacccggaggaagccgaagtgtcgctggaccgtctctgatcagcgacacggattgaattgtgctgctgatcagcacatgaatacacacggaggaaggaggagtaggacaaatgccatcgtcctcatcaagttggagcagtacacacccaccacaccgtcatcctttgccgtccggagagtgatcgatccattgtttgatagattgattgatcagaaaacatccatccatcctccgatcacagcccctggcattttttgctgcttaaaactttgtggttttaaatacatttagtgcctgcggcaacactttttttcaaa

SEQ ID NO: 50277 - DNA, 964 bp, Heterodera glycines
  SCN-specific regions: Sequence locations=1-145,167-964
aaacatgtctggcggtggcaaagatcggattgcagtttttccgtcacggatggctcaaactgtgatgaaaacgaggctgaaaggcgctcaaaaagggcatagtttaccgaagaaaaaggcggatgcgttgaatatgcgatttcgtgaaattctgaagaaaatcactgaaaacaaaaaacgcatggctgatgtcctgaaagaagcagctttttctcttgccgaggcgaaattcactgccggcgatttctctcacatggttgttcaaaatgtgtcttcccaagcgcagtacacagtcagaatgaagcgcgaaaatgttgttggtgtttttctgccggtgttcgaagcccaccgaaaagagggctctgacggagacgcgtacaatttgacgggacttggcaaaggcggggcgaacattgggaagctcaagcgcaactacaacaaagcggtggaactgctggtggagctggccactctgcagacgtgctttatcacactggacgaggccatccaagtgacgaatcgtcgcgtgaacgcaattgaacacgtaatcatcccgaagattgaaaatacgctcacttacattgtcaccgaattggacgaaatggagcgcgaggaattctttcgcatgaagaagatccaagccaagaagaaacgccaacgcgacgaagaaaaagcccgggaaacggagaatgtgctgaccgaacggcagccggacgatgggagggcgccgaagagtttgctggaagatgaggaggaagtgcccgtgttatttgcctaagggcagtcgaacggaaagagggaacaaacagacggactcaattaatatttgtttgattggttgtgataatggcagtgtgtttatatcatgctaatagagaacaatcattatgtaatttcgcaaattttcattccttttaatcagattttattttccgattcaatttgtagtgaataaaaactcatc

SEQ ID NO: 50278 - DNA, 638 bp, Heterodera glycines
  SCN-specific regions: Sequence locations=1-413,435-638
ggacagcggaaatgatccacgcgaaggacattgtggccatccttcaccttctgatcactctcgcccttcattaccgggcaccgattcgcttcccgaacaatgtcaatgtgcaagttctgatctacactcggcacggcaaacaaatcagcaaaagcatcgtcactgaacagctgaccaccaaacagacggaattggcaccgaaaggcgaacgtgacgcatttgatactctttttgactatgggccggacaaattgcaacacgtgaaaaattcgctagtcgccttctgcaacaagcacttgaacaagatcaacttggaggtgaccgacttggagacgcaattccaagacggcgttttcctcatccttttgatgggtcttctcgagggttatttcgtgcccctctacaaattccatctccaagtgaacaacaacgacgagaagctgaagaatgtgcaattcgcttattttctgatggaggaggcgggcatggccaagccaaagtgccgtccggcggacattgtcaacggcgacctgaagagcacgctgagagtgctgcacgcactgttcaccaagtacaaacacgtttaggaggaggggagaacagacggagcagcgaaattagggacaaaagagcgacgt

SEQ ID NO: 50279 - DNA, 483 bp, Heterodera glycines
  SCN-specific regions: Sequence locations=1-483
caatgactgaaccttccgcctcaattgttcgtccaactttcttcgattcggttgaaagatgggccgaccgcgactttggagaagatctcagaaattttttggaagagattagttactccgatttggcaagttacgcgcagttgatccatcacaaagatatcattatccaatgtctcctccgtcacttggccgatcggtctctctctttgcccgctttttgcgatttttgttcggctattgcgacggatttgcgtgacgattttcacacgcatttttggcagatttttgatgcaatttcaaatttggttttggcatcgaaaggtaaagagcaatgcagtgataacgaattggagtgcacatttcgcgcgatggaacaaattgtgcgaattaattttcgattcgtttcagcgcggctaaaacaattgtttagccgtcttttaccgctctttgcttttccttctgatgggcgcctccgttttatct

SEQ ID NO: 50280 - DNA, 371 bp, Heterodera glycines
  misc_feature (368)..(368): n is a, c, g, or t
  SCN-specific regions: Sequence locations=1-371
aaagggggacgacgcctttgcacaaggcagcatcgcagggccatcaacgcattgtcaatttgctgttaggctgtcgaaaaaacttgcaaattgatttgccaaatagggagggcgacacggcactgcatttggcatgcgaagaccaacagatggatgttgcgttgcttttggcacgttccggggccagcatcgaaaagaagaatcgccagaacaaaacgccgattgatttggtcgacggcaaagaacagaaactgaaactgatcaaagcgagtgaatcggtgaagccaactgccggaacatagccgaattcctttgttaaatcaattctattgtttttcaatgtaattgtaatgaatcttttgatttcnctt

SEQ ID NO: 50281 - DNA, 447 bp, Heterodera glycines
  SCN-specific regions: Sequence locations=1-414,436-447
gttcgttatgcccaaaaaacatacgcaatcgaataaaacgaggaacatgtcgggaagagaccttgacgagatccatgctgatctgatcaggcccgacaaaatgcaaagaattcaggaacggccttttgacgacgaccttcccggcggaggatggcactattgcgtcgcttgtgaccggcactttgtggacgaacagacaaaagcggggcacgaaaagaccaaaggtcacaagcgtcgcctgcgcgcactgcgagaaaagccgtacacgcaaagagaggcggaattggccggcggattgggcgtggaagagcaaatcaaattggaaagcctggcggatttgacattttagcacccatttcttatagggtgaatttatgtttttttttgttgttgtttttgagttctttatcatacaaacagaaaataataaataacattttcgcaaaa

SEQ ID NO: 50282 - DNA, 553 bp, Heterodera glycines
  SCN-specific regions: Sequence locations=1-175,200-399,432-433,455-465
ccaaagctggagctccccgcggtggcggccgctctccaactagtggatcccccgggctgcaggtattcggcacgaggttcctttttattttctggtccaaatgtcttctaagccggcatacaaagttgctgacatttctttggccgactttgggcggagggaaattacaattgcggagaatgaaatgcccggactgatggccatgcgggcaaagttcggtgcgcaaaagccattgaaaggtgcgcggattgccggctgtttgcacatgactgtccaaacggcggtgcttatcgaaacgctgttggaactcggcgccgaagtccaatggtcgtcctgcaacattttctccacccaagaccacgccgccgctgcgattgccaagcgtggcgtgcccgtctacgcgtggaagggcgagacggacgaggagtacgaatggtgcattgagcagacgctgattttcccggacggaaagccgctgaatatgattttggacgacggaggcgacctgaccaaccttgtgcaccaccaacacgccgaacttctgcccggcatc

SEQ ID NO: 50283 - DNA, 777 bp, Heterodera glycines
  SCN-specific regions: Sequence locations=1-12,36-472,495-777
atttcgtcctcctcccccttttttcttccctttgtctctttgccgatcgtttgtcgtcctttgaagacgaatgagtaagcgttgatgagctttgattccccacaataattaccaattttgctgctcctactgctgaatattttcaaaaaactgaacggagaaatgcattctaaggacataaaggaaaagggtggacaacaaattgggggacaaggcgaagttggcgagggagggacggcggagaatgggcagcagcggcagaacagagggcaaagcgctgatgccggggcactgccgcaaaggacaatgggagcattgtacgagatgactcccgagctggagaacaaccaagatgagatacgaaaattggactcccaattggaccacctcaatgattacatggaccgggtggaagagaggctgaagacgcacaatgacaaattgatggaaacacttcgacaacagagagaggaccgagagaaacggcgacggagttttcacgagcgtctcgaacaaagccggcaagaagacgatgacttccagcaacagctgagttcggtgctcagccgagtagattctgtgaggagcaaaaaaacggaaccgaaagtgaaattggagggcgatcagctttcatcgaattgagtgatacgccttaaaaatgaatgcattccaatgccaaaatgtcacttttcttagcacacatcggtcacttctatctgcttattgtacctttttaatcgttttcgtggttctgattaaaaattcaagttttcgaaa

SEQ ID NO: 50284 - DNA, 796 bp, Heterodera glycines
  SCN-specific regions: Sequence locations=1-796
atttgcttagatggatttgttaaaatcttacgacggctcttcatcatcggacaatgaacaagaattggcagatataccttcttcgtccaatcacaacaaattgctcgctttgaaaatcccatccatcaacttaacacccaacgtgattgaacaacgcgccattcaacaggttgcggttgtggatccaaaaaccaaagagttgtatcacaatccgcgcttcgacgaattgtttaaaccagagagcggcccacaaaatccgtttaaaagtgaacatcaacgagcagaaaagaacacactgaccggctatgtggagccagcgcatttcaacgccttccattttgagcgttcacttcgctcctacgatacgcttggctatgcggataatccaacggcagacacaaccagcgcaaagttcgttggtgacgttggacaagcgcaagaaaaggccggcgagtcgctttttgaatcagtaaaaactggcggacagaagcgaaagagagtgataaattacgacgcatcaaacgttgacggatatacgggaccgtgggcaaggtttgaggacgagaagacaattgctcgaccggacccagaattgcagaaggaaatggacgaaattgtgcggaaacggaaactgaaaagtcgtgctggccgaaaagcggccatcgcggaattgcatttggcagaagagagcaccaaattgcacataaaagatgacactgactatttgggccgttcctttatggaaccgccgaaatacacgggcaccaatctgcgcgaggactttgtgcccgaccgc

SEQ ID NO: 50285 - DNA, 579 bp, Heterodera glycines
  SCN-specific regions: Sequence locations=1-140,167-344,367-579
ttttcttttccctttcattttttattcgttcaatcccttctttctttttgcaatgcttctccgtttctccctcactgttcaacttttgctgcttttcttcgcttttgaagtttttggcgctgaaccgccagaaggtgcacaaaatgaagaaggccaacgagacagcaaaagattggaaatggccaggaaagggctgaacgttcacatgttttcctcccccaatttcgccccaatgtttggcattatcgccggcctttccgttgttcttatcattgccattgttttcattgtcgtcggattgctcagcatggaacccgcgaaggattcgattatctatcggatgacaacaactcgcctaaagaaggactgattgtgagcaaagtgtgggagagagtgccgtgccgaaaaggaaaagtccgtcccccattaaatgatttgtttcatttgatagtgaatggtcacccaccctttgtcggtgttgcaatccgcaacgaatcatcaaaacatttaattttatagaatgtctatttcttcccattcattgtaatcatgtagagaataaattttttattttcacaa

SEQ ID NO: 50286 - DNA, 667 bp, Heterodera glycines
  SCN-specific regions: Sequence locations=1-343,366-615,644-667
ccaagtttgagagttactattcatctaatcacttttccaatttcttaaaatggcagctcatagccctggcagttccggcgacacttcaacgccgtcgctgcgcaaatttctcaccgacgccctcgtcggtggcacagcggcgggcattgccaagacgggaatggcgcccattgaaagggtcaaattgatattacagtcccaagatgcttcttcacaaatcactgcggacaaacgctacaaaggcatcgtcgacgtcctcgtccgtgtgcccaaagagcaaggctttttggcgttgtggcgtggcaatttgccaaacgttcttcgctactttcccacccaagcgctgaacttcgccttcaaagacacttaccagagaatgttcatggagggagtggacaaggacaagcaattctggaagtccttcgtcatgagtttggcctcgggcggtgccgctggcgccacttcgctgtgttttgtgtaccctttggactttgcgcgaacacgattggctgtcgatgtcggaaaggccgatacccgtgagttcaaaggtttggcggactgcatcatgaaaatcctcaagtcggacggtcccatcggtctctaccgcggcttcttcgtctccgtccagggcatcatcatttaccgcggccgctacttcggctgcttc

SEQ ID NO: 50287 - DNA, 788 bp, Heterodera glycines
  SCN-specific regions: Sequence locations=1-102,124-365,387-788
gatgggtgtttgtgctgagaaaacggttgctgaatttggcttcacgcgtgagcagcaggacgcgtatgcactcgcctcctatgctcgtgcgactcgcgcgtgggcgggcggcgcatttggtgcggaaattgtgccggtgaaagtcaaacagcggaagggcaccgagttaatggtggcagaggacgaagagtatcggcgactaatgcccgacaaagtgacttcgctgcagccggcgtttgtcaaggacggcactggtaccatcacgggcggctaacgccagctcattgaatgacggagcggcatcgcttgtgatcgcatcaggccaagttgaaggggcaaaaccgttggctaaagttatcgcctacgccgaggctggcagagcgcccgtcgacttctcagtggcgcccgttgacgcggtcaaaacgttgttacaatcggtgaacatttcgatcgatcaaattgcgcgttgggaggtcaatgaggcgttctccgtcactgccttggctttcattcgtcagctcgacttggacccggcacgggtaaacgcactcggcggagcggtggcgctgggccatcccattggatgttcgggagcacggattgtggtcactttggtgcatcaactcgagtcaggggaatttggtatcgctgcaatttgcaacggaggcggagaagcgactgccattcttgtgcaaagaatttgattcagaaaactgttcgccgattgttagaatttcttaatttcgaatttgtcctttttaaattataaataatcaattcggtttttc

SEQ ID NO: 50288 - DNA, 662 bp, Heterodera glycines
  SCN-specific regions: Sequence locations=1-137,164-212,235-268,301 -334,370-419,445-662
ctttcttttattgctttacacctaaactcatcaaaatgttcaccaaattaatgccatttttatctcttagacaaccgctggcagtggcctcctattctctcatacaacaggctcggaaattttcaacggcagttatgaccaattacgaaatgatcaaagtggagagagtgggcgccgacgacgtcgtcgcactgatcactctgaaccgaccgaaggcactgaacgcattgtgcagccaattgatggacgagctcgcccattccctcacttatttggacaaagacgacggagtccatgccatcgttctcaccggcagtgaaagggctttcgcagccggcgccgacattaaggaaatggtgccgaagaaatttgccgaggttttcggtggcggctttttggagaattggtcccaagttgcgactgtacgaaagccgacaattgcggcggtcaacggacacgctctcgggggtggatgtgagttggctatgatgtgcgatatcatttacgcgggagagaaggccatgtttggacagccggaaatcaaaatcgggacaatccctggagccggtgggactcaacgtcttgcgagaattgttggcaagtcgctggccatgaaaatgtgtttgactggcgaaccgatcaacgcgagcaaagcactcgaa

SEQ ID NO: 50289 - DNA, 479 bp, Heterodera glycines
  SCN-specific regions: Sequence locations=1-223,245-374,397-479
attaagatgaaattattgagattgcgctcttatcttcatttttcatgtaatttgcatgttcgcaatttgacgaatttatccaaatttggtacctacaatgagaaagccattcagcttatccagcagcactatgatgaagcgacgtcatcttcacatcaatttgtcgattctccatcccaagaagtcttccgaatggttttgccacctccgaatgtgacaggcaacttgcacattggccatgccatcactgtcgccctcgaagacgcaatatgtcgctaccagcgattactcgggaaaaaagttcgttggaccccaggctttgaccacgccggcatggccactgaacaagtggtgcaaaggcaactcgcgcaacgctttggaaaacaaacggacgaaatgtcgcaatcggagtttgtcgcacactgtgaagaatggaaagaggcaagaattcgggacatttctggtcaactccgctccat

SEQ ID NO: 50290 - DNA, 510 bp, Heterodera glycines
  SCN-specific regions: Sequence locations=1-159,181-213,235-510
tatggattttcaaaaccgagctggtggcaaaactggaggtggtggcgttgcatcggcgaccgatgcaaacgtcgatcgccgagaacgacttcgtcagcttgcattggagacgatcgatttacaaaaagacccttattttatgcgcaatcacttgggcggctatgaatgcaaactttgccttacattacataacaatgaaggatcatatttggcacacacccaaggcaagaaacaccaagccaacctcgccagacgtgctgctaaggaagcttctgatgtgccgtatatgccgttgccgcagcaagcaaaaattgagccgaaaaaatttgttaaaattggtcgtcccggttacaaggtgacgaaagaacgtgaccatgcgtccggtcaacaagcactgctctttcaaatagactatcctgaaattgctgatggcgttgtgccgcgtcaccgatttatgtcttcatacgaacaaaagatccaaccaccggacaagcgttggcaatatctttt

SEQ ID NO: 50291 - DNA, 699 bp, Heterodera glycines
  SCN-specific regions: Sequence locations=1-699
gtccatttaagattacctaattagttaattatcttcaaaatggacatgagtgaattgtgtgcaaaagttaatgcaatttataagaaggaaacggaccacaaagtgcaatcggaaggacttcagaaactgcttgagggggtgctcacctccgtgccgtcggataatttgaagcaaattaccgaggccgtgagcaatttggtcgagactgtggtgaacaatgagagtacctccatggtcgtgtcccgtcaattcatcgccgacatcgcttcctatttgagtcagccttcgctgaacaccgcactgatcaaaggcattggcgaggccgtgctcactcagcttcatgcacgtgcacttgcctacgaggagcagagcacccaaatccgcatgattctggccaatgcgcttgagcgtgaccgccaatttgagcaatccgcgcggactcttatgggcataccaattgaaactggtcaaaggggctatcgccacgaattcaaaatggaactgtacttgcgaatcactgagctgtttttggaggccgacaatgtcgaggaagcggaccgacacgtgaaaagggcctcacttttgcagcaggacgtgaaggaggaggccctggtcatcaaatacaaggcactttacgctcgcgtgttggaccgtcagggcaatttcacggaggcggcgcaccgttaccccagctatcgc

SEQ ID NO: 50292 - DNA, 439 bp, Heterodera glycines
  SCN-specific regions: Sequence locations=1-439
ggcatttctccgaatacttcgctttttcaaatccatcaattaattcacgccaaactgtgcaatgtccggacgccaaggaggaaaattgaaaccgctgaaacaggcgaaaaaggacgacaaagtgctcactgaggaggacgtcgaattcaaaaagaagcaaatggaagagcaaaagaaactgaaagaggcggcacagaaagcggcggaaaagggcggcaaacttggcggtggcatcaaaaaatcgggcaaaaaatgagtcggtggagaaaaacgccggagggaatgaatttttggacgcaaaaatggctcagaacaaaaagagaatttatatgaacggagtgattgcgactgttctgttttgattcccatccaattttgttgttccatttttgctgtgtatttttatgacggatattttcgccagttattcggcactttt

SEQ ID NO: 50293 - DNA, 645 bp, Heterodera glycines
  misc_feature (623)..(623): n is a, c, g, or t
  SCN-specific regions: Sequence locations=1-15,37-199,222-366,388-645
ctaaaaccaacccccttgaatttgatgcgttttcttaatgggctgttcgtaaattaaggaggtcttatccataaagcactgctttcattgttagcgttgaatgattgagaacatagttcccattttcaggtgtacatgttcaactacgactccacccatggccgtttcaagggcaaaatttccacaaacgccggcaatttggtggtggagaaggaggggaagagcgcgcacaccatcaaagtgttcaacctcaaagacccggccgaaatcaaatggggcgaagcgggcgcggaatatgtgatcgaatccaccggagtgtttaccaccattgagaaggttgtgggtagaggacccgggatggctaattataagcaaatttaacatttaatgatgagttttttaaggcctctgctcatcttaaaggcggtgccaagaaggtaaagctttaattgctgtcttttggtgcattttttacgtctcaaaatcaatcccataaatttactacgtcatcaaatttttgcatttgtcacactgattgtaaaaatacgaataaacccaaaaggtggtcatctccgctccgtctgcggatgcgccgatgtacgtgatgggcgtcaacgaggacnagtacgacccggctaaggacga

SEQ ID NO: 50294 - DNA, 1466 bp, Heterodera glycines
  SCN-specific regions: Sequence locations=1-177,199-707,729-976,1012 -1434,1461-1466
ctttgctttgttgaatttctttcactcaaaaatgtccagcgatattgtcgagaaaaaggagacaaaccccaatgagacggatgacaaaaccaaagaaataaaatcgcttgacgaggatgaaattgccgcacttagtaattacaacatgggaccgtacgcggatcagttgaagcaggcggagaaggacattgatgaaattcagaagcgcataaacactctttgcggagtgaaagagagcgacacggggctggcgccgcccattctttgggacattgcggccgacaaaatggccatgtcccatgagcagccgctgcaggtggctcgctgcacaaaaatcatcaaagaagagggcaaagaaacgcgttacatgatcaatgtgaagcagttcgccaagttcgtcgtggacttgcacgaaaatgtggcgcccactgacattgaggagggaatgcgagtgggggtggaccgcaacaaataccagattcatttgcctttgccggcaaagattgacgcgtccgttacgatgatgcaagtggaggacaagccggacgttacctacgcggacattggcgggtgcgaagaacagatcaaaaagttgcgtgaagtggtcgagtttccgttgcttcagcctgagcgtttcacgagtttgggcattgagcctccgaagggcgttttgttttttggtccgccgggcaccggcaaaactttgtgtgcccgcgcggtcgccaatcggacggacgcgtgtttcatccgcgtcatcggttccgaattagtcaaaaaatacgttggcgaaggcgcgcgcatggtgcgcgagctgttttcgctggctaaaacgaaaaaggcgtgcattctcttcttcgacgaagtcgacgccatcggcggagcgcgatttgacgacggaaaagggggcgacaacgaagtgcaacggacgatgctcgagttggtcaaccaactggacggattcgactcacgcggggccatcaaggttttgatggccaccaacagaccggacacactcgacccggcgctcattcgtcccggtcgcattgaccgacgcattgaattttcactgcctgacgtaaaggcgcgtaaaaacattctccaaattcacaccaaacggatgagcatcgagcgaaacattcgatacgaattgattgctcggctctgtccgaacacgacaggtgccgatttgcgcagtgtttgcactgaggcggggatgttcgctttgcgtgcacggcgtaaggttatcacggagcaagactttctcaaagctgttcagaaagttgtgaaaggctatgcaaaattcagttcgacgccgtcctatttgacgcacaattaattaaaggaattgaaagagggacattatagaaaggaaaattctgaattcatctaattaatgcgtcgatttgtttgttatatttattgtacaatgataggttttattttattttaaatttatttaactaaaa

SEQ ID NO: 50295 - DNA, 599 bp, Heterodera glycines
  SCN-specific regions: Sequence locations=1-4,34-199,221-376,439 -439,479-599
ctctgttgccgaattcggcacgaggatttaagcattttctaatttaattaacggtttgccaacctctgcacattcttcgttacaacttccgagattaatggcgtcgcacaccgccggcatccaacaacttcttgcagccgaaaaacgagctgctgaaaagattaatgacgctcggaagcgaaaagcacagcggctcaaacaagccaaacaagaagcacaggcggagatcgaccaataccgacatgaaagggagcagcgttttcgcgagtttgagcaaaactatttgggcacacgcgacgacattgaggcgcagataaagcaggagacggaagcgaatctgaaagccatggacagtaatgttgcaaaaaacaaacagcaggtcattgtgcgtctgctgcaattggtgtgcgacatcaatccggaactgcacacgaaccttcaactccaagtcaaactgttcggcaaagcggcataaactgaacggacggaggagcggagttgggaaagaatgttttttgatgtgatcgtttatttaaaagacaacaattagttttatattccatcaaatataagaggttattaaaagtatcgtaaaatgc

SEQ ID NO: 50296 - DNA, 638 bp, Heterodera glycines
  SCN-specific regions: Sequence locations=1-638
gtccaattaagcaattacaatgcttcaacgtctatttgttggcaagaatttcacctgtctgccgttgttcacttctcatcgcaattatccgggctcaaatttcactttccccatagattggtatgaaaataagtatgtgttactgcaccaacgcgcccgtgaaaaagtttcgcccgattttcacaagcagaccaccggccttaacggcctttacgtgaatgaaaatccgcacaaagaccttcgcttgctttaccaccgcattttgcgcgtgattggaatgatcccggacagcagtcagtaccggatggccgtcgaagaaattgtcaagcatcgcctttcgcttgttgaagcggaacccgacattcaacaattggagcagaaaatcggcatgggtcagattgaagaagtagttcaacaggccgagtatgaattggagtgtattcgtctgtttgttgcacataaatgttgggaaccgctggtggaaaaagcggatgaggcgcaatggcggtggccaattggaccaggcccataagggaatcaaatgaccgtgaaaatttgacgccttagaacgctgtattttttctcgttacaattattttaacgaattcacgtggagaatataaacagtataattgcga

SEQ ID NO: 50297 - DNA, 605 bp, Heterodera glycines
  SCN-specific regions: Sequence locations=1-54,76-123,145-605
gcgaaataaaaaaaagaaattatccaatatttaaaaacagcgaacaaaaaggtcaggaggcaaagaagaaaaagatgtttgaagggccaatcaaaatttggtcatggaatgtcgccggtctgagggcgtgtgttaaaaaaggagggcacaaacatattcgagagtcgggtgctgacattgtgtcactgcaagaaacgaaatgttccgaatttccagctgaaatcaacgcattggacgaatatccatacaaaaaactgctgatgactaatgagaaaaaagggtatgcgggcgtggcactcctttccaaggagaaaccaattaaggttgaggaaggcatgggcgacgtggactttgacgaccacgcgcgttacatccaagcggaattcgctgcctttttcttaatcgctgtctatgtgccaaatgctggtcaaaaattggtgaacctacagaagagaggacgctttgatgaacttctgctcaacaaactctccgccctgaatgagagaaaggcggtgataattgctggggatatgaacgtggcgcatcaggagattgatcttcgaaatcccgaaacgaacagaaacaaaaccgccggattcacagac

SEQ ID NO: 50298 - DNA, 639 bp, Heterodera glycines
  SCN-specific regions: Sequence locations=1-639
ccaagtttgagtgatcttttgcttctgatcaccgactgatcgatcaatcgatcacttcgttattttctcggcaataaaatgccgagtacagccattcaaaaacttttgttggccgtttccatttttctgatcgtcgccggcatcgttttgacagtcgccggtgttttttcgcccgcttggcaagttgttgacattcgcgaattccgagctgaacatcagcacggcctttggtgggattgcattcgtgccgaaaagcatgtggtggcggtgggcgacttttacgaggaagcgccgctccattgcatgtacaaattcgacgagtccgcggcattagtcatcgaaagagcgctgaaccatgtcgacgaggacggggcagctggagaagctgagcaccaccgattctggggatggcataaggtcgtcctttcgctgatccttctctcccaattggctgcgtttgtcgccgtttgcaccggcgtttgtgcgccttattttgccccgtccaccttctgtttcgccatttctctgttcatcgccatgcttttgtcggtgctcgccgatggcattttcttcttctccgctaatcgcgtcgacattcgcttcgtcaccggaatggtcggcacttatgagcaagtgatc

SEQ ID NO: 50299 - DNA, 526 bp, Heterodera glycines
  SCN-specific regions: Sequence locations=1-526
ccccgcggtggcggccgctttcgaactagtggatcccccgggctgctttactcggcacgagggccgtgtcaccaacattccttccgggatgctcaatgatctattcgccatggacggccttctgacctttttgcggaccattgaaagtgcgccgtccatcgtcggacttgcgctgggccacgacttgaccaatttgggtctcaatttgaattcttcgaagcgaaatctcttccaaacgtttggtggtccctgggccgactttccgtgcagaattcaagatttggacgcgaaagtgccggacgaatatttgaccaatgcgaccattcgagacaaattgccgaacatcaaaatgaacaaattgcacgaggacgtccttttctatttgttctacaactgtccgggcgaagtttaccaagtggcggcggcgaccgaactgtattcgcgggattggcgcttccataaagtggaacgcgtttggctcatgcgggcgcccttttcggcgcctccgcgagaaattggcggcact

SEQ ID NO: 50300 - DNA, 476 bp, Heterodera glycines
  SCN-specific regions: Sequence locations=1-28,56-157,179-476
aaacatattcatatcaaacaattataataaacgaaaaagcaaaaacaacagcaaacccctgaaatatgttgaatgacgacgattttccggctttgccaaattcagtgctccaaagcaaccaatcccagcaaatatcggcgcaacagaggttaccatcacagcacacacaccaaaacaattcattgctcgtgaacgatgacgctaccaacgcaaggctaagtcggatgaagcagcaaatggcactggaaaactcggacaaagtcggcattcagacgcatccagacggccgtgtcaccaacattccttccgggatgctcaatgatcagtgtgtaacgaatgagacaaacattcgtcttcagataaacagttttcctctcagattcggcatggccggccttctgacctttttgcggaccattgaaagtgcgccgtccatcgtcggacttgcgctgggccacgacttgaccaatttgggt

SEQ ID NO: 50301 - DNA, 481 bp, Heterodera glycines
  SCN-specific regions: Sequence locations=1-449,471-481
ctttcaacggttttgtgacagagaaagcgattatggcgaacccttttgatgacgacagtgacgaattcattcgcaaaatccgggccggccgtggaattgaaccgacaaaaagtttcacaacgcccgcagcttcgcaaaacattgaggaccaaattgccgctgatgagaaggccattgagcgttacttgcaggcgtcgttggacagcacacagcgctcccgacaacagctgagctcatccgaggggttggccgagtccaccgcacgggaattgttggagcaacgggaaaagttggaacgggccgaacagaatttggacaccattcaccacaccactcagcacacacagcgcagcctgaacagcttgaaatcgtggtttggtgggctggtcagaaacaaactttcacgagcgccaaaagggttgggcacggcaaatgtcaatgccaacaatcagcagcaacaacaggaacagaccgtgcagca

SEQ ID NO: 50302 - DNA, 482 bp, Heterodera glycines
  SCN-specific regions: Sequence locations=1-482
cattaattcttaaaatgaacaaaactgacgatcaattagctgaatgtcgcgaaatcttttgctacttcgattccaaaggcgacgagaaaatcaatgtgaaacaggttggcgatgttttgcgggcactcggccaaagtccgacggagtccgaagtgcgaaaatgttgtgagcactggaccgaaccagatacgcgcatttcatttgaggaatttgtgccaattttccaaacggttagcaaatcgcgcgctcagtacacaaaggaccaatttgtggagggattgtctcatttcgaccgcgagggcaatggcacaattgccgttgcggaactcaaacatttgctgaccaatttgggtgaacgtctctccgaggaagaggtggagcaactgctcgccggccacgacgtggccaatggttttgtcagcatcgattcgttcattgaaacagtgcttcgttttcctttgacccctccggacaatgagaaa

SEQ ID NO: 50303 - DNA, 730 bp, Heterodera glycines
  SCN-specific regions: Sequence locations=1-730
attccggccccatcaacggtctctctgttgatgcatctgacggtttgcactttgtcacggttggccaagacgcgcagttcaaagtgtggccgttgccaattgaatttgatggaaatgctcagccaacgcagcccgtccattcgttgtcccttgacggggtccctcacggctgttcccacgtggcgatgtccagcgatttcgtcacctgtggtgagggcatttcggtgtggcggttgcacagatcttcgcccattcgccattacgctgttgggcccaacactgtgcagcatattaactgcaaccccatagaggaaggcattatggccggatgtgccgcagatcgctccatttttctgttcgacacccgccagaaagtgccgctgagccgcgtagtgctcaaactgaggacgaacagcattgcctggcatccgcttgagccgttcacttttgttgctgcaaatgaagactacaatttgtacaccttcgacatgcgcaggttggactccgctcgccacgtccaccaagggcacacctccgctgtgatggacgtcgactttgcgccatctggtcacgaatttgtcagtgggagttttgacagatccttgcgcattttccctgttgaacaatggcgaagtcgggaagtgtaccacaccccgcggatgcaatatgtgctgtccgtcttgtggtcttccgacaacaaatttgtgttgtccggcagtgatgacatgaa

SEQ ID NO: 50304 - DNA, 374 bp, Heterodera glycines
  SCN-specific regions: Sequence locations=1-374
tctctcgtcgaccgccgccaaaacgccggtccaggagttcggctttgagtatctgaagcggcagatgaacctgggcaggccgttgtcgccgcacttgcaaatttacaagccccagttgacctgggtgatgtccggcgtgcatcggatcctcgcctgcatcatgtccggagcgcttttggtcggcgttttcgtttttggcatttgttcggtcgatttcacttcgttcgcggaacggcttaactcgtggaatttgtggcgaccggcttttgacatggccaaaggcaccgaattggcgtccgtttaccgctccggctatttggtgatcggcttgtccacgctcatttccctgctcattgtggccaattcgaagcatt

SEQ ID NO: 50305 - DNA, 1405 bp, Heterodera glycines
  SCN-specific regions: Sequence locations=1-687,709-1405
gtcctattaagcgacaaaagaaaatggtcaaagacaaaaaatattactacatcctcgaagtaaacaccagtgcaacagaccatgacttgaaaaaggcctatcgaaaattagcgcttaaatatcatcctgacaaaaatccgaatgaaggcgaacgttttaaactcatttctcaggcttacgaagtgttgagcaaccccgaaaagcgtaaagtatacgacgaatatggagaagaagggcttaagggtggcggagaaggcggcggaatgcacaatccaatggacatattcgaaatgtttttcggcggtggtggttttcgtggcggtggtgaaaaaccgaccaaggtcagagatactgttcatcagcttaccgtttcgttagacaaactgtacaacggatgcaccaaacacttgcgcatcacaaggcatatcctttgtccgaaatgtaatggtgtcggcggcgctaaggaaggggtcaaacaatgcgaaaattgtcgtggacgcggactggagattcacaacatgcaaattggtccgggaatgattcagcgaattcaaagagcttgttctgaatgtggcggtgagggggaaataaatcgcaacccgtgcaaacactgtggcggcaaaaaacggatcaaatcagaagagacaatcgaagtgcatattgagaaagggatgcgcgacgggcagcgactgatgttctacggaaagggcgaccaacagccggggctggagcctggcaacgtgatcattgtgctggacgaggaggagcatcccgtgttcacgcgaagaggcaccaacctcaccctgaacatgaaactgacgttgacagaggcattgtgtggctgcactaaacatgtggtgacgttggacaaacgcattctcagctttactcagttgcctggcgaggttatcaatcaccgcgacttctatgtaatccaaggcgaagggatgccgacccatcgtcacccggaccaaaaaggcgacctgattatccaattcttcgtggatttcccagacaaacttcctcttcaaatgaaaaacatggacttgctgcgagaattgctgaaagatcacgagattgagcctgagccggaaacaatcggagcgaacgcgcagaacgctatcaaattggtgcccatctctgaagaaatgttacgccggcgagcgcacgacgaagaggcaagcaacggagaaccgcaagcggtgcgatgtgccactcagtgaacgtgaccgtgaccaatgaaaggatgattttgatggtcaattacggcgtctgacttttacatattaattgctgaagagaatattataaaccgctgtttgtttgttctttctgtattccaatcgcattgtttgatcttttacttggattcttcatgtatttgattagacctggaacagcaaaa

SEQ ID NO: 50306 - DNA, 684 bp, Heterodera glycines
  SCN-specific regions: Sequence locations=1-241,265-417,439-652,675-684
gtccaattaagtttttgtttaagcaatggcggacgacgacgctgaaacattcaaactttggcgcgtacgtaagactgttatgcagatgtgccacgaccgagggtatttggttacgcaagacgagttggaccaaacgctggaccaattcaaggaccaattcggcgatagacccagcgaacggaggcccggcaggggcgagctgaccattttggtggcacataatgacgaccctactgaccaaatgtacgtgttcttcccagatgacccgaaaataggcatcaaaactatcaaacagatctgtcaacaaatgcaagaacagaacatcactcgagcgatcattgtggttcaaagtgggatgacaccgagcgcaaaacaggcgattgtggacatggcgcccaaatacattctcgagcactttttggaggcggaactgatgataaacatcactgaacatgagcttgttccggaacacgtggtgatgagcagcgaagaaaaagcggaactgttggcgcgatacaagctcagagataatcaactgcccgcgcattcaagtcagtgacccagttgctcgttacttcgggttgaaacgcgggcaagtggtcaaaatcattcgtgcatcagaaacggcggggccgttacattacttaccgactttgcaattgatgtttaattcagaggatttgt

SEQ ID NO: 50307 - DNA, 1142 bp, Heterodera glycines
  SCN-specific regions: Sequence locations=1-134,160-166,190-253,275 -286,308-374,409-484,506-509,532-543,565-586,656-658,682-733,800-1142
gcgtgaaatcttccatattcaagctggccaatgcggaaaccaaattgggtcaaagttctgggaggttatttctgacgaacatggaattcaaccagacggaacttacaaaggcgaatccgaccttcaactcgagcgaatcaatgtctattacaatgaagcacatggtggcaaatacgtgccccgtgctgttcttgtcgatcttgagcctggcactatggattcaatccgagctggagcgtacggacaactctttcggccggacaatttcgtttttggacagagtggcgcgggaaacaattgggcaaaaggccattacacggagggtgctgagttggtggacaatgtgctggatgttgtgcggaaagaagcggaaggctgtgactgtctgcagggctttcaactcactcattcactcggaggaggcaccggctcaggaatgggcactctactgatttcgaagatccgcgaggaatatccggaccgaattatgtcctctttctcagtggttccatctcctaaggtctctgacaccgttgttgagccatacaatgccactctttccgtccaccaacttgtagaaaacaccgatgagaccttttgcattgacaatgaggccctctacgacatttgcttccgcacattgaaacttcagaatccgacttatggcgatctcaaccatctcgtgtctgtgacaatgtctggcgttacaacttgcctccgtttcccggggcaactcaatgccgacctccgaaagttggccgtcaacatggttccgttcccgcggctccactttttcatgccaggatttgcgccgctttctgccaagggggcagctgcgtaccaagccttgtctgtgtcagaacttaccaagcaaatgttcgatgctaaaaatatgatggcagcgtgtgacccgcgtcatggccgttatttaacagtcgcggcgatgttccgcgggcgaatgtcaatgcgcgaagtggacgatcaaatgatgtcggtgcagaacaaaaattcgtcttacttcgtcgaatggataccaaataatgtgaagactgccgtatgtgacattccgccgcgcggtctcaaaatgtctgcaacttttgtcggaaattccaccgccatccaagaattattcaaacgaattt

SEQ ID NO: 50308 - DNA, 484 bp, Heterodera glycines
  SCN-specific regions: Sequence locations=1-10,32-215,237-484
ttaagatcaaaaaattttcccaatctttatatattatttttttcaaaatgcggcagtcgcccaaccaaacgccggtcactcgcacaacgacgacgacaatcactgaacaacagagggaaggcggaggagaccaacagaccaattctgaacaatttgtgcttaggctggaagcaccgcccgacacgcggccgagggtccaatggagcaccggaacagtggacaatgaaaacatgggcaaaaagaagtcgaaatgttgttgtatttacaagaaaaagcgcagttgggacgacccaaacgcatcgagcgaagacgacgacggagaatgtgaaagttcgcattgccgtggccacgtggagaaacagcgaaagccgccgccgtcggacgatggaaatggcggcggtgggcccggcccttcgtccatttcaacctgatcaattttgccaatcatttgcctatccatttactattatttatcgatttcctt

SEQ ID NO: 50309 - DNA, 477 bp, Heterodera glycines
  SCN-specific regions: Sequence locations=1-59,103-114,146-271,302 -330,361-477
caccatgtcgtccgcttcgcgcttcaacgaataccaggtggtgggccgtcaccagccctctgagaccaaccctcagcccacgctctaccgcatgcgcatctttgcgcccaacgcggtggttgccaagtcccgcttctggtacttcctcaagaagttccgcaaggtcaagaaggccactggccagattgttgccgtcaaccaagtgcttgagaagaaccccactcaagtcaagaccttcggcatctggcttcgttacgactcgcgctcgggtacccacaacatgtacaaggagtaccgtgagttgacccgcgtgaacgccgtccaggcttgctaccaggacatggctgcccgccaccgtgctcgcttcaggtcggtgcagatcatccgcgtcgccgaggttgccaccaaggacgtgcgccgcccctacattcagcagattctcgagaagaacctcaagttcccgctcccccaccgcgt

SEQ ID NO: 50310 - DNA, 1074 bp, Heterodera glycines
  SCN-specific regions: Sequence locations=1-769,791-1074
gtttgagagaacatgtcccaaactgaaaaggaactactggcagaaaaggtggacaggcagcccaatgcaggaggcgaagccgacagcttctctaaatttgttcgacctcagtgtaatgcccgactcagaaacgagcattgaactcaaccaaatgcgagtggacgctgtgccggacttggcaaggttcacccaattacagtttcttggtctccgccaaaacttgttgacatcgttgaatgcgaaccttggccggttgaccacgcttaccgagttggagctgtacgataaccaactgactgaaattgccggcctcgaccagttggtcaaccttgtgatgttggacatgagttacaacagaataaccaaaattcaagggctttccacaatgacgaagttacgccgtctgttcctcgttcacaacaaaattaaacggatcgaaggcctggaaggtttggacgcgttggaactgctcgaattgggggacaaccgaattaaggtcatcgaaaatttgtgccatttggtcaatttgaatgaactgtttgtggggcacaacgacattcagcgaattgagggaatccaaacgctgataaagttgcgagttctcagtctgccggctaatcgcttgaccaaattggaaggattggacacactgacggagttggagcagttgcacctcagtgaccagggcattgaaagcctcgacggacttggcaatcagtcgaaactgatcattttggatgccgcgaacaacagaatcgtcaatttggatggcttgggacatttacagaaattggaggacctttggctgaacaacaacaaaatcgttgtttggtccgaggtggataagttggcccagcttcgcgccctcgacacggtgtacctggagcacaacccgttgtacaccacggacaccaaccagtacaggcgcaaggcgatgctggcactgccgcacattcgccagttggacagcaccgtgtgccgtcagcaaaaaaatgtggtggaggaagacacaaaacaaaacagcgaagacaacaacaacgcgaagccaaacagccaaagaagtgccgtggcgac

SEQ ID NO: 50311 - DNA, 448 bp, Heterodera glycines
  misc_feature (445)..(445): n is a, c, g, or t
  misc_feature (447)..(448): n is a, c, g, or t
  SCN-specific regions: Sequence locations=1-14,36-388,411-448
ctcataaattgtcttgcagaagtatttaattaaaatgattgaaacactcgagacgagcgaagtgttgaagcgggtccttaagtctgcgctgattgtcgacggagtggcacggggtttaaacgaagcggcacagactttggacaagcgtgaagcgcacttttgtgtgctggccaaaagctgtgacgaggcgtcctttgagaaattggacaaagccgaactcggtcaaatggttggccagtgcaaatacgacaaagacggaaaagcgcgcaaaatcgtcggctgttcggtggcggtggtcaaagactacggacgggacgaagaggcgaagaatgacttgcaggaagtgctgaagaaaatcagcgactgatgaggttcctatgtcatcatattgttgtttttgtttggttgttaccgcggctataaaagactcttctgtttaaaaaanann

SEQ ID NO: 50312 - DNA, 459 bp, Heterodera glycines
  SCN-specific regions: Sequence locations=1-31,53-358,381-382,404-459
atggtcgaagccgccgaacagtcgcaacaacagcccatccgtcgccgtgccggaccgaagtcggcacgtcgcctttatgtgaaggcggtgtttaccgggtacaaacgcggacaccgttctcagcacgagaacacgtccctgctgaagcttgacggggtcaatgacaagtcggatgccagtttctatcttgggaagcgtgctgtctacatgtacaaggggcacaaaacaatcgcacgcggtggtgggccgaagacgcgtgttcgtgcaatttggggacgtattacgcgcgtgcatgggaattcgggagtggtgcgtgccaagtttcgtcacaatttgccgccgaccgccatgggcaagcgaatccgtgtgatgttgtacccgtcaaacatttgaggaaatacagaatgttttttgttacaccgtttttttttttgttgatcgtttataaatgttgatgac

SEQ ID NO: 50313 - DNA, 336 bp, Heterodera glycines
  SCN-specific regions: Sequence locations=1-293,315-336
caagtttgagcaatttttttcctaattggtactcaactgagagtaaattaaatggttcacgaaaacatccattggtcccggccacgcaaatttgggcctggctcgcgctcgtgtcgcgtatgtttcagtcatcatggactcattcgaaaatattcactgaacatttgccgtcgctgcttccgcgaatacgcctccgacattggattcaagaaactcgattgaattgatggagaaagcccgagtatttttcattgttttcccggaagcattgttatcaatcacaaattattgttgaattttttgttttgataaatcaaaaagttaaaaaaaaaaaaa

SEQ ID NO: 50314 - DNA, 652 bp, Heterodera glycines
  SCN-specific regions: Sequence locations=23-39,61-169,193-302,325 -339,363-652
attaagaagaaaactgaaaaatgtcgagacctaaagtcttttttgatataaccattggtggaaaagcagctgggcgtatcgtgatggagctttattcggacattgttccaaaaacggcagaaaattttcgttcgctttgtaccggcgaaaaggggatgggaaagagtggcaaacctctccattacaaagggtctaaattccaccgtgtgattccaaatttcatgttgcagggtggcgacttcactcgcggtaatggtaccggagggggaatcgatctatggcgagaagttcgtggatgagaatttcaaagagaaacacacccagcccgggattctctcgatggccaacgccgggcccaacacaaacgggtcacaattctttgttacgactgtgaagaccgaatggttggacggtaaacacgtcgtattcggtcgcgtcactgatggaatggatgtggtgaaagctgttgaagctcaggggtctcagtccgggcgcgcttcgaaagacattatgatcgctgactgtggacaattgtcgtgagaatagggccaagaaaaaccggattttccaatgttatgaatggtattgaaacaagttaaggcaatctctaattttaattattgagggcgatgataaatttgtgatttaaaaa

SEQ ID NO: 50315 - DNA, 127 bp, Heterodera glycines
  misc_feature (103)..(103): n is a, c, g, or t
  SCN-specific regions: Sequence locations=1-127
cggcggcgtgggacgcaaagcgcaggcgcaagcgtggggcacaacacagggacgttggccgaaaaagtccgccgagttccttctcccacttctcagaaatgcngagagtatggccgaggttgagggg

SEQ ID NO: 50316 - DNA, 716 bp, Heterodera glycines
  SCN-specific regions: Sequence locations=1-27,62-716
ttatttaaatctgagaaatgccgtcgcgaaatttgtcagcaaagaaaaaacaacagaattcgttagttcgggatgagtcgacctcttcacccagcagaacgcccaaatcggtgtcgaaagcgagtaacagcaacagtagccaacagaaacttcagaagaagcataattcatcagaactgtccacgattagcagtgaaagtgtcgaaaaggatctcagctcttcaatgtctaccaatccgcacggacatccgacggacaaaaaatggaccattggggagaaagtgttatgccgttatctgaactcggagcacatttattatgaggctaaagtgatgtttctgaaagacttgtctggcggagatgtcggctatggcattcattatccgggttggagcaaccgtcacgacgaagttgtaccacaacatgaagcactaattcgcttcaagaattactccgatgaagaggcaaccaaggcaaaggaagacgtgaaaagggctcagcagatgctaaatgccaaaaaaagaaagcgatcggaactgaagaaccgctcgcaagcgcatgatgaaagtagtcgctccagcacaccaggaagcgccgacaacgcatcaaaacgtaagatcgcccgtcggacgacaattgaaactagcgcagtggccaaaaaggacatgccccaagtcacattgaccgaccctttgcgacgcattctgatagacgac

SEQ ID NO: 50317 - DNA, 452 bp, Heterodera glycines
  SCN-specific regions: Sequence locations=1-64,86-107,129-452
aacattatgactttgcttatcaccggaatccttcgcaaatttgcacttacaaaattcccatttactgcatcaaattcttctttgtcgtcatggtgtaaagctcgagagtccccatttcccatctcaatggcgaacaattggaaagcctttttgttgatgaacgcgtccaacgcttgctgctttcgctgaccggccatgacaccgacaaaattttgcgccatcgtcgcatcaaccaaacggagcgcaagcattacgcgttgatgacggacggcatggtgaaggagttcatgtcacgactggaccaacgggcgggcaaatttctgcgaattgtgccgttcaaagagccgcgctcaaaccgaaccgaagtgttggcacgggacgcggaaattgacggatttgacaccgccaaattcgttttcaccgacatttcattcgacgccacagatatggat

SEQ ID NO: 50318 - DNA, 602 bp, Heterodera glycines
  SCN-specific regions: Sequence locations=1-386,408-602
cgcagattcgcatttgattggattctcggtacgcagcataaattggacgtggacgtgcatgtttcggacgaattggacattaacgcgttcttttcaactggagaattacagccgaacgaaaagagtttgcctgttgacgacacttcagccgtcataaaggagcgcttatggcaagagccgaaccatgaaattgtggccaagttgctttcgatgggtttcactgaaaacgcagctaaaaaagcggcgcttttcacaaagaacgaatcagcggaatcggccattaattggattcttcagcattctgacgacactgatgtaaacgatccgcatccgatgttaacgaaacaaagcactccgccactgacatccaaccaaggccagaacgcgtctcagaaagttcgtcacggcaaaggtcattaccgactgcgcgccttcatttcgcacattgggtcgacgccaaattctggccattatgtcgcacacgtaaaggcagacaatggccagtggcacatttttaatgacgaaaaagtggccaaatctcaacatcctccgaagactcttggctatctttacctgttccaacgggccacctgaacagtcaa

SEQ ID NO: 50319 - DNA, 521 bp, Heterodera glycines
  SCN-specific regions: Sequence locations=1-15,37-521
ccaagtttgagctgttaataaaagcatagaaaatgccggaacgtttgacttatcgtagaaggctttgctacaacacaaagtccaataaaacgaaagtggtgaagacgcccgggggacggaatgtgttccactaccgcaataagcttggttcaatcccaaaatgtggcgacaccggtgtgccgttgaaggggattaaagccgcgcgtccgcgtcaattggccaaaatgacaaagcgaaagaagacggtcacgcgcgcttacggcggttgtctcagcgctgcggctgtccgtcaacggatcatccgcgcctttttggtggaggaacaacagctggccaacaaaatactgaaggcgaaaagtggcggtgggaagaaataatgcgggagacggacggacgaagacgggcggacagttcggtcattttaaggacggaattatttttgttgcttttttgttacctttgtgagtaaaagcattgctctgttcacaattcttcaaattacataaagggaggctaacttt

SEQ ID NO: 50320 - DNA, 1550 bp, Heterodera glycines
  SCN-specific regions: Sequence locations=1-214,236-311,342-495,523 -525,547-660,684-733,783-864,919-975,1012-1072,1094-1104,1126 -1128,1228-1479,1519-1529
gagatttacaatctcttagggatgctcagttctttccccttattattgtccttggtcggcctcatcgccgtccacgccgaagtcttcttcaaggaggagttttctgatgacagttggactgatcgatgggtcacgtcgaagagcaaggatgactacgggaagttcgagctgtccgccgggaagttcttcggggacaaagtgcgggaccagggcctgaagaccagccaggacgcccggttctacgccatctcggccaagttcccgaagaagttcagcaacaagggaaagccattggttgtgcagtttaccgtcaaacatgagcagaacatcgactgtggcggcggctatatgaagctcatggcttctgacatcagccaagagaacttccacggggagacgccgtaccatctgatgttcggcccggacatttgcgggcccggcactaaaaaagtgcacgtgatcctcggctacaaaggcaaaaaccagctaatcaaaaaggacattcgctgcaaggacgacgaactcagccacctgtacacactgatcttgagcccggacaacacttacgaagtgcaaattgacggcgaaaaggtcgagagcggcgaattggaggccgattgggaccttttgcccgcaaagaaaatcaaggaccccgacgcgaagaagcccgaggactgggacgacaaggaatacatcgacgacccggacgacaaaaagcccgacgattgggaaaagccggaacacatcccggacccagatgccaagaagcctgatgactgggacgatgaaatggacggcgattgggagccgccgatgatcgacaacccggaatacaaaggcacctggaagccgaagcagatcaagaaccccaactacaagggcaagtggatccaccccgagatcgacaaccccgagtaccagccggacgacgacctctacttgcgagaagattggggcgccatcggaatagacatttggcaggtcaagtcgggcaccatcttcgacaacattttggtagcggactctgtggaggacgcgaagaaacacgcggcggacactttcgaccagctgaaggaggcggagaagaagcagaaggaagcgcatgacgaggaggagcgcaagaagttcgaggaggaagagaagaagcggaaggaagaagaggagaagaagccgaagattgacgaagaggaggttgaagaggacgaggaggagaagaaggaggaggagcacgacgagctttaggacggcgcccgaccattggccttgtcactttccatcctcaatgattgcaccttcccgggttctccctcatctcttcttttcggtatttaatggcaatttgttatttaattggttcaagagggactgttcgatgattccttcgaccgcccacaatggtctctctcaccgcctttttgatatttctttctgaaagtgaataatgaatgaatcgctgactcccatctttcctccgtgcttgttgtttttcttttgttcttttacataaaaatatttattgtcccaatttgaaaataaattgttaatttgtt

SEQ ID NO: 50321 - DNA, 785 bp, Heterodera glycines
  SCN-specific regions: Sequence locations=1-687,709-785
ataggcttttgcctaaaaatcgaagccctaatcataatttatttatcttcaaaaaatctgattttttgacgacggttcagtaccgaagccatttggccacttcacgagaccgagaggagtcgaatgatttatcatttgttagatttggtgagaatgggcattttaactgcttcgaaagtgtgcactttgccacggctttcttccgctcgctctatgacttggtggtggggcccggagaaaaacaatgggcgcgaagttgttggccccactttccacggggatgaattttaccaagatcgtcttgaccgttggtacccgtccattcgatttcgcaaaaatgacgaagtgatcacgcccattcgccacaaggaattgggagattggaagaagttgagcattgaggagaagaagcttatctaccgctactccttccgtcaaactttggccgagtttgaggcattgacgccttatggctatctcacagtcactttgttcttttctatgcttgggcttactattctgtacgcttcgtttgttaggacttacgtgacaaaattcaatgaccgattgcctgacactttcgatgatgaatataaagaaagtcaggccgagcgccgtgtggtactggaaaggggcaatccttatggaccggcctactactacgattacgagaaaaatcgttggaaggactgaagtggacggaaaagtcctactcgaaattcgttggagtgttttttaattttaggggatttttaatggacatttcaaatttgcacattttttcg

SEQ ID NO: 50322 - DNA, 500 bp, Heterodera glycines
  SCN-specific regions: Sequence locations=1-25,47-500
aatggcaactgttagttcatctagcaataatacatgtaaaccaagtgaaagttattccgcctcaaaaatacctcaatgtgcggaaacaatcaaaaaaatgttccacgaattgggaatcaaagagtacgaaccgcaattagtcttacaattgtgtgatatttcttactcattgaccaaggagattctcgtcgatgctcgttctgtttccgagtttagtggcaagaaacaggtggacagaagcgacgttgaccttgcgatcaaaacatttgatgaaaagcacagtaatgatcgcccaccaaaagcttttgtgtcggaattagccgcagaaaaaaatgcactgcctttacatccgatacgtcaaaattatggactccgtttaccgaatgaccgtttctgtcaactgcagcccaattacatatacatcggagatgatccgaacaacgaagaccaagcagtccatatggaagagcggcccagacaaaatggatcgtcgaaattca

SEQ ID NO: 50323 - DNA, 441 bp, Heterodera glycines
  SCN-specific regions: Sequence locations=1-9,31-32,55-70,92-193,215 -441
cagcattccaattaaaaatataattattttcgttatttttacacaaataacaaataaatattcatcatggcaacaccaaaattgtacaaattccatgtcgaaatgacctgcgaaggctgctcaaatgcagtgaaacgtgtacttggcaaattggaagacaaggtaaagctgctcagtgtggacctgaacgccaaagaggtgcaggtggagagcagcagtatgggccaagatgagattctcgaggtgctgaagaagacgggcaaagcagtgagtccgatcgaatgaggaacgcattcgatgtgatcagaattattccacctcctttttttttggccgatgcgatcagttccctgttgtaccctttaaacattccattccctcctctccatactgatcagtgatcgatggtcatttattaaaaaaagaatttaatcaaaaaaa

SEQ ID NO: 50324 - DNA, 725 bp, Heterodera glycines
  SCN-specific regions: Sequence locations=36-88,110-281,303-725
actagtggacccccgggctgcagaatcggcacgagcccctcaaggcagttcattctcctgctgtccattgtctggtccttcaatgtcgcttggaattgcaccattcattgtttgggccgactgaggacggcaccgactgtgcttcttccaccaaatcgtatgctttgcgcagtgacggggcttcctgctcgacaacaacagatgcgaagcccgactttgcttcaacgtatgagcattgcattgacttgacctccactgttggcacgtctcaatctgcaaatttgttggatttagtggccgaatccaccagtccattggaagtgccgatgtgtaagaaatgtgccaatgcagtgactgcggagctgaacaagcaattgggtcatttggagaaggaatgcatccaatacaaaaagtcgttggaccatttgttgcgccggcgtgcggactgtccatttgacatggaggcatcgcgcatcaaattggacgctttaaaatcagaagagcgcgacctattggaacaactgacgctgttggaagacgaggaacggacactgcttcatgaattggatacaaaacaggaggagcgcaagaaaattggtgaacgagacgagcaactttatcgacagttgcgagacaaccacagtatactcattgaacaatcggatgaacagcggtcatttaaattgcaaatcaatcaggccaatgaacaaattcgacgtctgtcc

SEQ ID NO: 50325 - DNA, 632 bp, Heterodera glycines
  SCN-specific regions: Sequence locations=1-15,37-351,373-632
gagaatttgaagttcaaaagagagagacgagaaaagttcagtcagtcggcggcgattccttcgaatttgcccccttcgacaagcaatggacaaatgggttcgcttcttctgcacgatgaaatggcgtccgcttccagcggttcttcgacctttgcgttggacatggataaattggagcaacagcgggtgcaggaacagaccactctactgctcgacgataccgaacagttccaccaatcccggttctactccatggaaagcattgaaagcagcatctctgagctgggcacgattttccgccagttggccactctcgtctcggaacaaggcgaaatgatcacgagaattgactcaaatgtggaggagagcagcctcaacgtggaggcagcacaccacgagttgctcaagtatttcaacaacatttcccgcaaccgttggctgattatcaaagtgttcggcgttctgatggcattctttgtgttctttgtgattttcctcacctgatcggctgataaactcagttctgcggggattccttcacattgtcatcataatcactcacagaattttattctcttaaacagcagtcaaatcattgaccaaatattcctaacttattacccattctttat

SEQ ID NO: 50326 - DNA, 786 bp, Heterodera glycines
  SCN-specific regions: Sequence locations=1-635,657-786
ccaattaagacttattagatatttgcttccgtattccctctttgttgtcctgtccattcattttccatgctgctcaacaatcggtctcaattgccgttgagtgtttacggcggtggcattggcagcggagtttcggcactttccgccggtgccaaagaccattccgccaccgcttcttccgcgtccgttcgtcggcccccggtcagccaatatcagagcacggagtgcgtgctgttcggcagcattttcaacgatcagaaagaccaactgatccaacggctgaagggtctgtgcgacccggacggaccgacgcccttttttgagcacaacatggtgttcaagctgaagacgggcattgagtcgcctgtccaagtgcaaatgcgccgtcgtttcaaagtggacactgtgcattggcactgccgttacgtgtcccaacccgaggcacacattaaggacgtggtcgtgcgcaaggtcatcgactcgttgattcattccaccgacatgatgagctttgtcaaatcgttggggctgaggatggaatacgaatacattgccaacggtttcctgttcaccaagggtgacatccgcattctgctctaccaactccaatgctcggagaccatcggcaactacaacaagttgaagcagttcggcgactcctttctggtggaggcctccgttctgttgccgggccatgggctcgagcacttgcaacaggcggccaaatcggtgaaggaatttgcggaccaactgcacccgttgtgcaagctgagctacgtggactat

SEQ ID NO: 50327 - DNA, 681 bp, Heterodera glycines
  SCN-specific regions: Sequence locations=1-5,28-635,657-681
cagcatcatcatttgcttctgttcatccatatgattgtgaagcctgttaaaaatttttttcaaaagaatgtgaccaaagtttggctgaagccgccgcctcatgacacttttattgagccttggtttccctatgctttaattctaaagccaattggtcgagcatttcagcgtttgggcgtatacacttacaacaatttcatcgcccgaaccacttttggtctttacccgcgagaatggaacccgcgtgtccacggcccatatgttcattatcgttactacggaacaaacaatgacattccgctaatggaagtcaaagtcaatgacttggccgcgtacatcgcccgtcgtgacaaatctccgcgtgccatttggcgcgaatttatgcgcaacttctacaagcttcagtacttctacttctcggggcccgagttcggcaaccctttgacaatgatttggcgctatctcgtcattttcatcgtcggctttttcttgaccctccgagttgtgaccggcgcggacacgcgtttccgacacgctttgtaccattggtagacggacggacaaagagggccgatgagagaaaaaggaaacagagcgatagagcagaaacaccgtccgaattattgttaggcaatgtctccatattttctgtgctgttattaaagcctattgtagtttaaa

SEQ ID NO: 50328 - DNA, 476 bp, Heterodera glycines
  SCN-specific regions: Sequence locations=1-297,322-476
ttaagcatcgtttgctcttcgattgttggccatattttgtttgatgagattcgatttctcgagtgttttcacccattttaacccatagtttcactgtcatgaaaattggacatcggaccccgccgaggcagaaaagagccactgaccctcccccacagttcgattcttccgatttgggctctccgcaaaaggtttggtcactgttatgcgagaaggacgagaaattgcgccgagatccgcacgtattttcgcgccagaagaaaataaacgccaaaatgcgtgccatgctgctcgactggctgatggacgtctgtgccgacaaacagctccaccgcgaaaccttccatctttgcatcgattacatcgaccgtttcatcgcattgagtgaccaccaaatgcagccccagcgattgcaactgttcggctccaccgccctggtaattgcgagcaaagtcgaggaaatttatcctccgaaa

SEQ ID NO: 50329 - DNA, 862 bp, Heterodera glycines
  SCN-specific regions: Sequence locations=1-300,416-506,528-571,593 -682,704-862
ggtaaatttactggcaaatcaacaaaaattaggccatcgaccgctaccatgacgacgacagaaacgccgacggcaccgcgcttggaccacaccacgggctggacctgtttggcgtgcaaattggtgttctccagcgggcaattgcagcgggaccattaccgcagtgaatggcacctgtacaacatgaagcggcagattgccaacctcccgcccgtgacggaatgtgacttcctggagaagcttcagtattttttgcaacaccagcagaagaatgctttcgatgctgaccatcgtcgtctgtcctccctctctgtttctgctgctgcttcatctcttcccctcggtgcctctgctgttgcttcttctcttcccccattgtcttcctccaatttgtcgtcttcttctccgtcttctttggtttgcactgtgtgccgcaacaaacgctttcggtcgcgcaacgcctttgacaaccatttgcagtcgcgtcggcacaaagaggaagaacaactgcaacagcagcagaagacgacagcgacaattgaggctaatgagtgccaaacggaggggcgagaaaatggcggcatggaagcaaaattgccaaagattgtggcacaaaacattgatggtgaagaagaagcggttttgccaatcgaaagtgataatgatgacgatgaagaagcggagcagaaagaagacaacagttttgccaaaaaagaagacggcatcccgccaaacgaatgcctttactgtgaactcaaatccgacacttgggaggcaaatttggcgcacatgagcaagcagcacggttttctggtcccggactcgccattctgcacggatgtgcccgggttgctcacttatt

SEQ ID NO: 50330 - DNA, 638 bp, Heterodera glycines
  SCN-specific regions: Sequence locations=1-230,252-638
gtccaattaagattacactcacaatcttatctacctagttattttttcatttgatcaactacacgattaaaagcgtcaatcatgggcaagggattccaaaattttatgtccaagaaggacttccatccaagtgcatggtggaacttaaaaaggaaatgccgaagctgagcaaaagaatgacttggagaaaagaagacaggatgaattgcgtgtccaatatgagaaggagcaagaaattctcaacaataaggcacttcttggtgacgaaaaagcgaggttgggcctttctttcatgtacgatgcgcccgctggcattaacaaaaagaaggaggaagggccggaaccgaaattcgaatggcaaaggaaatacaatgcaccgcgtgaagaatgggcgaaaggaaatgaactcatccaggaccaacctttcggaattcaggtgcgaaacgttcgctgtgtcaaatgtcgcgcgtggggtcatttgaacacggaccgcgaatgcccactgtatggtatgagtggaaatgctgaagaccatggctatgcaaataatccctccgatatcattcgtgatttaaatgtcgaaaagaaaacaaagactgtctctgatgtcacgaccaatgagcagattgatataaaac

SEQ ID NO: 50331 - DNA, 476 bp, Heterodera glycines
  SCN-specific regions: Sequence locations=1-86,109-476
gttcattttgagggtgccgatgttgacgcgtctggttctcgttacggtgcatcaattccatttgaaaaagcaatgcgaccggaagtaattattgcatatgaaatgaacggagatgtcctcacgagggaccatggctttccaatccgtttggttgtgcctggtcatgtcggagcccgacaagtcaaatggctgaacgccattcgccttagtgacgaggagagtcccagcacttggcagcaaagggactacaaagcatttccaagttccgtccaaattggcgatccactgccctttgacacaactccagcaattcaggaatacccagtccaaagtgtcatctgtgaaccaaactcaaacactaaaattgcaccgggtgccaaaactatcacagttcgtggatatgcatggagcggtggtggaagaggaattattcgtgtcgaagtttctccagacaatgggaccacatggaaatgtgc

SEQ ID NO: 50332 - DNA, 487 bp, Heterodera glycines
  SCN-specific regions: Sequence locations=1-459
aacgtggacatgctaatgagtataatcgtccccgaaaggcgtagcattgccagcgccattcagattctcttttcccatttgttcggcgatgcctccggcccctatttggtcggtgccatctccgacttcgtccgcggctcttccgatttgccagccgatcgtttccattcactgatcgtcgctttttatctgcccaatgctttgctttttctcagcggcgcggcatttctcggcgccgcttattcacttcccgcggatttgaaacgaatggaagcggaaaaagctgcggcagagagcccaaaacccacaacttcggccaccattggcccttcgtccgctaacattggtccgcaagggcggcaaaacgaagcttttgaatgagagggaaaagcagctgataatgatcatcatcatctctgcgtttcataatcattctgttatcgaattctcacattttacttttttttaaattctatttattttattt

SEQ ID NO: 50333 - DNA, 628 bp, Heterodera glycines
  SCN-specific regions: Sequence locations=1-628
accattcgatttcaaaacaattcctttcaaaacaaaataaatgggcacaccctccaggcgtggcaggaaaagaaagtctgaagtagtgcccgataaaagaacatcgacatcttcagcaagatcaaaacctttgatgccgcgcaaatcatttgtgccgttgtccattgaacagtttcggccaaccgcagttggcacacgcgtgctgagctgtggcgagggcgaacaattgggccatccaaatcggaacacaacgaaaaagccgcgtgccgttggcacattcccaaccgacatgacatttgttcaggtcgccgcgggcggtgttcactcgctggtgttgaccactgatggacgtgtgttcagttgtggcatcaacgagaagggcactgtgccggtccaaggcctggaggcggaaggcaccaccgacacattcagcgaaattgtgttcaccacggacatccaacggcttggcaaaattgtgcagataactgccggcgcgtcattttccgcagcgctcaccgaaaagggcagtgtcatcgcgtggggaaatttgagggatacccaaggggaagtcaatgtgcacgagacgctcacggacatacagaagaaaccgatggtggtgatgcggcac

SEQ ID NO: 50334 - DNA, 487 bp, Heterodera glycines
  SCN-specific regions: Sequence locations=1-487
ttcattactagtttttattttttgaataatggacgatgatgacgcaatcggtggtgctgaggcattcaaatgggaacaagcttacacggaagggctgaacattcgttcggtgctccaagaggacgaacatggctccgtcgaggagtccatccgtcggttggtcatggacgagaagcgacagcgacggatggaccgactgccggccaaaatccgactcggaatgatgcgttatgtccatttggctgtcgattgttcctccgccattctctccgccgatttctttccctcgcgtctctccgtcgcgttggaatgtcttcgtaaattcgtcgacaaattcttcctgcttaatcccctctcccaaatgggactcatcgctgtgcgtgacaaacgcgccgagcgcatcagcggatttaccagttctgtccaatttctgctcgaatctctgcaggacatcagttccaccaattgtggtggtgaattctctctc

SEQ ID NO: 50335 - DNA, 716 bp, Heterodera glycines
  SCN-specific regions: Sequence locations=1-83,105-282,304-368,390-716
gtgaaatatttaatggcacaacctgctaagcgtgttgctgtcagctcagttaactgggctaagttggccgaacggctgacgccacaacaggaggaggagcttaatcgtttgaaagcacaaaactcttcatatcatgcagaggttgtacaacaccaggctgatctgcctaaagttgactgggctacactgaagaagcaaatgccggaaaattcgactgttcttgactcattgcagaagcaatgggaagcgttgtgcattccatacggaacgatacctgacaatctgaagaaacaaattgaccagtgggtgaaattcaatgaggcccgagtcaagtttcacgagcttaagacggcggatggacttgtggaaatgaagaagattgaagacaaatgggcgaaaatgccgccagtcgagcagctttggcgtgaccaactcgtccagtatttcccacataagtatcaggaccttcgctatctcaacgagtattatgacccatggggcattggtgttaatgacaccaattggcgcgagcgtttcaaggacttccagagtcgtcctcgagagggtgcaacgcttcactgatcgcatgattttacaatttaggaaattcaacgtgattttatttggaagaagttattcgatagagatgttattaaatggacattctcttttgcacaaattggtttagatgataaaaatttgttgctctcaaaaaa

SEQ ID NO: 50336 - DNA, 667 bp, Heterodera glycines
  SCN-specific regions: Sequence locations=1-5,27-228,250-667
agccctttaaatgtgcatatcatcatcctttgtatcacttcattttttactaatttctgaacgaatttaattcccaaaaatggcctccggtttttgggcatttgttggcagagcttgggaatggctgaaaacgttgattctgccacagagtatcaatgggacttgtctcaaccaaacgttcatcaacgacacgccatcggcgggagaatttttggccgatttggagccctttcaaattgtgcttctctctgttggcagtgtgctcactttcaccgtttttctgctcgcctttctccagtggtggtacattttcaattacgtctcctcggagcagcggcgcaacaaactttacttgctcatctcattgttccccgtttgcactttttgctgtctcgtcggaatgttctgtcctcgcaccgctctgctcgtctcttccttcggccttctctatttcctcctctgtctttttgttcttgtttcactgatgcgccatttgtccggtggtcgtgccactttggccctttctctcaccgacaaaggcaaattgatcgatttccgtggtcctccattttgctgtcttctttactgtcttccaagggcaaatccgacagaggtcaatttgacacgacttgaatggatcgtcctccaggcgcccatcatccgagtt

SEQ ID NO: 50337 - DNA, 1439 bp, Heterodera glycines
  SCN-specific regions: Sequence locations=1-165,188-1172,1195-1439
tttgagataatgccaatcatactgaaccaaggcatattatcaaccacatgtgatgagcagcaaagagagacgctcaagcttcaacttgagccagcagcagaatacaatgaaacaaattttaaacgaacggtgttaaatgcgtccggtacaccaatcaatggagcgttcactttttggtcagccccttccactgctgctccggcagcgacagcatctgtctccaatttatcggccacaacaacagttatctcatctgaaccggatctcactccactcacaccgtccacttcggacgtgacagttaatggccacagcagcaatgtgaaggtgcttaagccggtgccgttggtgatccgaacccaaagtgcggacgaaattgcgggtgccgttgcgcacccgaccaaaccgtcggagatccggaaactgatccggtcaaagatggtccgatgtcgcatttgcaggaaccgttttctggacaagcacatttatgagcgacatttgcgcgacaggcatcccaaggaacacgcggcttatctgagccaacaggaggacgaagttcgacagcaaagaaaggaagaatttgaagcgaaccgattagacgaactcgtcagtggcggtttcattccgcctcaggaggatttggatgcatcgaaatacgaagtgaacatcaaagagattccattgcccggcgaattgaccggcggcgtgcccgcccggtttgaccgcttcggtgtgctctttcaaccgaagcgggtgtacaagaagaaggtgtcaccgcagtgcccattctgtgacaagcgctaccgcaacgaatattcggtgaagaaacacatcgccaaaaagcatactgaatgcgcggaatgggcccaatgtttgaagtgcttcaaggcggtgccgagcaaggccgagatggtggaccatctgggtgaaatgatttacctctgttttgaatgtgtgccgccgcgcaatctgtgcaacgacgtgcgcctgtacaaccaccggacaaaattccatcgtggccaaaattcggggttcaaatgcaacctgtgcaatcagaagtttttgacgccgcgcaagttgcgcaagcacaagaaaatgtcgcatgtgttcaccaagacttaccagtgccatttctgcgaggaactgttcatcaacgaaacggcggtgaccacccacgagcgcatccacacgggcatcatcaaatttgagtgcaaaatttgtgactacaaatgcaatcgtttcctgaacatggaggaccatgtgaaggaggaccatggctatctgtgctccatttgtcagagcaaactcagcgaatggggtgacctcaaaaatcacatgctcatggaccacggcggctatctgtcgtcagagttcaactcagggtacatcgaaagcccgcgcgtttggctgatgttcaagggggactgattgatttgacg

SEQ ID NO: 50338 - DNA, 343 bp, Heterodera glycines
  SCN-specific regions: Sequence locations=1-258,280-305,327-343
gaagctgaaccctttcgtctcctcctcagcgcgcaaatcgcgcaaacgccatttcaacgcgccctcgcacatccgtcgtcgcattatgtccgcgccgctgtcgaaggatttgcgcaataaacgcggagtgcgttctacgcccattcgcattgatgacgaagtgactgtcacccggagccactacaaaggcaatgcccggcggataatgcgtgtgtatccggaaaatttttttattgcaccgttgacaaaaatcctcccggaaaagggccaagggaccaacgggcccaggttgggaattttccctttcaatggtggattcccaaagtttgaaaatgggaaaagg

SEQ ID NO: 50339 - DNA, 519 bp, Heterodera glycines
  SCN-specific regions: Sequence locations=1-519
ctcaagacaatacgaacacaattcaaagtaaatccaagtcaggatatcctacgaaaatggttattgtctatcgaccttacgtcagtcgttggcgccgagcatggacagttatcaaggcaaagcctcgtttctggctcaaatattatccagaattttctgcgggctggtatatgctggttccatcggtcattatttgtctcggaacaaggttctattttggcgggtatccaaacaacttcggcatgggctggaacgaaaaacccttctatcgtcagtttttcgaggtgcgtcgtcccgatgatccattggttctcaaatggcgtcttcctgaggaatatcccgctcgtttccaaaccaaccgtcagtccgactactaccctactaccgctcacaacaaacactacgcctgggacgtgaaataactgcgtgtcgagcgaacagcgaacgacaagaaaaaaacatgcacatttattttatgttacgtttaggaatgacactgtaaaatgttctgccaaaaaa

SEQ ID NO: 50340 - DNA, 399 bp, Heterodera glycines
  SCN-specific regions: Sequence locations=1-344,367-399
ggcaccgattcgattaattacttgggtgttcgccttttgtgggtgacgggtcaatcgggcgcaacgctgcaggccaaactctctaaggatttgatgttggtgcatatgtcggtgcctcgtacaatgtctcccgttgccatctccgttctcggcgagttcgttcagccggcactgaagtcctgggacgttttgagcgttcaggaagaaatggcgtacgacctgagccaacagagtccatacgatttgaccatcgaagggttgtaccgggcggcgttcaggaacgggtcattgtccaacgcgctgttgtctccccattatcaaattgggaacatcaccaacaagcgcactcaacaatttgtcaactcgcgctggttgaccaaggagacggcactgatcggg

SEQ ID NO: 50341 - DNA, 500 bp, Heterodera glycines
  SCN-specific regions: Sequence locations=1-121,166-182,205-223,245 -307,329-420,442-500
aattaaccgcatatttgccactgacatcaccatggcggacattcaaactgaaaaggctttccaaaagcaagccatcttcttgaacgccaagcaggttggcgccaagaagcgcggtcagcgctggtacaaggatgttggtcttggcttcaagacgcccaaggaggcgatcgagggtcactacgtcgacaagaagtgccccttcaccggcgacgtttctatccgcggccgtatcctcaccggcaccatcgtgtccaacaagatgaagcgtaccgtcatcttgcgtcgcgagtacctccactacgtcaagaagtacaaccgttacgagaagcgccatcgcaaccttgccgctcacttgtcgcccgctttcgttggtgtcgagtccggtgatgttgccaccgttggccagtgccgccctctctccaagactgtgcgcttcaacgtcctcaaggtccagaaggccattgctggctccaagcagttcaagaagttctaaaatcttg

SEQ ID NO: 50342 - DNA, 477 bp, Heterodera glycines
  misc_feature (460)..(461): n is a, c, g, or t
  misc_feature (471)..(472): n is a, c, g, or t
  SCN-specific regions: Sequence locations=1-477
tgtaagacaaattttacaaccaaaaaaaaaatggttcgtcttattcaaaaccaattttggcggggaacgttgacgcagccgtggggtgtcaagatgttcaagtacatttggcgcaagcacagtcgttttttggtgaaaacggttatggtccaagaaaacgacatcgacagcgcatttcatctgctgaacagactcatggaacgtgaagggcttttgaagatcatccgcaacacccagcgctatcagaaaccgtttatgcagcgttcccaactgtccatcgaggcgtcgaaggcaattctggaggaggaccgggaccgcaaactcaaatttttgggagcgcaaacaccgcgcggacgcgtacccggggcaactgacgatgtgacgggggcgggcggaagatttgtcattgtttttttcactcaaatttttttttattggtaaatattcatgtcttccaaanngggaccaaanngagaa

SEQ ID NO: 50343 - DNA, 868 bp, Heterodera glycines
  SCN-specific regions: Sequence locations=1-868
gcccatttgaatgcggcggaaagggggcgcccttacctttttattgttgcgcattacgacacttacggaataatcccgtcccttggcattgggtccgactcaaacggcagcggaactgcggttctgctcgaactactcgccattctaagccaaatttattcattaccgtcacacaaagcacgctacaatttggtttttgttctttcggcaggagggaaattcagttaccagggaagtcgcagtttcatcgacgacttcaatgaacgccattcggatgagcgtattgcccttgcaatttgtttggacagtttggctcgcggcgattctctttttgtccacgcctcaaaaattccatcggatgagacgaaggcttttcgcttcattcaaactttgaggcattttgccaatcgaccagtcgagcttatctcgaaaaaaatcagtttggcttctgataggttggcttgggaaacacgaaatttacaacatccgacgtattcacgccgttaccatttcccacttcagcaaccattccaaccctttcagaaattcgttgctggacattccgacttcgttagatttctccatgttagaggacaatgccaaattaattgccaatgctttggtttcctttgtgttcgacttggactcgcgactttgcaacaacgccaaagagaacaatttggcctgttcactgcttaatgatgcagttgaagttgacccaaaaaggctcaaggcgtgggtgtcgatgttcgggtcaaagtcgcgcccaattgtcgtgtctcagcaccaattggtcgccaatctgttcgaagttgtcaaacgacttgctcacagtgcacacgtttcagagattgtggtcaatgattat

SEQ ID NO: 50344 - DNA, 667 bp, Heterodera glycines
  SCN-specific regions: Sequence locations=1-319,341-621,644-667
gagtgaagtaaaaaacaatgattgtcaatggttcgttgaaaatttgccggacagcgctcggtccgtttgttcgtcgggcatcggcttccgcgctgggtcttccgcttgaggacggtccgtccgtttctccaccttcggtggaccgcgcgaaggacatttcgccgcgcgtccgttcgctcgtcgaccaaattgccgaactttcattggtcgaagtctccgatttgaattttgctctgaaaaagcgtctgaacattcccgacactcccgcgatggcaatgagtccggaaatgtttgcagctgccggaatgtttggagcacaagcgggcggagcagcgggagcacaaacatcacaagccaacgcggacgacgattcggcgtccacaaagacttcgtacgcggtcagattggccaaatttgacgatgctaaaaaaatcgcactgatcaaagaggtgcgaagtgtgatccccggcatgaatttggtacagaccaaaaaaactgatcgaatcggcgccggtggaaatcaaaggggacatgggcaaaacggaggcggacgaactgaaggcgttgttggagaagcacggggcggaatgcgaagtgatctgatgaacatttgaggggcgaagggacatttttgtttttgtttggactattattttctatatttgtt

SEQ ID NO: 50345 - DNA, 306 bp, Heterodera glycines
  SCN-specific regions: Sequence locations=1-229,251-269,297-306
gaaacatcaaccgatggagggaatttcgacgatggaggaccgtgcgtttcaaaagaaatgcggcgaaaaataaattacgagattcggaagaacaaaggcattcgaaaggacaaagggcgaaggaaagctaaacagcggcattcgcgggtgatgaagcgaacgcaatacgaaaaagcactgatcaagcgcaaatcgcaggtcccaaacatgcgtcgggaaatggagagatatgatggtgaaaagcgtggaattcgtatttctacaatccgttccacaaaattttaattttgattaaattctttcttg

SEQ ID NO: 50346 - DNA, 604 bp, Heterodera glycines
  SCN-specific regions: Sequence locations=1-604
ctgtcattcgctttaaatgatttccggtcaccgttcggttggcagatgtttgctgtctctgccacaatttgcaagtcggttgattcccatttacggccatgtccaggcacaatgtttccacttcatgaaaaaacaagtcaccgtcgacccagaaattgcaaaactgagagagggcagaaaacggcgtaaattgacaaaagcaatcaaaaagctggcggagtacagcaaaaagccggtaccggttgaggagattgaggtcgacctacgccaccaggcaacgaagggacagagggaacggacggacaacggagtacaaggacgagacgagaagaaagaggcatatggcagaaagaagttgctcaagcagtacgcccagtcgagagccaggctggccagaacggacatcatgtggattaaacgttcaattgatgcccaagagaatgcgttggaagtgttgaagcaactctctcccacactttacgaagcggcggtacaactcgacgagcgcttattctacacacaaattcaaggtccaccaatcagtccgccgattgacaattacaattgcccagacggggagtaccaagacgtaaccaagaaatgg

SEQ ID NO: 50347 - DNA, 462 bp, Heterodera glycines
  SCN-specific regions: Sequence locations=1-462
ttgtcaaatgaacgccattcgccaaaaaaagtgaagagcaaagagaagcagaggaaaagaaacgcgctgaaaagctgcaacaatttgttgattcaagaaatttggtctttcagaagagaaaatccggtgaatacgacgacgaagtgttgacggtttgcggagaacttctgaagaataacccggacatttacacactttggaatgtgcgacgggaggccattgaaaagcgagcgacgaaatgtgaggacgaaagtgacgaggaattggccaaacgaatctccgagctgatcaatggcgagttgaagttgacgcaaagttgtttgttgcgaaacccaaagtcatattcaacgtggcaccaccgctattggtcctgtcttcgccaccccacgccaccgttgcgacaagaattggcactttgcgaaaaggcgttgggccaagactgtcgcaattttcactgctggg

SEQ ID NO: 50348 - DNA, 573 bp, Heterodera glycines
  SCN-specific regions: Sequence locations=1-195,232-340,371-573
ccacctttgagtttcattgctttttctattgaaaatgaccgaacaaactgagcgcgcataccaaagacagccgaccgtgttcttgaacgacaagttcagaactcaaggaattggaaagaaggcggccaacaaagaccgttattggaagaatgttgggcttggctttaaaactccccgtgaggctattgagggcatatacattgacaagaaatgccctttcactggaaatgtttcaatccgaggccgaattctcaccggagtagtcatcaaaaacaaaatgcagcgaacgattgttatccgtcgcgactatctccatttcgtgccaaagtaccgtcgttatgaaaagcgccacaagaacatgtctgtgcattgttctccgtgtttccgcgatgtgtccattggtgacatcgtcacaattggcgaatgtcgtccgctgagtaagacggtccggttcaatgtgctcaaggtgatcaaagcatcgggggcgaagaaggcgttcgacaagttttgagagacccttatttgaccaccctattcattgttgctgtttgttatgacaaaattttggttgaa

SEQ ID NO: 50349 - DNA, 376 bp, Heterodera glycines
  SCN-specific regions: Sequence locations=1-281,303-376
ttgagaccaaaattaatttgctccctctctaaatgccgaaggaagaagtgcccgaaggagttgaccagctgacttattttcgtgagcaatgcgagcataaggttgcccatttgaagtccattttggaggaatgcaacgagcgcgtgcggtccaagccgaagaccactgaaatttgtcacatggagatgatcgactacgtggagggcctcgatcattgtgccaaaccgaaggcattcaaagcactgaaatgatgcccttcaccgccggatgattactttaggttttttgtctgttaatgtttttcggatttatgacgacgatatcagcaagcttttcaaatggatattaatcaactggtaaaatatgtaattaaaaa

SEQ ID NO: 50350 - DNA, 705 bp, Heterodera glycines
  SCN-specific regions: Sequence locations=1-143,172-310,347-640,663-705
ctcacgcttacgcttacccgcccccccgacccacccaagcaaatcatctaacatggctgacactgttgaggttgccgccgccgaggtccacgttgcgtcgaccatgactgtggaggaagccctccaggacgtgctcaagcgttccctcatccacgacggccttgcccgtggtatccgcgagtccgtcaaggctcttgaccgccgtgaggcccacctttgcgtgctcgcccaatcgtgcgacgagaaggaatacgttcgcctcatcgaagccctctgcgccgaacacaacatccgcctcatcaaggtcgaggacaacaagaagctcggcgagtgggccggtctctgcaagatcgaccgcgacggcaacccccgcaaggttgtcggcgcctcggtcgttgtcgtcaaggattggggagaggagtccgaggctctcaacatcattctcgagtacttcaagtcccaataagttgggtcctctgcgaggttggtcggcgcacgttgcgcacgcatgattgtcggtttgctcgctcgctggcgttcccgggtttctcgttccaagattgacctcggcgctcgggttttgttggttgcgagtcgagccggtttctttgtctgtgtgtgtttctgcgtgccttcccatcagcccattgtactttttcttgaatgcaacgttgcgtgtccttgtggcacactcattttcgcttt

SEQ ID NO: 50351 - DNA, 489 bp, Heterodera glycines
  SCN-specific regions: Sequence locations=1-489
ctaaagcttcgtttgcatggatttagtttaccacgaaaagcaagttggacgtatgtgtgctcaacatgcactgaacatgcttctgcaaggcgattacttcacgcccgattctctcgcttcaattgctcaagaattggaccaaagagaacgtgcgatgctaagggacgaatctgagtttcaaagtcaaaattacgacgattcgggatacttctcaattcaggtgaaactgaagctttgcgtcgtcaagcgaatttgagtctggagcctatcataagcccaaatgctatgaaggttttgcaaaatccgagtttggcacatgcttacatttgtcacctggaggaccattggttcacaattcgcaaaattgggacgacttggtttatcctcaattcgctgttcaaagcaccgcgcattgtatctgaaacgtttctcgaattgtacgtccatcagcttaataccgaagcgcccaacatttttggccatgacgaa

SEQ ID NO: 50352 - DNA, 687 bp, Heterodera glycines
  misc_feature (684)..(684): n is a, c, g, or t
  SCN-specific regions: Sequence locations=1-687
caagtttgagatggcatcaaaaattgttccaattgccgtttcgccctctttcaactttttgcgtcgtccattgccttcgttggtctttcgtcgttctcttttcaaatcgccattggacgcgccgttctgtggcatttacaggacaaatggcgggatttgccggacggatgacattttggtgtgccaacgcaagatggactatcaccttggagcaaatgtccgtcatcaacggggtcggaaccagcacttgttgaaagctaattgtgacgggacggttgtgatcacacgcggcaaaacgttcgaagagttcaagcaggagtatgagcgtgagtcggtttcgaggcgtgcggcatttactcgcggcaccattttcactgttcttttttatccgggcatttttgttggcattttggcggtcatcagtgtcatgtctcatcgctggtacacttatcatggcactggccgtgaacttcgccccgtgtcgaacgccttcgtccgctttgtcgccgctttcttcggttgttacagctattttccctacaacactgaccccgaccctgaaccaatcgctgtcgttgaaaaggaatgagtggtgaagaggaaatacgatttaggcaagcaaccacaacactttggtctttttattgttatttccctggcacataaacacagaccaaatgcaantaa

SEQ ID NO: 50353 - DNA, 358 bp, Heterodera glycines
  misc_feature (117)..(117): n is a, c, g, or t
  misc_feature (277)..(277): n is a, c, g, or t
  SCN-specific regions: Sequence locations=1-5,34-358
aagggggccccgggctgttttccccaaagagggcttattgtagtaaaaatgtccgaaaataagtccgaaggtggtttctgccaagaagaagagcggtggattcaacacgaagaagtnatatttggacctcgcatccggcggaactgctgctgcagtctcaaaaaccgctgttgcacccatcgagcgtgtcaagctgttgttgcaggtgcaagatgcttccattcacatcaccgcggacaaacgctacaaaggcatcatcgacgtcctcgtccgggtntctttttttttttggctttctgtcgttgtggcgtggtaacctgttcaactccatcccgttcctttccgactcaggcgctga

SEQ ID NO: 50354 - DNA, 846 bp, Heterodera glycines
  SCN-specific regions: Sequence locations=1-770,794-846
gaaagaacaaaacagcggcgacgaggaggcggaagaagcggacgaacaccggacaaagaaaaggggcatcctcagcttggaagacggcatcatcgtcgatgccgaaccgcttgccaagcgggagaagaagcagttggtcatccccgtcctccaagtgtccagcagagcacaaatttctcgcattcagaagctggtggacgagggaacagccacagaaacagacttagcacgactgtcgctgttaatcgacagtttggacgacgagcaaaggaaaactaccacattgccattggacgcgcgccaccaaaccgtgccgaccgttgcggtggcggacgacgacgacccggactacgcgagtgtgccggtgggcgagttcggactggcttttttgcgaggctgtggctggaaggacgagaagtcgtgcatcggcaagtcaaatccgcaggtggtgccactgcgcgtcatcgaaccaaggccaaagggactcggacttggcgctgtccttccgacaacggcaccgccgacggccaacgcgctaaaggcggcagaaaacggtgacgaagaagcgacaacacttggcaaacactcctacgtcagatgcttatccggtctgaacaaaggctcttatggccaagtgatgtcaatggacgaggagaatgccagcattttcgtcgagttggcatggccccccgccaacgttggcaaaacggtgcgtgtcagccaatgggcggtggaagtggtgagacggaaagagtatcgcgagtgcgtaaagggcggcagcggaggaggaggaacagcggagaacggacggaggctcgaaagggtccgagtctgatggaattggca

SEQ ID NO: 50355 - DNA, 671 bp, Heterodera glycines
  SCN-specific regions: Sequence locations=1-197,219-671
gttttcatagtgacttttttccgtgctcctcagctgctcatgtttgaatacatcgaccaacttgacagtgagaacaaacacgaggaggcctattgcctgttggccaagcagagcctgaacaccggcttaaatcagcaggaaattctgtggcgacttgctcggtcatgtgttcagatggcgtacccgctcgacatgaaaaacccgaagaagaagaaactgcttgacgaaggccataagtacgcctgctccgcctacgagctgtgcagcgacgacttcaacgtgttgaaatggactgctgccgcggttggctcacggacggactttctcggcacgaaggagcgcatcgaacagggcaatttcttcagggatgttctcgacaaggcattggccatcaacccggaggagtacactctgcttcacatgcgcggcaggctcgtcctctcggtggcttctctgtcgtggattgaacggaaggcggccaccgtccttttcggcccgccgcccgaagtttcactcaacgaggcgatcagagacttcacggcggtgttggagttggcgccggattggctggagaacactctcttcctggccaaggcgtatttggccaacagcgacagggaaagtgcggtgcaccatttgaaacagctgatcgattcctaccagcagaacga

SEQ ID NO: 50356 - DNA, 799 bp, Heterodera glycines
  SCN-specific regions: Sequence locations=1-232,254-385,407-799
ccaagtttgagtttttttaatggccaacaattttctctccgttcgtcgctttttgcattgctgccctccactacgaaatgttgtcaatggcagatggacgacaacgcattacacacagaggccgagagaaaaggacggaaggtggaaatgcgtggacatggcttgtgtggaggacgagttcgacgtggtcattgtgggcggtggccccgctggactgtccgccgccattcgcctcaaacaattggcggcggagaaggcaaaagaattgcgcgtttgcttggttgaaaaagcacccgaaatcggtgcccatacgctctccggtgccatcattgagaccggcggattggaccgtctttttcccaattggcgagaactcgactcgcccatcaaacaggcggtgaagaaagacgcattcgcaattctcaccaaaaatggacgaattccggtcccattggtccccggcgtcctgctgaacaaccatggcaattacattgtccgccttggtcatttggtgcggtggttgggcgaacgtgcggaggagcacggggtcgagctgtactcgggcattgctgcgcaggaagtgctttttgacgaggctgggaaaacggtgtgcggagttgcgacgggcgatgttggaattcacaaggacggaagcccaaaggagagctttgaacgcggcatggaactcaaagcaaaatgcacaatttttgctgagggctgtcctggccatctgacaaagtcagtcattggaaaattcgggctcagggagggcagagacccgatgacttttggaaatggg

SEQ ID NO: 50357 - DNA, 733 bp, Heterodera glycines
  SCN-specific regions: Sequence locations=1-733
gctcgccgtatcgccttcacccttttctgtgctcgatggggaccgtgtgccgactgtggacattagccaaaacaccgccgaataccgcgaattgatccccgaggaggtgacctagttctaccacgagctgaccgaggatgacaaaaacgcacttaatgaagtggcagaacgccacgaggaattccggacggaagagcaagcaatggaagcgctgaaggaaaagagtgagaagctgtacaacaaagcggtcgaactgcgcacccttgtcaagggaaaaattgaccaattggtgcccgacgcgaaggcattcgtcatcgggatgatcgaaaaggcaaagggaatgcgcccgaaggccggcgagaagccgaagcttgaggagctgcgcacggcggccaacgagctgatcgagaagtacaaagcattgaatgacgaagccaaagagtcgctgaagtccaacttccccaagattacgagcgtcatccaaaacgagaaattccaaaccttggccaagagtttgctgaaacaggaggcaccggccgcctaaacggcggcacttaggaaggaacggactgatcactgattaattgatggaccattgcgcttaatcttttgccattattttgtaccaaaaaaacagacagaacagaatttgtgcatattcacatacactgataatataatattataataacttttctcagtcttttgtaaatggctaataaattgaattgcc

SEQ ID NO: 50358 - DNA, 533 bp, Heterodera glycines
  SCN-specific regions: Sequence locations=1-482,523-533
gcatggaagactctgagcagaatattaccgaacaatcggtatcggctcccaccactgatcacgacgaatatgaagaactttgcaaattggtcaacccaatctcaaaaccgcttgcaaacagaaaattggcaaagaaagtctacaaattggtgaaaaaagcggcaaaagagaagggctttttgagacatggattggctgatgtgatgaaagccttccgaaagaatgaaaaaggaattatcgtcttggcaggaaacgtttcaccgattgacgtgtacagtcatattcctgccatttgtgaagaaaagggtcttccttatgttttcactccgtcccgtgaacaccttggtctttgtgctggctataaacgtcctgcaattgtccttttggtgaagcgacacgattcgttcgcggagcttttcgatcaaacgcacgagtcaacttatgcgctggtggtggaaccggaataagcttttaattccaaaattgttgtttgttcgttttgtttcactcaataaacaaattgtcttaaaaaa

SEQ ID NO: 50359 - DNA, 653 bp, Heterodera glycines
  misc_feature (643)..(643): n is a, c, g, or t
  SCN-specific regions: Sequence locations=1-594,617-653
attcatacaatgtctaccttttattcgttaaatgtttcttcgaattggctgaaatatttatctcttgggacggctttggtcgttggctatgcagtttacattgaccgtaaacgtcgccttgacccggaatacaaacaaaaaattcgtcaaaacaggaaacagaaacaagccaactttttctacgcaaaaatgagcggaggagttgattttcccgacccaagtgatccacaggcgaatgagatcttcttcttcagtcagatcactcttggagaggagaaaatgcagactggccacattgaggaggggattacgcatctgtcgaatgcaattgtgacttgctcgaagcctgacgaattgctcagaattttccaacagaccatcccaccggagtgtttcagtttgcttgtgcaggcaattcctggcgccaaaatgcgtcggaatgcctcttcatcgtatcgccatgggcgagagccgattgatttagactgtgcaaagattgacgatattggtgacaatgcggtcgacaagaaaatgtttgttttgcaagatgacgagcttgaatgaaatggaatacgacaggaaagcaggccactccaaattatattttgatttgtttcgaataaatttgaaattttcaaaaaanaaaaaaaaaa

SEQ ID NO: 50360 - DNA, 811 bp, Heterodera glycines
  SCN-specific regions: Sequence locations=1-498,520-811
tcatcaaagggcctttgctcactttccgactcttcgcacaatgaatcgcagtgtcttctctcctcccaattgttctttgtttcgtttggcttttttcctcgtcttttgtttgcttagtgccaatgccatgaaatttgctgtcaaaggcgatgacaacaaatattgcatccttctcgactctccacaaatcactggcgcaattcgttacgaagaaaaaaatggttccttcaacacgaccactttttcgctttcaaacagctcggcttcggttgacaaaaatgccagcagttgtgatgcttccattcagcgaatttccatccaatttgcgcctctcattgagggaattgccaccgaaatgagcaaaaaatggaacatcactttggaattcaccaaaaaggacgggaaaaactacgctttgtccgactattcgctgggtgtcgttttctttccggcacaaaaggcatcgcaaaaatcccatgtctacgagaagaacggaaccgcggaatgggtcgcacagctcgaaagtgaccagtccaaacaccccaacgggttcacctgctccgagaacaaattggcgctgtccgacgcgtccacgattaattttgaatttctgaagttggttgcctttgacgacaatgaaaaggacgaattcagagacgggcaaatcttcgagaactgtcctttggatgcgcgtacttcggatttggtgccgattgtcgtcggtgctctgttggccggccttgttgtcattgttctgatcgcttatttgatcggccgcgctcgtgcaaagcgacagggatacacttcggtt

SEQ ID NO: 50361 - DNA, 468 bp, Heterodera glycines
  SCN-specific regions: Sequence locations=1-468
atgggtcagaaattagctgttagtcttgacgattattttcatcctgagacggcacctcgaattgacagaccaccgacgtttgatcctttgtatggttttccaaagggtcgcaagccaagagaaatgcaggcttcgtgggaagaattggagaaaatgaaaatgccgattagtgagcgagattattgtgcccataaaatggttgctttgcgcaaatgcgtttgggatagggcgccatttgcctcgcattattgccatggacgtcgacacgatttgggactgtgtctttatgatgatcatttgatgcgtatgaaagaatttgagcgggagaaaaggctccttatgagaaaggcaagaaaggaaagggcaaaggctgcttaagaaactaatgttgatttgctagacaattgtatctttgtggcctctgattaggaatatttccatgtttatgtgtaaaatcattgcttaatt

SEQ ID NO: 50362 - DNA, 816 bp, Heterodera glycines
  SCN-specific regions: Sequence locations=1-141,163-175,197-816
attaaggcttgcgcaatggagcagctttttcagcaggcgaatatggaccttcatcagatccatctcgaaatgagacatttggagctttgtaaaaatgagagtgaagcgcagcctctttttcagaagctccaccaacaaataaggcaatctgccgctcagctcgacggcctcgaacgtttggtgaataaagagccttctgggaagcgtcacacttcgaaatatcggtttgaacagctgcgacatgattataatgcccttgaaatggcaattaattcactgcaaaatcgactcacaacgaaatggagaacggctgcggaaagggaggagttgctgaccatgagatttaaaccaaacgaaacgcatttggactttgaggggacggaattgctcgtcaacgaccgactgaaacagtcgcacaacgccgtggacgatctgattgcgcatgggaattcagtgctcacttcgcttcgtcatcaacatttggggctaaaggacgttaaacggaaaatgcacgatattggtcaagtgcttggggttgtcaacgacaacactgcaaatgattgaaaagcgattggaggacgattggctgcttttcctcgtcctttgtgttttgtgcgttgtgttcatgtactgcttctacagattttggaaaggctaagctctttgtcctctctgctcacaatcagaataactcttgaaaaacgttatgatacttcctgaaaaggcattcccttttttcgggtcttttgctgattgtttttttctttcactgaattcttatattattttttcttgtgataataaattagttcgttt

SEQ ID NO: 50363 - DNA, 708 bp, Heterodera glycines
  SCN-specific regions: Sequence locations=1-332,354-412,435-469,492 -638,662-708
tacagtgcactggacatgcacgagcaggcgcaagaatttttgaagcgggcgattaaattgtgcccgacaaatgcgtccatttgggtgcttttgggacacgaatatttggagacgaaaaaccaccaattggcctcaacggcgtacaaaaaggcaacagagatcgattccgtttgttaccgcggatggtacggactcggccaactttacgaaatactgaagcaatcggagaccgccctttactattaccaaaaggcgcacaaatgtcggccagcggactcgagaattttgatcgcattaggtgtgattttctccaaaatcgaccggaaatcggatgcagaaaaatgctttaaaaaggcatttcaaattggcgacgtggagggaaatgcgctgacgcatttggccaaactttacgaagaacaggaaaaccagcaaaacgccgccaaagcatatgaagcttatttgacgctttacacggaggaattggtcggcgacctcagtctaatcgctgaagcgtgtcgctttttggctcgtcacaatttggaccttggcgatttggacacgtcctacgcctatgcccagcggtgtttgaattatgacctgtccaaagaggagggccaacgcatcctccgactgataatgagcaaacggaaggaggagcaggagcgcaagctggcactccctgtcggaacgcctcagcagcaaaacatt

SEQ ID NO: 50364 - DNA, 633 bp, Heterodera glycines
  SCN-specific regions: Sequence locations=1-329,351-633
acccgccgtacgtccactacattaacacgcacacaacctcggaaccccagcggggatttgcctttatgccgaaacggggaatgaattcgttggaaaacgaaatcaatcgcatttacaaagtgaccacaaaaggagtcgttgacatccttcaattctttgtgcctcggaaatccgatctgtggcaagccgacctttacccggacacgcgcagcttaatacccgctttgacagcagaagaattcgttggcggcaaaaacgcaccgccgaatttaattccggtgaaccccgaggcagcaaaggcggggccaaaagtgcaagtggcaaaaaaggcaaacattttggcacaaatgccaccccaacaagaacatccgcccgaaccgccgatgcaaaggccggcgccccctcagcagcagcgagccgcgccggtacgccacgacgaggaaatgggcatcgtacgaagccaacgaagagagccatcgccgccggaacagcaaacgccggccccgagacagcaagtccaattgcggtcgagggaggccagggacgaaacgggcggctctcaaacggcaggtcaacgccgcgccgccgcggaattggacagaattcgaagggaacagaacagaagcggggccg

SEQ ID NO: 50365 - DNA, 667 bp, Heterodera glycines
  SCN-specific regions: Sequence locations=1-71,96-104,127-667
ctgaaatataaaccacaaataaaccgacaaaaacgaaatggctccacgaggaaacaacatgcttcccaatgcccacttccacaagcattggcagcgtcgtatcaaaacttggttcaaccaaccggcacgcaaggaacgtcgccgcgctgcacgttccgccaaggcggcccgattggcaccgcgtccggccggcggtctgctgcgccctgttgtgcgttgcccaagcgttcgctacaacaagaaatgccgggtgggccgcggcttcacactggaggagttgaagcggtccggcatgggcaaataccaggccagatcgttgggcattgcggtcgacacacgccgtgttaaccgatccgttgaatccaccgagcgaaacgttgcgcgtctcaaggaatatcggtctcgtttgatcattttcccgaagaagatgaacaagccgaagaagggcgacagcagtccggaggagttgaagctggccgcacaaatgcccggctctgtggtgatgccgccggtggtcaaacagcgccggttgaaggccgagccgatcaccgaggcgatgaacaaattctccgcctattgtcaccagcgtcgcgtgcgggcggacaaacggttgaagggcaagcgagaaaagaaagcaagaaacggcggacgaagggctgggcaaaag

SEQ ID NO: 50366 - DNA, 1141 bp, Heterodera glycines
  SCN-specific regions: Sequence locations=1-187,209-652,674-887,909 -1141
tgatgacctattataatgattcgaatagcccctttctgatcactctgttgggaaggatttgtctgagtttgctgctggccaaagtgtgtcgctctctgtacaacattctctacccttatgtgatcgcaaaaccgcgcgacctgcacgaacttgcgggaggggatgccaattgggccgttgtaacgggtgccaccgatggcattggcaaagcctatgccgcgggagttggccctgcgcggcttcaacctggtgctgatctcgcgctcggcccacaaattggaggcggtggccaccgagctgaagcagtattcggccaccagcggacagcggggcgaagtgcagctgcggacggtccaattcgacttcaccaacgccaacccggcggactacgaacgacacatttttggtgccatcagtgacttgaacattggcattttggtgaacaatgtcggcatgggcaacccaaatgattacccggaacgatttgacgaaatgtcgaccaaattgttgtccgacatgacgattgtcaacactttgcccgttaccgttttgtcctcttttgtcctccgacaaatggtcaaacgccgtcgcggtgctgtcataaacatttcgtccgcatcggcgtatatgaaatggtaccagtacgccgtctattcctctacaaagagcttcattgtccatttgtccgaaatcttgcgcaaggaattcgcctccgattgtccgggcattgccatccaaacggtgtgtccaatggtcgtggccaccaaactgacgcagcgttcgtcccgtgacggcctttcttcccttttggccgccagcccaacggaatttgcgcgtcaagccatccaaacggttggcctcgtgccggagacgagcggatgtttgtcccaccaaattcaggttgagctgttgttctcccttttgctcactttcgtcccaaattcgctgttcgactttttcgtccgtttggaggcgcatttgcacaaaagtgtgctgaacacggcatccaaacagcacgactaaatacataaaatggcaacatcattaacgatgccaccaatttaaaaattgagcgatcttttcaatttccaatttcaaattattaattttgcttatcccaataaattctcaatttttaaaa

SEQ ID NO: 50367 - DNA, 419 bp, Heterodera glycines
  SCN-specific regions: Sequence locations=1-324,346-365,387-419
gtccaattaagcttaaattatatttgctacttacaaaaatggctccaccgacaaacaaagtgcaaaaggtgatggtccagccgatcaacctcatctttcgctgtctccaaagtcgttcgcgcattcaaatttggctttatgaaaacgcttcttcgcgcattgagggttatattatcgggtttgacgagtatatgaacgtggtcattgacgaggcggaggaggtccaactcaaatcgttgaaccgtcacaagttgggccgcattttactcaagggcgataacattacgctgatccaaacaatccaatgacgaggacgggcgaagatctctctgttgttgtgtgctggagcatgaaattaattcgttttcatttgcattttattaaaacgatggtcagaataattaaagcgattttcaacg

SEQ ID NO: 50368 - DNA, 539 bp, Heterodera glycines
  SCN-specific regions: Sequence locations=1-97,119-539
tttggaaaaagtaaatttaaaaatggtcgcactccgtgcccaatttgaggcgagcaatgatgtcggagttttctgtaaactcaccaatgcttattgtctggtgggcattgcttcttccgaaaatttttacagtattgtggaggctgagttggccgacgtcatcccggtcatccattgcacagttgcgggctgtcggattgttggccgtgtgacggccggtaatcggcacggactgttggtgccgaacgcgaccacggaccaggaattgcagcacatccgcaacagtttgcctgactcggtccaaattcgaagggttgacgaacggttgtcagcgctgggcaatgtaattgcatgcaatgaccacatcgctgttgtccacgcggacataagcaaggaaacggaggcggcgctggccgaagtgctcaaagtggaagtgttccggctcagtctcggcgaaaatgcattggtgggctcttacgcggcgatgacctcaaacggtgcgttggtggcggcaaagacaccgccggaggtgcagcgcg

SEQ ID NO: 50369 - DNA, 277 bp, Heterodera glycines
  SCN-specific regions: Sequence locations=1-277
tagcaaagaacagaaaaaatggctgcgcacaaaaccttcatcatcaaacggaagttggcaaaagctgctaaacaaaatcgtccgcttccccactgggttcgaatgaagacgggcaatcgaattcgttacaacgcaaaacgtcgtcattggcgcagaaccaaactgaagctgtaagcgcaaaggaacaggcggaagacggcgggcgatgatttgacttgttgctgttgattcatacatttttatggactgttgataaaggaaattgtcatcggaaaaa

SEQ ID NO: 50370 - DNA, 475 bp, Heterodera glycines
  SCN-specific regions: Sequence locations=1-475
ggaacgcgtgtctcaggccgatggaccatcctaaagaagcttggcgccggagcatttggagccgtctatttgtgcaaagatggcaagggaacagtggcagcactgaaaacggagccaatcgacacacgtcaaccgcttcttgttatggaggccaccgttttggacaccctgggcaaaaaacttaagaatgctgatggtcaacacttctgccgtctgttggaccttggacgtagtgaacaacggaatgctacgtctggagatacggtgttcaactacgttgtcatgactgtggttggcactccgttggacaaacttattcgaaacgcgggcgatcgcttcagtccgggaaccgcaatcggcatgtcaatccaattgctgagtgccatcaaggctcttcacaatgtcggttttcttcatcgcgacatcaaaccagcaaacacagcgattggacgggcggagaccaacgaacatcgac

SEQ ID NO: 50371 - DNA, 843 bp, Heterodera glycines
  SCN-specific regions: Sequence locations=1-170,192-267,292-687,715-843
acttgatttattccccactttaaattgaaggattagttaaattatattggcagtaaaatgggaattaagtttctcgagtttgtcaagcccttttgtgggttcgttcccgaggtttcaaagccagaacgaaaaatacagtttcgggaaaagatgctgtggacagcgattacgttgtttgtttttcttgtgtgctgccaaattcctctctttgggataatgtccacggacagtgctgaccccctctattggctccgtgtgatcatggcttccaacagaggcacactgatggagttgggcatttcgcccattgtcacttccggtctcataatgcaacttctcgctggtgcgaagattatcgaagtgggcgacacgccaaaggaacgggcattgttcaacggggcgcaaaaactgttcggaatggtcatcactattggacaggcaattgtctacgtggcttccggaatgtacggaaacccacacgaaatcggcgccggaatttgcttgcttatcgtaattcaactcgtcgtggctggtctcattgtccttctgctggacgaattgcttcagaaagggtatggacttggctcgggaatttcgctgtttatcgccacaaacatttgcgagaccatcgtttggaaggccttttcaccggcgacgatgaacacgggccgtggcacggaatttgagggggcgatcatcgcacttttccatctgttggccactcggaatgacaaagtccgtgcacttcgtgaagctttctaccgacagaatttgccaaatttgatgaatctgctggccactgttctagtttttgccgtcgtcatttatttccaaggttttcgt

SEQ ID NO: 50372 - DNA, 471 bp, Heterodera glycines
  SCN-specific regions: Sequence locations=1-471
attaagctcgctttggtcggccaagaaccgattctttttgcccgatcggtggcggaaaacatcgcttacggattggagaggtgcacaattgtggacgtggtcgaagcggccaaaatggccaacgcacacacatttattcaacagactcgggaccaatacgagacaaatgtgggcgagaagggcagtcaaatgagcggcggccaaaaacagagaattgcgattgctcgtgccttggtgcgtcggcctgcaattttgctgttagatgaagcgacttctgctctcgacacggaatctgaacatcttgttcaagaagccatctataagaatctgaaggggcgttctgtcattttgatagctcatcgtttgtcgacggtggaaaaggccgataaaattgtggtgatcagccgaggacgacttgaacagatcggcacacatgagcaactgttggctcaggaaggaatgtatcgctct

SEQ ID NO: 50373 - DNA, 954 bp, Heterodera glycines
  SCN-specific regions: Sequence locations=1-954
caaagatcggttttctctctttcgaggcgtttttacgtgtcctacgcgcaacctcagcagaaagtgcaaacatataaacgggagaagccgcatttgaacgtcggtacaattggccacgtcgaccatgggaagacgacacttagtgcggccattacgaaagtgctctcacggcagaaaaaagcgcgctttgtcagttacgaggacatcgacaagggcgcggaggaaagggcacgcggagtcaccataaacatagcgcacattgaatacgaatccgacaatcgtcattatgcgcacacggactgtcccgggcacatcgatttcataaagaatatgatcaccggcactgcccaaatggactccgccgttttggtcatcgcagcggacgacggagtgatgccgcagacgcgggaacatttgctgttggccaaacaaatcggactgcgcgagatcatcgtgttcgtcaacaaaaccgacttggtggacacggatgtaatggaattagttgaaatcgaagctcgcgaactgctcaccgcctacggcttcgatggagagaatgccaaaattgtgtttggttctgcccttcgggcactcgctgatgacgacgacaagtgcattttggagttgatcaatgcgctggacggactggaggagcccgtgcgtacagagaacggtccatttctgatgccgattagcagcaaatgcaaaatcaccggccgtggcagtgttttgattggcaccatcgaatcgggcacagtcaaaaagggcgacacgttggaactgttggggcaggaatatgcgcagaagacactcattgcggacattcacgtgttcggcaaaagcacagcgcagagttcggccggtgaacacgtcggtctgctgtgtaagaatctttactatgatccaatttcgcgtggtttttggttgacaaagccgggaacagtgacgccaacgaac

SEQ ID NO: 50374 - DNA, 546 bp, Heterodera glycines
  SCN-specific regions: Sequence locations=1-81,103-546
tctgcttatcagttcatttcttcacattctcccatctcaattacgtggaatgcgtcattcagcttattttgtggaaagaaaattccgactcatttcctttcattttttacgtcgttttctgtcaacttcggcaatgccaactaaacccagcagacattcgccatcaaaaatcgtccatggagcgggaaaaagcatttgggttgaatttactgctttggctgtcgaatgcaatgcggtcaatttgggacagggttttactgattctccaatgccggattttctcacgcgacatttggccgatatcggaaaaagtcccgaaaggaccgatttccaccagtacactcgtggctatggccacccgcgtttggtctcagtgttggcaaaactttattcacgtctcctcagcgtttccgtggatgcccagtcagaagtgttgatcaccgtcggtgcctatttgtccctctattacgcttttatgggttggctcaacgcgggcgacgaggcaatcatttttgaacctgcttatgacagttacgtctctcagat

SEQ ID NO: 50375 - DNA, 504 bp, Heterodera glycines
  SCN-specific regions: Sequence locations=1-504
aaaaaagatgcgagatctgttcatcgaagacaacagcccgatcactccggcccggcttgccgaactgatcagacatttctacgcgttgggatggatgcgcgataacggcggaggaatggcggtcctttgcaacggcgccgtgttcggttcgcccacttcggtgcagaaggagaaagtgtccgaaaatgatctgtttgtaattgatgctacgaccggcacagtactgaaacggccgcaaaacgcggcgagtgttccgagtgccacctgcggactgttaatgaacacaggtctgaactgcgtaattcacacccactccaaatacgcaaatcttgtctctcagttggtcacgggcaacgaattcgccatccaaaaccaggagatgattcagggggtcgagaatcgtagcagcggactccgtctcgacaacgtcgaccgcctcgttgtgcctatcgttgattctgagttaaacgaacaaatgctcagtcctgttttgctccgaacttt

SEQ ID NO: 50376 - DNA, 914 bp, Heterodera glycines
  SCN-specific regions: Sequence locations=1-29,51-807,830-869,891-914
cctcgtgccgctgtcattaaacctaaattgtaatggcttcgaaaagtaaacgaacgactcgatcacagcgcgaagctgccattcacattgatgcaagtgcggatgagaccatcgaaagcagcagtaatggctcaacaattaacagttcatcaggtcatctgtcgtcgcgtcaggacgagaagaaccacctgtgcaatcttaacgaccgtcttgctggctacattgagcgcgtgcgcagtctcgagacggagaatgcgcgtctacagatccaagtgcgcgaggttgaggttgtggagcgcaaggagaaggaaaatttgtcggcccgctacgagatcaaaatcgacgaactgcgcaagcagttggagttcttcacgcgtgaaaaggccaaattgcaaattgagagtgacaaggcgcagagcggctttgaggagttgaaggcgcgggtcggcaaattggagaaggatttgcgcaaggcggagaaggagcgcaccgcggcgcaggcggacgttcaggaactcacggcacgcttcaacaacacggacaccgcacttggcaacgcggagcgcgagatcgagcaacttcgaaacgagttcaacaactcggaaaatatggtggacatgttgcgtcgtcagttggaggacgaggtgctgctgcgcactgagctggagaatcgtctgcacaccgccaaagacgacttggattttgcgcgtcgcagtcacagcaaccaaattgaggagatacggcgcaagcgccaagtggaaatgacatcgttcagcgacgaagtggagcaccgttaccaggccaagctgcaggaacagctgcaggccatgcgggacgactttgacaatcgcattgcgcagaaccgtgccgaggtcgatgagctgtaccgcaacaagctgggcgaggcggttgaa

SEQ ID NO: 50377 - DNA, 420 bp, Heterodera glycines
  SCN-specific regions: Sequence locations=1-420
cgaaccgccgatgaggcgatcgttgccactgtgagtaaagttggcgagaatattcaactcgcccgagcatctgtcatttcttcttcaccagcgaacaaactttttggccaaacccatccaaaagaggaatttaacggcgttcaattggggcgttttatttcgttggtgtctttgggtcacaaatcggatgagagtgtttctgactttccaacagcacaacttggccaagtgatttgtcagcacatcattggaatggcgccggaaagtttgggtgaaccaaggaaaaagggagctaaacgggcaactcaaatggaaatcgttgacaatggggagggaacggagaaggaacgctcagctaatgcggaaaatgaaagtgacaccggagaagaggaggatttgaacgcttcacaagttgaccaa

SEQ ID NO: 50378 - DNA, 854 bp, Heterodera glycines
  SCN-specific regions: Sequence locations=1-854
gtttgagcttcaataacctttcaattggaagccatttgtctgcttacctgttaaatggcttccatcgcatgtttgaacccaaaagcggagttggcccggcacgcggccgcactggagatgaacatcagcggtgctaaagggttgcaggaagtgatgaagaccaacctcgggccgaagggcacgctgaaaatgcttgtctccggttcgggtgaccttaaagtgactaaggacggcaatgttttactccatgaaatgcaaatccaacatccgactgcttcactgatcgccaaggcgtgcaccgcgcaaaacgacgtcaccggcgacgggaccacgtcgaccgttctgctgattggcgaactgctcaaacaggccgagaattacgtcagcgagggtgtccacccccatttggtcaccgagggtttccaattggcccatgaccatttgctccaactgttggccgtctccaaaaaggcgttgctcatcgaccggccgctgctcatcgaagtggccaggacgactttgcgcacaaaattggaccaaaagttggccgaccacgtcacggaatgtgttgtggacgccgttttggcaattcgtcgggatgaaaacgacacggagcccgacttgcacatgattgaaattcagcaaatggaacacgagatggagacggacacgcagctgatccgtggcctcgtgcttgaccacggcggccgacacccggacatgccgaagagtgtgcgaaacgtgcacattttgacatgcaatgtttcgttggagtttgagaaaactgaggtcaattcaggccttttctacgagactgcggctgagcgtgaacgtttgctgcaagcggagcgtga

SEQ ID NO: 50379 - DNA, 481 bp, Heterodera glycines
  SCN-specific regions: Sequence locations=1-415,437-481
ttacgtccgaaatatgtgtacacacttggagctgagcaacaaagaccaagattaccaatgggggttggacttcatcaacaagcaaagtcaactcataaccaaccaactgtcagtcagttcgacggagctgatcagcgaaagcggcaaagcgtccacgcaattctttttcatgccgggccagggccaccatttcatgagttacgggggtcgattagtgcgcgtggagcgcgagcgtacagagcaaatgctgcaaagggcggacaaacgacggacaccgctggaaaccgttcgactgaccacaattggcgtcaagcccgaattttggcgacaaatgctagagaaagcggccaaagatgcactgtccgaggtagagacgggccttgctgtgtatactccgttcggtccggaatggcaccattttgggaagccactgaagaagcagccgctggacacaattgtgttggacaacggcatccgcgaa

SEQ ID NO: 50380 - DNA, 539 bp, Heterodera glycines
  SCN-specific regions: Sequence locations=1-217,240-512,534-539
atttttaaagtaataattgatttaaaatgtctaagcgaggtcgtggaggcgcttctggggcgaaattccgggtttctcttgctcttcctgttggcgcagtaattaattgtgccgataacactggagcaaagaatctgttcgttattgctgtttatggcattcgcggtcgactgaatcggatgcccagtgccgccgttggagacatgttcgtctgttcagttaagaaagggaagcctgaactgcgtaaaaaagttttgcaagctgtcgtcgtccgtcaacggaaacaatatcgacgcaaagatgggaccttcatctatttcgaggacaacgccggagttatcgtcaataacaaaggcgagatgaaggggtccgccatcactgggcctgttgccaaagaatgtgccgacctttggccgagaattgcttctaacgccagttcgatcgcctaatttgtttgcgttattctgttgatttttgttacttggatgcaaaaattgttatttgtctaattttttcaattagtaaaaattctacagtta

SEQ ID NO: 50381 - DNA, 802 bp, Heterodera glycines
  SCN-specific regions: Sequence locations=1-82,139-173,213-261,303 -402,427-453,515-536,559-568,594-608,658-658,694-756,787-802
gagtaccttcaaggctttttcaaaatgccatctaaagctatgcacctttattgacctcggcacgacgtattcgtgtgttggagtcttccagcacggaaaggtggagatcatcgcgaacgaccaaggcaaccgcaccacgccgtcctatgtcgcgttcaccgacaccgaacgtttgatcggcgatgcggccaagaaccaggtggcgatgaacccatccaacaccgtgttcgacgccaaacgtctcatcggacgcaagttcgacgacccggcggtgcagtcggacatgaagcactggccgttcaaagtggtgcagggagagggtgctcgtccgaaagtgatggtggaagtcaaaggcgaggacaaagcgttcttccctgaggaggtttcgtccatggtgcttatcaagatgaaggagacggccgaggccttccttggccagactgtcacggatgcggtggtcacagtgcccgcttacttcaacgactcgcagcgtcaggccaccaaggacgcggggaccatcgccgggctgaacgtgttgcgcatcatcaacgagccgacagccgccgcgattgcctacggcttggacaagaaggggcagggtgagcgccatgtgctcattttcgacttgggcggtggcactttcgacgtgtccatccttaccatcgaggacggcatcttcgaggtgaaatcgaccgccggtgacactcatctcggtggcgaggacttcgacaatcgaatggtcaaccactttgtcgcggagttcaagcgcaagcacaagaaggacctcagttcgaaccctcgt

SEQ ID NO: 50382 - DNA, 829 bp, Heterodera glycines
  misc_feature (824)..(824): n is a, c, g, or t
  SCN-specific regions: Sequence locations=35-69,92-719,746-829
cctcgtgccgaattcggcacgaggcaagtttgagggtatccaattttttgcattgttttgcaactgatacaacatgatcatctacaaggacgcgttcacagacgatgagctcgcctctgactcgttcccgatgaagttggtcgacgacctgatctacgagttcaagggtcgccatgtcgtgcgaaaggagggcgaaattacgatgagcggggcaaatccgtcagcggaggaaattgacgagggcactgaagaggcggtggaacgcggcattgactttgtgctcaaccatcgactacaggagatgaattgttacgagaaccaggcaacatttaaaggctacgtcaaggacttcatgaaaaagatcattgagtacatggagaaggagcagaagtcggctgacgaaattgctgcgttcaagaagaagatccaggcctgggttgtctcattgctggccaaagaccgtttcaagaatctcgcattctttatcggcgaaaacatggcccgagggcaagggcgaaggacaggtggccattgttgagtaccgtcagggagaatggtgaggaagtgcccactctgatgctgatcaaggaggcgctcattgtggagaagtgctgacgacgacgacaagcgatatacgagaaatgcgcgcgatattattattataacttttttgttttaatatgatatggtgacacaatgtccagttactctattacatattgttgttgttgttgttgttttgttggctggccttcgtttgacacggaactctcaattggttgattatattgatggtagataagatcgcggttcgcaactgttanaaaag

SEQ ID NO: 50383 - DNA, 896 bp, Heterodera glycines
  SCN-specific regions: Sequence locations=1-13,35-123,150-152,178 -228,262-763,785-896
gagatttgaaaattttgaattcgcttttctcattccaaggcaaataattgtaaaatgagtagcccacgaaagaaaatccttctcaaagtcatcattctcggtgactcgggcgtcggaaagacatcgctgatgaaccaatatgtgaacaaacggttcagcaatcagtacaaagccacgattggtgctgattttcttacaaaagacgtgatgatcgatgaccgacttgtcaccatgcagatttgggacactgccggccaagagcgtttccaatcgctcggcgtcgccttttaccgtggtgctgactgttgtgtgctggtttacgatgtcactcacgcgccgtccttcaaatcgttggagagttggcgcgacgaattccttgtgcaggcgagtcctcgtgatcccgaacactttccgttcgttttgctcggcaacaaaattgacaatgacgcggcgcgtgcagtgaatgcgaagagagcgcagagttggtgccagtccaagaatgggatgccgtactttgaggtctctgcccgggacggagtgaacgtcgaagaggctttccaagcgattgcccgtgctgcgcttgcacgagactcgcaggaaacgcacgacttcccggaatttccggaccaaattcgacttgatcagagccgcaatggcagacagcagaattcctcctgttgctgaccgtccgggggcatttcgcgatgagtgaaatggaagaaatggtcgatcactctgtcgagatcaaatgatttgtaatttcaaaaagaaagaattcggatttcaaattcacatcttctaacacagacaagctcattccctcactttgactacccttttaaccaattcaaatagaaacgatgtttagcacttttattatgaggccatttgccccc

SEQ ID NO: 50384 - DNA, 296 bp, Heterodera glycines
  misc_feature (296)..(296): n is a, c, g, or t
  SCN-specific regions: Sequence locations=1-296
acaaaggcatccgacgactttgtcctccaaatggactcgcaccacatttgggacatccttggtcgaatgttcagcgcggtaataaattttgggcgggcagcaagcatttccctctccaggccccacgtctgttcggttgggtccgggaaatagccgtaatgttccgggtccgcctcggaggcggcgaggcgattgctgtgtgaaaaatttcgcatgattttggggagcagagaacggccggacaaaagtcggttcattgtcattgaaagtgaaatgaataaattgttgaaataaan

SEQ ID NO: 50385 - DNA, 1046 bp, Heterodera glycines
  SCN-specific regions: Sequence locations=1-175,200-703,727-1023,1045 -1046
gataaacttaaaaattgggaggcattttctgaaaaaaaattcgaaaaattgaattataactttttgtacaagttcggtttcaatgttcagattggtcattaggcaaagggtccctccaaataacacgccctcaatcaacttataaagttgtatttagagacaaaaattatcgtaaatggctgtcggaaagaacaagaagatggggaaaaagggagcaaagaagaaggccgtcgacccatttacgcgcaaggaatggtacgacatcaaagcgcccgcaatgttcacacaccgaaacgttggcaaaactttagtgaaccgcacccagggaacacgcatttcaagtgactttctgaaaggtcgggtctacgaagtttcgttgggcgatctcaacagcacggacgccgactttaggaagttccgattgatctgcgaagaagtgcaaggcaaaatttgtttgaccaatttccacgggatgacattcaccagggacaaactgtgctccattgtcaaaaagtggcatacactcattgaggccaatgtggcagtgaagaccaccgacggtttcttactccgactcttttgcattggctttaccaaacgaaatgccaatcaaatcaagaagacgagctatgcaaagacatctcaagtacggatgattcgtgccaaaatggtggaaataatgcaaaaagaggtctcttccggcgacttgaaagaggtggtcaataagctgatcccggactccatcggcaaggacattgagaaggcgtgctccttctactacccgttgcaggacgtttacatccgtaaagtgaaggtgttgaagaagccgaagttcgagctgggcaaattgctggagatgcacggcgagggtgccggaacggtcgccactattacgacggccaccggagagaaaatcgaaagtcggccggacgcatacgaaccgcccgttcaacaaagcgtttaaatggtcagattgacaaaatggagatttatttgactgtttgcatccgaattgttttgctgttgttgttaaactgactttgttg

SEQ ID NO: 50386 - DNA, 396 bp, Heterodera glycines
  SCN-specific regions: Sequence locations=1-37,59-74,101-334,356-396
agaaagtgtttcgaatttgcatttgattcaatgacgaaaggaacttcatcgtttggcaagcgccacaacaaaacccacacgctgtgccgccgctgtggtcggtcctcataccacattcagaagcacacctgctcgtcctgtggctatccggcgaagcgaaagcgcactttccaatggtctgtcaagtccatccgccgacgcaccaccggcaccggccgaatgcgtcatctgaagcttgtgcaccgccgcttccgcaacggattccgcgagggagtgaccgcgccgcgcaaaggcggagtgaaagcgtgagaagagtgaagaaaaaaggcatcaaaaaatgatggaaaatgttttgttgttgactgattgttacaagaaaaaaatggtcatttaaaa

SEQ ID NO: 50387 - DNA, 516 bp, Heterodera glycines
  SCN-specific regions: Sequence locations=1-115,144-351,373-459,481-516
gcatattttaatcaattaaacatattcttgcgagtaataatggtgggacgagtgcgaaccaaaacggtgaagaaagcatcccgtgtaatcattgagaaatattacacaaaattgacaaacgacttccacaccaacaagcgcatttgtgaggaggtggccatcgtcccgagcaaaaagatgcgcaatcgaattgccgggtttatcacccatttgatgaagcggattgagcgaggccctgtccgcggcatttccatcaaattgcaggaggaggagcgggaacgtcgggacaattacatgccggaaatttcctaccttgacgcacagaatcaccagacgatcagcacagaccaagagacgaaggacatgatcgagtatttgggacttggtctcaacttggaggtgaaggggcctgtgccgactggcgcaggacgtcgttgaatcacgaaaaaccattaagcgatttggtggtgttattgttatctttttaagcgctgataaaacaattttgttgaaaaa

SEQ ID NO: 50388 - DNA, 476 bp, Heterodera glycines
  SCN-specific regions: Sequence locations=1-380,406-476
atatgcttccattcgaagtccaacatttttccactggaactgcggacacagcgccgtccttccacgccgacactatccatcatgttgagttcgacttttacggccaacgcgttgcaacagtgtccagtgacaaaacggtttgcatttgggacaaggacacacagaacggcgcgtggaggaaaagcgcgtcatggaaaaaacacggtggtgccgtttggaaagtgcgttttgcgcatcccgagtatggccaagtgttggccacctgttccttcgacaacaccattcaaatcttcgacaaagacgctgccgatctgtccgaaatccgaccgatcaccggcgccgactcgtccaatgggtgggcatgtcggaccgttttacgacaaagcaatgccagcgccagcatcactgacattcaattcgcgccgcattatttgggccttcaattggccgcttgcacttcctctggtcgactgatc

SEQ ID NO: 50389 - DNA, 632 bp, Heterodera glycines
  SCN-specific regions: Sequence locations=1-26,82-82,168-171,193 -193,237-249,284-285,310-310,396-399,460-555,578-632
attcaataccccttcaatttggctatcatgcaaatcttcgtcaaaactctcaccgggaagaccatcactcttgaagtcgaggcgagtgacaccatcgagaacgtgaaagcgaagatccaggacaaggagggcatcccgccggaccagcagcgcctcatcttcgctgggaaacaactcgaggacggacgcaccttggccgactacaacatccagaaggagtccactcttcacctcgtcctgcgccttcgtggagggatgcagatcttcgtcaagacgctcaccgggaagaccatcactcttgaagtcgaggcgagtgacaccatcgagaacgtgaaagcgaagatccaggacaaggagggcatcccgccggaccagcagcgcctcatcttcgctgggaaacagctcgaggacggacgcactctggccgactacaacatccagaaggaatcaactcttcatctcgtcttgcgccttcgtggtggaaagaactagaacgacgaacggaagaaatgagtgatctgtatcgatccatatccgtatcttgagactgtcctgtattattgtgttccgttttattcatcatcatgaaatgtatttcaatgaccacggaacgataaatccatcaaaactca

SEQ ID NO: 50390 - DNA, 933 bp, Heterodera glycines
  SCN-specific regions: Sequence locations=1-933
atttggtagaggagttggcctttttcaatgaggtcgaagatggttccgttctgagaaaagaagaaattccgcaagaataccgcgaagaggcaaagatactccgccaagaacttctcgaaaacctcgcaaattgtgacgatgttattgccgagtgttaccttaacgaagtgacgccgtccgtcaaagagataaaagaggcaattcggagggcaaccatcaaacggtcctttgtccccgtgctcgtgggcagtgctctgaagaacaagggggtccaacaaatgatcgatgctattgtacattatttgccaaacccttctgaagttgacaattttgtgaatttatatgacaaaaatgacaatgcagaacgcgtgctgatggaccctttgaggaccgcaaactccgaaaaacaaaagccatttataggacttgcgtttaaattggaagcaggaaattttggacaattgacgtattttcggatttatcaaggacgactggtcaaaggcgacactatttatgcgacaagggacggacgcaaagtaagaattcagcgtttggtccgaatgcatgcgaatacaatggaagacgttgacgttgcctatgcgggagacatttgcgcgacctttggcgtcgattgtttcagtggggagaccttttgttcggatgagcaattacgagtccattgcgaatcaatgcacattcccgaccctgtcatttcaatgtccataaaaccgatcggaaaaagggacatggaaaactatctcagggcattgaagcgatttgcaaaggaggacccgacgtttaaacttttttacagcaaagagcacaaagaaacggtggtgagcggaatgggcgaattgcatttggaaatttatgcgcagcgaatgggaaatgaatacaattgtccggttgagttgggaaggcccaccgtttcgt

SEQ ID NO: 50391 - DNA, 1107 bp, Heterodera glycines
  SCN-specific regions: Sequence locations=1-355,449-462,495-539,603 -906,931-1063,1098-1107
ggcgaattacaccaacaaaaacttctatacaaaattgaccttggcgctgtgtacaatcgtccgccgtgtgaccgcaagaatattggtgaattttttcccgtggaacgggaactcgtctttgacatcgatttgaatgactacgacacaatacgacaatgttgcaaggacaaaagtgtgtgcaaaaagtgttggcgttggatcataattgcggttgatgtgctggagcatcttttacgaactcattttggcttccaacatttgctctgggtcttttccggacggcgtggcattcactgttgggtggcggacaaaaaggcacgcgcattgagcagtcgcgggcgtgaggcgatcaccaaatatttgacatttaacaaagatggctctgcgatcaacaaatatcgggtgcacccatttgttacggaatcgtaccgaaaaatcatggaatccgacgattttgagcagttgatcatggaacagggatggttggactcggccgaccaatggaactctacaatccttgcccattgggccgacaaaaatttggctgaactgctcgacaaaagcttttcaaggcttcaaacgccaaaattgcgttgggaatcgatgaaactccgatttgatgatgcaacgcgaatcaatgcgcgagggatcaaattgccaccgacaccttccgatgaagcgagacgttttttcatttcattggtcatgaaatttgcttatccgcaactcgacgcaaaagtcactgctgggctcaaccatttgctgaaatcgcccttctctgttcatccagaaaatggaaatattgccgttccgttgagtgccaaagaaatccgtgcctttgatccgaatgtggtgccacgaattgataaattgttagcacaacttgcctcattgcgagaatccagccaagaaaacaaggagaatcaacgttcaattgtctatcgtcaaacttcattggctccacacattgctgtgtttgaacaatggaccgcacaaattctcaattctgaagcgcaaaaatgacagagcaataacaacaactcattccttcatcattgctatttttgaacactttttaactgtttaatttaacattttgattttgcc

SEQ ID NO: 50392 - DNA, 481 bp, Heterodera glycines
  SCN-specific regions: Sequence locations=1-448,473-481
ggaacttccgccaagcgccaaagacggcgatccaacgcggaacggttcccccctgacaatcaatggaaatcccttcgttcctctaaacgaacgcgcgtatggacgtaaaaaggaagctgttgaggcggatggaatccgctggcaattggccaaaaaggacgaggaattgctcaatttgcagaaagcgctcaaagagcgcgacagtgaaattggcacaatgaaacttcgggtggaaatggcaaagactcagttggcagaaacgacggggaaaggcggcatttccgtggagatggaattgcttcggcagcgatgcaccggcttagagaacgacttgaagagacagaaggatgaatacgaacaacagttggaccaactgcgacaacaattggccgaagaacacaacagaacccgcgagttctccaagaaggcgctttttgcgaatatgcaaaatcaacagcagcaggcggctgcgtcagcactg

SEQ ID NO: 50393 - DNA, 821 bp, Heterodera glycines
  SCN-specific regions: Sequence locations=1-740,762-821
gaaagcatgcaacgaaaaaccagaattttgaaaaacgactgttaactttcttccatccctgatccgcagtcgtggatttaagtcgctgatcgcggttgcgcgccacccctgatttcctccaacgccacaaccacactttggcacaaatgttgtcgtcacaaccgacgctgatcatggacaacggcgcgtacagcataaaggcgggctatgccaccgaccaaagtgccagaattttccccaacactgtgtttaaatcgaagggcgagcggaagcgcattttcgtcgccgacgaattggaccagtgcaccgaccgatcggcactgtttttcgtcttgccattcgaacggggatatcttgtgaactgggacacgcagctgcagatttggaaccgcgtgttcggcacggagggcgccggcctcggcgtggactgccaacagtgccgcctggtgctcactgaccctaacgaagtggcatttgcatttgcggacaacacggatgagattgtgttcgagaattaccgcttcaacgctttcctccgaacgtccgcgtccgcctgcaccgcccaggcgcactgctcggccaacaatccgtgctgtgttgtcgtcgactcggggcactcgttcactcacattgtgccatttgttgggggacaaattgtgcgcgagggcattgtccgaattgacatcggtggcaaagcattgaccaatcagttgaaggattggatctcctaccgccaactgcacatgatggacgagacgtatttggtcaattgttgcaaggaggactgctgcttcgtctccaccgactttcagcgggacatg

SEQ ID NO: 50394 - DNA, 1023 bp, Heterodera glycines
  SCN-specific regions: Sequence locations=1-1023
atgctttcaaaaatcacggtggttttggcatttctctgcctgctgttggcattattggtgggcatcgatgctcagcaaagtcaatgggagcagaagcagaaccgtgcagcaccgcgagggttggcaagtgtgacattgcgccggatggacaccgtccgctcgcggctggcagccgccggttcactcgtccaattccgtaagcatttgcgccaggcgctgcgccaacgcttggaccgtctgtacagtgacaaaatggcacgcgcagacgtggcatttgacaccgatgccgcggcaagggaaggcattgacgaagtgttgcgcaattacatggatgctcaatattatggtgacatttctattggctctccaccgcaaaacttcaccgtgattttcgacaccggttcctcaaatctttgggtgccgtccaaaaaatgctcatttttcgacctcgcatgccgctaccatagtaaatatgaccacaaaaaatcgtccacctatcagccggacggacgcgaagtggcaattgaatacggtaccggatcaatgaaaggcttcgtctccaaggacacggtttgcattatggacggtatgtgtgtggaaggtcaggagttcgcggaggcgacaagtgaaccaggcgacacttttgtaaacacaaaagctgacggaattctcggaatggcttacccgggaatttctgtgcagaaattgtcaactgttttcaacaatttggttgagcagaaagaagtggaggagccggtgtttgcattttggcttaatcgagacccttcgtacgaatttggtggccaaatgaccgtcggtggcatggacaaacgccggtttgtggaaccaattaattatgtgccggtcactcgccaaacttattggcagttcaaaatggactcggtcactggcggacaaaatggcaaaagcaaaattgcatgccgaaacgggtgccaagcaatcgctgacacgggcacttctctgatcactggacctcagaaggacgtggaagccatccacaaa

SEQ ID NO: 50395 - DNA, 253 bp, Heterodera glycines
  SCN-specific regions: Sequence locations=1-253
aaaactggagctccccgcggtggcggccgctttcgaactagtggatcccccgggctgcagtgaccttcacacgaggattattttctcaacaaacttccgcttaatcttcagaccttcactattttcttgtttaaaaaagttgcaacgatggtgaaaccaaaggttggcatcaacggttttggacgtattggacgcttggcattgcgtgcagcgattgaaaaggacactgtccaagtggtggcggtcaacgacc

SEQ ID NO: 50396 - DNA, 548 bp, Heterodera glycines
  SCN-specific regions: Sequence locations=1-121,143-548
gcaagatcagaggtctcgcttacgtatgcaaagtgacgccatcaatcgcatctcgaatgattgacggagctaaaaagatgcttcacggaaacatttctgacatttacattacgattgaccagaggaagggcccccagggcggactatctcccggctttggaatcttcttgacggctgaaaccaccgaaggcgtatttttccatggagaagcgatgtcgcgccctaagggccaaaacgaagaccaaacagtgccggaagaaattggggaacaggcggcaagacgtttgctggatgaaattcatatgggaggctgtgcagattcgtcctgtcaatctttggccgccactttcatgactctctgcgacagagatgtttcgaaatttctccttggtccactcacaattaacagcgtacacacccttcggaatttgcaaatgtttttcgagcaaatgtttaaattggaggaatggtggaaggttatgaaagaaatcgtcggaaaaggcggaaatgcgatgaaaaacggaagtgaggacaaatgtttgatgacc

SEQ ID NO: 50397 - DNA, 585 bp, Heterodera glycines
  SCN-specific regions: Sequence locations=1-1,23-585
ctttttctctccaaatttttccatgcgttttcaaaaagccaaattcgccatttttcgactgaattcccaccaaattttcattcttttacttttgcttatcaaattggcaatgactgatcagcagaattcaattgtcgggggatggacagagcaaaatgtgaacgacgaaaaaatcaagtctctcgcttctcgctcagtggccaaaataaactccgagtcaaacgatcgcttcagtcttttccccttggaggttctcagtgccaagtcacaagtcgtggcgggcattcagtaccaattgcgcattaaggtcggaaggtcgaactgttcgaagaatcagtcaaacttggctgaccacgcaaactgtgcaacggaggatgatcagacagcgcgaaagacttttttggtaacgatttgggagaaaccgtgggaacaattcgagcagatcacttacaaactcgaataagaggaaacccgaagaaagaaagcgagcaaacagaagggggcggggaagtgattgatcacatcgcaatcatcctgttcaaacatttaattatttccaatcggtaaaaaatggcgaaattaaaa

SEQ ID NO: 50398 - DNA, 1596 bp, Heterodera glycines
  SCN-specific regions: Sequence locations=1-133,156-191,213-940,962 -1014,1036-1401,1423-1596
tgaagataaaagtaattaatggacccttttcaccggaacgaggctaaagttgaggtcgccgttgagccaccaacggcgatagaccaacgggtggacgacataatgcaaacgggcagatttggagacggccgattggtgaagatggaagtggactatagcgctcaagtggacagtcagttgatagtggcagacaatttggccaaggaggggaagactgccgaggcaattgagtccttggaaaagctggaaaaggacagacgcataaattgcgacatgcgttccaaccagcgcctgttgtgccacatggtcaaattggcatttgacgcgaataattggcaattgctctgcgaaactgcgaagacattgtgcaagaagcgtctgctgatcaagtcgagcatcaagaaaatggtccaagaatgctgcgaaatggtgccaaaagcgccagacgcgtcgtccaaatcgacgctcatcgacacactccgcgcagtgactgcgggaaagatttacctagaggtcgaaagagcgcggctgaccaaacaagtggccgaaaagttggaagccgagggaaaattggacgaagcgcgcgaaatgatgatggaactgcaagtggagacgtacggcacgatggaagtggaggaaaaggtcaattatttgctgcatcaaatgcgcctttccattgccaataatcattttacgcgtgcttcaattatttcacgtaaaatcagcacaaaatttttcgaacgcgaaggcactcaagtgcaattgatgaaattggaattttacaaatatatggtgcaaatcggactgagcgaaaacaactatttggatgtgtgcaaacactttctggcaattcttaacactccgcagatccaagaaaacaacgtcaagaaaattgagattctcaagtgtgtcgtgttttacttgctgctttcggctcatgacaacgaaaaatgggaacttttgcatcgagtgaatgcgatgagagaattggaacaaatacccaaacacaaagaactgctggaactgttcatccaccaggaattgatcttttggagcaaaaccattgagtccgaattcgccccaattttattcgctgctcaaccgccggtcgaagtcatttcggattcgtttctcccgtccacccacgtgtttccgatgaccaaagaggatggtcaaaagcgcagagaacgccttcatgactgtgtgggggaacataatgtgctatatggtggccaaatattactcgcggatcactttccaacgaatggccaaacttctcgaattcggaattgagcaaatggaagcctttgtgtgcaaaatgattgtcgacggagtaatccccgaagtgaaaattcaccgcccttcgcaaattatttatttgagcccgaaaaagaacggcgcagaagtgctggacgaatgggtttttaacgttcgcaaattgaccgacacaatgaacaaagtcagtcagctgatcgcaaaggaggaaatggttcacggattgcaaatttctcagcggatttgaccgatgatatcgatacaaagaatcaattgattgttttattattgttttcccaaaaaaataaacgaattaaaaaa

SEQ ID NO: 50399 - DNA, 480 bp, Heterodera glycines
  SCN-specific regions: Sequence locations=1-1,24-143,165-340,364-480
tctatttgttttttattcaatttcgacctgaatgtcagctgcggtttcttcttcgcgtccgatggaagattggaaatctgagttagctatgccagacaaggaccttcgatacaaaacatctgatgtgactgcgactaagggcgttgaatttgaggaatttgggctcactcgcgaccttcttaaaggcatttttgagaagggttgggagcatccaagtccggttcaggaagcgtcgattggaattgcacttacaggccaagacattctcgctcgcgccaaaaatggaactggcaaaactggcgcatattgcattccctgcattgagaaaattgacccatcaaaagaatacatccaagcaatgataatcgttccaactcgggagcttgccttacaaacatctcagatttgcgtagaactcagcaaacacttgaagattaagattatggtgacgactggcggaacagatcttcgtgacgatat

SEQ ID NO: 50400 - DNA, 1271 bp, Heterodera glycines
  SCN-specific regions: Sequence locations=1-54,76-112,134-306,330 -572,605-862,885-1271
gtttgtatatcaaattcaactcaaacaaactcgaaaaaaatacttgtttaaactgcagtgaaatggatttagggggattttaacctttaattaggaatttgatcacagttaaagaattaagacactttgttttatatttgaatgcattggcgttttttacgccaacaatttattggcgacttttcgttttttttaccgtccgtggaaaggggcacccattttgggccctttcctggcgaatgggctgggctgggggcgaccccgctattttgtatgttgttacttgaacagatttaagcattatttaattttctttttcaactgtcacagtttaaatgttggaaatgaacggtgttggaaattccaaagactatgacaccaaagtgaaggcaattctcgaacaatgccgaatatcacagaagctcttgaactatactgagcattttaactatccctatgtcagcgaagtgacatattacgagcagttgttgaagattggacaaggaacatttggcgaggttttcaaggcgcgttgcaagcgaactggcaaattggtggcactgaaaaaaattttgatggaaaatgaaaaggaagggtttccaataactgcacttcgcgaaataaaaatgctacaaaggcttcgacatcagcacataactgaactggtggaagtgtgcacaagcaaacaaaagagtgggaaggagaaattctgcttttacttggtgttcaccttttgcgagcacgatcttgccggtctgttgagtaacacccaagtgaaaattcgactggtggacatcaaaacgatgatgcagcacattctgcgcggattgcacaaaattcactccagtcaaatattgcatcgcgacatgaaagcggccaatgtgttgattactggtgacggggtgctcaaattggcagattttggtttggcacggataatgtataagcaaccagaacattgctacacaaatcgagttgtcactttgtggtatcgaccccccgagttgttattgggcacgcggaactacggcccggcgattgacatttggggcgcgggttgcatcatggccgagctttggatccgtgcaccaatccttcagggtaacaccgaacaatctcagctggagctcatttcgaaactgtgtgggtcgattaatccgcacagttggccagggtgtgacaagttgccttattacaacaatttgcaaggatcgttacagcaaaatttaccgagacgcgtgagagagcgtataaatccatttcttcagaac

SEQ ID NO: 50401 - DNA, 605 bp, Heterodera glycines
  SCN-specific regions: Sequence locations=1-605
aaaaaggaaaatgtcgcttattatgcccgaaaaattccaacatattcatcgtgtgatgaatacaaacattgatggcaaccgtaaagttccttatgcccttacagcgatcaagggagttggtcgtcgttatgctttccttgtttgtcgcaaagccgacattgacattcacaagcgtgctggagaactttctgaggaggacatggaaaagctgactactgttatgttgaacccacagcaatacaaaatcccaagttggtttttgaaccgacagaaggatattcgcgatggtaaaaatcaacaggttttgtccaccaatttggagagcaaataccgtgatgactttgagcgcatgaagaagatccgtttacatcgcggtctgcgccattattggggtcttcgtgtgcgtggtcagcatacgaaaacgaccggacgtaaaggacgcactgtgggagtgtctaagaagaagggaggctaaaacaaccgtttggttaccgatcatgaagtcgatcagttggaattgttgttgacgttattttcgttatttgatgaggtctatgtaaaatgttattgttgccaacggacaaaaaacattccaacttggacaa

SEQ ID NO: 50402 - DNA, 678 bp, Heterodera glycines
  SCN-specific regions: Sequence locations=1-678
gtttgagggcctaattctgactacctagttttgcgaaatggttgtgctctcaaaacttggctcgccgcttcgtccgttttccaatgactatctcctttgccgcttccaggccttccgtaattatgcaatcaaaaaagaaaggccgccaccagcgaagattcaagtgccgccacccgcaaacgaaactggccattggaaatatgagcgtgactactcctatgacctgcgttattcaaacccgatcaacaaatactccagttttaccaggttcattacgctcaccgcaacaggccacaaagaattgtgggcacttttcgcccttctgatgctttcgtcatctctggcgataggaattgtgttctatagccttggcaagatcgaagtttgggttgaccgaagcacctcaactccgccgtgggattgggcgcgagtacgtgacaaatattggaaatttccgacggttctctatgacccgaccggcattactcatgttcgactcagcccgatggagaaacttcaggacgaaatgctggaagctgctaaagaacgtggaacccgcgatgctaagggctattgggttggaaagcaataggaaaatggatgtaatttgatgtgttaactgttctttagcttgcgttctcatataatgtatacgtggagcaaataaaagcagatttt

SEQ ID NO: 50403 - DNA, 1061 bp, Heterodera glycines
  SCN-specific regions: Sequence locations=1-1061
tttgctactgtcctcggcgcacgcactgacgcgggtaatccgtgcgcaatgactttgccgtccattttcgaatatttggcgcaagaatctctgagcgggtcgatgaagcagggcattcgcagtgttttaaatctgttttcccatttttcgggccgtcgtctctctttcgtcgactctcattttgacgagctgtttttgctgcttcatttgttcctggagaatcgctttctcaaacgattttccgcttcattttccgagaatttctatgggatgaaaagggttccgtggcgaatgaatgcgtcgtccttttctcggctgggccatcgctttcggtcgctttttctaattgttgttttgccttacattcacgacaaattcgaaagattaagtgaacaaattgaaagtgaaagggatgcaattcggcaaaaaggatggcgtcgtcttttccttcgcttttatccgtctctgaaagcccttctcttcctcgtcacgttgctcttacaattggccttcgtcttttccttctcttctgtccccagcctttcccttcttttggccaaatgtcgtcttgagaagttaactctctccgacgtggcgcaattcgacgctgagggccaattgccttttcatttgcggaggacaaatgttttcgcgcgtctttggcgttcgttggtttcgcttccctcgactttgggccgtctctttacttacgctcttttcctggtccaatttctcgagtatttctactcggatgaactcggccgtcgcttcgggcaatttgtggaagggcgtcggaatattcgaattccgacgcatccgttcaacaatttaccgactgaacagcaaactctttgcatggaagtggacaaatgcccaatttgtcgtcggatccgcaaaaatgacaccgttctcaccgtttccggctacgtgttttgccattcctgcattttcaacttcgtccgaattgagcactgttgtccgatcacttcgcttcccgccacttcaagtgaactcgtcaaaatatacaattgaaacatttataattaatggagtttaattga

SEQ ID NO: 50404 - DNA, 531 bp, Heterodera glycines
  SCN-specific regions: Sequence locations=1-333,355-531
gccgaaagcgaaggggcgaaaggcgacggaacggaggccgagggaagcgatcggtcgccgctgctcacttcggtggatgtctctcgattccgttttctgaacgagcggttgtgcagccaaacatcggcttcttccgcaaagctctttgaggaggaccccgactcgttcaggctgtaccatcgcgggtaccggcaccaagtgtccaaatggccggtgaatcctctcgagaaaatcgtgctggacctcggctcccttccgcccggaagtgtcgtcgccgacttgggctgtggcgacgcggaaattgctaagcgattgggcgaacggctccgagttcattcctttgacctggtggcttcaaatgagcgggttttggcagcggacatggccgatttgccgttggaggcggagtctgtggacgtttgcgtttactgtctgtcgttgatgggcaccaatttggcccaattcttccgagaagctcatcgagtgctcaaaactcacgggaagatccaaattggccagataacgaagcgt

SEQ ID NO: 50405 - DNA, 512 bp, Heterodera glycines
  SCN-specific regions: Sequence locations=1-512
cgaaataccaacttatctcacaaatggctaaacaaaagggtgaaaagaaaggaaaaagtgcgctcaacaaagtggtcactcgggaatataccatccatttgcacaaacgcatccacggaataggcttcaaaaatcgagctccgcgagcgatcaaagaagtgaaaaagttcgctgagcagcagatgggcacacccgacgtacgcgttgacacgcgtctgaataaatttctctggtctcgaggcgttcgtaatgttccattccgcgttcgcgtccgactttcacgcagacgcaatgacgacgaagactctccgcacaaattatacactttggtgacgcatgtgcctgttacttcgttcaaaaggttgacaacggtcaatgtggagagtgaggactgatagatggagaaaggatccggactgagtaaatggctgttttttgttgcgttatattgttgcggatttttttgaaataaaagaatcgttgacaaaaccgaagaaaaaggaacgccaaaa

SEQ ID NO: 50406 - DNA, 486 bp, Heterodera glycines
  SCN-specific regions: Sequence locations=1-280,302-486
aaaacacagaaatggctgatgacaaaagctgtgacggtgcttcttctgcgttgcctccgtgtttaattgtgcttggaatggccggttctggaaaaagctcatttgtccaaaggttggcgagtcatctccactccaagaaggtgttcccctacttggtcaatctcgacccggcggcagcaaccgttccattcccagcaaacattgacatcagagacactgtaaattacaaaaaggtcatgcaggaatacggcctcggtccaaacggtgctattctgaccagtctgaatttgttttgcactcgcttcaaccaagtgttggacttgttggacagacgaaaggggtccatgccatacgccattttcgacaccccgggccaaattgaggtgttcacgtggtccgccagcggcactgtcatcaccgattcattggccgcctcttttccgaccgttgtcgcttatgtgatggatagtgcccgttcgaccaacc

SEQ ID NO: 50407 - DNA, 360 bp, Heterodera glycines
  SCN-specific regions: Sequence locations=1-186,225-360
atcgattcaccagctctcttcaacaaaaccttcgcctctccacatttcgacgacaaaatgcctccaaaaccatccggcaaaggagcgaagaaggcggtcaagtcgaccaaggcggtgcgcacgggagacaaaaagcggagaaaggcccgcaaggagtcttactcggtgtacatctaccgtgtgctcaagcaggtccacccggacaccggcatttcctccaaagcgatgtccatcatgaactcgtaaggcccaatttggcgtttttccgtcccaagattctcaattttcccatttttaaggtttgtcaatgacgtgttcgagcgcattgcggcggagcctcgcgattggcccattacaaca

SEQ ID NO: 50408 - DNA, 626 bp, Heterodera glycines
  SCN-specific regions: Sequence locations=1-188,215-626
gaatgaagcggttggagtgtgccgtccaacactacgcctggggcaagagcggcaaggacagttttgtcgcccatttgttgccggctgagcgagttgatttggacaagcgatatgccgagctctggatgggcacccatccgaatgggccgtcccgtgtgatcgacggcggcgcagaggcgtcaacgaatttgaaggactttttggcccaaaatccgcaactgttgggccaccacgagaagggcgagctgagctttctgttcattattttgtcggtggacaaagcgttgtccatccaatcgcacccgacaaaagaacaggccaaggtgttgcatgccaaagacccggccaactacccggatgacaaccacaaaccggaaatggcgattgctctcaccgactttgagctgttgtgcggctttcaaaccccgcatggcatcatttccaacgtgaaggcccaccgggaactgctccaactcgtcggcgagccgttactagacgaattggcacaggcggaacaccacgagccggactggggcgagcgtgcactgcgccgcatgttctgccaagtgtggacgagcccggcggagcaaattgcgcacgttgttgcacaaattgtggaccgattg

SEQ ID NO: 50409 - DNA, 480 bp, Heterodera glycines
  SCN-specific regions: Sequence locations=1-480
caactacggcatctttcccaatgagcacatttgctgcatgttcctcgaccattttctcggctccgctcagttgcaatatgcggccaaaattgccatttatgtgatgctgcaggaaatgttcgacttccctttgctcacttttctcgccactcgcgcccttctcgagtggacgcaaggggaacgaaaactcgatgagcaaatccatccgaaaatggcaccttctctggaggacgagactaacttcaatgaggagaacgtgcgcctttttcgctacccttttctgaagaaccctttttgggatggacacttcgatgagaatgactccgaccgaatggcaggcaaagccctcgaatggctttcataccatttgaaattggcaaaaaatgacgaaacgaattacgacgagacactgatcagagtgatcagacttttggggttgagcatacagcggaaatggacggaagcgaagtcattggcgga

SEQ ID NO: 50410 - DNA, 408 bp, Heterodera glycines
  SCN-specific regions: Sequence locations=1-74,111-408
tgaaaatcgtctagacctatttaatttttcgaaaaatgtctgacaacaaagaagaactcgttcagcgggctaagttggctgagcaagctgagcgctacgatgacatggctcagtcgatgaaaaaggtgacggaattgggtgcggagttgagtaatgaggagcgcaacctgttgcgtgacaacttgacgctttggacatccgacacggctggcgatgagcaggaggctggtggtgaggcgggcgaagctggtggcaactgatcgggcggacagacgttgaagaccaagaaaatgccccacgaaattttttccaccgaatcatttaatgacaattatgcttttctcaatatggcacttttgattgggtaaatttttttgaaaaatcgttcaattaaaattgttgtttacc

SEQ ID NO: 50411 - DNA, 665 bp, Heterodera glycines
  SCN-specific regions: Sequence locations=1-69,92-110,150-227,257 -382,417-665
cactcatattattgcaagttttgtgaaaatgtcgcattgaggatgaatatgactatctttttaaagtggttctgatcggcgactcgggcgttggcaaatccaatttgttgtcccgtttcacacgcaatgagttcaacttggagagcaagtcctccgctggtgtcgaattatttttcgaattctcaccttccattaaggtggacggcaaaacaatgaaggcacaaatttgggacacggcgggccaggagcggcaccagcccattgtgtcggcattctatcggcgtgccgtcggcgcactgctcgtctacgacatttccgtgcggctgacatatgaaaatgtggggcgatggctcaaagaactccgtgaccactccgacccgaacattgtgatcatgttggtgggcaacaaaagtgatttaggcaatctccgagcagtgccgaccgacgaggccaatgcgtacgcggagcgcaaccaaatggcattcattgagacgagcgcgttggacggcacaaatgtgggcgcggcgttcaccaacattttgaccacaatttgtcgttcacagtcaacaactgcgggcagcacaccgaaaattgacattaatgatgatctgattgacgaggacgcattgctcgagcccgaggacttacagcgccctgaacaatct

SEQ ID NO: 50412 - DNA, 1152 bp, Heterodera glycines
  SCN-specific regions: Sequence locations=1-703,727-889,919-1098,1120 -1124,1146-1152
gaggtttaaggccttaagcctgctaattgacatcttgaacctcaaaccttctcctgtttaaaaaacgacaaattttttgatggctgctgtagtcacaaacaatagcaaggaattcatcgttggtgtgaaatacaagctcaagcgcaaaatcggtagcggatcttttggcgacatttacctcgccatcaatattcagaatggtgaagaagtggcggttaaacttgagtcagtcaaggctcgccacccgcagcttctctacgagagcaaggtgtacaaaattctgcaaggaggggttggcattccgcacattcgttactacggcatcgagcgcgactaccactgcctggtgatggatttgctgggtccttctctcgaagacttgttcaacttttgttgccggcgcttcactatgaagactgttctgatgcttgccgaccaaatgatcggacggattgagtacatgcatgtgaagaactttattcatcgggacatcaaacctgacaattttctgatgggtatcggtcggcattgcaacaaactcttcatcatcgattttggattggcaaaaaaataccgtgactcgcgcacgcgcatacacattccctaccgagacaacaaaaatctgacgggcaccgctcgctatgcgtcaatcaatgctcacatgggtatcgagcagtcgcgaagggacgatatggagtcgctcggctatgtgctcatgtatttcaatcgtggaaatttgccatggcaaggcctgaaagcggctaacaaaaagcagaaatatgagaaaatcagtgaaaagagaatgtcaaccccggtggaaatgctgtgcaagggattcccttccgagttttcaatgtatttgaattactgccgtggtttacgctttgacgaggcacccgactacatgtatttgcgtcaacttttccgcatcctatttcgcacattgaaccatcagtacgattacacatttgactggacactgctgaaacagaaggcaacaatgaataacgcgaacagcacggccacttatccaactgaggcggccgccgggacgtctgctcagcagtgaacattatcgtcgatgatttatcattaccacaccatcatcatcatttattttgtaaacattataaagcaccacattttaaaaaa

SEQ ID NO: 50413 - DNA, 547 bp, Heterodera glycines
  SCN-specific regions: Sequence locations=1-94,123-154,176-364,387-547
agcaattaatgatttgttcttgagtacaaaaaacttaatttattggcttttgacgcccttttcattagtcatcacttctcaaaatgatgaagcatacaacgagcagcagcagcagtaacagtggggatgccaaggacagttcatgccatcgaaaccagcgttccatgtcattgggtggaccagcacatgagtcactgttgtccaagcaacattcctcctcccctccacagacggtggagctgagccgggccgacaacggcgactgtgttgtgttggttgtggaaaacacgcggttcattgtgaacccggctttgctggtcgtcaaaccggacacaatgctgggacgaatgttctcgttgagggcacgcacgggcggcgggacaaacactctgtccgtgccctcgtcgtcgtcgtcggccaatgaccccggcgccgaccgtggctcccccagtgatttggtgcgtcccaacgagcgcaatgagtacgacgtggcggagggactttccgccgcttgtttccgtgttgtcatggacttttaccaccgtgg

SEQ ID NO: 50414 - DNA, 814 bp, Heterodera glycines
  SCN-specific regions: Sequence locations=1-17,59-84,108-150,172 -241,273-387,409-507,542-814
gtttgagcacttttgaaaattttataattgaattttgctcatatttttgcataaatgaaccaagaacaagacaatatcccaactttcaagcttgtgttggttggtgacggtggtaccggaaagaccacttttgtgaaacgccatttgactggagaattcgagaagaaatatatcgctacgcttggtgttgaggtccatcccctcacttttcacacttcgcgaggtcaaatccgattcaacgtttgggacacagccggccaggagaagtttggtggacttcgtgatgggtattacatccaaggccaatgtgctattgtcatgttcgacgtgaccgccagagtcacatacaaaaatgtgccgaattggcaccgcgatttggtccgagtttgtgagaacatcccaattgtgctggtggggaacaaagtggatgtcaaagataggaaagtcaaggcgaaaagcatcacttttcaccgcaagaaaaatctccagtattacgacatttccgcaaagagcaactacaatttcgagaagcccttcctttatctggcacgaaagctgatcggcgaccccaacctcgaattcgtggggaaagccggcactcgctccacccgaagtacaaatggatcccgctttggctgccaaatacgagcaagaagtggccgaggcagcaagcgctgaactcccggacgatgatgaggacatttgaagagatggaaggacggctgggacagattcctgggacagcaatttccgagcagacaaagttatgtccattgttttaattgattgtttgatgagtaaaggaaagcgaatg

SEQ ID NO: 50415 - DNA, 540 bp, Heterodera glycines
  SCN-specific regions: Sequence locations=1-18,47-85,107-250,272 -329,351-498,538-540
tagacactacccgtaccctaaaattttttaataacttttaaaaattccattttttcaaaaaagagatcctaccatcggcagtattacaatttttgtctttaatttttctggttcaaatggctgttggcaaacagaaaaaatccgcggagaatatcaatgcgcggctggccatggtgacaaaatcgggcaaatactgcctgggctacaaacaagcgcttaaaacacttcgttcgggcaaagcaaaattggtgatcatctccagcaacacgccgacactcagacgcagtgaagttgaatactacgccatgctgtcaaagacgggcgtgcacgagtaccatggcaacaacatcgagctgggcaccgcttgcggcaaactgttccgagtgtccatgctgtccatcactgacccgggcgactcggacatcattcgcacaatgccaaccgaggcctgacaaatctctgtgagctgttgtgatcacacactgtgctcatcgccgttgttttcttatgttgttgttgttgtttttaacttgaaaattt

SEQ ID NO: 50416 - DNA, 468 bp, Heterodera glycines
  SCN-specific regions: Sequence locations=1-142,178-255,326-468
gttaaggcggggagacgttcgatatttattgtgtgtgttagaagaggaagagaagaagcaggaagagtggaagatgagcgcgaatacggaatgctatcgttgccacgaattcgggcacatttcgcgtgactgtcccaatgccggtcgtagtggtggtggtggtggtggcggtggcggctcgcgcggcggtggaggcgaaaccaagtgttataactgtggacgttctggacattttgcccgtgaatgccgtgatgccggagaccgcgaccgtgggcgcggtggtggtggcgggggcggcggacgaggtggcgatgaccgcggcagcaaatgttacaactgcggtggttacgggcactttgcacgcgaatgtcgcgatgagagaagcgccagcggcggtggacgtggcggcagagacgacagggatgaccgaggcaacaaatgctacaattgtgggaaaagcggtcattt

SEQ ID NO: 50417 - DNA, 365 bp, Heterodera glycines
  SCN-specific regions: Sequence locations=1-322,362-365
cttttctggcgaatattgtgctctttgagtgtcctttcattggcccattgtgcttacagtgccgcacagcatcgttcctaccttcgcctcgttggccaacctttcactcatttgcctgcggaccttactacacaaacgttgctcagtcttttgttcgccattgtttctgccagtttcgttgttggcgacttccaaccgattcgcaccgaccttttgatttcaaaaaagtcgtgggatgtgctcggcaattgtccctccttttacgtgttcaatcatcgtgccaaatgtttgatgccaaaatttgatgacattgattaattttttggcacttttttcaataaatgtttttattattaaatgattag

SEQ ID NO: 50418 - DNA, 420 bp, Heterodera glycines
  SCN-specific regions: Sequence locations=22-420
gcacgagggttacatttaattaatttttggttcggatggtttctatggtcgctgggagagtgcatcttttgccgcgcgccgcctcttttggcaaatcgtttctttcatcggatgcgactaaaaagcctgataagacttcctttggcaatttgaacgactctgatcggattttcactaatctttacggtcgacatgactatcgcctcaaaggcgctttggcgaggggcgattggttcaaaacaaaggatattattctgaagggtcccaaatggattctcggcgaaattagcacttccgggctgcgcgggcgaggcggggccggctttcccagcggaatgaagtggggcttcatgggtaaaccgttcgacggtcggcccaaatatttggtggtaatgcagacgagggcgagcccggcacatg

SEQ ID NO: 50419 - DNA, 853 bp, Heterodera glycines
  SCN-specific regions: Sequence locations=1-47,70-79,101-115,138-853
cctccttccaaattcggcacgaggctttttttaaaaaatggctaacataatgaagaaaaagaagaaaaatgctgttgctactacaactgctggaccccaaaaggatggaggcaaattcaagcagaaagggatcaaattcaacacggaaaagggccaacacattctgaagaatcccggcgtggtccatgccatcgttgagaagtccgctgtcaagggcactgacactgtgctcgaggttggcccaggcaccggtaatttgtccatgaaattgttggaccgtgccggccgtctgattgcctacgaattggaccctaaaatggtggcagagctgcagaaacgtgtggtcggaacacccgtccaatacaaattgcgtatcattgctggcgatgtgatcaaagcagccgagtggcctccgtttgatgtgtgcgtctccaatttgccctaccaaatttcatcaccgtttatttttcgactattgctccaacggccattgcccaggtacgccgtgctgatgctgcagaaggaattcgccgatcgactgttggccaagccgggcagtaaggtgtattgtcgcctgtccgtttctgttcaattattggccaccgttgagcatctgatgcgtgtgaagcgttccgaatttgtgccacctccaaaggtggactcggccgtcattcgcattcagccgcgcaatccgccgccggccatcaattacaaggaatgggatggaatgttgcgcattgcgtttatgcgcaaaaacaaaacactgtcggcgctgttcaagcagaagcaggtggtcgatgtgttgcgcaaaaattacgcagtcgtttgcggcacgaagggaaaggaagtgcca

SEQ ID NO: 50420 - DNA, 929 bp, Heterodera glycines
  SCN-specific regions: Sequence locations=1-324,350-556,578-929
tgccaatgttgccaatccggctgctttttctgttggccgtgccgtcgtccgcaatgggccgatttgacttgggtggactgctcgtcaacctaccccaatttacaagacacgcatgcgtccatttgagcggcattttcggccggatgggtcaacaacagcctaactcggcacacagctatgatcaaccaccacgacattttcatcgaggcggaccacccccacaccatcatccagacagcggcagtggtggcggactcggcaacatcggcggtgccgtggaaggcatactgagccgtgtgggtgtcaacccgcagttggccaaccaatttggcaaaatccaaattccgcccattccgtcgttggcggtgcacaatgtgctggacggagtgccgggaattttgcgccaatttttgcctgcccaaactgtgggccaaatcaccgcaattgcacgccaagcgattgagtccatttgctcttcggataattgtcttcagcagaggccggaatggcttcatcagcgggcgacagttgcgcagtttgaaactttgatcagaaaaacattttcaccaggccaatcggacagtcaaattggtcgtgacgtggagatcagactttcgcgaacattccaagtgaagaaggcgttgattcgcaaagctggcctggagggacgcgttgagccggcgaacaatggcgttttccagcaagatttgctgctaacggaacagcaggcgaatgtgctaattacggagatcaatcagaatgaggttggcgttggtgccgtgccgccttctgacaaccgccgtttcagtcgtcggcacaatttcaatcgccgtcgtttcactcgcgccggcaattcgctgttctttgaagcttctcccacccaaaaatggccagtcggacaaccaattctgtacatgttcgatcagtcc

SEQ ID NO: 50421 - DNA, 554 bp, Heterodera glycines
  SCN-specific regions: Sequence locations=1-5,30-134,161-269,293 -311,338-350,394-475,497-554
gcgatccacgtcacggcaaatacatggccgtgtgccttctctaccgaggtgacgtcgtcccgaaggatgtaaatgcggccattgcttcgatcaaaacgaaccgttcaattcaattcgtggactggtgcccgaccggcttcaaggttggtatcaattatcaacctccgactgttgttcccggcggtgacgttgccaaagtcccacgtgccgtgtgcatgttgtccaatactaccgcaattgctgaggcttggtctcgtttggaccataaatttgatttgatgtacgccaaaagggcatttgtgcattggtacgttggggagggcatggaggagggcgaattctccgaagcacgtgaggatttggctgccctggagaaggactacgaggaagtggccattgacactgtggagggagatggcgctggagacgacgactattgattgaaaacattgttcgattaaattatattttggtttggaaatgttcttattgtattgctttattgagacgtaactgctttgatgctttttatataaatatgcttatcttttaac

SEQ ID NO: 50422 - DNA, 681 bp, Heterodera glycines
  SCN-specific regions: Sequence locations=1-389,411-681
ccacgtacggattgacatttgccaacccgtcggtgagtgccaacaattgccagggcactttggttgcgcaaatgttgcggcgtgccaccaaaaatctcgaccttggtgccgaatacatttaccatagggacgaacggtttcctggcaaacagtcgaacactctcagctacgccttgcgctacattcagcccacttggatattttcgggaactcttgcgccaaccgaactccatttgtgttactaccacaaacagagtgaacacttgcagttcggcgttgaatttgaggcgaatttcaagcttcaggaggtgaacacgaccttcgcctatcaaattgaagtgcccgactctctgactctgagggcctgctgcgacacaaattggaaggtcggtgctgtgctggagaagaagctgtccaagcagttgcccttctcgctggcgatcagtggcgtgctcgatcacgtcaaagcgcagggaaagttcggcatcggactgctcattggctgattggcgactgatgaggggagaagcggcgaatgttcgcaattgttagcttctgccaatttacattttacaccatttttttgctggccgaccattttctgttgtgtcgccgttgtttgttatcattttacattagattgattcatgcgattcaaaacggataaaaattgacattttc

SEQ ID NO: 50423 - DNA, 412 bp, Heterodera glycines
  SCN-specific regions: Sequence locations=1-412
cattatcaacaggggtacgattgggaggccaaaaccgctattaaaatttcactcggtgtgcgggacgaacattcaattgctaagggaagggcgagtggcaccacgaaaagagtcgttttgcaagggtcttgcattcatcaaccgacccataagcatcaatgagatcgtatgcattcgattgagtgagatcggcactaattggagcggagttatgagattcggtgtcactaatgttgatccggccagttttcgcgacattgaattgccaaagttcgcgtgtcctgacctcacctctaagggcggctattgggcaaagtctcttgctgaacgatattccgtggaaggctcaattttgcattttttcaccaatgccaatggcgaaatgtattacggcgttaatggggtgcacaaa

SEQ ID NO: 50424 - DNA, 481 bp, Heterodera glycines
  SCN-specific regions: Sequence locations=1-481
gcattttccattaaaaaaataaaatggtgcgcacattgaaattccatgagaaaaagttgctgaagaaagtggacttcatcaattggccggccgagttggacaacagtcttcatgagaacaaaatcatgcgccgttaccatgtggagaagcgcgagcactacacactgtacaacaaactgtccagagagatccgagaaatggccaaacgcatccgcgagttggacgacaaaaacccgaacaagttggtgttggcacggatgctgctcggcaagctgttcgacatgggcgtgattccgaccgcggacacactcgagcgatgtgacaaagtgacggcatcgtccttttgccgccgtcgcctccctgtcgtttgccacaaaatgcaaatggcaccgacggttaggaagtccagccaactggtggagcagggccatgtccgtgttggtgtcgaaatggtcaccgatccggcctttttggtcacgcg

SEQ ID NO: 50425 - DNA, 665 bp, Heterodera glycines
  SCN-specific regions: Sequence locations=1-20,73-665
ctttcttttccttccgccctctttttggccacttcctcccccactttttctgccttctcccccactttcttccgccaatgctctcatcgcccccaaaggaatttgttgcgcctgtgggagaggtgcatgcgtttgtggtcaaatgtatgcaaagtgtcggcacttcggcggcgcacgccgcgcaattggcggaccttttgttggatgccgacatcgtcggccattacagtcatggccttaaccgcctttgcatttacattgaggacgtcgcctcgggcgtaaaaggcgacggtgaaccgaaggtgctcaagcagaagggtgccaccgcttgggtggacgggtgcgatttgcttggcgccgtcgtcggtaatttctgcacagaattggccataaagttggccaaagagcacggcatcggctgggtggtgtgcaagcggtcgaatcattacggcatttgccaacattatgccaaaaagatagcaaatgccggcttgttgggactgtcgttcaccaacacttcgcccatcattttccccactcgctcttcccaaattggccttggcaccaacccaatcagttgttgtgccaattcacgcgaaaaaggcgacggattcattttggacatggcggcgtcgacagttgcgcttgggaagggcgaaatcgca

SEQ ID NO: 50426 - DNA, 480 bp, Heterodera glycines
  SCN-specific regions: Sequence locations=1-480
attgaaataattcttcaatgggcaagccgacgagtgtgaaggacgttgaccaacatgagattgtccagtcggtggccacctttctgaagaagagtggcaagatcaagttgcccgactgggtggacttggtgaagttgggcaaaaacaaagagttggcaccgatcaatcccgactggtattacgtgcgcgtggcatccgttcaccggcaggtgtcggctcgttccgcaacgtgtatggtggaaaaaatcgccgtggtgttgcactcagtcacttcaccaatgcgtccggggcagtgattcgtaaggcattgcaatcgttggaggaaatcaaatgggtggagaaagacggaggcactggtggacgcaaactgaccaaacagggccagaaggatctggaccgcattgcgtcacagctgcgttacagaaccgaagaatgaggatttcgacagatagatggggagaacaattatacttttctgtt

SEQ ID NO: 50427 - DNA, 457 bp, Heterodera glycines
  SCN-specific regions: Sequence locations=1-310,333-457
ttgagacattgcagcattttctctgatggacgaagaggcgaagcaggaaaacctggcgaaagagcttctaaagctcacttcttctctcaagcaaaattttacgactgccggttcggtgctaaaggaagacaatgcgacattggatgttatgcaaagggtcgccctgtccaacaaagaaaatctgataagggagaggggccgacttggccaccacgcctaccaatcgtgcttcaactgtgtgatggtcatgacagtgattgtggtcatttggtcgttcattgcgatgattattatgatgcgaatgttccccaaaatttaagtgttttatattttccttggataactcaaaacgggcccaaaccaacaaaataagaacgattcacttctgtgattgcttctgagctgtgttattctgttttgtttatttatttttcgtcatttaaatttgtttttcttt

SEQ ID NO: 50428 - DNA, 843 bp, Heterodera glycines
  SCN-specific regions: Sequence locations=1-13,45-843
agatattttaagcaaatattttttattttttctaattttaaaatgaccaacgaagcaggaaattggtgtttgattgaaagtgaccctggccttttcacagaattgataagtgggttgggtgtcaaaggaacacaagttgaggagctgtactccattgacgatgagcagcatctgtccagcttaagacccatttacggtctcattttcctcttcaaatggcgtcccggcgaagaattggagggcactccgatgcccgacgcccccgtgtactttgcccagcaggtgatcacaaatgcgtgtgcctcccaagcactgatcaaccttttgctgaacatttcgtcgtccgatgttcaactgggccccatcctcgaccatttcaaaagtttcaccgtcggctttgacccggcaacgcgtggccttacgctgagcaacagcgaagatattcggaagttgcacaactcgttcacccgggaacactttgtggagttggacgtcccaaaagccaaggcggaggacaatttccactttatcacttacgtgccggtggacggaaagatttacgaattggacggaatgcgcgaggcgcccatttgcctggcggacattgagccgggaaaagaaagttgggtggacacgctgcgcccattcatccaacggcgcattcaaaagtacacagagggcgaaattcacttcaatttgatggcgctggtgccgaatttgaagaccaaatacgagcagcgggttgccgagctgagcgcggttgggatggactcggacgaagtgacaaaggaactgaatgaactgcacatgttgatcagtggcgaggaggaaaagttcaggaac

SEQ ID NO: 50429 - DNA, 1314 bp, Heterodera glycines
  SCN-specific regions: Sequence locations=1-72,99-1314
gactgaatctcaaaaatgaacggttctctgacaaatggcaacaaagtcgaccgcggcgtcaccattcttttgggcgcgcaatggggcgacgaaggcaaaggcaaagtgttggattttctcatcggacatcacatgattgacattgtcgcgcgatgccaaggcggtaacaatgcgggccataccgttctggcaaatggccgcgagtatcatttccaccttttgccttccggattggcctcagaaaaggtgttgaacattgtcgggaacggagtcgtcgtcaatttggacgcccttttcgaggaattggagagcaacaaaattgaggattcggcagaccgactgttcgtcagtgacagtgcccatttggtgttgcctgtgcacatcgcaacggatatcatgcgggaaaatgcgttgggacaaaactcaaaactcggcaccaccaaacgtggcattggtcccgcctattcgagcaaatgcttccgcaatggcatacgactgggcgaactgctccaccaaccagagaaatttgaacaaaactatcgttcgctggtcgcccacttcaaaactcttttccctgacattgaattggacacggaaagtgacgtcaaacagttgaaggcccatgccgcacgtcttctccaaatgggcattgtctgcaacacaaccgttttcctgcacaaaaagcgtttggagggcaaatcgattttggtggaaggagccaacggcactctgttggacatcgactttggtacctatccgttcgtcacttcgtccaattccaccgtcggcggttgcatcaccggccttggcattccgccgacagccgtccgtcgcgtcatcggcgtggtcaaagcctaccaaacgcgtgtcggctccggtccgttcccaactgaactacttgacgccgatggacatcccagcgaagagggcaaacgtttgcaagaagttggtgctgagattggcgtgaccactcgcagaaaacggcgctgtggttggcttgacttggtgctgttgcgttattctgcaatgatcaacggattcacttctttggctgtaacaaaagtggacatcctggaccaatttcatgaaattaaaattgccattggttacgaattgaatggacggcaaattgagtaccctccagcgaccgtcgatgattgggcaaatttgtgcgtccattacaaaacctttgagggttggcagtcgccaacgaccagtgcccgtcagtgggaacagttgccggacaaatgccgtgcctatttggagttcatacaaaatcaactgggcgtacccgtcgaatacatcggagttggg

SEQ ID NO: 50430 - DNA, 478 bp, Heterodera glycines
  SCN-specific regions: Sequence locations=1-478
cacaaacaagcgcattgtttggattgacggaggaatgcatgccagagagtgggcttcaattcacacggcactttggttcatcgatcagctgatctcactgtatggagtggacccgcaagtcacagcttacatggacacgttgaacttttacgttttgccgttggccaacccggacggatttgaatactcgcgctctgacgtcaacccgcagacgcgcttttggcgcaagaaccgaggccagcaagtgtgcaagaaggaccgctggagacgggaacgatgctgcggcggggtggacctcaataggaacttcgacttccactggggagagactggctccagttctgacatgtgctccgacatttaccaaggtgcctacgccttcagtgagcccgagtcgcgcgcaattcgcgacaaaatgatgtcatcggaattgtacggcaaagttgacgcgttcctcacactgcacacatactcacag

SEQ ID NO: 50431 - DNA, 526 bp, Heterodera glycines
  SCN-specific regions: Sequence locations=1-526
cccccgggctgcattttccggcacgaggctattctctgcactattacatctgatttctgctgctcaccgactccatcgacaacgacacgcgatggaagaactcgtggcgctctcccctggaatccgcgtcggccgctggacgatcacaaagaagctgggcgccggagcattcggagccgtctacctgtgcgtgaacgaccaaggagagcaggccgcgctgaagacggagccggtcaacacgccacatccgctgctcgtcatggaggctcacgtgatgaccaagctggacgcccttcgagacggagacgggaagcacttctgccgctgcttggacctcgggcgcgatgagcaaaaggaccaacaatcgggacaaatgaagaagttcaactacatcgtcatgtcactcgtcggtcgtggcctggacggagtcgtcaaggatgccggtggccgcctcagccttggaagcgcagtcggcgtctcgatccagatgctcgccgctctcagaggactccacaccgtcggctac

SEQ ID NO: 50432 - DNA, 550 bp, Heterodera glycines
  SCN-specific regions: Sequence locations=1-550
tggagctccccgcggtggcggccgctctacaactagtggatcccccgggctgcaggaattcggcacgaggagactgtggaacctttggttggccatgtttagcattgccggctgtctggtgaccagctacgcgctgctcagagagattggcacctacgggctggtcagctcgtacacgaactgtcgcgacttcttcgagggattcaccggcttgtggacctggtggttctgcatgtcgaaatttgccgagttgggcgacacttacttcatcgtcctgcgcaagaagcccctgatgttcctgcattggtaccaccacgtggccacgctcaactacggtctgatgtcctacgtggacaacaccgcgttcaacacatggattgtgtggctgaacttcagtgtgcacgccgtcatgtacacctattactttttggccgcctgccgcatccgtctgcccgcttggttcgcccagtgtttgaccacctctcagatcacccagtttctgatcactttggccatccttgcccacgtcggtgtgcgactgttggtcggg

SEQ ID NO: 50433 - DNA, 476 bp, Heterodera glycines
  SCN-specific regions: Sequence locations=1-476
gtggactcctcaaacggttggaagaggattgtattgggtcagccccagcagcaatggacaaggacgacgccaaacaatttgaagaatatcgggcgaggaaagtcgcaatgataactggcatttctggtcaggatgggtcgtaccttgccgaatttctcctcgccaaggggtaccaagtgcacggggtcatccgtcgttcctcctccttcaacactggtcgaattgagcatttgtactccaatccgatgacacacgctgtcggttccagcttcaacttgcactacggcgacatgaccgactcgtcctgtttgatcaaactgatcagcaccattcgtcccaccgaactgtaccatttggccgcacagagtcacgtcaaggtgtctttcgacttgcccgagtacaccgccgaagtggacgccgtcggcactttgcgcctcctcgacgcgatccacgcgtgcggactcacccgattggtc

SEQ ID NO: 50434 - DNA, 849 bp, Heterodera glycines
  SCN-specific regions: Sequence locations=1-66,88-398,420-706,729-849
tcttctcaaaatgccttctgtttcttttgtggatgtccccgttaattcgccgtttacctttgagaatctcccgttcggcgtcttctcaacaaatgaaaatagcaaaaaacgcattggagatagcgataggaacccaaatcttggacctttcggtcgagacacatctcttcaccgggacgctgctttccgagagacaaaatgtttttagtcaagaaacgctgaaccaattcatgggactgagtcggcagtgttggctcgaggcgcgtctcaccctccaatcgttgctgtccaatgccaacccaatgcttcgcgatgacagcgaattgcgcgaaagggcttttgttgcgcagtcggaggccaagatgcatttgcccgccctaattggcgattacactgacttttattcatctatttatcatgccacgaatgttggcacaatgtttcgtggcaaagacaacgcacttatggagaattggaaatggctgcccgcttgcttaccatggcagggcgtcaagcattgttgtctccggcacggcagtcaatcgcccgtggggccaagtcaaggcggaagatgatacccagccgaactttgtgacaagtcggttaatggactttgagttggaaatggcatttttcgtgggagggcccgaaaacgctttgggcacgccaattccaattgagaagacggaggaacacatcttcggaatggttctgatgaatgattggagtgcaagggacatccaaaaatgggagtatgttccgctgggcccattcctcggcaaaagtttcgccaccaccatttccccgtgggtcgtcacaatggaagcactccgtccgttcgtcgtcgac

SEQ ID NO: 50435 - DNA, 994 bp, Heterodera glycines
  SCN-specific regions: Sequence locations=1-435,457-723,745-944,966-994
gtttccattcagtacagactcggcataatcggattttcatcgacgggcgataagcaaatggcaggaaacttcggcctttgggaccaattcgccgcgttggaattcgtttcggaaaacattgcgcaatttggaggaaaccctgcggacattaccctttttggcgaaagtgccggcgccgcgagcgtttctttcctcggactttccccgcacagccaaggtcttttccaaaagtgcgtccaattaagcggctcgcctttgtccgcgtgggcactaaatggacgcgtaattaacgaaactgcccaattagcagcagcgattaattgcgctgagaatggacgggaaggaatcaaagaatgccttaaggggaaaacggtggacgaattgttcgaaggggtcgaaaaagtgggcaaaactcgccaggaatacgacttcaccaaatggggcccccttttggacggcgactttctgccggcggacattccgcaactgatcgaaagagcaccgccgaagcccacagtgatgggaattgccgatttagagacacttttatggacattggccatcggtcacaacgacagcatttcactttatgcaattccatgggacgaaatggccaattttgacagacgacgctttgaaatgtttgtccaaaactttgtgactaaacgcgaattatttggccagcaaatggcgacggaattgcaacgagaaattgtgcaattttacacaagagacaaagcggtggagagaattgaaaatgagggcgaatattatgtgaggaaaatcactttgcttttgtctgacctccaattcgccgtgccggtcatttgggaggcggcgcaaaaggcgcagaaggggtggccgatttacttcttcaaaaacagttacttcaacgaagtggtcttcccaaaagtggtcaaagtcagacaaaatttccacgccaacgattttatttattttttcgaccgaaaagtgtatcgttttgaattcaatg

SEQ ID NO: 50436 - DNA, 420 bp, Heterodera glycines
  SCN-specific regions: Sequence locations=1-420
gttttagctaaaccagccaaacagataaacgacgacaaatgggtgtcgccttcgtcctgtgctgtttctccgtcgcctttacgccttcgctgttcatttttcgccgtttcgttgcccccgacccgttgcgcatcattctcttcgtgctcggtgccttcttttggctctgttctctgctgttgtccgccgtcgttttcgccgtgttcggccaacatctgttgctggtcgccattttcttctccattctgttccaagaagtggcgcgcgcactcttctacctgttgttgtacaaaacgcaaagcaatttggcccgactgatggccgccgatgcgaaccgcaccggcacagtgtccagcatgcgcttgctgtactcgtcccggcacattttggccattgtctgtggcctcggcatgggcaccg

SEQ ID NO: 50437 - DNA, 693 bp, Heterodera glycines
  SCN-specific regions: Sequence locations=1-668,691-693
ttctattctaattcattaaaatgacaactgcacatcgtccaacatttgatccggcaaagggtggaactggacgcaatgaaggcgatttagcgaagctttctcaacaatattctagcagggacatgccttcgcatatgacattgaagtacagacaaaaaggacaggcccaccccgaggaagtcgttgcaaagaacctccgccgtgacattgaggaacgtgagcagcattcgcgtgagcgtcgttcacgggattctctggacagttttggcacgggtcccacaaacaaaaaacaacgcgttgaggacacttcatctgcacgtaatcttgacgctgatgaaccatttgatgagctcaacgaggacgacaccgacttggacgaagactctgataacgaggccgaacttatggcggaactcgagcgcattcgcaaagaaagagctgcggaaagggcctcaaaagaggcgaaagaacgcgaagaacaggaacgcattcgagaagagaacattctccatgggaatccgctgctgaaccccgcatcgtcggagtttaaggtcaaacgccgttgggatgacgatgtcgtcttcaagaattgtgcacgaggaattgacgaaaggaagaaaacgccttcattcataaatgacgcaattcgatcggagttccatcgcaaattcatggagaaatacattaaatgag

SEQ ID NO: 50438 - DNA, 690 bp, Heterodera glycines
  SCN-specific regions: Sequence locations=1-194,216-690
acctcaaaaggaggcaagtttgagattcagtttctttttattacaaataaatgggacgtcgtatccgagctcaacgcaaaggacggggtgggattttcaaatcgcacagcaaacatcgcaagggcccggctaaattgcgcccagtggattactccgagcgtcatggcttcatccgaggcattgtaaaagacataatccacgatcctggccgaggggcgccattggccattgtacaattccgcgatccatacaaatatcgggtgaagaaagagacgatgattgcggcggagggattgcacactggacagtttatttactgcggcaagaaagcacaagtccaaattggaaatgttatgcctattggagaacttccggaaggtacgaccgtctgcaatttggaggagaaggccggtgaccgtggacgtttggcaaggacttcaggtaattatgccattatcgtcgcacataaccccgacacgaagcgcacgcgaattcgtcttccatctggtgccaagaaggtcgttccatccgccaaccgtgcaatgattggcattgttgctggcggtggtcgcaccggacaaaccgcttttgaaggcaggccgagcctaccacaaatataaggtcaaacgcaactgttggcccaaagttcgtggggtggcaatgaacccggtcgaacatcctcacggagga

SEQ ID NO: 50439 - DNA, 474 bp, Heterodera glycines
  SCN-specific regions: Sequence locations=1-80,104-474
agcaaacttccgccggagctcactcagcaagtgatgcgcggtgaaatgcccgacttgaccaagttgccgttggatttgcagcagtggatcaaagataactttgaccggcttgttgcttcgttggagaacaatcccgatctgagcattgacgaaatcatgaagaagttgcccacgttcgagcacccgctcatgtccaccttctccccctacgacatcaacaaggtcgacgccgatttggtggtccaacagcgcaacgaggaggaggccaaccaccgtttctggcgcattttcgccgccagcgccttggctttggctggtgccgtgacgctgggcgttctcagtgccttcttctggtacctgaaacggagcagacgtctggcggacccgccgatggcgccgccgattggcattgacgggggccccgagctgccctcggtgattcgtgagcagtacttccgaccgtctgcctcttca

SEQ ID NO: 50440 - DNA, 574 bp, Heterodera glycines
  SCN-specific regions: Sequence locations=1-574
gttttaattaaatttggatatctgaaagccgacggacggatctcttctcatgcgtcgcttgtcacagctgtttttgcggtgccattggacgccctcggagattgcggcgagttgtcgtcatgccagcagtgccgccaccgcccgtcccttgtacatggacgtgcaggcgaccacaccgatgacctgggacaaaaccgactggcgcaatgcccgtttcgagtatacgccgaagcaagtgaacccgaacattgcggcccatttgatcgccgagctggcgcccgtgcccagcgaggagcgcgtggtgcgctgcgacgggggccaccgcgagttgggccacccgcgcgtttacatcaacttggacaagccgggcacacacgcttgtggttactgtggccaacgcttttacaatgtgcacatgacaaaggccgagggattggacattcatcatattcaagtgtagcggttgaagaacatacagatggtgatcgggaaaaagtgatcgaaatttcgttttgtttattttttcgccaaagctcgtaatttagaaggcaattattaaaaaagctgtggatta

SEQ ID NO: 50441 - DNA, 860 bp, Heterodera glycines
  SCN-specific regions: Sequence locations=1-3,32-85,108-476,498-860
cactttttctttctttcgtccttttcttctccattaatttctctccttccgtcgttgcccaacgcacccaatgggacgcgttcaatttccccaacccaacggcgcccggcgatttccatcgctgcaaaatgcgatcgacggcacttttgtgtgacccggacgaggtattaagcgaacaggagcggtaccgactgaactacgaattgggactgatcgaatcggcaacgagacaggaaaacggaagggaattctgtgagcggaaaggaattaacgcggccgtagcaattgcacgccaagtgaagggcgggcaggagcaggatgtgcggaatatggccaatgaccttttgcgacgctggacgttggacaaacaatgcgaagaggcacttgttattgtgctgtcgctggaggaccgccgcttttgggtggcgcggatgccgcgagtgccggtttatgcgcaggaattcacggaactcttcaaaagagagcaaggcactttcaaaaccggtcgcaattcggagggccttcaaaatgtaatccgcgccatccgcgaccgcgctctctccaagcagtttccctccgcacgccctgacgacgacggccgttctaaaggcactccgtttgtgccgatgccaaaaccaacgcctcacccggagggaaagcacaggcagaggggcggcggaggagtgcttagttggctgttcatccttctggtcatcgtcttcgtggtcatccccttggcatgctgctgctgctgtctttatttctgctttttccgcaaaaaggacagcggcagcaacaaccgcacaccacacaatgcggaaaacggtggctctggcgcggaaagacggggcggcaccgga

SEQ ID NO: 50442 - DNA, 480 bp, Heterodera glycines
  SCN-specific regions: Sequence locations=1-16,47-47,118-135,176 -282,304-480
cctcgtgccgcgactttgcagaagcaggaattggatttgacttcggcgatgattgcttcgggttcgtggcgtggcaagcagttcaaacagtacaatttctccgcgatgggcgtgccgcccccctccggccatctccaccctttgctcaaagtgcgtgccgaatttcgcgacattttcttccaaatgggtttctctgaaatgccaacaaatcgtttcgtggagagttccttctggaactttgacgctctgttccaaccccaacaacacccggcacgcgactcacatgacaccttttttctttcaagaccggcactttcaacagaattcccggaagattaccttgaaagtgtcagaaaagtgcattctgagggcggtttcggttctattggctatcgctacgattggaagttggaagaagcgcagaagaatttgctgaggacgcacaccaccgccgtttctgcccgtcagctttaccttctc

SEQ ID NO: 50443 - DNA, 495 bp, Heterodera glycines
  SCN-specific regions: Sequence locations=1-155,185-190,212-221,245-495
aagaaggttttgtctgttccaaaagccaaaaaatcaaaaaagcattcgttgacaaaatgggcatttccgacaacgatgtccaaaagcagcttcgccatatgatggcatttattgagcaggaagctaacgaaaaagcagaagaaatcgacgcaaaagcggaggaggagtttaacattgagaaggggaaattggtgcaacagcaaaggcagaaaatcatggaatattacgagaagaaagagaagcaagtggagctgcagcgcaagattcagaggtcgaatatgcaaaatcagagtcggttgaaatgtttgaaggcgcgggacgaccatttgaaaaatgtgttggaggaggcacgcgccaatctcagcaaaatttcggcggacagagagcgctatccggccattctcaaaggacttttgcttcagggccttttccaattgctcgaaagcaaagttgtgttgcgatgccgcaagaaagacgaggaaatggtggcgagga

SEQ ID NO: 50444 - DNA, 493 bp, Heterodera glycines
  SCN-specific regions: Sequence locations=1-17,40-81,103-493
gtccaattaaggtcaataatttcgctttctttgtttgagcttactatttccgcataatggacgaggaacaacttttggattatgaggaagaacaagaagagactcaggaacaacaatcaaaaaatgatgcagcaacaaacggagatgcaacaaagaaaattaaaggtaattatgcgagcattcacagcagcggattccgagatttgatgctccgtccggagttacttcgtgcgataattgattgtggatttgagcacccttctgaagtgcagcatgagtgtattccacaagctattcttggaatggacattgtctgtcaggcgaaatcgggaatgggtaaaactgcagtgtttgtgcttgccactttgcaacaactgacaccgactgatggcacggtctctgttctcgtcatgtgtcacactcgtgaactcgcctttcaaatttcgaaagaatatgagcggttcagcaagtacatgccaggagtgaaggtttc

SEQ ID NO: 50445 - DNA, 1332 bp, Heterodera glycines
  SCN-specific regions: Sequence locations=1-76,98-108,130-148,170 -231,253-555,582-609,636-682,715-915,937-1082,1110-1332
attctctgatcaacaatgctctcaaaaaaacttttccagtctatcttgaacaaatctccaaagactgctttctcaacttcggctcgtttgtctgcgtcaagtgctgaagtttccaggattttggaggagaaaattcttggacaggcgtcacaaatcaatttggaggaaactggaagagttctttcaattggagatggaatcgcacgtgtttatgggcttaagaacattcaggcagaagaaatggttgagtttgactctggaatgaagggaatggcacttaatttggaaactgacaacgttggtgtggtcgtctttggaaatgataaagtgatcaaggaaggtgacgtggtaaagcgaacaggttcaattgtcgatgtgggcgttggcgaggctttgcttggacgtgtcgttgacgcgttgggcaatcccatcgacggaaaaggtccaatcaatgtcagcaaacgctctcgtgttgaagtcaaagcgccgggaatcattccgcgtgttggtgtgcgagagccaatgttgacgggggtaaaggcggtagactcattagtgcccattggccgtggacagcgtgaattgatcatcggagaccgtcagactgggaaaactgccattgccatcgacaccataatcaatcaaaagcgtttcaactcaagcacagaagaaaagaagaaattgtactgcatttacgttgccattggccagaagcgatcgacggtggcacaaattgtgaaacgactcactgacacggacgcaatgaagtacacaatcatcgtttccgccactgcttcggatgctgcgccgctgcagtttttggccccctattctggcgccgccatgggcgagttttttcgcgataacggcaaacacgcgttgattatctacgacgatctctccaaacaagcggtcgcttaccgtcaaatgtctctgctgttgcgccgtccacccggtcgtgaagcttacccaggtgatgtcttctacctccactcgcgtctgctcgaacgtgcggccaaaatgaatgagactcatggcggcggctcaatgaccgctctgccgatcattgagacacaggcaggggatgtgtccgcctacattcctacaaacgttatctccatcaccgatggccaaatcttccttgaaaccgagttgttctacaagggagttcgtcctgcgattaacgttgggctttccgtgtcacgtgtgggttccgcagcacagacaaagtcgatgaagcaggtcgccggttcgatgaagctcgagcttgctcaataccgcgaagtggcagcctttgcccagttcggatccgacttggatgcctccacgcac

SEQ ID NO: 50446 - DNA, 410 bp, Heterodera glycines
  SCN-specific regions: Sequence locations=1-288,310-410
tggaatggcttggctttgtcgaaaaatatgcaaatgtcccttctgtgtgcactttgaatgtatcttcgcttacggataattcctacaacaattggctccaacgcattttggtctccgctacgctttccatggacgtccattccctccacaaatggaacctccgatgtccaattctgttccaagctgagaaagagataaaagtcaaccaacaaactgagaattcggcggaacctgccgttcttctgccaaattcactcactcataaactcattgtttgtaagcaaaacttcaaaccattgcttctcttcagagagatcgacttaaattttgacaaatggaatagaatcattgtttttgtcaacaagaaacaaaccagtcgaaggctctcctctctcatggaaaccttgagc

SEQ ID NO: 50447 - DNA, 480 bp, Heterodera glycines
  SCN-specific regions: Sequence locations=1-7,30-159,181-185,208 -430,454-480
atagccctacaatttaaagagttgcaaaatgaccgcctctttgcaacctttacgagcccaacccggctggacggcggacaaatgcaaagagcaaattgaggtggccaagagcgagaatcggacattccaacgccaaacgctgcaggcgcatctggtccatttgctgaacaaagagcacaaattcaacgaggccatccaattggctgctcaacttgtgcgcgagctgaagaaggtggacgacaaggatttgctggtcgatgtgcaattggaggagagcattggcttttaccatctgtccaactacacaaaggcacgtgccgagttggtcagcgcacggactatcgccaacaccaaatacactccgcccgccatgcaggcccgtctcgacctccaatcgggcattttgcacgcggccgacgaccgcgacttcaagacggcctactcctacttcttcgaggcgttccaggcgttcgactcggt

SEQ ID NO: 50448 - DNA, 669 bp, Heterodera glycines
  SCN-specific regions: Sequence locations=1-669
ccaattaaggggtattcattttttgtgcaatgtctcatagtcagtccgagaaatcgctcgaccagcagttcgattgttgtgagtgcgtcgtcgatgatttgctgaagggccgtcttggcgattctcaatttgcgcaaaggaataacgtcttgagagattgtatccaatctctccaatccgtggccaaaacaatcgatggcctttcgttgttcagtgccaatgattccgtcgaagaacttccgacgaactctctccgttttttgctcgtcccagcttatttggccaccgcactgcaagaaatcggcgtggagatggacaaacggggcgcatatttgagagcttcgaagacatattatcgcgaattcctgcagaacatgtcaatttttgggctggtaaacttccgacttccttggcttaatgaagatgagcgcaattccgacgaccagcaaaaagagaatgggcgcaaccgatcgaaactgatcagcagttttgacgatgcaaaagcacgtcgacagcacaccatttcccgtcttcaacaattggaacagctcgaaaagactgtcgaacagctgaaaaacgaaaaacgacgcaatgatgacgaggcggcgcagcgtgaactgattttcgcacttttgcgtttttggtccattcgatctgtgaaggaactgg

SEQ ID NO: 50449 - DNA, 726 bp, Heterodera glycines
  SCN-specific regions: Sequence locations=22-196,219-394,422-584,614 -726
gctcctttaactcattttcttgatccaccaccgttttgtcctcctacccatttcctaaatcaaataacaatccacagatcgctgagaaatggccgagaacatcgaagaaatccttgccgaaatcgacggctcccaaattgaggagtaccaacgctttttcgatatgttcgaccgcggaaagaacggttacataatggccactcaaattgggcaaattatgaacgcgatggagcaggactttgacgagaagaccctcagaaaattgatccgaaaattcgacgcggacggctcgggcaaattggaattcgacgaattctgcgcgttggtgtacactgtggccaacactgtggacaaagacacgttgcgaaaagagctgagagaggcattccgactgtttgacaaggagggcaatggttacatttcgcgccccacgctgaaaggactgctgcatgaaattgcacccgatctcagcgacaaggatttggaggcggcggtggacgaaattgacgaggacggcagcggaaagatcgaatttgaggaattttgggaactgatggcgggcgaaacggactaaacgaacgatcagaaagaggaaagaaagaacgaaagaaagtgatctattggcggaaacggcggaacgtacaaaaaacgtcctcaaaacaaaaataaaaaaataattcgccaattattatttttgcagcggaatttcccattaaaattcagtgg

SEQ ID NO: 50450 - DNA, 480 bp, Heterodera glycines
  SCN-specific regions: Sequence locations=1-45,67-480
gaaaagggaggcgatcctgaacaaattcgcaaatctcaagtgggccgtttcgcagatgtttcattagtggacaaagtgatttcggcggactccgaatggcgaaaagagcgtttctttttggacggtttgaatcgtgcgataaaagtgtgcagtactgcgattggtgacaaaatgaagaagaaagagtcggctggtgactccgatgccattccggaaggacaaatcaaatcacttgcagaactgaaaatggatgacatcaaagaaatgaaaatttcgcaaattaaaacagtcaagggaatggtggacgaagaagtcagacggaccaaactcagaatggaaacgcttgagggggacagaaatgagcatttggccaaaattgggaatttgctgcataattcggtgcccatcagtgacaatgaagacgaaaatcgagtcgaacggacatttggcgactgcgcaagcagaaaaagttattctcat

SEQ ID NO: 50451 - DNA, 1170 bp, Heterodera glycines
  SCN-specific regions: Sequence locations=1-442,465-1088,1114-1170
gtccaattaagcttttccttcgcttttctcctccgtcccaccaaaatggcctccggtcattacgaagtttggcactcgcaaagcgtcggctttcccattttctatttgccctatgaatacgacgacaagtgggcgttggagaagcgcgtgtggaacccggcccaggccaaatggctccacccggtgttcatccgccattggcacatttccttctttttggtgttcctttatatcgccggcatccattatctcaagtggtggatgcgcgacagaaagccgttcgaactgcgcaactttttggtcttttggaatgccggattggccattttcagcaccttcggggcgttgaggttcagcgaggagtttctctacgttatgaagaacagatcattccaagattcggtgtgcctttccatttcgcccactcagccggccgctctttgggcctttcttttttcgctttccaaagtggccgagtttggggacaccgttctgctggtgctgaggaaacgcccgctcatcttcctccattggttccaccattcggttgtgctgatttacagttggcattccgcgactgaactcaccgcagccggccgttggttcatccaattgaattactcagtccacgccatcatgtacacttactacacattcgccagcctcggaatccgattccccaaatgggtgtcgatgactgtgaccacgctgcagaccacccaaatgcttatcggcgtgttcatctctctgtacgtcgcccgcctgaagcttttctcctcccgtccgacggtgtgccaacagtccgttgaaaatatgtgcatttgcttctccatttacaccgcgttcgccttccttttcatccgcttcttcgtcaattcgtatttactcggcaaaaaaccgacggcagcgaaagccgtggcgaagaaagcgcaatgagtgaagcagcataagcccgggatgctcagaacattccatccgcgcactttcgttgatgggagcagcccaaaagccgggaacacattctatgccccaaatcctccaacttttttaattgttgctggcgggaaaatcatttggcatccctccccttttatttattatatttttatttatgtatagtacagtacacactcaaattatttcctatgctttgataaatttaaagtttct

SEQ ID NO: 50452 - DNA, 659 bp, Heterodera glycines
  SCN-specific regions: Sequence locations=1-58,82-473,498-659
ctcacgaacggacgtgccctggtgcaacaatggcaaaggaggaatactgtttcgatgcaaaggcggcggcagcggcggggcaatctcgtcgtccttcgacaacggcatcagtacttgtgcaaggagatggccagtcaagcagatttgtggatgcgatcatcagaaaagtcacgcagccgcctcttcaacgcttcacggatgagatcaccgacgaggaactcaaacaactctgcaaggcggccacggacttcttccggatgcagccgacgctcgtcaggatccgcccgccggtcgtcgtcgtcggagacatccacggacaattctcggatctgcagaggatcttcacaacgcatggccccccgccggagcagcagtacatgttcttgggcgactacgtcgacagaggagcacactcgatggagacaatcatccttctcttctgctacaagatcaagtacccatcgaacttcatgctgctgcgcgggaaccacgaatgctccaacatcaacaaagcttatggcttctacgaagagatcgaccgccgttacccgcgaacgggcgctcgtcgactcttcgacctcttcaatcaagtcttcgcctggatgccattcgtcggactgatcggcgagaagatcctctgcatggacggcggcatctcc

SEQ ID NO: 50453 - DNA, 658 bp, Heterodera glycines
  SCN-specific regions: Sequence locations=1-140,162-311,340-546,568-658
ggaaggtcaggcattcgcctgtccaacgcttcacggatgagatcaccgacgaggagctcaaacaactctgcatggcggccacggacatcttcagaatgcagccgacgctcgtcaggattcagccgccggtcgtcgtcgtgggcgacatccatggacaattcacggacctgcagaggatcttccacacgcacggcaaccctccagagcagcagtacgtcttcctgggcgactacgccgaccgaggttcccagtcactggaaacaattgttcttctcttctgctacaaggtcaaatacccagcgaacttcatgctgctgcgcgggaaccacgagtgcgccaacatcaacagagtgtatggcttcttcgatgaggtcaaccgccgctaccagcgtccgggtccccgccgcctctacgacctcttcaatcagacgttcgcctggatgccctacgtcggcctgatcggcgacaaaatcctgtgtatgcacggcgggcctctccgacccgatccacagcctggagcaactcagccagctgaatcctcccgcaaatacaaccccccggcttcggacgctggagaaacggatccttttgtggggagaaaccctgccgaacaggaaatatcgatggcaggcatacccccgaacaaccatggagaaag

SEQ ID NO: 50454 - DNA, 735 bp, Heterodera glycines
  SCN-specific regions: Sequence locations=1-214,236-735
gtttgaggtatttaactaaaaatcgcatccctattaatcactttaaagccgttctctttgaattttcactttcctgctcattttttgataatgggtcgacacaggcgttatccgatgaaaaaaacagcaaagaatacaaaccaagcccaaaaaatagaacgattgtcctttgacactgatcagacgcctcttcaaacaccaaaggacagcaggaaaaacaagaatatgaacaaaaagccatccaattcgatgttggaggaacagccaacaacatggaaagagcaaatgttgaagaaactgacagacgaagttgcacaacaaaaaaataaaatacagaaaaggaacaaaaaaccaaagaatcgacttttggaagaaacgcagaaattgggttatcatcacatgccctgggaaagtgcaaaaacactgatttaccgaattcagcaagaccaaaacaaggctataaatgaagaacttttaaaggctcgatttgcaaaagcaggaagagatgttaaggaaatagcggaggaatacaaaataatggacgaaaaaaacaaaatgaaaaaggagcggagaaaagtattgcacgagaaacagagcaaattaagagccaaagaaaaagacattgacgaaggaatcggagcgaattcggaagaagaaatggaccaaaacgaaatggaagaagggaagagagaagacggaagaggcggagaagcgcaagagaaaagagcaggtcca

SEQ ID NO: 50455 - DNA, 628 bp, Heterodera glycines
  SCN-specific regions: Sequence locations=1-232,254-423,445-628
gtttcgcctccagcggatgctccgccgatcgaaattttgcggcattttcaaattcgttgccaatgggtggtcaaagtgagcagcagcattttggagaattggaagtgaaaacggcggagaagacgagcagagacggagaggaaggcaagcggaggacggaggacagacaacaaaaagtgcagagagagcacagggaaaacagagagcagagagagtacagagagcacgcgcttccctttaagggaatggtgggcaacgacccgagctttgagcagatgcgtcaaattgtgtgcgttcagaaactccgtccaccgatggaaacccaatggaatgacggcgccaatcccataatgcattcgctttacgttctgatgacggagtgttggagcgaacattcgctgagcagacacacggcactgaaagtgaaaaaggaattgggggcactgagcgaacaaggcggggacggacgggggaaagagacaaattagcaccgaataaaagtgacaaggaacagcagcagaaagaagaagaaagaagcagaaacagaagagacttttgaaaaaggaaatacccatctttggccttcgagatggcttattcatatgcttctgataaagatttgcgattt

SEQ ID NO: 50456 - DNA, 534 bp, Heterodera glycines
  SCN-specific regions: Sequence locations=1-235,257-385,408-534
cactacacgcccaacgccggtgatgagacagtgcttggaccctccgacgttgtgaagattgactatggaacgcacgtgaacggtcgcatcatcgactgtgccttcactttgacattcgacccaaagttcgacactctcttaaacgccgtgagagaggccaccgaaacgggcattcgcgaggcgggcatcgatgttcgtctttgtgacattggcgaggcaattgaagaggtgatgacttcatacgaacttgaactcgacggaaaaaccttcccaataaaaccaatacggaatttgaacggacattccattgggccttatcgaatccatgcaggaaaaacggttccaattgtgaagaatggcgagcaagtgaaaatggaggagaatgaattctttgcaattgagacattcggaagtacgggtaaaggacatgtgcacgacgacatggaaaccagtcattacatgaagaactacgacctccatgaggagcacattcctctcagactcacgcgtagcaaaaaacttcttgccacaatc

SEQ ID NO: 50457 - DNA, 650 bp, Heterodera glycines
  SCN-specific regions: Sequence locations=1-650
ctttttacgccattttggccaattctttgcctccatccgccaattcaccaactcatccatcaataatcttcgccacggctcaccacttctttacatgtcggccgtaagagaatggtgtgctcccattgagccgtgtaacagcctttctgtagaaaagtgaaacatgtgaaaaaggcgttaatttgccatgggctttggacctgatcacagagcggaggataaggcgcaacaatgtccttctctgaaaagtttttgttgccaaagtgtgcaatagaagctattacaaaccgcaaaggtctctgagtgacatcaaatatttggtttcgcccagtcggtccaaccaccggcgacaaaatgccaaagtcccgaagttcttgttgattgtggcaagaagttttttgctacgcgtgagtctgaaacgatttagcttatacaaataaaaaccctttttttacgcattggattaacacttcacctgagaggaatgtgctcctcatggaggtcgtagttcttcatgtaatgactggtttccatgtcgtcgtgcacatgtcctttacccgtacttccgaatgtctcaattgcaaagctaaaaaggaaacagtaaattaaattagttatttattaactgacaattcattctcctccatttt

SEQ ID NO: 50458 - DNA, 586 bp, Heterodera glycines
  SCN-specific regions: Sequence locations=1-509,531-586
tgacaaagacgacagaacggcgatcaatcggatgaccagcgaagagaaaaaggctttggacagcagttacgaagagatttacaacgattttcgacgtgctgcagaatcgcacagacaaacgcgaaagtacgtgaagtcatggattaagcccgggatgaagctgatcgacatttgtgagcgacttgaagcgcacagtcgtcgaatgatcaacgagtcgggactggaggctggcctggccttcccgaccgggtgctccattaatcattgcgccgctcactacacgcccaacgccggtgatgagacagtgcttggaccctccgacgttgtgaagattgactatggaacgcacgtgaacggtcgcatcatcgactgtgccttcactttgacattcgacccaaagttcgacactctcttaaacgccgtgagagaggccaccgaaacgggcattcgcgaggcgggcatcgatgttcgtctttgtgacattggcgaggcaattgaagaggtgatgacttcatacgaacttgaactcgacggaaaaaccttcccaataaaaccaatacggaatttgaacggacattccattggg

SEQ ID NO: 50459 - DNA, 552 bp, Heterodera glycines
  SCN-specific regions: Sequence locations=1-351,373-493,516-552
aaagctggagctccccgcggtggcggccgctctttcactagtggatcccccgggctgcaggatttcggcacgagggtatacaatacatataagctaaacaaagaaaaagctttcaatggaccaaaacaacgaccaacgccgtgctgttaacgaatatcggcttaatgaggacaatgaactgcgtttagaagtgggcaaagaagaagtcattctcgaattgctggagggttctgccgaaatattcggctcccaaatatccatgcacaaacgctactctctccccccagggtttcgcgccgccgttttcacatataaaggtgcccttattgaagtggtcggtcgaacagatagtgcttacattgcacaacaaacacctatgattatctatttgaatactcatgccgctctcgagagtatgcgaaaaagtgccgagacacaattggtggccgaccgaacatcttccgcccgtggtccacgtcttttggttgccggaccaactgatgttggaaaatcgactctttgtcgaatattatgcaattacgccgtccggga

SEQ ID NO: 50460 - DNA, 793 bp, Heterodera glycines
  SCN-specific regions: Sequence locations=1-793
gctccaccaagcctttttggaaagcggcaggcagcactggatcggggttacagaagatatgaacgggtacagacaggagggactcgggaagatggacatgacgattaaagacgggagacggtggagcgcatccagcgcatatctgactaatattttggaccggccaaatctgttcactaccgccggtgtcacttgcacctctgttttgttcaacaatcatagagcaatcggaatcgaatttatacgatatcatcgtttcatgctcaccgaagaagtggatgcctactcacgggagaaaatttactgcgaagactctgtgattctttgtgccggtgccattaatacgcctcaattgctaatgctcagtggggtcggaccggcatctcacttgaaagttcatcaaatccctgtcgtgcaggacatgccgggcgtgggccaaaaatctacaggaccatcttgaactttatgtacaacagaaatgcaccaagccgatcacattgtacaacaaatccacgtggcgacacccccaccgcatggtcatcaacggtcttcagtggttcctcaccaaaaagggcttggctgcgacaagtcatctcgagtctggcggctttgcccggtccagcacagaaattgatcaccccgacttgcaattccatttccttccgtcgacggttcacgaggacggcaggcaaagtccgaattgccatgcctttcaagttcacgtgggcccaatgcggacgaagtcggcaggggaaatcactttacagagcaaggacccgcgcacatcgccgct

SEQ ID NO: 50461 - DNA, 476 bp, Heterodera glycines
  SCN-specific regions: Sequence locations=1-476
ctaattcgtcgcttggccgtgcttacacgcccgggggaggaggtattgaaggagtggtcgagagtttgaacggtgccaaccacaacaacggaggaacgtccggacaatcggccgcacggcacgctgaccattcaggcattggccagccgtgctccagccacgtgcgcgaactgcccacgctgaacacccatttgacttctcccgcagcagccgtcgctctcggcctcatttatctgcgaacgggcgattgttggatcagagaaacgctggcaattgctgacacattttacgagattgaccaaattcgtcctgacatgctaatgattcgcactttttcgcgttgccttgtcgatttcgaagacattaaatgcacgagagaatgggtcgatgcccaaattccgcagataattcgtaaatatgtcaaacgctttttggaagtcaagtccaaggaggacatgtggtggtccgatttcatt

SEQ ID NO: 50462 - DNA, 629 bp, Heterodera glycines
  SCN-specific regions: Sequence locations=1-629
ttaattcttaaatatgagtagtcagcaacaacagttggatgtgcttattgtcatagatggtaccaacattgataagccttgtgttgatattttttcgagttctggctttgttgcttcttgtctcaattgggtttcaaagcttcattctcctaatgtaattgttgcgttacccaatcaaccgaatgatgtagcagccgaacttttaaaaaaatgggcttctaaattcaagcagcttcaggcatttggtgtttcaaattgccaatctttaaacgatgttcttcgtgaagttgattttcgacaaattcttagaaatgatttcatgctcatacaaaatttagccactttttgtttttcctatctgacgcgacaaatcgaaaaatttcgaaacgataggcggcaaaacaacaaaaatgtgctcacattgctttattactcaaaacgaaattatggaaggaaattcgaggaagatcggtctctgattggatacattgaacaaactcaaaaattaacacattatgagaacattggcaaacatagaacttttactgttccaaagagtgaatttttacatgacacggttttccgggttgacctgttctcctgtgggattgcgctttgtggaatcgaat

SEQ ID NO: 50463 - DNA, 705 bp, Heterodera glycines
  SCN-specific regions: Sequence locations=1-705
aaaatggcatcgaatttgacggttaaagttcaccccatcgtttacatgtccatcgtcgacgcctatgagcgtaagtcatcttcgaacatcaacagtcgcgtgggcaccgttcgttccgtggaaacaacggaaaaccgagcgttgggcacgttgttgggattttacgagaagaatgtcgtccaggtgacaagctgttacgccgtgccgttccgcgagacctccgacgacattcccgaaataaatgatgcattgaacagacaaatgtggcacatgtccaaaaggacttcgccgtccgaacaaatcgtcggatggttcttcactgtgcccgacctttctgaaatgtgtccgcattatcacggctattacacggggttagtcaatgaaacgccgcgaaaagagccgccgcccattattctgatcaccatggatttcaccttttcgggagagagcgccgaccgacttccgatcaaagcatacgcggcacgcgaggcgggggtcccggggaaaggagcgactcaagcgacgattttctacccgttaaaagttgaaatggacgtgttccctggcgaatccgttgcactttcatttataatgaggggtttggactcggaacggcgcgagattaaaattgccaacagtcaggagcaatttttggagaatgggaaacagatggtccactggttggagaagatgctcggctacctg

SEQ ID NO: 50464 - DNA, 1032 bp, Heterodera glycines
  SCN-specific regions: Sequence locations=1-399,421-664,707-1032
acaacccatacccaaaaactctttaatgagccgggtggcaaagatgtttatgaaggcgtaaaaatcgactacagcggaaccgaggttaaccctgaaaatttcgaagcggtccttttgggcgatgagcagcgatcggagggaaagccggtgctgaaaagcactgaaaaggacaaagtgttcgtgtacttctcggaccatggcgcggtcggagttatcggattcccagcagccgacttaacggttaaacaattgactcaaacactgaaggaaatgcatgccaaaaaaatgtacggcgaattgacattttatctcgaagcatgcgaatcgggctcaatgtttgaccacacattggcgcagagtttgaaaatttacgcagtcaccgcggccaatggcgacgaatcgagctggggctgtttttgcgacaccaaatttttgcccggaaattgtttgggcgatcttttttcagtgaattggatgcaagactcggaccaggaaaatttacgcaccgaaactctgcggaaacaatttggcattgtgcgcgaagaaacgaacaaaagccacgtgatgcactacggcgacttgcaaattcaggacgaacacgtttctgagtttatgggcaaagagcaggcgcacaagcgcaacgaacgcccaccatcaccgcacaaatttccaatgtttccttctcgagacattcccatgttcatgatggcacgacgtcagaatgagtctaagcagattcagcgaaatctccgcgtggcgtggaaaaaaagaagctttctcgagcaatcgattaaacaaattgtgcaccaacttgtgcacgacatgaacaaccggcgacagatgttgacgacttatccgcaacaaattcgcgacttggactgtcaccatgaggtgatgcacacgttcagcaatctctgcttcagatttagcgagaatccgtacgcactgaaatatgcctatgttttggccaatttatgcgagcgacccgagttggacgccgaacgtatcagaatggcactgattgaacactgt

SEQ ID NO: 50465 - DNA, 597 bp, Heterodera glycines
  SCN-specific regions: Sequence locations=1-597
cctccccaagttcagctgagtgcgcttgtccttcccccttcgtcacaatcctttaacatcgaaagtcccaactccgatttaaactctccacaaatttcgaaccgtcaaacaaataaaacttcggcactatcaatgccccggggcacgaccaaaacggtggcacagcgaaggggcgggcggagaccgcgagaagcggaagatcaccagctaacggatgaggacaaagaccgacgggcgaagcgacgcgagcgcaacaaacaagcagcggcacggtgccgacggaggcgggaggagaaaatgcaaagtttgcaggaacaggtggacgaattgcggaagcaaaatgaacgccgggagaatgaaatccgaaaaatgcgagaaaaagagcagcgacttttggaaatgttgcgactgagaaacggcggaattgtgcagcagcagttgcaccaccatttgcaagcagttcacgtccaacaacagcaccaatccgtcgctgatcatccgactgtcagtcggcccacttctcttcttcagccttttctggtcggactgaataacaaaagagattctgtgaagccccggcagtgccatcctcgtcct

SEQ ID NO: 50466 - DNA, 476 bp, Heterodera glycines
  SCN-specific regions: Sequence locations=1-476
taagctcccattgtattattactatgaccaaaacggataatgggaagttcaccgaagaaaataacacgttgatggcaaatggaaggacaaaaccctcagagaaaacatctctgtccacatttatatacaacaaacaggacgggactttcttagggcgttctgcaaagtcttgggcacagatcatcggattctacatcgtcttttacatatttctagctctcttttggttgggatgtctgtggacctttcttaatacgatcgatgattttgttccgagataccacggggaaaacacaattattggcgcaaacccaggtgttggttatcagccttggctggccagcaatcccgagtccacgctgatcaaattttacgaaaacgacacctcaagttacaaggattatctcaatgccatcgatacgtttctggagaagtatcacaacacagaaaacactcgcttctgcgacgagaacggc

SEQ ID NO: 50467 - DNA, 510 bp, Heterodera glycines
  SCN-specific regions: Sequence locations=1-510
tctgcctccaacatgtcaagcagtcttgacgtcttcaaactgacggacgatgacgcaatgaaatttttggtgtgcgaatcgcacatcggcaccaaaaagatggactaccaaatggagcattatgtgtggaagcgtcgatcagacggcattcacatcatcaacattcgcaaaacgtgggagaaactgttgttcgccgcccgtgccatcgctgccattgaaaatccgtccgatgtttttgttgtctctactcatcccaactcccaacgcgatgtgctccagttcgccgctcacattggtgccactccaatcgttggccggtttacgaccgggtctttgaccaaccatcttctgaagaattgcttggaacctcggctgctcgcggggtccgaccctgaggtgcaccaacaggagggacgcgacgcgtcctacgagaacactcctgggattgctccgaccaacacagactcgacgttgagatttgtggacattgccgtcccggcaaacaacaag

SEQ ID NO: 50468 - DNA, 479 bp, Heterodera glycines
  SCN-specific regions: Sequence locations=1-56,78-432,454-479
gcaacccggagcagtacctggccaatttacatgagctttacctaaagacgcacaaattgctgggccttctgcaggagaaattccgcacgaattcattggacccccaatttttgccaacgctcactcagtcggtgttcggcccctatttggtcacatatgcaaaaattgagcacaaattcatcgccgacaaatgcacttttacgctccgaaagttctacgagtccaaagggcaccaaaaacggagtattctctcgagcggacttcaagaactcaagtcgcgtctgctgacagcggaggattttggtggcgaaacttttctttccgaaatcatagcgataaacattctgcaggagtttaagaatgccttcgcccgctgttcatcgctttgcaaaaaaacggagtctcttgaactgaacacagtgctttttgacatgcttctcaaatttctgtacaccgaacacgtggaatacgccattgag

SEQ ID NO: 50469 - DNA, 769 bp, Heterodera glycines
  SCN-specific regions: Sequence locations=1-267,289-518,541-582,605 -706,728-730,767-769
atttttggctggcaatgacaacgaaaagtgagggggatgaaaataattctgtggatgagaatggcgagccctctggcaatcacgcggagaattgcagcaccgggccctcttcgcctgccccgtcagtgtcctgcgaggcgtgcggtaccaatttctcacaacttgagaaggatgcttttgccgcagtacgcgaaatggcgccgtacgtcaaaaccatcgccatttccgaaatactatcccgcactcccgagctcatattcctcaacattgtcactttggaaaatgagagttattgcgtggaactcactcaacgaggctggcgggtgagttccgaccgtctcgactgtatgaacggagacattcaaaagttggaaatgcacgtcacttactacgacgccattgagcagctgttggacagcttaagcgagcagtaccgcgagaattttggcgccgcactctcttcaaaactggccgctctgcagacggaacagaagcaaagacagcaggacggagaatcagagggaaacggcggaggggcggcagagagaagcgacgcggggcaaaggacggacgacgagccgaactgacaatgagcggagcaaagaaaagcacagaatgtttgtccattttgattgtcccacccttcgttggtctgttactcatttacacttctccgaggcgagtgtcccatttctcttccattcccttcagtttcattttgaccgtaatcatatttaaaaattttttgtaaaataaaaattattttgtc

SEQ ID NO: 50470 - DNA, 476 bp, Heterodera glycines
  SCN-specific regions: Sequence locations=1-114,136-476
caaatgttgagttggttggaggacaaaaacgagaagttcttgaacattgtcacggacattatgcagaaagtgatcacgaagaattccgaacaaatgacatttttcatcggaatgaacggacaccaaaaactggtcggactaattgccaattgtcgtcaggaggcactgttatggagagttaccaaactgatggacaaaattgtgcagatggacgcggaaagaatggtcggcgcgggactattggaagcattgcaacgccatttggaccatccgagccaaagactgcttcgtcaagtgctgtcgtgcgttcgaagtgtcagtcacgtgccaaccgccgaccgaacagttcagccacttctgcagaaactgctccaacttcttggaacgagtgacattcgcctaaaagaaaattgtgtggacattttggccaatttgtgcgccaacaattcccaaaataaatccttccttgttgagaa

SEQ ID NO: 50471 - DNA, 1090 bp, Heterodera glycines
  SCN-specific regions: Sequence locations=1-180,217-1090
caatttgggtttataaattgttttggatataaatttgccaacattgccttcgtttttcctggggatgaacaccagcacaccgcgcgatgctccgacggcgcaagacgcacgaactttgcgccaaatggcgtcacttcgccggtccatgcgcagcactctgtccccaattgtggcggaagagggggagagagaagtggggacttccgccgccgccgcaacccaacggcgttcaaccgacttggcccagtcgttgctccaacgacggtcagtgctcagccaatttggcagtgcccagtcgtcggtgtcttcctccgtcgggagttacactccgtcaatgatggccagcaaaattgacaatcggcccgccattgtcatcgaaattggcactcgactgaccaggattggctttgccggtgattttttgccccaggagattttccgctccgaattcgttgacccattggacggtccgtccccgtcctccccaattgcactgtttgaccggtcgcgcactgagcaacagcagtacgaagtgctcgtcaaattcttcaaaaacatcgttttcggcaaattgttgaccactatgagctcgcgtcgtgtggtggtggtcgaatcgcttttggtgtctaattggcaacggaatgccattgcccgtgccctcttccaatgcccttctctaagcgctcattccattttgttcgctccgtcccatttgtgctgcacttttcccttcaacacaaaaacttgtctggtcattgacatgggtgctgacgaagccgtgctctttccggtagctgaaggggtgctgatgctgaacagtttggagaccagtgtggcgccctccgcgacggcgttggagcaaaatgtgcgtcgtttgatggcccaatttggccgtctgcggaccggggccgaagacgatgcggagggacggccgctcactgagactgagttggaacaagcggaccgaatgcgactgtgggaggacgtggcggtgcgcttctgtttcgccacaacggccgcgcgcggaaaacgcattcagacgtatttggccaattccgctgcttcttcgtctgccgattgttccgctgcg

SEQ ID NO: 50472 - DNA, 629 bp, Heterodera glycines
  SCN-specific regions: Sequence locations=1-629
caaaagccaaacagatcaacaaataaacacgtcagattagggtcgattcggaatggcacaatatgtgccgtggtattacaaacgctcaccgcccattttttgtggcgtttgtgtgcccgtttatttgggcgtttggtccgttcgtaagttcatcgttgtgcttggctttctgctctttctgatcggcgttctgctactgctcggtcttctgctcatttgcgtggccatcgaatgttccgctgctgccggtgctttacttccgttcgccttagtgcttatcattgctgggctactacttttgcactgcggatgggctgctcatcttttggacgttggcgagggaatgccgtacggtgaatattcgacgacaaaaacggtgagcacttcgaccagaacgaaaaggacggcgccgaagggggaggaggagccggtgttcgaagagatcgaaggcaaacagccgccgcccgagatcaagcagggattttggcaattcgatgagcgcgaggcgtggcaaacggtggccaatccgtacccgataaattacacgctgaagccggtgattgaacgccaaccgtacgtgccataaccatgggaaagcaatgaaaatgccattctctgtgccaattttg

SEQ ID NO: 50473 - DNA, 462 bp, Heterodera glycines
  SCN-specific regions: Sequence locations=1-17,39-252,274-462
gtgacgcaaaagattgtgaagaaaaaacagaagaaaggggcgcaggcgggcaaatacgtcaccaaaacggtgaccaacgaaagcttcttcaactttttcgatccgaaagtgacgaccatcacagaggaaatggacgacatcgaggaacagaaaaccaatgatgacttcgaggttggacagatcattcgtgaacagctgattccccgtgcggtgcttttcttcactggtgaggcggcagaggaagacgaatatgacgagttcgatgacgaggaggaaatgggggacgaacagtcggaagaggaggacaatgccatgcactgaaggaccattggacgctgttaatgacaattgtttagtgacgctgatgatgttctctatttaaaagttgttttgttgacacttatctttatcacacacattctgttaatgcgcgtacacacaaacaaaagatttattctgttc

SEQ ID NO: 50474 - DNA, 475 bp, Heterodera glycines
  SCN-specific regions: Sequence locations=1-191,213-475
ctattggtcttttgttagagcaaccggtgaaaaaacgcaaaattgaagttggggaaagcgatggcaatgagcagcggagtgttgcggtccgtctcttctcggaggacggaaaagagatcggccaggcacccgtcgttcttcttgcttccaccactgctgaacagctccaagtgctttaccaccaattgttgcgcagtgaaaaacagcaaaacggcgaatgcggcgacgacggagactttgacgaagggacggcgcccgtccaatttcggaccgtcgcagacgaaaaaagtggcggaaaagggacggaaattgtcgattctttgctcgactcactgccctcagaacgcctcttcttggaaaagcccctcgagttggtctgtctgccacaggccgtgttccgagttcggcccgtcactcggtgcaccgcttcgttgcccggccatggcgaacccgtcctttccgtacagttcagtcc

SEQ ID NO: 50475 - DNA, 639 bp, Heterodera glycines
  SCN-specific regions: Sequence locations=1-85,107-449,471-639
gtccaccaactttggtgcagacacaggtagaaggtggctctacccttttctccctgaatttcttcggcgagtccgctttcctcactcagtcttctcagctttacctcgaaacgtgcattgcctcgttgggcgattgttattgcatttcgcagtcttaccgcgctgaaaagtcgcgcacgcggcgccatttggccgaatattcgcacgtggaggctgagtttccatttatcaccttcgaaggtcattttcaaagtgtagagaaccagcgaagctgtgtgttcagatttgatggtgcgcattgaggaaatgacatgtgacacagtcaacagagtgatggccgacccggaaatacgcgaacttatccagcagcagtggcaaaaggattcccaatatgagttcgtcgctcccaaacggccttttcttcggatgacttatgcggaggcaattgaatggcttcaaaagaatgaagtgatgaacgaagaggggaaacccttccaattcggcgaggatattcccgaaggccctgagcgatttatgaccgacacaattggacaggtctttgaatccctcgtttttctttcacaatcgcccgttcccttcagccaattcttctcaatcgctttccgcatggaattaagg

SEQ ID NO: 50476 - DNA, 476 bp, Heterodera glycines
  SCN-specific regions: Sequence locations=1-289,311-476
aaaagtttcatcgattcggcaattgcatttgtgcgaaagcacggctttgatggcattgacatcgtaagagaatacccaaagggcggagagcagaagcgaaacttcagcagattttttaaggaactgaaagacgccgttcggaaagaagcgtcttcaagcggaaggccgcgtctgctgatcactgctgcggttgcggcggggacggaaaacattgacaacggatacgacattccgacagtcggaaagcttctcgactttgtgcttctgatgggctacgacttccatggctcgtgggagcagcagacggggatgaacgcgccattgtacggacggtccaaagatgtgccggagaagcgcttgtggaatgtggctggtgctgcgaattattgggctaagaagggcatgccgaaatcaaagattattatcggaatcccaacatatggccgtggatggacactgagcaacccgcaacaatt

SEQ ID NO: 50477 - DNA, 1065 bp, Heterodera glycines
  SCN-specific regions: Sequence locations=1-67,89-92,114-1065
gtttgagtgcgtctgatgttgtgctttcttcgttctgcaaatggttgctcctccgtgggattctcttcgtctgtctgttctcgttttgcttttcctcgcctttgtgtgttggcttcgttgtccaatgagtcgggactgagcgagtgccttccccaatcggttgaaagtgtttcggcatcggctgctgcaattcgggagagagaacgccgtgagcgccttctgacgatatcggacgcaatgaagttttacctggagaggaagcaggacgaaatggcgattctggagaaggagaagttgctgtacgcgcagggaaagcgccacttggccaacataatgggcttcgaccccgactcgatcagcggggaccaaatatcgcagtccatccgttatttgttccccagcggcctattcgacaaaaaagcgctacccgtgatgaaacccccggaggaagtgttcccgaaaatcgtgaagattgacgtggacgcctccggctctccgaagcattcgctgtttttcactgccaaacccaaattctattctttgctttcggacataaacaaacgcacacaaaaactggtgaatgcattcgacggacatcagacaaaagtgaacgaagttgaaaagatgcaaacgatggaattggcacttctcggagaaaaaccggccgagaaaggacagatcaatttgatgggcacccaatgggtgacgaaggatcagctgcagcagcaaatgcaggagatcctttccgatgacgaatatgcaaattttataattgcgctcgaatacatttcgcaattgccaaattccgcggaggaggaggactttatcatgtcattgcgtcgtgggattggagcaagtgaaaaaaatagacttttccgcgcaaaagtaccggaggtgacgataaacgaagatggcaggagagaatgctggagaatttgcaagacgagggcttccgccgtgaaaattgtggtcagagacggaggcaccggccttttcacagtcaatgggcaacactattgcacgttccgttcgctcctcgcgagagaatgtctcttggctccaatg

SEQ ID NO: 50478 - DNA, 436 bp, Heterodera glycines
  SCN-specific regions: Sequence locations=1-62,84-343,366-436
tcattctaccccgattcgtactaaattttcccaaacatgtaaaatgtgttgagtgttcatccaaatttttcaaccaaaattccccatttctcgcttctttacaattttatttctataccattattcgacttcaaacagagtttattaacgacatgccaggcaatgaaacaattcgaggccatttggaaaaacggaaggattggatccgacggacgagggaccatcaggaaaagtcggcggatatcaaaaagttgaagagaagcgcacgggaacggaaccccgacgaattccattttcatatgttgcggagtcaaatcggatttgatggaacacatcgcgacttagagacggaagaggaggagaaaagcgaagcgcaacgccttttgagcgatgtcagcgacattaatttcgtacaattcaaattgggcatggaacg

SEQ ID NO: 50479 - DNA, 705 bp, Heterodera glycines
  SCN-specific regions: Sequence locations=1-218,241-705
caaataagtgccaaatttaatgccaaatgttgtctcaaattgaggaccatctcttcctcagtttttggattgaatatgctcaaaagtatttgattgatgctaagattggccgtgttctcactgttgcacttgaccatattccccaaattcggcaccttcaaaatgtggagtaccgacacattcgaatggctgatgtcgagtcggaggagctgttggcgagtcagaagctgcaaaatgcattggattacgtcgaagactcagtgaacagaggaatcaacattgttgttcattgtcaatgtggcataagccgatcggcaacagttgtgatggcttatctgatgaggaaatacaaatggaatgttaacgattcgttttcttttgtgaaagcgcgacgttcatgcgttcagccaaatccgtctttcttacgacaattggaagttttccagaagttggactatcgttgtgacttgctaactctgcgcaactcgaagctgttcaaggaattcgaatgcatttccgaaaatccatccgaagtcagtcggtcaacttgtgacatttactcattaaatgaatcggcaaaactttctgttgggaggcgattttcgtgcaaaaaatgtcgctgcgatctcttctatgatttcaatattttatcacacaattttgttgttgccagcggccaaaatgaaagcgtaaagttggcaaaaa

SEQ ID NO: 50480 - DNA, 1195 bp, Heterodera glycines
  SCN-specific regions: Sequence locations=1-110,132-199,221-337,359 -1195
atattccgcccattttgggcttttaaaacacattcaatttcaaacggaagtgttaaatgtgcaacgggtggaggaatttgcacagaatggcaaatggacagtcacttatcggaagacggaggacgaggagcaaaaagtgatggacgacactttcgacggcgtcatgctttgcactggccatcactgctccgaacggtggccaaacccccctttccccgggcagtccgtcttccgtggccaagtcattcactcgcgcgcctttcacaccgcaaaaccattcgaagaccaaactgttgtggtggtgggcattggcaattccgggggcgatattgcggtggaactgagcaaagttgccaaaaaggtgtatttgtcgacccggaccggctcgtgggtgatcaacagtgtgtgggagaagggccaccccactgacgcggtactgctcaaccgattcgcatttgccctgcgggcgatcactccgcgcagcgtccaaaacagattgatagagcgcaagttgaaccttcgccttgaccacgaacggtacgggcttcgcccgtcgcatcgctttttggaggcgcacgtcacagtgaacgacgaactgcccaatcgaatcgcgagcggaacggtggtgataaagccgaacattcagaagttggcggagaaggacgtgacttttgacgatggtacgactgtgtacggtgtggatacagtaatcttcgccaccggctacaactttttctttcctcagctggagaatggcagattgatttctgtgcaggacaacaaaacacttttgtacaaattgatgtttccgcacgacttatcgcctaagaacactttggccatcattggcctcatccaacccaccggctccattatgcccatttcggaaatgcaggcgcggctgttttgtgcccaattggtcggtgacatttcactcccgcaaaaggcacagatggaagccgacgcattggcacaagcgcgaagaattagcaaggaatttgtgaacagaccacggcacacaattcaagtgcaatacgtggattacatggacgagttggccaagttggtcggctgcaagccgaaattagtcggacgcattttcactgatccatgcctggccaaagttctcctcttcaacggcctcgtgccgtaccaattccgattggatgggccccaccgatgggaaggggcgcga

SEQ ID NO: 50481 - DNA, 658 bp, Heterodera glycines
  SCN-specific regions: Sequence locations=1-196,218-658
gagaaaattcgtagatgggaaattactacagtccacctaaacgagtggggcagaaccctttcactcgttctggggcgccgccgcctaaattggtcattaggaaggacaaggatgtgccgatgcaccgagtcaatgacccgatgagctttgcagctgcatatggcggatgaacgcgttcggactgcgggactctcgaaggcggagagagagtggagagaaaaatgggttcatgaccagagtatgcatccggatgagcctatccatgtcgacgcggtccaccgccaactgaatccaatcagagtgctttatcgatggccaatggataagctttacaagcatttcttgcgaccaacttttgggaattactgggcaacgattatccgtgtctatgttcccaagttcttctggttctttatgacattcgaatttttctactacgtgtggaaatacgaatcgaagagttggcaaaaacgaattggcttttccactatcaatcgaccggatcgttatgtgcttgtcaaagaccacgatgaggagacgcttaagcttggcctgacagactacagccgatctgactattttgacaaggaattctaccagcgcattaaaacggccaacatcgacttcggccccccgaagaggccgtggtgatcgctgc

SEQ ID NO: 50482 - DNA, 472 bp, Heterodera glycines
  SCN-specific regions: Sequence locations=1-88,110-248,271-288,366 -416,438-472
ccaagtttgagcaaaaacaaatcataatgaaatacgtcgctgcttacatgttggcatcgctgggcggaaatggcgacccatcgcccaaggatttggaaaaaattcttgccgccggcggacttgaggtggacatggacaatgtgaacgccgtcatcaacgcagtgaaaggcaagtccattgacgaggttattacggcgggccaaaagaaattggccaccatgccaaccggtggaggcgctgcggcaccggcagcagctgcagcaacgggcgctgctgcgccggccgggaaggaggagaaggaggaaaagaaaaaggaggaagtgaaggaggagtcggacgacgacatgggcttcggactgttcgactgatcaacggacggacggaatgccaaagtggattgtgccgtcggaaaattctttctgttttttcttgttatcccctgtcaaaaaatcataaaattgtttttgttgaa

SEQ ID NO: 50483 - DNA, 883 bp, Heterodera glycines
  SCN-specific regions: Sequence locations=1-403,425-619,643-883
tttctcgcctaacgaagtgcgcgaaaaagcgagccaaatgatcggctaccatttggtcaccaaacagacgacggccgagggccgactgtgccaggccgtgttggtctccaagcgactgttcacgcgcaaggagtactacttcagcatcactttggaccgttccaccgccggtcccattttgatcggctcctccaagggcggagtcaacattgaggaggttgccgccactgatccggatgcgatcatcaccattccgatcaatattaacacgggcgttacactgcagatcgccgaagacatggccactcggatgggcttccatgacgaatgccgtgcacaggcggccgacaccattcagcgattgtacgacctgttcatcaaaagtgacggtaacttggtcgaaatcaaccccatggtggaggacgcggaaggcaatgtggtgtgcatggactgcaaattcgttgtcgacccgaacgccgagtttcgccaaaaggagctgttcaaactgaaggacagcagccaggaggacgagctggaggtgcgcgcccagaaggccaacctgaactacattcgactggacggcaacatcggatgcatggtgaatggtgccggtttggcgatggccaccatggacatcatcaaattgcacggcggcgaacccgcaaattttttggacgttggtggcggcgcaacagttgaacaggtgtacgaggcgttcaaaatcatcactgcggacgagaagaaggtcaatgccattctggtgaacattttcggtggcattatgcgctgcgatgtgatcgcccaaggcattatcaaagcggcggtcgtccgagttggacttgaagattccgattgtgtgccgtctgcaggggacgcgcgtgga

SEQ ID NO: 50484 - DNA, 660 bp, Heterodera glycines
  SCN-specific regions: Sequence locations=1-64,94-660
ccacggccaatttcctgacttgatgagaatcttcaactgcctcgggaccccgccggagaagaaatacctgttcctgggcgactacgtggaccgtggcgcgcaatccgtggagaccatcatgctgctgctttgctacaaggtcaaatatccgacatcgattgtgctgctgagagggaaccacgagacgagcaacatcaacgcaacgtacggcttcaaaaaggaactggaggaacgctatccggcccattcgcaagccctgttcgacagcttcaatgacaccttcgcgtggatgccgctgaccgggctaatcggccaaaaaattttatgcatgcatggaggcatcagcaacaaaattcgaagcattgaacagctcaagcaattggaacgcccgatgctgctaccgccgaccgatagtctgcacattgaccttatgtgggccgacccgatggaagcgcaaggacaacgaccgaatccacgaggcgcaggtgtcctgttcggcgaagatgtggttatcagaacttgccagctgctgaagatttcgtgcatcatccgagcgcaccaattcatccaatccggatttgagccaatgttcaaccaacgactcatcaccgttttctctgcacccgcctacacaggccaaacaaacacgggcgcggtact

SEQ ID NO: 50485 - DNA, 734 bp, Heterodera glycines
  SCN-specific regions: Sequence locations=1-734
gaaccaatgcacaaccaattccttccgcttgcgactgcgttgtcgtccatccgtcagtaccattcgccttccgtttatggcaaatcggatgaactgttgcagctgcgcattgagctgaacatgaccaccgaaaaagcgaccaaattcgtgtcagattcgcgtcaattggttgtccttccgcatccttttcaacactctgaaaagcgtaccattttggcatttgccggcaccaaagaagcgcaacaggaagtgatgctaaacggagcggacattgcaattgggccggaaatggtcaaaaagattctcaagggtcagttcaacatggacgactacgacttttgcattgcccacacggacatggccaagcacattctgccacttcgcggtgttatcaaaacgcgatttccgactaaaatcaacggaggaattggcgatgatctcaacgaaattttggaaagctttttgtccggaataaatttgaccgtaagaagggaccctaccaacaaggaatggggcctaagtgagcctttgatcggaagattgagcatgtccgatgagcaaattgaggagaacgtggcggtcattgttgacactctgtgcaaaatgcgcaaagccgtgcttggcccgttcatcaaccgcgcctctctgatcacagcctctgccggccctcaacagtcgtttttccctgtcgacgtgagcccttgggaagcgttgccgacggaagaggaaattga

SEQ ID NO: 50486 - DNA, 476 bp, Heterodera glycines
  SCN-specific regions: Sequence locations=1-80,102-476
attaatatgattggtgcgacttggataaagaatttaaaaatcactgtgcagggccgtgagatttatgactctaactcactttatgcttataaagcatacttggatgccgaactttcttattccaaaaacgtaaaggagtcagacctacaggcgagcgggtattatgtggacagtgagaatcaggacggcacggatattactcagcagggttttgaactgagaagaaaattgttttcacaaagtcaaactgcacaatttattacaaaattggatgcagatatttttaatcaggacagatatatggtgaatggagttgagattgatatacaacttacccctaatgacaatgagtttatggtaatggcagcggccgacgataaatatagaatagaaattaccgcttgtaaattatatgttaaaactcttgaagttgttgatggtcttgcattagacatacagaaaaaacttgaaagcaa

SEQ ID NO: 50487 - DNA, 490 bp, Heterodera glycines
  SCN-specific regions: Sequence locations=1-105,128-490
atttggaccaaatgggcgagtcgacttgggccatcaggagttccaagtcgtggtcgaccatttcgcggtacggccaataccaagcggagtcctttcgccattctctgaaagaggaaacggaaaaactgcgccaggccaaccccaaattgttccaacagcaaacgcccagcacttctgacacgccacccgtcgactgtgcttcgccagcaccgtcgaagaagcgcaaaacggccgcttcaatggccgcggggagcggaacgccgacgagcagaggccgcgtggaggagagcagcccgtacaaaatcatcaaattcggcaccaacattgacctgagtgacgagcgaaaattctatgtccaactgaaggaattgaacaaattgcccgccttttgtcgcctccattccgccagtaatatgctcagttatctcggccacaccgtttttgggatgaacactgtccaattgtatttgaaagtgcccggctgcagaac

SEQ ID NO: 50488 - DNA, 523 bp, Heterodera glycines
  SCN-specific regions: Sequence locations=1-523
aataccatcacggcccggctgattttaaaattccagtttcctcattatcaactgtgcttctattgatttacgtacctttttatgatggacgaggacatggaagaagtcgaaattgtttttgctcagcgattggccagcggtgaaccaacggcacgacaaagggccatgaaacacttgcgaacgcacataagagaaaggacgaaaactgatgcaaagggcttttcctctgtttcgttagcgcgactttgcaaagggttgcattatgcgctttggatgcaggacaaaatgactttgcaggaggaacttgcggatgaaatctgcgctctttgcaactattttcgcaccgacgagcaactgcttgaatttgtcgttgttctgttcactacgctttctaaggaatggccgtacatcgaccggtggcgaatggacaaatttctcatgttggtccgtcgtttggttcgcactttgttccgtcgattgtcctcccaccgctgggacccgccattgtgtgaccaatttttgc

SEQ ID NO: 50489 - DNA, 658 bp, Heterodera glycines
  SCN-specific regions: Sequence locations=1-658
attaaaatactagtttttattttttgaataatggacgatgatgacgcaatcggtggtgctgaggcattcaaatgggaacaagcttacacggaagggctgaacattcgttcggtgctccaagaggacgaacatggctccgtcgaggagtccatccgtcggttggtcatggacgagaagcgacagcgacggatggaccgactgccggccaaaatccgactcggaatgatgcgttatgtccatttggctgtcgattgttcctccgccattctctccgccgatttctttccctcgcgtctctccgtcgcgttggaatgtcttcgtaaattcgtcgacaaattcttcctgcttaatcccctctcccaaatgggactcatcgctgtgcgcgacaaacgcgccgagcgcatcagcggatttaccagttctgtccaatttctgctcgaatctctgcaggacatcagttccaccaattgtggtggtgaattctctctccaatctgtcctccaatgcgctcttcactctttccagggtttgcccgcccattccagcaaagagtgcattcttttgattgcccagtttaagttccgtcgatgcgtcccctctccgccacactttcgagcagctcaaaatgcgttccgtccgctgctccatcgtttcattt

SEQ ID NO: 50490 - DNA, 417 bp, Heterodera glycines
  SCN-specific regions: Sequence locations=1-103,127-417
atttaattattcttcccggttatttttagtaatccaatttttaaaattgtataagctttttaagatggcccgtcgctatgatactcgtacgacaatcttctctccagaaggccgtctctaccaagttgaatatgcaatggaagcaattggtcaggctgggacttgtcttggaattcgagctcccgatggcattttcattgctgcacaaaaactaacggcaaacaaattgcttgatgatcgagtgttaaatacaagtcatttgaagcagatcattgcaacagttgctttaaaattttactgaaatccaagcgggaggcgcctttttagtttacagaattttttgtcacaataagtcaaaatttattttcggtaattccgtggtctctttatcaccttccattatttttgaacgaaatt

SEQ ID NO: 50491 - DNA, 754 bp, Heterodera glycines
  SCN-specific regions: Sequence locations=1-66,92-183,225-641,663-754
cacaatttgctgtcccattgtttcccgatgctgtgaagaagcaatgcttgaaggaattgaaacagcgatatgaaaataaagaaattaaaagtccgccggaaaattttgaagaatgggttctgcaccattttggaccccaaattttggatgtgttcttcaatccgtactccaaaaaagtgtggacagtgaaaccgtcgaaaatgtctccaatttgggttggcactcgggtggcaaaattgccacaagaaaagctggaggaactgtgctcaatggatgccaatgtgttgaaaaatgccgattttggatggggcccaaatgcacaatttaatttcccaaaatacggtggcaccggcgccgtgtggaaaaatatgacggagaaattgccatcggaatggttcaaatataattcaaaggtccttcgcgttgaccatcgccaaaagtgtgtgcattacgtccaactgaatgccaatggtcagccgacgggcccaacaaagtcactgaaatacgacgcactgatcaactccagtcccatcgacgcgttcgtggcggacaacaaaatttgcgagatgccgttgttggagcacaacaaagtttttgttattggcgtcggattgaaactgccaatgactgagttttgcgagaaatacacttggctctactttcctgaccctgacgtgccgttctatcgtgtcacatttttcacggtatggtgaagtaactccggacaacaccaaattttggtccgttttgtgcg

SEQ ID NO: 50492 - DNA, 516 bp, Heterodera glycines
  misc_feature (273)..(273): n is a, c, g, or t
  SCN-specific regions: Sequence locations=1-12,34-46,97-192,225 -315,348-516
ttagaataaatacaaattattttaaaaatgcgtgaaattgttcatattcaagctggtcaatgtggaaatcagatcggttcgaagttctgggaagtgatttctgatgagcatggaattcaaccggacgggacttacaaaggcgaaacggacctccaacttgaacggattaatgtctactataacgaggcccatggtggcaagtacgtgccccgcgctgtgcttgtggacctcgagccgggcatttttttttcaatccgggccggaccttacggncagcttttccgtctcgacaacttcgtgttcggacaaagcggagcgggcaacaactgggccaagggccattacaccgagggagccgaattggtggacaacgtgttggacgttgtgctaaaggaggcggaggggtgcggccgtctgcaaggctttcaatgactcaccccctcgggagtagcaaacggaccgggaggggaactctgtttgttcgcgaaaacccgtgaagaataaccggaaccgata

SEQ ID NO: 50493 - DNA, 777 bp, Heterodera glycines
  SCN-specific regions: Sequence locations=1-85,109-513,536-777
cctcgctccgtccaaataagttttatttctgaaatgaaaacttcacctaagattaaaagcagaaaaactgcttcaacaaatgaagtgaaaaaggaatgccctgaaggcacagagaaccgcgaaaatgttgggacgtcgagcaggttaattgtgaagaatttgccgtgtggcaaaaagacgcgatgggacgaggccaaagttcgagcgcacttctccaaatttggcactttgacggacgttcggctgaaactcagcgaaaagaccggagcttgcaaatttgcctttgtcggcttttcatctgccgaacattgccaaaatgccatcaaagcgttggacggcgcgtacattggcggctcaaaacttacggtcgaagagtgtaaagcattgacaactgaccgaacggcgatcaccaaacaactttcgttgaacaaacgcaaaaaactgaggcaaaaaggcaaatgcgaagttgatgaggaggaggacaaagaagaagctgccgaagaggcggacgtcgactcactaattgaaaagcaaattttggacaccggacgacttttccttcgaaatttgccctttgtgtgctcggaagagcaaatacggcaacttttcgagccgtttggaccactcgccgagttggaatgtgtcgtggacaatgcgggcaaatgcaaagggtacgccctgtgcaccttcatcttcccggaacatgcggttgccgcgtggaaagcgttggacggcaccgtttttatgggccgaatgctgcacataatcgccggcgaa

SEQ ID NO: 50494 - DNA, 487 bp, Heterodera glycines
  SCN-specific regions: Sequence locations=1-145,167-487
cttccttggattgagttcaagaaatgtctttcctcaaagtgttcgcccgtcgtctctttttgcatgtcacttttcttcgggtaccaacgatgatgttttatttgaacgggtcaatcaaaaattggtcatcacgctgaacaggcccaaggcattgaatgctcttaactttccgatgattcgcaaaatttacccccagcttaggaattcttccttcgatttggcacttgtcaaaggtacgggtggcttagccttttgtgccggtggcgatgtcctcgctgtctcaaaatcctataaggcgaatgatccggaccgaatttttcagcaattttttctagaagaataccaactcaatcatttaattggatcactcagccgaccctacgttgccttcatcgatggcattacaatgggcgggggatgtggcctctcattgcacggggcttttcgtgtggctactgaacgaacaatattggctatgccagaaacg

SEQ ID NO: 50495 - DNA, 494 bp, Heterodera glycines
  SCN-specific regions: Sequence locations=1-494
catgatgatcgtgtgccagcatttacggaacttacgcttatcagacattcacccgactctgagaatattcaaatgcaattcgccgcgttttttatttacagcggccttggaagattgatgagaccagttaggaaccttttatttgatcaaatcgagcaaataggaatttttgaacaagtttacctttccattataattgaccccgaagaggcagaaccgggcgtaacaatgcaccaagaacttcatccctcgtctctgttctcattcgctggcaatttgattccttttcccgatcacaaccaatcgcctcgaaatgtgtatcaatgtcaaatgggaaaacagacaatgggggtcccagtccacgcttggcagacgcgtacggacaacaaaatgtacaaattgcaaactgcgcaaaaacctttactcaaattggaggcccatgacaaatacgaaatggacgaataccctctaggcacaaatgcgtgtgtggccgt

SEQ ID NO: 50496 - DNA, 894 bp, Heterodera glycines
  SCN-specific regions: Sequence locations=1-13,35-349,371-593,617-894
tccatacatctcaaactcaaaaattttcttcgtttttctactgcttctcgtcaatataattgcttatgagctcaatccatacaatactttgggaattcgtcggacagccagtcaaaaagacattaaagatgcttataagaaattagccttgcaatggcatccagacaaaaacaagaatcccgagtccaatcagcggtttatggatgtcaatcaagcttataaaattttgtcgaaccctcagagaagaaaggcttatgatactttcggcttcacagatgagcaatttgaaggcatgcgaaaggaattctttcgcgaacaacagcagcatcagtttcagtttgtcagatggccccaacctccaaggaaaaaacaaacggatatttctcaatttttgttgccattcggaagtgtgcttggaacactatttttcattttcgtcgttgggtacttccttaaccatatgaatgtttcggagcaatcgaagagacggagacagccacaaaaccgcgcagaagaagctaatgaaatgggaggaggagacacgaaaacagaggacaatgaaaaagagcttgctgaggaccaaaaggcaccattgactgaggaggagcggcagcagaagttgcaagcgcgggtttggcgagtgatgggtccgatgattcgggaattgcgagctgaaactcagttcgggctgatacggctgctgaagccgggctgtcgttcgatcatcgtcctcgtggacaaggacagtaaggacaaactgctccagcagtttgcccgtcacctgtactgcttgagaaacaacaagactttctcattcggtttcctaatggtgccgaagaatctcagctggttccgttctttgctcgagctgactcttccagacgaacagcaaaa

SEQ ID NO: 50497 - DNA, 814 bp, Heterodera glycines
  SCN-specific regions: Sequence locations=1-230,252-748,770-814
attttctttaattagttagctaaaattctcaatggatgatttgttaaatgacatcgatgaagatcagcagcaaagcgaaagtgggagcagttcgcttccaccgcagtctgttaacacgatggcttggctggaacaaaacaaacagaaccaagcgcgggcattctccgagaatttgttgaaagatttgagcgctgtttcagagacgggcaaatctgctgaatttaacgtcaaagatgaaatggaaggtgaagcaggagacgaagaggagaatcagttcattcagaattgtcagcggattcgttcttaccaagtggcttccgagaagaattgcaaccacgaggcaatcgtcccctttgacgttgaatatcaacagctaaagaagaccaacaccccggcaaagctttacgagttcaaactcgacatgttccaaagccaggcactcaaatgcctggacaatcaacagtctgtgctggtctcggctcacacatcggccgggaaaactgttgttgccctctacgcaattgccatggcattgcgggacaaacagcgagtgatttacacgtccccaatcaaagcattgagcaaccaaaagtaccgtgaacttgttgaagagttcgaagacgttggccttgtcaccggggatgtgacactgaacccaaatgcatcatgtgttgtgatgaccaccgaaatactgcgttcaatgctttaccgaggctgtgaaattgtgagagaagtcggctgggtgatctttgatgagattcattacatgcgcgacaaagaacgtggcgtcgtctgggaagaaactctcatttta

SEQ ID NO: 50498 - DNA, 1443 bp, Heterodera glycines
  SCN-specific regions: Sequence locations=1-89,112-121,146-206,229 -1235,1262-1443
gagattgattggaataaccggctgcccttcgtcggtcgctgctgcgactcattccttcgcattttccgctgtttgtgcgttttccgtgccttttctgtttccccccttttcgactgccgcaaaaacaacaaattaataaataattaaaacgaaacgaattttaatgggacaactgctggtcgcttttcggggagcagccaatggcaacagaaacaacgacaaccaaaatgcagcaacaaatccatcggcagggcttagacgactgttcgttctgctcagtgcttttttgccgttcggacagcaaacagcgaataatttggagcaacggaacgacaataatcagcagggagagtcagcagaaatgggccaattccgtgccgggttcggcaggcgccgccggcgccatgcgccggctcctcccgatttgtcgggcagcggcgaggcgggcggtcacggcagtccgtgcggtgccaacggcggcggctcatttttcggctcgcactttctgatgggcggtgagctgtacgactcatcaaagccggaagtctttttgtttggcgaccagcaggacttggagctgttgggcagcaaatcagtgaagttccctttctcggccaaaggcgtcaccgattcgatcggtgttctgaacgcgttggtcaatgtgcgcaaggactccgtcaaattcacaaaagttggccgtgccggcggcggttattcctccggcttttaccgtttggaattcgtcttcgactgcgacgtgtcctgctttgtccaaattcacttctgtgcccgggaacaaattgacgaacagcagccacaacttctccagattgtctctcgtcagccccaatttgaacactccgaacgtttccatttccccgtgggcgccaaccaacacttcagccatttcaccttcaaaccgcaccgatacgacatgaaaatgatgcattgggacggcggcccagttttcccggtggtcatcgaaattcgatcggtgtccgaccaattccctgaacaggtccaaaccacgctttgcagcatcgaacggtccaatgatcagtcggcggtgctaattctgaagccaatgaagcagaaactgttctcggacggtgtcctatttttgctgcaagaaattttcggcattgagaacaaagagatggagacggcgccgccggcgttggcggatgaaaacggcgccgaatgcatcatttgcatggccaactcgagggacacaatgattttgccgtgccgtcatttgtgcatttgcaatggttgtgccgaaacactgcgatataagctgaataattgcccaatttgccgttcgccgtttaaagcactgctaaaaatcaaagcgatgcgcaattcactggtgggcaaaggggtcggctctgacgggagtatgaccacggcacggattcgtcatgagccggtgactctgattga

SEQ ID NO: 50499 - DNA, 809 bp, Heterodera glycines
  SCN-specific regions: Sequence locations=1-360,382-666,696-809
acgctctcttcgtcggacgtcggtggtggcaatcgcagtagtaacagcgagcactcctcagccgacaacactaaccgaggaaagaaagcggcaaaggtggtggtgaacaagaggagggaagtgaaggaatttgtgttggtcggaggaggtggtgacgtgaaggaggcagaagtggccgccggaacggtaacacttccggaaggagcagcaggggtgggaagagtggacgacccgaggcgggaaaacagcaaccgaatggttgccgcctgtgttgcgaccccctccgtcactgttaccgccaccgccgccacttatttcaatcacaatcagacggggtttgccggcactctcggaggtggtggtggttccaaaaaagggatggaggcgaacagtaacccatccaaagcctcgaaaggagtgaccatgaccaccgcagaggtggaccagctcaggcaacagctgcaatcggtggttgaaaatggagatctcactgcttcgaatgtgtgtgttgaacagttggaaagtgcggtgttaagcaaggatacactcgaggcaactcgtatcggccgttttgtgaacgacgtgcggaagcagactgcccagcaatggcccgacttctccaaacgttgtcgtgcgctgataaagcaatggcagaaggtggcagagtacaggcccagctcctcctgcgaaggctcttccaatggcggcactcctcagcttgtctcgccggctttgaagcgcgggctgacaccacgggcgggggccgtgacgacgcccggcaaacgcacaacaccacatcaaccgcaaca

SEQ ID NO: 50500 - DNA, 643 bp, Heterodera glycines
  SCN-specific regions: Sequence locations=1-643
aaactccttaaaagaaaagcagcagaagaattaccaaacggaagagcagagaaatgccgtcccaaggagaactcaaagaaatcttcaacctttacgatgaggaattggagggcaaaatcgacgccacgcaaattggcgacgtggcacgcgcgtgtgggctgaagccgaccaatgcgatggtttggaaagcggcgggcgaagaatacaaacgcaagggcgagaagaaattggcattcgaagaatggctgcccatcttcgaacagttgcagaaggagaaggaagtgggcacttacgccgacttcgtcgagggtctgaaagtgttcgacaaagacgagagtggcaaaatcatggcagccgagctcaggcacgtgctgctggcgctgggcgaacggctgagcgcggaggaagcggacgaacttttgctgggcgcccaggacggcgagggaatgatcaattacgaccagttcatcaaaaaggtgttggccgggccctaccccgaggattgaaagacgcaacgcaaattagacaaaacacaaaatgagagatgggaaaagtccacccgaatgacgaaagagatgatacaactgttttctcgccccatttccaaattggcaattgctccaataaaaggcgttcaattttc

SEQ ID NO: 50501 - DNA, 645 bp, Heterodera glycines
  SCN-specific regions: Sequence locations=1-95,117-222,246-645
atgtcgggcggttgtcctcttgcgggcggtgctagcgttaatgggtgtcctatgtcgaatggcggcgaccaaattgacccatcgaatgccatgccaccaccaaatcagaagccagcccctgatcagcccttcgttctttcaacaaaccgtcaaaagtcaaccattccaaaagcgaaagtgatggtcgatggccaattggaaacttgggaatatccttcggctcagatgttttggaatgcaatgcttaagaaggggtggcgttggcgcgacgatcagttggaccagcgcgacatggacaacatcatcagaatacacaatgctaacaacgaattggcttggcaagaagtgcttaaatgggaacactccttgcatcctgagtgcgatatgccgaagctgaaaagctttcatggagacgcaaaaaatttgtcgcctcgagcgcgcttccgttcatggcttggttatcaattgccgttcgacagacacaattggctggtcgaccgatgcggacgcgaagttccttatatcatcgattattacgacgtcggacatgtgaaccccgaaacgaaattgtttgcccatttggacggtcgaccggcaattcgcgatgccagcacaatgtgggaccgaatggttgtgggatattgg

SEQ ID NO: 50502 - DNA, 487 bp, Heterodera glycines
  SCN-specific regions: Sequence locations=1-487
ataagaacaaaaaatccattgactgacgattaaatgttctcaacagatgcgcaagatatactcggtggtggtggtagtggatcccaattggccaagaaaagtgggttaccaacgatgaagttgaccaatttggacaaaaagaaaaaaatcacaacaaatggacagccaaaacggcctgtcggaatgcatcgggaactgtacaatctcttcgttcaccagggcaaggacaataacaaagaaaagatcgaatcgttgatgccaacacagacaaagaagggattttctctcgcaaaagcgcagctgggtaaacgtcctgtcagaaaatggctttggtgtccatttgagaatgaggcgagaaaggatggacttgcgcttaagcattgggaacgtgaggacaaacattcaacgccctactcctttgtgcagttcaataagcaacttgatgtgccttcttttacggatgaggaatatgaagaacatttggtgg

SEQ ID NO: 50503 - DNA, 681 bp, Heterodera glycines
  SCN-specific regions: Sequence locations=1-659
aatgggtcagaaattagctgttagtcttgacgattattttcatcctgagacggcacctcgaattgacagaccaccgacgtttgatcctttgtatggttttccaaagggtcgcaagccaagagaaatgcaggcttcgtgggaagaattgttcgttttttttacataaacaactgactaaatggctctacacaagtttacgcaaactggtgatggtaattggttggacgcaaaaactgcactagagcccactaaactataaaataaatttatattctttagggagaaaatgaaaatgccgattagtgagcgagattattgtgcccataaaatggttgctttgcgcaaatgcgtttgggatagggcgccatttgcctcgcattattgccatggacgtcgacacgatttgggactgtgtctttatgatgatcatttgatgcgtatgaaagaatttgagcgggagaaaaggctccttatgagaaaggcaagaaaggaaagggcaaaggctgcttaagaaactaatgttgatttgctagacaattgtatctttgtggcctctgattaggaatatttccatgtttatgtgtaaaatcattgcttaattgaaactttggctcgctcatgaacttgggaattaaatccaattagttttttaatgattcaatgatttttaatttctttgag

SEQ ID NO: 50504 - DNA, 594 bp, Heterodera glycines
  SCN-specific regions: Sequence locations=1-135,177-246,268-289,448 -468,518-561,583-594
gtcgacgacagcacacacagccgaaaagcgcttcttctcatcgccttcgccttcaaaacttagaagcaccaatcccaaccagaaaaaatgtgcgacgaagaagttgctgctctcgtggtggacaatgggtccggaatgtgcaaggccggtttcgcgggcgatgacgcgccccgcgcggtgtttccgtccattgtgggccgcccccgtcatcagggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgcgtgtcgcccccgaggagcacccggtgctgctcacagaggccccgctgaacccgaaggccaacagagaaaagatggcccaaatcatgtgcgagacgttcaacacgccgggcatgtacgtgggcatccagggcctgctgtccctgtaaccctcccggcgcaaccacagtctcatgatggactaccgcgatgccgccgcccccccgcggccgtttacgaagggg

SEQ ID NO: 50505 - DNA, 623 bp, Heterodera glycines
  SCN-specific regions: Sequence locations=1-8,45-488,512-572,594-623
caacgaagttgttgcctggcctttttcttcgctcttctgcattttgtgcaccaattgcttgcagtcggatggcaaagtcggacgtgccggcgctgagcacgacgaatcagccctacccgtacaaggaacagactccgaagggtattttcgagaagatgggcttgcagaaaacgccggacggcacttcaatcggcgaattcgcagttatgcgtatggacgacatgatgaacttgatcgggcgtggctctctttggccattgaccttcggtttggcgtgctgtgctgttgaaatgatgcatttcgccgctcctcgttatgacatgatgcggtttggcgttgtttttcgtgcaactcctcgtcagtgcgacttgatcatcgtctctggcacagtcacaaacaaaatggcaccggcactgagacggatctacgaccaaatgccgcatccaaaatgggtgatcagcatgggctcgtgtgccaacggtggcggttattaccattattcctattcggtgttgcgcggctgtgaccgggtcatccctgtcgacatatatgtgcaaggttgtcctccgtctgccgaggcgttgctctacggcgtgcttcagttgcagaagaaaattaagcgg

SEQ ID NO: 50506 - DNA, 1070 bp, Heterodera glycines
  SCN-specific regions: Sequence locations=1-1070
atggcccacctcatccaggacggttttgtcgtcaatgacgcaacatggaaactaggcattttcatcaccgatatgaacatatcgcgagagttattcgttcgcggtgacatgaccatcggtagtctgatgatgcagttggtggggcaaattggcgagactcaggactggagtgaccattacatgtggtggcctgaccgccgtaagtggctgaaacacacgcgaagcacgttggaccaaattggaatcactgcagcgacttacttggaatttacaccgatgcataagcatgccaaggtccaactccccgatttgcagattatcgatgcccgactcgatttttccgtgcccattttgaaggtcacccaaaaaatctgccaagaacttgccatccgtcacccggaagaactgtcgctgaagcgtgatattccgccagatattttgcgaaaaggcgcatctgtcgaatcggaggctcagattcagccatacatgaagccgggcgaggagtccattggacccggcactctccgaacggccaaacccatccgcgcttcaactgtcaacctcactagcgggcgaggctcacctgcactttcgcaggcatctgcaatgggccccggtcacttgtttaacgcttctgaaattggcacactgccgaagatgggaacgattccgcgcggaatgagccccgggtcagccgcatatcgcgaagtgcttggacgaacaccggagcccggttactctgaaggaggcggtctcgaatgtgaccagttcgacgaaaatttgataaactcaccgaaaataactccgggtcgtgaaacattcagaccccaaaattatttggagaaagccgcgttgaaccggggatggttggactcatcgaggtcgctgatggaacaaggcatttgcgaaggcgatgttgtgcttcttcgttttaaattcatgcagtttttcgacatgaatccattaagaaagtgctgcagatgcaagcaggaagggcagcggcagcgcaaaacggtgcacaaaacaagaagaaatcgcaaccggtgcagctgcccacggatttcaattcg

SEQ ID NO: 50507 - DNA, 664 bp, Heterodera glycines
  SCN-specific regions: Sequence locations=122-122,341-345,380-385,528 -612,655-664
agcgtgagatcgtccgtgacatcaaggagaagttgtgctacgtggcactcgacttcgagcaggaaatggccactgccgcctcctcctcctcgctggagaagagctacgaactgcccgacggccaagtgatcaccgtcggcaacgagcgcttccgttgcccagaggcgctgttccagccgtccttcatcggcatggagtcggccggcatccacgagtccacctacaactcgatcatgaagtgcgacatcgacatccgtaaggacctgtacgccaacaatgtgctgtccggcggcaccaccatgtacccgggcattgctgaccgcatgcagaaggagatgaccgcgctggccccgtccaccatgaagatcaaaatcatcgctcccccggagcgcaagtactccgtctggatcggcggctccatcctcgcctccctgtccaccttccaacagatgtggatcagcaagcaggagtacgacgagtcgggcccgtccattgtccaccgcaagtgcttctgagcagcagctgcacgaccgcacggaggaggaggagaagaccaacgaagccgggacactcgccatccgccgacccattcgccaccccccaccaccatctgttttttgctgaaaattatgcaaaaatatttttgaataaaatctatgaacaa

SEQ ID NO: 50508 - DNA, 653 bp, Heterodera glycines
  SCN-specific regions: Sequence locations=1-48,70-653
gtttgaggtaaaatttgtgcgtaaacacagagccaacaacatgggatctcgcagtgtcgctggtggtgttggtgcttcgattatgaacaaacaagccagcaaatacaacgagagtgagggtgagctgttgctcaactggatcaagcaggtcaccggtgccacaatgacggtgaacggaacgcgcgaaaacttccaagcacaactgaaggacggcacattgttatgcaaggtggcactgaagctggaaccaaactcgatcaaaggggtgacggacaaggccagctccacgttccagcagatgagcaacttggagctgtttatcgaattctgtcgcaagcagggagtcatcacgcatgagttgttccgcgccgtggacctggtcgaggcgcgggacctctactcggtgtgcatgacgctcaactcgttgggccgaattatgcaaaagaagggcaaatcccacccgaagcacgtgtcggcatccgaaattgtgaacatcccctccacggatgcgcttcgtctttgatcagtgatcaaacattgaaaatggggtgggtatgcggcaccaaatttttgcagtgatcggagttattggctcataaagatgtgtgttccgtttattggcagttctgtgaataaatttggcactttgaaaa

SEQ ID NO: 50509 - DNA, 420 bp, Heterodera glycines
  SCN-specific regions: Sequence locations=1-420
gttcaatattcctatcatttcctcggatcgtttgccaaaactgcgcaatgttctcgccggtgtcttctccattcaaaacacttacaaatataacgacaattatccgttggacggtgaaggaaatacaaaaggcttttgctttttggagtaccaaacaaaggaggcggccaacgcagttttggccatttgcgatggacatcgccttgacaaaaaccacacattttcagcgtatccattcaccgctattcgaagcatgaaggagccggaaaaggactggaagaaaccggagagacaaccttatgtcgatttgggtgacccatggtcttggctgcaaaaccccaagtgtttggatcagttcggtctcctctatgaatcgggccagggtggcactctccgtttggatgtgttttggaacgtcag

SEQ ID NO: 50510 - DNA, 550 bp, Heterodera glycines
  SCN-specific regions: Sequence locations=1-478,503-550
tggagctccccgcggtggcggccgctctcgaactagtggatcccccgggctgcaggaactcggcacgaggctaatattcaattttttgaattaacataattcttttggaatggctcctgcaccagaaaaggaaaaaactgaagataagaaactgaaagacgggcaaaaaccaaatgtgaccacggatcacgcacactgtttgagcaatgtccaaccaaatcttcccgtcaataaagtggtggtgcatccgctcgttctgcttagtgtggtcgaccacttcaaccgcgtgaacaaaacgcacaaagtcaatcgagtggtcggtgttttgcttggttgtatgaagcacgacaaaacccttgacatcgcaaattgttttgctgtgccttatgacgaggactccgagaattcgaacattttctttcttgatgctgattttctggaggacatgtttgggatgttttacaaagtcgcggcacgtgaaagaattgtcggatggtatcactctgggccgcgtctttgcaagaatgacattctgatcaacgaagtcatc

SEQ ID NO: 50511 - DNA, 609 bp, Heterodera glycines
  SCN-specific regions: Sequence locations=1-347,370-379,401-609
ggcaacagcacatcatttagctaaaactcatcaacacacagaacacctgcaagaaatggtcatcaaatccaattcggtcatttcacgttcgcattctgatcattttcaagaagcttctggttcattgtcagcaacttccggttccgaagatgcaattaagcactggggttggtggaggcattttgtcgcaggtgccactgctggttgtgtcagccgatcagtgacggcaccgctcgaccggctaaaagttttccttcaggttaacgccaaccataagactccacacactttgccatccgcagtcgattatttgtatcgcgaaggtgggtttctgtctttctggagaggcaatggcatcaacattctgaaaatagcacaggaatctgctatcaagtttatgttttatgaacaggtgagctcttcaatatttgttctttaatttttggatttagaaaagcaagagttccaaaaattaacggggcatcgcgatctcgacatttttgagcggttcatggcaggggcttctgctggtgttatcgcccaaacggccatttacccgttagaagtgctgaagacgagattggctcttcgaagaacaggcgaactcaa

SEQ ID NO: 50512 - DNA, 509 bp, Heterodera glycines
  SCN-specific regions: Sequence locations=1-74,116-119,152-158,181 -275,335-347,419-509
ctattgctttctttcaatcaaatctctcaacaatgtctgaacaatccggggaaacctttgcgtttcaagcggagattgcgcagttgatgtccctgatcatcaacaccttctactcgaacaaggaaatcttcctccgtgagctgatctccaactcctctgacgctcttgacaagatccgttaccaggcgctgaccgacccgtctcagatggagagtgggaaagagctcttcatcaaaatcgtgcctaacaaagccgataagacattgaccatcatcgacactggcattggcatgaccaaagctgacctcgtcaacaaccttggcaccattgccaaatccgggacaaaagcgttcatggaggctcttcaggctggtgcagatatttcgatgattggccagttcggtgttggattttattcgggtttccttgggggcgagcgtggtcgcgtcacgtcgaagcggcatgacgagcgattgtgggcgtgggaggagatcagcgtgggggggccg

SEQ ID NO: 50513 - DNA, 487 bp, Heterodera glycines
  SCN-specific regions: Sequence locations=1-62,84-487
gaataaccatcatccaactgtaaatggaaatggctttggcttgaccaatgggacacatttcgctgatgaattttctgagtccattaaagacgttggtattattggcatcgaactttactttccaaaatcctacgtgaaccaagaagaccttgaaaaatttgacaatgttacatcaaataaatacgtgctgggacttggccaacaagaaatgtgcttttgccatgataatgaagatgtttgttcactttcgctgactgttgcagctgcactgatggacaattacaaagtcaatccaaaggacattggctttctcgcggttggtaccgaaacttggttcgacaaaacaaaaggggaaagccgtggttatggaattgtttgccgattccggcaactggacttggaaggcccccgacgaaaaaaccccgggttcggggggacccaagcgttggttattgccccccaatgggtgggacccgaattacccaac

SEQ ID NO: 50514 - DNA, 1225 bp, Heterodera glycines
  SCN-specific regions: Sequence locations=1-12,38-187,209-661,683 -826,854-1225
ccaagtttgaggtttattatttataaatttataaaatgcaaaatcaacagaatatggacaattcagcaaggtcaattttcgttggcaatatttcttacgatgtgagcgaagacgaattgcggaagcttctctcagcatgtggtcaaattgttagctttcgccttgtccatgaccgcgagacggggcgccccaaagggtttggtttttgtgaatttgccgatgtgcctcaagcggaggcagcaattctttatttcaatgggttcgagtttcggggacgtccacttcgtgtcgactcggctacgggcaatgatcggagtgctgatgagatgcaacacttccaaatgactttgactcgtccgcaaaatcccaccgacgaattgagtccttatgggcccgaattggagccgggaaaagcaccggaagtaattgcccgcacagtcgcgtcaatgcctcccgaaaaaatgttcgaattgatgcgatccatgaaggaaacggtgaacaacaatccgcaaatggcgcgccaacttttgatggaaaatccgcagctgtcgtatgcattgctgcaggctcaagttgtgatgcgagtggtggacccgaagattgcctaccaaatgcttcatcgtgaacatgctcagccgcttgtaccgccgacttccatccccactcatatccctcaacaatttgctggcaaaccccctcaattgcctccccaattcaacatacctccgccctccgtcccctctcatcagtttcaaatgcaacctcctccattggtgccaggccaatttcaccacggatttccatccatgggcatggctccgccttcgctactgcaacagcagcagcaacagacgccttttacacaacaaaagccgacacccatcgctcctttggcagtgcctccggcagcgaccgctccgcaacagcagcaggctgttagtccgcctccgcttagccaacaagcacagcaaagtaacagcgacaatttggacgaggagcagcaggcgcaaatgcttatccgcgtgctgcaactcaccgatgagcaaattcgtatgttaccaccaactgagaagtgcggatgcaaatgcgtgaccatatcaaatcgcactgacagaggtcgaaaagccaactgatctcttctttctccatcaacctatttttatataatgtttgatttttttgttgttgaaaatcaagatttaatgaaaaaatttttactaggaaa

SEQ ID NO: 50515 - DNA, 538 bp, Heterodera glycines
  SCN-specific regions: Sequence locations=1-538
gagccatggatggatggattaacaacttcaccagcagatgaacgcgttggaattcaaaaaatgaatcactctgttatttcctcgtgtttcacaataaattctgtgtgtgtctacgcttttttctactgttttttcaactattttggttttggagtgtaccgatacatacgaatcaatttttgtacattttttaatatttttttttgcaaattttaatcgctgtttattgactcttttttttggctaatttactggcaaatcaacaaaaaattaggcaatcgaccgctaccatgacgacgacagaaacgccgacggcaccgcgcttggaccacaccacgggctggacctgtttggcgtgcaaattggtgttctccagcgggcaattgcagcgggaccattaccgcagtgaatggcacctgtacaacatgaagcggcaggtgggccaatttttggattggtgatccacccaatactgattgagagcgtgcaaaaaattgcccggtactttcaaaatcccggtaatccttcagaattggtg

SEQ ID NO: 50516 - DNA, 667 bp, Heterodera glycines
  SCN-specific regions: Sequence locations=1-86,128-197,219-241,575-667
tttcatttcatttcgtattcattaattagccgataaaaatgtgcgacgaagaagttgctgctctcgtggtggacaatgggtccggaatgtgcaaggccggtttcgcgggcgatgacgcgccccgcgcggtgtttccgtccattgtgggccgcccccgtcatcagggcgtcatggtcggcatgggacagaaggactcgtacgtgggagacgaggcgcagctccaagcgtggtattctgacgctgaagtacccgattgagcacggcatcgtcaccaactgggacgacatggagaagatctggcaccacaccttctacaacgagctgcgtgtcgcccccgaggagcacccggtgctgctcacagaggccccgctgaacccgaaggccaacagagaaaagatgacccaaatcatgttcgagacgttcaacacgccgggccatgtacgtggccatccaggccgtgctgtccctgtacgcctccggccgtaccaccggtctcgtgttggactccggcgatggtgtcacccacaccgtgcccatctacgagggttacgccctgccccacaccatcctccgttttggacttggtgcggcgtgacctcgctgactaccggatgtaaaatcttattgagggcggggttcctccttcgagacaaccgccgaagcagaa

SEQ ID NO: 50517 - DNA, 257 bp, Heterodera glycines
  SCN-specific regions: Sequence locations=1-257
tggtgtttattccaatggttatgatggttccttaaattcttgccaccgttttcccctttttcacacagtgatcatagccaatcactttacgagaaaagatccgaatcaatccgattccctgactgacgaggacattaagccatccccgaattggcaaaacttccgcaatagctccacaatttttttgcggggcccgcccacatttttgggcccggccaaatggaaacaggcaattgtttttttttttttcggcgggg

SEQ ID NO: 50518 - DNA, 1124 bp, Heterodera glycines
  SCN-specific regions: Sequence locations=1-189,211-571,608-1124
ggaaggcgaccgccgcccgatcggtttcgactggtctatctgatcgtgcttctccatggaatgggcatgttgctgccgtggaacactttcattacgatcgcaggggattattatttgcaattcaaattcgctaatgtgagcaatgaagacaattacaaagtgtacttcttcaattatctgacggtttgtgcccaaattcccaatttgctgctaacttttctgaatttatttggcgtcataagaggcggcttttaccgtcgcatttacttcactttggccgtcatttttggcatatgtctcgtcacaattgcgatgggactttcggctttttcctcttcacaatgctttccgttgtgcttctgaatagcgccagtggtgtttatcaaaacagtatttggggattgttcgctgattttcccggggaattcgccggtgccattattattggcaacaatttgtgcgggattctgatggcagtgctagacatcctcatcattgtgttggtcggtgccaatgccgcactcgccgccacagtttacttcggtctcgctctgtttaccgtcgtcctttgcattttttctttccattttcttcaaaaattgaatttctacaattactatgtccaaaaagcggcgaaagcgcgcgcgaacaatggaacgaatattctgcacgaggaggaaacgggcgaagcgaaggccaatataaaagtgacgcatccgccgctaaaaacatacatcgcaattttctctgaggtccgtcgccagttgctcgatgtttggcttgtcttttttgtcactttggctctgtttccgaccgttttgttgaaagtgtctttaattagtccgttcaacgaccagaaaacttccgaatcgctctacaagcagctgacagttttcctcaatttcaatgtttgggccgctgtcggctgttggctgtccggcttttccccgaggccttcccccgattatttgtccctgccgatttgcctccgtctgctctttcttccgttgttttgggtttgcgattaccaatatgaccatttgactccgcgtcgcttcgtgttcatccacaacccatgggtgttcactgttctgatcactcttatggcactcagtcacggctat

SEQ ID NO: 50519 - DNA, 223 bp, Heterodera glycines
  SCN-specific regions: Sequence locations=1-30,57-71,120-128,171-223
ccaatccctaacaaaaaaaagatattcaccgcgtcacggatgacattctccaagaacaccttcagcactgagcgagtctcctcgtagatcaggccggaaatgcgcttgacgcccccacgacgagccaaacggcggatggccggcttggtgatgccctggatgttgtcacggagcacctgagaaaatgtggagaccaattagaccttgaaaacacgctttaaac

SEQ ID NO: 50520 - DNA, 666 bp, Heterodera glycines
  SCN-specific regions: Sequence locations=1-217,397-483,505-666
ccttatcctcgaaaattcctttctggactaaactctgccccttctccaaacaacagccggaacagcagcagtcttcccccgtcgcagaagacacaattccgccccagcaacaaaaagaaggtgccgcaatgtctgccgaaggaaacgacgcaccgccagccgcagagcaaccgccaccagccgaagcagcaccagctgaagcggtccctgtccaggaggcggcggcaccgccagtagaagcggcggccgaaactgcaccagcggaagcagcgcaaccggtagaggaggcggcaccgcctgctgaggcgcccgttgaagcggcaccagcggaagcagcgccaccgatagaggaggcggcaccgcctgctgaggcgcccgttgaagcggcaccagcggaagcagcgccaccgatagaggaggcggcaccgcctgctgaggcgcccgttgaaccggcaccaccagtggaagagccaaaggcagcagagcctgaggcacccgtttcggaagctgttccagcggcagaagcgccagtggaagaagctgttgctgcccccattgaagtcgcgcccgcagaggcagagcccgtctctgccccgccagctgaagcagtaccagccgaagaagcgccggctgctgaggtcgcccagctgagtttggaggaacaag

SEQ ID NO: 50521 - DNA, 714 bp, Heterodera glycines
  SCN-specific regions: Sequence locations=1-474,496-714
taatttctttggcattcggacaaaagcgaacagatctccgcctagccccaactgatcatgaccgaacgaccttgtcgttgaaaatgcagcgcgacaaattgcgccaagcgtatcaacggtacgagcgcaacatcgccaaggacgcggagagagcgcgggcactgctcagagacggacgcaaagaccgagcattgttactgttgaaaaggaagcgcttccaggagacgatgatcaatcggatcggtttttttttggagcaggtggagcggacgatcaccgacatggaaatggcacagatcaacagggaagtgttcgacaaccttcggcttggcaccgaggcattgaaggcactgaacgagacaatttctttggacgaagttgaacgtttaatggaggagagcaaagaggcgcaagagtttcaggaggaattgtccaccatgttgggccaacaaatgtcggaggaggacaacgacatggtggaggaagagttcgagcgaatgctctccgaacaaatgccggcagtgccaacagagcaaccgacggacacaaaagagggacggaaaacagcggacgaagagaggacaaaggaggagaaggagccaaaacgacggagggagggggtggcgcaggaggcgacctaaaggcgtcggcacttcaaattggtgccatcgacgggtcggacaaatgccaaagacagtggccatcggctgcttt

SEQ ID NO: 50522 - DNA, 542 bp, Heterodera glycines
  SCN-specific regions: Sequence locations=1-542
gctccccgcggtggcggccgctttcgaactagtggatcccccgggctgcatgtactcggcacgaggtggcgcaagagccgcccttacaaattgtgattcccagattggatgatgataaaccgttggtgcgtcgaccgacgcctcaggcacaaccggcggctccagcggtgccggctgaactgcgcgtgtccaatcgggaggaggacgcgcagaacatcgaaccgtcaatgagtggcaaacaaatagtcgggttgatcattccaccgcccgacattcgaacaattgtggacaaaacggcgcttttcgtggctcgcaacggattggaatttgagatgaaaatcaaagagcgcgaggcttccaacatgcgtttcaactttctcaaccctaccgacccatattttgcctactatcgcaacaaggtcaatgaatttgagacgggcgttgcatcggcggacactcagtccaaagtgaagttgccggaggctgtccgtgagcatgtgcagcgggccgaatttattccgcggctgccgcccaaaccgttc

SEQ ID NO: 50523 - DNA, 478 bp, Heterodera glycines
  SCN-specific regions: Sequence locations=1-478
cagatcatggcgcaagagccgcccttgcaaattgtgattcccagattggatgatgataaaccgttggtgcgtcgaccgacgcctcaggcacaaccggcggctccagcggtgccggctgaactacgcgtgtccaatcgggaggaggacgcgcagaacatcgaaccgtcaatgagtggcaaacaaatagtcgggttgatcattccaccgcccgatattcgaacaattgtggacaaaacggcgctttttgtggctcgcaacggattggaatttgagatgaaaatcaaagagcgcgaggcttccaacatgcgtttcaactttctcaaccctaccgacccatactttgcctactatcgcaacaaggtcaatgaatttgagacgggcgttgcttcggcggacactcagtccaaagtgaagttgccggaggctgtccgtgagcatgtgcagcgggccgaatttattccgcggctgccgcccaaac

SEQ ID NO: 50524 - DNA, 816 bp, Heterodera glycines
  SCN-specific regions: Sequence locations=1-816
cctctactctgtttgctgctgatcgtccgcttttcctccccttcagcttaaacactcaaacccctctcccccccccccccgcctccattctccgctgactgatctgtccgcccccgcacttcttttgcccgtttcttccgccgttacacactcatctcacatagtcccacaaaacatttcaccaacaaaagcagcagaagaattaccaaacggaagagcagagaaatgccgtcccaaggagaactcaaagaaatcttcaacctttacgatgaggaattggagggcaaaatcgacgccacgcaaattggcgacgtggcacgcgcgtgtgggctgaagccgaccaatgcgatggtttggaaagcggcgggcgaagaatacaaacgcaagggcgagaagaaattggcattcgaagaatggctgcccatcttcgaacagttgcagaaggagaaggaagtgggcacttacgccgacttcgtcgagggtctgaaagtgttcgacaaagacgagagtggcaaaatcatggcagccgagctcaggcacgtgctgctggcgctgggcgaacggctgagcgcggaggaagcggacgaacttttgctgggcgcccaggacggcgagggaatgatcaattacgaccgtaagcgattattaatgaaattaaccgtgtcgagagtcccgacaaatgaccgttcccccttggtatttcagagttcatcaaaaaggtgttggccgggccctaccccgaggattgaaagacgcaacgcaaattagacaaaacacaaaatgagagatgggaaaagtccacccgaatgacgaaag

SEQ ID NO: 50525 - DNA, 966 bp, Heterodera glycines
  SCN-specific regions: Sequence locations=1-334,356-916,949-966
ctccattgaagctcgccgttggcttaatgcgactgtggttggttcttaaaacttaccaacaagtctaccatagtaatgcattaagtgttctttggttgaatttgatgacggaaataacccaaaatccaacaccatagtgccgttgatcgatggtggaacagagggattcaaaggaaattcacgtgtgattattcctttcatgacgccgtgtattcagtgcacgatagatctttacactccccaggtcaactttccgttgtgtacaattgctcacacacctcggcttcctgagcattgtgtggaatatgtaaaagttgtgctttgggaaaaggagaagccttttgggcaaggtgaaaatggtaaataactccatcaccattttccatttccatagacgttaaattggatgctgatgaccctgctcatgtcgaatgggctttccgtgctgctcaacaacgcgcgaatgagtatgaaataaaggatgtcgatttgcgactcacccaaggcgtgctcaaacgtataatcccggcagtggcttcaaccaatgccatcatagcgggaagctgtgctcttgaggcattgaaactggcatcaaagtatctgtttcaacgttgttgcattggaacgtgatcccgaatgtttggtctgcggtcagaaatctgtccaaatgtattccgtgcgcgaggactgtacactctcaggctttttagatgacttgaaagacaaataccaacttcagaatccttccattcgagcgggtagcactttcctgtatgaaatcaacactcttatgccagaaatggagacagcaagtcggaagaatttgtgtaagacgctcaaggaacttcatgtcaccgaggatagcgaactgcttgtagcggatgaagcattaacgagatctattgtttttcggatcaaatattccaaataaattttattcgaatgtccgataaatatctctgaagg

SEQ ID NO: 50526 - DNA, 365 bp, Heterodera glycines
  misc_feature (56)..(56): n is a, c, g, or t
  misc_feature (90)..(90): n is a, c, g, or t
  misc_feature (93)..(93): n is a, c, g, or t
  misc_feature (147)..(147): n is a, c, g, or t
  SCN-specific regions: Sequence locations=1-321,352-365
acagcacacacagccgaaaagcgcttcttctcatcgccttcgccttcaaaacttanaagcaccaatcccaaccagaaaaaatgtgcgacnaanaagttgctgctctcgtggtggacaatgggtccggaatgtgcaaggccggtttcncgggcgatgacgccccccccgcggtgtttccttcattgtgggccccccccctcttcaagccttcatgctcgcatggaaacaaaggactctatttggtaaccagggccaatcaaccgggttttcctacccttaattccccttttaacccggtttcccccccctgggacacattggaaaaaatttggccaccctcttttaaaaaaattttttttcccccc

SEQ ID NO: 50527 - DNA, 670 bp, Heterodera glycines
  SCN-specific regions: Sequence locations=1-40,62-670
ctcaaacaaaaatattcacaaatgacatcttcggacgaagaatttaaaaaagaatgcacttttgcctcacttccgcgcactgtgcgtggaatgcctttggttgtttcgtcgaattcggatggaaccaaattcctttactgcaatggaaatagcgtgttcatcagagacgaggaaaatattgccgattgtgatgtgtatacggagcacgcgactttgacaaccgtggcaaaatattccccctctgagttttacattgccagtggagaccaatcgggcaaaatccgtttttgggacaccacacaatcaacgcatattctgaagtcggagttcgctcttctttcgggcgcaattcgcgacatttcgtggtctgaggacagcaaaagagtcgcaatagtcggcgaaggccatgaaaggtttggccatgtcttcctctttgacacgggtacgagcaacggcaatttgtcgggacaaagtcggccgatgaatagcattgattttcgtccgacacggccttatcgtttggtcagtggttcggaggataacactgtcgccattttcgaaggccctcctttcaaattcaaatcgatttttcatgaacattcgcgttttgtccaatcagtgcgttacaacaaagacgggtccctttttgcggcaggcggaatggatggga

SEQ ID NO: 50528 - DNA, 624 bp, Heterodera glycines
  SCN-specific regions: Sequence locations=1-377,402-502,540-624
atagctcatctcactgatattttggttttctctctctatctcaaccaacaacaacaacaactcaatgtctgacaatcgtggtgcctccgttgcttcgaccggtacgaccaacagtcaggagtctcaagtggcgtctccagtgaaagccggaaaagctactacgaagacgacggctagcggaaagggcggcaaagcgaaggcggacggaaaagtgaaggcgggcggaaaaggggcgaagaaggcgggcggaaagggtggtatttgtgaagattgctgcgagcggaacgtacagcacgcgctctgctcgtgctggcgttgcatttcccgtcggacgtatccatcgtttgctgcgccacggtcgccatgctcagcgcattggggccggagcgcctgtctatatggcatcgggtgttggaatacctggcggccgaaatgctcgagctgaccggcaacgcggcgacggagaacaaaaagttgcgaatcaacccgcgccatttgcaattggctgtgcgcaacgacgaggagttgaacaagcttctctcggaggtcaccatttctcgtggcggtgtgttgcccaacattcacacggaacttttgtccaagatgcaacagaacaagcagcag

SEQ ID NO: 50529 - DNA, 808 bp, Heterodera glycines
  SCN-specific regions: Sequence locations=1-372,395-665,687-808
gtttgagtgatagtatccttattttataaactcaaatttgctgaagtatcatgggagttccagcctttttccgttggctttcacgaaagtatgtgtcgatcattgttgacgcggtggaacagcgcagaagagaaattgacggagtaaaaatcccaatagatgcaactcaaccaaatgagaattaccaagagtttgacaatctttacttggacatgaacggcattatccatccgtgcacacatccggaagaccgacccgcaccgaagaccgaggaagaaatgttcattttgatcttcgagtatattgaccgcctcttttccatcgttcggccaagaaaacttctctacatggcagttgatggggtcgcccccagagcaaagatgaaccaacagcgaagtcgtcgatttcgagcagcacaagaagcggcggagaagcgcgagctcatcgaaaatgtgcgtaagcggttggagtcggaaggaattccgttgccgccaccgcgaaaggaagaggaacactttgactccaattgcataacacccggcacgccgtttatggcccgtctttctgttgcccttcgctattacgtgcacaaacggatcacctacgacccggcatggcaaaagatccaggttattctttccgatgcgaatgtgccgggtgagggcgaacataaaatcatggactacgtccgacgtcagcgcgcttcgccggcgcatgacccgaacaccgttcactgtctttgtggcgccgatgccgaccttatcatgcttggattggccacccacgagtccaatttcaacataattcg

SEQ ID NO: 50530 - DNA, 281 bp, Heterodera glycines
  SCN-specific regions: Sequence locations=1-281
agaaactcagctgttgcaccagccattcatgctcaatcctgaacagactgtcaacgaatatttggaagaacatggggcaaatattgcggatttcttgcgcattgagatgggccaagaacacaccaagacaaatgacctcgtcacacggtcgaaaggatttagttttctcggctattaaattacgccaattccctggcaatctcgttaatgagcacacgtcggcgttccccagttagaatcactcaagaaatggcgtaattttaatcaagaaaagacagtat

SEQ ID NO: 50531 - DNA, 786 bp, Heterodera glycines
  SCN-specific regions: Sequence locations=1-146,169-459,481-786
tttggcctccgacgaaacggcctatctgattgcggacacctattaccgaacacacaaatatttgtccgccctctccctgtccattccctgtgtcagttacaaatggatccaacagtgtgtggccgagaaacaattgaccgaccatcggccctttttgttgccagctggcgagtcttcattggataccaagcaacaattcgaatggagaccactaaagggcgtgctgatgaagggaaagcgtgtgctgatttggtcgagctccgccgagacggaccctggcattgtcagttttgccgaaatttggacaccgatcctgcaaaatttgggcgcaacattagtcggcattggtcctggtgaaccatttgcctccaaatcgagcgctaaccttgaggaaaagatggaattctgttccaaaattgagcctcccgttgatgtgctgctggcggagactggactgccaggccgaggtggccaagctggtcgaggaacggggcggtttggccgtgtccagcgaatgggtcattcaggccatcgtcactggttcgctgcccgacctgggcgagcccggaggcgagaagttccgctacgattttgtttagtgttggctgaatgaacatccacagttttggtggtgaatgacggcggcaatggactttgactctacttgaacacacctaacaatatcataaaccattcgcttttttggaactacacccggaaacttttctctttttgttgcagaattatctgccctatttaattattattttattgtcccactgacat

SEQ ID NO: 50532 - DNA, 575 bp, Heterodera glycines
  SCN-specific regions: Sequence locations=1-243,266-307,330-575
ttggcgcgcgaccgaaagtatcgcattccggtggcgcttaagattctcttcaaatctcagctggtcaaagggaatgtggagcaccaattggtccgtgagatagaaattcatgcccacctcagacacccgaacattttgcggatgttcaactattttcacgacgataagaaagtgtacctcatattggagtacgctcttcatggcgaattgttcaaagttttgcaaaaaagtcgtcggttctctgagtcaacttctgcccagtacatctttcaagtgtccgatgcgctcaattattgtcactcaaaaaaggtcatccatcgtgacatcaaacccgagaatattttgctttgtgccgatggtaaaattcggattgccgactttggttgggctgtccacgccaaaaataggcgtcagacaatgtgcggcacacttgattacttgccacctgaaatggtcttgaaacgacaacacgatgaaaaggtttgacgtccttttcggcagtgacggtcccagaatttagggaatattcctttttggatggactctgaaatttgtttcatttaatttgaattttt

SEQ ID NO: 50533 - DNA, 570 bp, Heterodera glycines
  SCN-specific regions: Sequence locations=1-5,33-166,188-570
ctccgtgacgaattcggcacgagggtccaattaagatagaaatggcaacgcggaagttgagttttcctgagaaaattgccaatattcttggagttatttatcgctatcatgaaccgcgacttccacgttacaaagacattctgaagaaagtgtgtgtccgagaattggctcctccaactccaaaggattggcctcagatcaaagcggattatgccaaattggacacagtgatgagaacgcaggcctacagacagtttaagttgaaggaatttctcgtttattcggctgttttcgtggaagtgctctgttggtttttcgtcggagagatcattggacggggcagtctcaccggatacatcgtccgcagttctttcgttgacccgaaggccgcaaagaaaatggcgcactttaaatgggacgatcatcatgaactcaaagtggagaacgacgaagagcaaagcgggcactgatcggcgttcgatagatgatgcatatttctgtattgtaatgcttaggaactcgactcgaaagaaaattgttaattagacaataaaaacgatgctttcaaaa

SEQ ID NO: 50534 - DNA, 855 bp, Heterodera glycines
  SCN-specific regions: Sequence locations=1-668,690-855
aaagctggagctccccgcggtggcggccgctctacaactagtggatcccccgggctgcaggtatccggcacgaggtacgtggagaccgccgatcggttggtggaaattgcgcggaacgaattgccaaatgcgaggttacccgccttccaagtggcacaagcggtcgatgtgctcacgttgggctcctacccgcggctgccacaaaatatcaaagaccgttttattccgccacttccgttgggtgcggccgaacggcgcctgacattgcgccaactgaataagttgattgaattccatttggcacaacaagcggcgcaactgtctccacgaattcgacacattactgtacaaaacggaatggcatgtctggtggtccccggagaatttgaaatggagctgactcggctgggcgatgagccgaccacccggtggacccttctgaacatccgaattctcgtggaaagtgccgaagtcggagagggacagcaaatggtccatccgctgcaaatcaatttcctccatcaaatggtgcaggaaaaactcgacacagcaaacgaacccattatggcggcttacattgttttgcattggttctgtcgctctctccatttggacattcttttttgtcaggctctccaaattgcgaaaataaaccgaagcggcaaagggagtgagggctcctcgcagcaatacatccgagtggacgagtacaatgagaaggagtgccgtttggcgatcagttattggctgaggagagagggcggcaccattcacggaaggctgtcgtctcattaccgaatgctcatttttggagacaaaaacaattcccatgtcggactgaaaattcgtcaccat

SEQ ID NO: 50535 - DNA, 530 bp, Heterodera glycines
  SCN-specific regions: Sequence locations=1-530
aatgcgttgatttatttgggacgaaggatctgtaccaaattttgaaattggacaggagcaaaagcaacttgagcagtgcacaaatcaaaaaggcctattatcgccagtcaattctgtggcatcccgacagatttgcatcggcacagcatgacgaaacgacgcgcgagttggccaagcagaaattccaagtgatcggcagagcatatgcaattttgggggatagtgagaagcgcaaagcgtacgacgaaacgggttcgctcgacgatgagaacgaattttacgaaggcaaagattggtcggccgtgtggcgaggcgttttcaaaaaagtcactccggaagagatcgaagcgtacctggccaaattcagaggtccgtatggaaagaacaatagttcaaggatgaaaatgtataaatgaaactaccgcttctcgttaattggattgatttagagaaattagttttaaggattgtttaagcaattggtattatatggttcatatgggtttgtattaaattgaacttgtacaaaa

SEQ ID NO: 50536 - DNA, 660 bp, Heterodera glycines
  SCN-specific regions: Sequence locations=1-300,324-570,592-660
gtgaaaacggcgtttgcggatgtggcggggtgtgaagaggcgaaaatcgaaatcatggaatttgtcaactttctgaagaaccccgcacaatacaaagcactgggcgcaaaaattcccaagggtgctcttctgactggccctccgggcactggtaaaactcttctcgccaaagcaactgctggcgaagcaaatgtgccatttatcactgtgtccggttccgagtttttggagatgttcgtcggtgttgggcctagccgagttcgggacatgtttgaaatggcgcggaaaaaggcaccatgcattctgttcattgacgaaattgacgctgttggacggaaacggggcggaaagggcgccatgggaggccactccgagcaggagaacacactgaatcaattgctggtcgaaatggacgggttttcaactgatgaatcgaacgttgtggtcatcgctgccacaaaccgcgtggacattctcgaccccgcgttgatgcgtccgggccgatttgatcgacaaatattcatccccgttcccgacatcaaaggccgtgcttccatcttccgcgttcatttgacaccaatcaaaacaaccttggacaaaatcgagctttcccgcaaacttgctgcgcacacgcccggattttccggcgcagacattgcc

SEQ ID NO: 50537 - DNA, 621 bp, Heterodera glycines
  SCN-specific regions: Sequence locations=1-171,200-353,380-392,419 -521,551-551,593-593
cttaaaaaacaagacagcccgcgaccaatttccgaatcacaatttcattgtttatgctggacatgtcattccccgaaacgatgtctctgtttttcgcgatgaccctgcgtgaagtgatctctattcatgtgggacaagcgggcgtgcaaattggaaatgcttgttgggaattgtactgcttggaacatggcattcagcccgatggaaaaatgccatccgaccaaaacaaccaagacgattcgttcatcaccttcttctcggaaacaggcaatgggcgtcatgttccgcgtgcggtcatggtcgacttggagccaacagtgatcgacgagatccgcactgggacttacaagcatctcttccaccctgaacagctcatcactggaaaagaagacgcggccaacaactacgctagaggacattacacagtcggcaaagaaatcatcgaccccgtcttggatcggattcgtcgcatcgcggataactgcaccggacttcaaggctttctcatcttccattcgttcggtggtggcactggctctgggttcacatcgctgcttatggaacgtctctctgttgactatgggaagaagtctaagctcgagttctccatctaccctgctc

SEQ ID NO: 50538 - DNA, 500 bp, Heterodera glycines
  SCN-specific regions: Sequence locations=1-101,124-407,429-452,474-500
acgagggatcagttcaatgttagcctctgtgatcaacgaccgcttcaaccggcacagccaatacgcccctttcttttctttggaattttaccctccgctgaaagaacaccccaaaaatttggcggacttcttcgaaatgttggatcatctgaagcaggcgcagcctctgtttgtggacatcacttggtcaagacgaaatgacccgggaaatttggccaaattgaattcttcgtcggccattgccattgccaccgcggccattttcggcaaagaacgcacaatgctgcatatctgctgcaatgatcacacgaggactgagtcgattagtcatgtgaagcaaacattgagccatggcattgcgaatattatggcactgaggggggacgacatgccaacggagcaaacgcttctcaccaaaaacacaaaacacttcgccatcgatttggtcaaatggactcgagaattggaagagaccgacggatattttggcaatgatcggc

SEQ ID NO: 50539 - DNA, 861 bp, Heterodera glycines
  SCN-specific regions: Sequence locations=1-861
caacggttcgccgccgtcggatgagtccgtcgtttattcatcctcaattgcttttcaaccgccgatgcaatggcaccaccgccggcaacagtcgacgaatacaccctgtcgcagtcacgctttccttccgttgcttcactggcgccgcccaccgttttgatgatgtccaccgctggtcaaacgcccgtccaccgcaggcgacactgtagcgccggctcaaacaatgcgcagcccaacaacagtcacgaagcaatctccagaatggacgtgttaagtgagcggatccgtgacttccattacaacgaggaccaaacgcacgcacagctcaatcgaaaattgcaattacgcgaccaactttattacgcaatttcaccgattttcccaatgtgcggactttacattgtcggctcgtcactgaacggattcgggacgaagcggtcggacttggacctttgtctgatgataaccaatcgcgatattgaccaacgcactgatgcggttgttgtcctgtcgtcggtgatgcggacattggagagcaatcaaattgtggccgagcagaatctgatcctggccaaagtgccgattctacgcatcaaatttatcggcactttccacgacataacggttgacctgaacgtcaacaactcggtggccattcggaacacgcatttgatgtgttactacagctcttttgactggcgtgtccggccgttggtgatggtggttaaagagtgggcaaagcgtcacggcatcaacgactcggcctgctcctccttcacatcgtactcgctggtgctgatggtcatccactatttgcagtgcggtgcacagccaccgcgtacgtgcggatgtgcgcacgct

SEQ ID NO: 50540 - DNA, 841 bp, Heterodera glycines
  SCN-specific regions: Sequence locations=1-280,302-307,329-841
ccaagctttagagagtaaaccaaacatggaaaatccgagtgattttaccctaggaggtgcattgcccacatcaagcacagacgattatttgaagctaaaacgtttggagaataaactagcaaacttggacgttatggaggagtatctgaagatggacatgcgaaatttggagaaggaattggtgcacgcacaggaagaagtgaagcgcattcaatccgttccgctaatcatcggccaattcctcgaagccgtcgattacgaccacgccatcgttggttccactactggctcgaattactacgtgcgtgtgctgtccattttggaccgtgaactgctgaaggccggctgcagcgtgtccttgcacaagtacagcaacgcgctggtcgacgtccttccgcccgagtccgactcgtccattcaaatgctgcgagcggacgaaaagccggacgttgtctactcagacatcggcgggctcgacacgcagaagcaggaagtgcgcgaggcggtggaattgccattgaccaatggcgagctttacgagcagatcggcattgaaccgccccggggagtgcttctctatgggccgcccgggttgtgggaaaacgatgttggcgaaggcagtcgcaaagcacacaaaggcatcattcatccgagtggtgggcagcgaattcgtgcagaaatatcttggcgaagggcctcgaatggttcgcgacgtgtttcggctagcaaaggagaacagtccatgtatcattttcatcgacgaaattgacgccattgcgacgaaacgatttgacgcgcaaacgggcgcggaccgggaagtccagcgcattttgttggagtt

SEQ ID NO: 50541 - DNA, 475 bp, Heterodera glycines
  SCN-specific regions: Sequence locations=1-3,25-243,265-475
aagaaatgaactatgataatggaattagcgatgatgatgatttggaaatggatgaaaatggaagcgatggcgtagaaattgtggattttgttgaagagccgcacaaggaagacaattccgccgcaaaaattgctgcgcattcgaaagatgtgttttgccttgccctttccccggatggccattggctcgcttcggggtcggaggatgaaactgcagccgtatgggacttgcggcacggaatgacttctcccctcctccaccgcacaatttcttcccattccgactctgtccatttgttggcatggaacgtttccgcaaatattctcgccagtgcggacatggccggtcgcataatttgcacaaaagtgacgggcgatgaagccacacaaacggcgtcacttacaatcgacgattgcttcgtcgaaccttcacggagagacgacgacaacggggaggacgaggaaggccaaggctc

SEQ ID NO: 50542 - DNA, 1475 bp, Heterodera glycines
  SCN-specific regions: Sequence locations=1-597,641-742,767-1132,1154 -1475
attacgctgaacaaccctttttaatcgaaagctttgacttgacatgactgatgcgaaaactgaccaaaaagataatgtgaagagtgaagttggagatgtgcccaatggcgggacgtcattcactgcacagcttagcgacgatttcactatccaatcgaatacgaatgaggtggtcgattcattcgacaacatgcaactcaaggacacattgctgcgtggcatttactcattcggttttgagaaaccatccgcaattcaacaacgtgcaattgttccatgttgttcagggcgtgatgtgatcgcgcaagcccaatctggaaccggaaaaacggcaactttctctatttccgttcttcaacgtgtcgatgagaatgcaccggatgttcaggcacttgtgatggcaccaactcgagagttggcccaacagattcttcttgttatgcgtgcacttggcgagtatatgggggtcaagtttcacacttgcatcggcgggacgagtgtgcgcgacgaccagcgcaaattggaggggagcgttcaagtgatcgttggaacaccgggacgagtcaatgacatgatcctgcgcggagcactcaagactgacaaaataaaaatgtttgtgcttgacgaggctgatgaaatgttgtctcgcgggttcaaagaccaaatttatgaagtttttaaaagcttgccgaacgatgtccaggttgttttgttgtccgcaacgatgcctaatgaagtgctcgacgtgaccaagaagttcatgcgcaaccccatccaaattctgattaagaaggaggaattgacgctcgaaggcattcgtcaattctacattttcgtcgacaaagaggaatggaagttcgagaccctttgcgacctctacgacaccgtaaacatcactcaggcggttattttcgctaacacgcgaagaaaagttgaggatttggcgcgaaatatgacgcagaagaaattcactgtgtctctcattcacggcgaaatggagcagcaggaccgcgacgtgattatgcgcgagttccgttccggctcttcccgcgtcctcatcaccaccgacctgctcgcccgtggcatcgatgttcagcaggtgtcagtcgtgataaactacgatttgccgggcaaccgtgagaattacatccatcgaatcggtcggtccggacgattcggtcgtaagggagtggccatcaactttgtgacgaaacaggaccagcaaatgttgaaggaaatcgagacatattattccacccaaatcgaagaaatgcctgccaacatcggggacatgatttgagcgttgacagggcaggatcgataaatgggaaagtgatttgggagttattatgtttggattaccacccacccgccctttcaaatcattcggtattaccattattatgttggtcccctttcggctcctggttataaatcgattgttgttttggagggatatgaataatatttggtat

SEQ ID NO: 50543 - DNA, 865 bp, Heterodera glycines
  SCN-specific regions: Sequence locations=1-61,83-385,407-865
ggacggggaccacgttgtgttcaccgactttgagcacgccgaactgaacgaacttccaccagtgccagtcactttgaagggaagtgagtgccaccactgaacatttgttggttcatctacagtcctcccatttttaggcaaagtcttcaacattggaaatgctctcgcggccttttctggcgcagttcaaggccccgtttcgcgtggacgtgttcagcaagtcaaagtgcccaagaaaatgtccttctattcattgtctctcgcactcgccgagcccgactttatgatttgggactttgccaagttcgacgaacctgcgcaacttcacgccctttggcaggctttgtacagttttgaggagatggttcgtcatcttgcgactttccatttgtttgggttttcctttcagaaaaactacagccctttgccccgttccgatgccgacgcaaaattgttaaaggaaatgctgccaaaagatgcgcccgaaatgccggactcactgctcttaaacttctcttaccaggtcccttttgtgccattttcaacttcgaattcctcccccgtcttaaggcgtgcggaaatctccaacccatcgcttcgctcatcggcggtttggtggcccaagaggcgatgaaggcagtgacgcaccacacgactcccctcaagcagtttctgtacaccgattctcttgaggcgttgccgggcgcagattcgacctttgacgccgccaagttggagaagaacgattgtgcaccggtgagtttttggacggacaactaattgctgttggagtattcaaaaactgtccatttgcagcgcaacaatcgctacgatggacaggcggccgttttcgggtgggcctttc

SEQ ID NO: 50544 - DNA, 481 bp, Heterodera glycines
  SCN-specific regions: Sequence locations=1-481
cgcgagtttatgtcggcagttaaaggacgacgtgagcaggacagaaaggaatgggcagcctattggaatattcgatggaaggaggtggagaattcattcgtcggcaaatactcttattacacaaaccgttttttggattggccggtcacttggttccgtgagaacattgtggagcggctgcacgacaagcacaagatgccgtattaccatcgcaaaatcagcagagtgcccgaaatcgacgaatgcggcgtcaacgaccgaatttgtctcttcgaagctgaagaacaattccgactggacaaattggtggaccattacattcgcgatattttgtaccaacgcttcactcagtgcgttcgcgccgaagggtacgaccatttgtacaaatgcgcaaagcacgttgacgactacgaaaatgccgagttgaacttctttatcaagtatggcgaattgggcagtgagcagactgtggtggcgtgtt

SEQ ID NO: 50545 - DNA, 500 bp, Heterodera glycines
  SCN-specific regions: Sequence locations=1-80,169-500
ccaggttgtctgtatggtcgatccatgtgaggacaaaagttggattcggcttcgttcaaagcctggccaatcagttcaggtcactcgcactttctccgtcttttttctctttattctcactcctcttctctctttctctctctctctaactcccctttctccttgtctaatgatatgtccttgccgtcgctttgtaagaccgattctgtccacgcttttgatcagcttcggcccggaagcgacaacccagaaacactgtcggaggcggtcaaagtgttaaaaggggaatatttggtgaaagcaatcgaagagcacaaaatggaccaagcgatcattttctgtcgaaccaaattggactgtgacaacatggagaagtttttggcgccacgcgggtacaaatgcgtttgtttgcacggcgaccgaagcgcggacgaacggacgcggaatttgctttcgattaaggaaaagatagtgcgctttctcatctgcacggacgtggc

SEQ ID NO: 50546 - DNA, 422 bp, Heterodera glycines
  SCN-specific regions: Sequence locations=1-375,397-422
tcttcggatgacttatgcggaggcaattgaatggcttctaaccaatgaagtgatgaacgaagaggggaaacccttccaattcggcgaggatatttccgaaggccctgagcgatttatgaccgacacaattggacaaccaattcttctcaatcgctttccgcatggaattaaggctttttatatgtcacgttgtgcagatcaaccggaattgaccgaatctgtggatttgctaatgccgggcgttggctagatagtcggaggatcgatgaggatttggaaggaggacgaactgcttggggccttccaaaaagccgacatcgatcccaagccatactactggtacgtggaccagcggaaatacggaggttgcccccacggaggttttggacttggtctggagcggttcgtatgctggttggcca

SEQ ID NO: 50547 - DNA, 479 bp, Heterodera glycines
  SCN-specific regions: Sequence locations=1-20,42-479
ggagaattcactgctttggacaagaaagtgataaacgccttattcttgacttggatgaccaacaagcggggccttcggagcaaaaagtcggcaggagagggcctggacggaagtcagcgaatccgacattggacaatcttctgggccatgcaaacttagaacatgcccgtgggcggacaaaggaggccatgacttttcttttcgaagtagtcaagctggccccttaccatgtgcagacatacaaagaactttcggatttgtactcggaattgggccaaaaagagaagagctttgaattcaaaatgttggctgctcttttaaactctaagacaacagccgaagaatgggatgaaatagccgggactgctaagtcgtttaaccggttggaattggctgtcgcatgtttggccaaagcgattcgatgtgaccccgagaattggctttactacgaaaaacgcatccaaattcttgatgcatcc

SEQ ID NO: 50548 - DNA, 434 bp, Heterodera glycines
  SCN-specific regions: Sequence locations=1-48,70-91,113-434
tgagcgcggcgtggccaaccgatggcgctcactgttcatcatcatcggggacaaggccaaggatcaggcggtcactttgcatcacattttggccaaggccaccaccggggggcgtccgtcggtgttatggtgctacaagaaggagacggagttcagctcgcacagaaagaaacgcatcaaagagttgaagaagcgcaaagagtcgggcctgttccagtcaaaggaggacaacctgttcgagcagttcatcctgtccactcaaattagctactgttactatgccgactcgcatcgcattctgggcaacacctttggcatggctgtgctgcaagactttgaggcacttacgcccaaccttttggcccgaactgtcgaaacggtggagggcggtggcctcgtcgtgctgctcatccaatcggtcacctcactgaaac

SEQ ID NO: 50549 - DNA, 420 bp, Heterodera glycines
  SCN-specific regions: Sequence locations=1-75,97-337,360-420
gtttgctgccgccacttgaaaatttggcgaacattgaggagactgtcgtgcgtgacaaagcggtggaatcgttgcaaaaaatagcagaaaaacacagtgcagctcaactcgaggaatatttcattccgatggttctgcgattgtcagctggtgattggtttacttcgcgcacctccgcttgcggattgttcagcgtggcatacgctcgtgccaatcctgctcaaaaaactgaattacgtgccgcattccggtgcctctgtcgcgacgatacaccgatggttcgccgtgctgccgcatccaaattgggcgactttgccaaagtgcaggaggaggactatttgaaaaatgaaatcacccaaatgtttgaggacttggccaaggacgaacaagactctgttcgactgctttcagttgaggctg

SEQ ID NO: 50550 - DNA, 706 bp, Heterodera glycines
  SCN-specific regions: Sequence locations=1-59,81-508,531-706
gtccgaaagtgtggtcattatcagcgaacgcaaagtggaaattgtgttgaagcaagtggccaaaattgggtggacaaacttctaaaggaacaaacgacgggattggcacaatcttcggactgtgagcagcagcaaaagcaaccgcagcagaaaatagacgatgagaaacaacaagaactactcatgtggaacggactgaacgaacctagcgaacgcttcacaacagaaaaagcgatgattccgctcaatttgcaaattgcagagtctgctctgaaggtcctccaaacaaaaacgcccgggggagaaattgagcaaagtgcgacggcgggagctcactgtacaaacaatacgtgcaaaaaagtgttcaccggtcccgagagcgatgccgaagagtgcgttttccacccgggcaatgccgtttttcacgaaggactcaaatactggtcgtgttgtgggcgcaaaaccaccgattttaccacatttttggaccaattgggttgcactcggggcaaacactgctggaaaaagaaagaaattgtcacaaatgcgcgcgaggattggtttcaacgaggtggccaagtgcacatcacaatttactgcaagggagcacttccgagcgaaacatccgccaaatcggacggtctgacattggaagtgaccatcaacgggtccaccaaacggtacgaactgttcggggaaattgcgc

SEQ ID NO: 50551 - DNA, 624 bp, Heterodera glycines
  SCN-specific regions: Sequence locations=1-475,497-624
gtcaattttgacatgagttcagaatcggacgaacagagtgccgatgttaacggactctgttcgcaatcgcttcgatcagatgaaaaagtgtgtcccgacccggacacaattaaaatgtttattggccaaattccgaaggcgtgggacgagttacaactgaaggaatactttgaggagttcggtccgatttatcagctgagtgtgctgcgggacaaagagacggcctccagccgtggctgttgcttcgtcacttattatcaccggaaggatgcgatcagtgcccaaaatgagcttcacaatgtgcgcactttccccggactcagtcacccgattcaaatgaaaccggcggatgtcgaaaacaaaaacgagcgcaaacttttcattggaatgcttcccaagtcaatggacgaagagagcgtccgggcgctgttcaaagagtttgggcaggtggaggactgcagcattctgcgagaggacggcaaaagcaaaggctgtgcttttttgactttggtttctcgttcctgtgcccaacaagcgattcgaaaaatgcaccattcgcagattttcgagggctgttccaaaccgttggtcgtcaaattccccgattcctgtcgagaaaaaacg

SEQ ID NO: 50552 - DNA, 590 bp, Heterodera glycines
  SCN-specific regions: Sequence locations=1-48,71-407,430-590
ttccttgttaacaaagcaatggcacacatccagtttggaccgcaacaacccgaggtggaggaggacctggtcaactgggacgaggtgccagatgatgagttggaggagactgcgttcgaacgttttgaggggctcaaggaaatgtttccgacaccggtgcgctctgtgttgtccaccactgtgcaattgacatgggtggtagcgcagaattcgttctcttttgcacgcagtgctgcttgggtgttgtcgaccagcgcgctgctcatggtgatgccgtacattgtggacaaggagttgcaagatgtggagaaggcacagttgaaacaacagcaacagttgctgctcggtggacggcccagctgaaatgattgattttgatcaaattggtcgatcagagagcgcaattttcttgatcagcactgattgatttcgatcactttttgttgcttttttccattttttgattgtttcgtttgttgtgttcacaacaattagagcgcctttgccccgtttaccctcaaatcgtcgccattatccgccgtttttctttgtttgaccaatttcttcaagctattgatacataaaatttt

SEQ ID NO: 50553 - DNA, 464 bp, Heterodera glycines
  SCN-specific regions: Sequence locations=1-464
caaaaataggcgtcagacaatgtgcggcacacttgattacttgccacctgaaatggtcttgaaacgacaacacgatgaataggtcgattattggtcagtgggcgttttatgctacgaatttttggtgggaaggccgccattcgaaactaaaactcaggaggagacgtacacacgcattatgaaggtgcaatactcattcccgagctttatgagtccggacgcgcgagatttaatttcgaagttgctggtcaaagagccgtcccgccgcttgagtttcgagcacgtgctgaaacaccattggatcatcgcccattgcaataagaacaacgacgccgactcgtccaccgcgtccagcgaatgttggtgattggagaagcgaacaaatgggggacagcactcactgcctttgattttatttccttatttctatccgatctcttttgtgaataaatggctgtaagcaa

SEQ ID NO: 50554 - DNA, 592 bp, Heterodera glycines
  SCN-specific regions: Sequence locations=1-592
tcaaacagcacagacgcgaatcgcaattgtaaacccggacagatgcaagccgaaaaattgtgggcagccgtgcaaaaagaattgtcccgtcgtccgcactggcaaacaatgcattgtggttgagccaacatcgaaaattgctgaaatttccgagatattgtgcatcggatgcggcatttgtgttaagaaatgcccttacggggccatccaaatcatcaatttgcccagcaatttggagcgcgagaccacccaccggtacagtgccaattcattcaaattgcaccgcctgcccacgccgcggctcggctcggtgctcggcctggtgggcaccaacggaattggcaaatcgaccgcgctcaacattttgtccaaccgactgaagccgaacttgggcagcttcaagagtccgcccgattggccctcaattttgcaatattttcgcggctctgagctccaaaattacttcaccaaactgctggagaacaaattcaaggcgatcacgaagccgcaatacgtcgaccaaatcccgaaattcctcgaaaaacaaccgctgaaaaaggttggcgaattgttggagaaacgggcgcagaaa

SEQ ID NO: 50555 - DNA, 635 bp, Heterodera glycines
  SCN-specific regions: Sequence locations=1-52,74-635
cgcaggaccaaggcagagatgatgtcgatgtgcgtgtgattgtccatcagtctcatgccggagcaattattggcaagcagggcagcaaaatcaaggagcttcgtgaactgatgcaagcacatatcaaagttttccaagaatgcgcaccccaatccacggatcgcgttgttctcataaccactcaacaatccaaaatgccggatgcaattaagcacctgatggagtttatgcgcgaggtgccaattaaagggccaaccaaaccatacgatccgagtagccacgaccctcgcattgtgcagtgttatgggggcttcagcggaccaatgccaccacctccaatgggtggtccaccgatgggaatgcatggaggcggaggaggttatgcaggttttggaccacgtggcggaccgcctatgcctggtggaatgggaatgcccggtggttttatgcaagaacaagtgaccacgactcaagtgaccattcccaacgagttgggcggcaccatcatcggcaaaggcggagatcgcattaatcggtagtcacccaaaataaattcaaattttgttattatgctgacacagaattcgggcggaatcgggtgctcgtattgagatcggaaatgcttatgggaacga

SEQ ID NO: 50556 - DNA, 646 bp, Heterodera glycines
  SCN-specific regions: Sequence locations=1-47,70-646
ccaagcgcacaacgacaatgaacacggcgacaaattgggagtcccctccccgcagcgtctcttctctcccaacacttcgttccacacggaactgcccgcggacggccccggcggcactcagtccaacgcggcgagtgaagcaggcggtgtcgctgccagtgaccaaaaccagcgacactttcacatgcgcatcaaaaaacgcattttccgcggagaattgatgagccgagaagttcgcgccagtggggtgctcgccattggcaaactgtgccttttggacgaacagttggccaagaagtgcatccccgtgtttgtgcgacaattgcgagaaaacccggaccattttgtgcgcaacaatatcgtcgttgtcatctgcgacctttgtattcgttacacttccgaagtcgaccggtacagcaccattctcgcctcgtgcctttgggacagttccattctcatacgccgccaaacgttgctgctgctcaccaatctgatcaaagaacagtacctcaaatgggaagggacggtcatttaccgttttgtgaccactcttttggacccggagcagtgcattgaagaatatgccaatttttgtttgacggacattttgttgccccaatttcgtgagcggatgttcttccatcac

SEQ ID NO: 50557 - DNA, 1081 bp, Heterodera glycines
  SCN-specific regions: Sequence locations=1-708,730-1081
atctttccagggagagtgccatttgctgccatcacaagtcgctccccaaacttcgtccctccgcctcacttattccgctttccatggcgtcggctccaaattcgtccgccgaatgttcgctgagtttggctttccctcggagaacatttcgtacgttaaggaacaagacaagcccgaccccgactttggcactgttccattccccaaccccgaggaagggcaccgggtcctcaaactgtgcattgagactgcaaatgccaatgactcgactttgctcctcgtcaatgacccggacgccgaccgactccaattggcggagaaagaggcaaacggagagtggcgcgtgttcagcggaaatgagatgggcattctgctgacgtggtgggcgtggaccaattggcgtgccgccaacccaacggcggactcttcgcgggtgttcgtcctccattcggccgtctcttcccaaatggtcgccacaatggccaaaaaggagggcttcaaagcggcgcattcgttgacgggcttcaaatacataggcaatttggcacacaaattgcggtcggaaggcaacaccgttattgccgcctgggaggagtccattgggtttactcccggcacaacgctggacaaagacggcgtttcttccgccgcggtctttgctgaaatggccaattggctgcgcacccaaaagggcgtttcgctgcgtgaacagctcttccgcctcttctccatctacggctttcacctccaacgcaattcgtattggggggtcaaatcgacggaagtgacgaagaaattatttgcggaccttcgctccgattatcccgaaacgattgggcagaatttcgatgtgaaatttgtgcgcgacttgacgacaggttatgacaacgctcaaccggatgacagggccattctgccgctgagcacctcctccgaaatggtgacgttcactttggtcgacggaagtgcggtgacactgcgggcgagcggaacggagccgaaagtgaaatattacatcgaactgcgcaccgaaccgggcaaagaagaaaaggatctgagttcggtgcttgagcagctcgac

SEQ ID NO: 50558 - DNA, 805 bp, Heterodera glycines
  SCN-specific regions: Sequence locations=1-427,449-473,495-805
acggactttgcagaagagcacacagattttgtacacgccggacattggaaccattctgctgctgttggacgtgaagccgggcgcacggatttgtgagaccggcacaggcagcggttctttgtctcacgccattgccaccgcagtggcaccggacggccatttgtattcatttgacatcgatgagaaacgtgccaaaactgttcataatgatctcaaactccacggtttgtcccaaaatgccactgtgctttgccgtgacgtgtcccagcatggctttgccgcaaccgattgtgcggagaaagagtggcgttgtgacggcgttttcctggacttgcccgccccgtggttggccattggccatgcccacaaagtgttgcttcaaaacgggcccgagcgccgtccgtctcggctggtcagcttttcgccatgcattgagcaggtgcagcgggtgtgtgccgagttggagcagcacggctttgtggacattgagacggttgaggtggtgccacgaaaactgaaggtggtcgacttgccctgcgaaagtttgtccgaatacgcagccaaaggagcgaacgcacagacattcttccagaaagaatctcagcacaacaacactgattgtgaacagcaacggcagaagggacgccggggtgccaagcgcaaggcggacaatgcgggggaaaagaccaaaatggaggaggacgcggacacatgccaaaatggactgaacggaaaagtcgctgctgccagtattgcgcaggaaagcgatggtcctcagaccgagactgatgccatgccattccct

SEQ ID NO: 50559 - DNA, 569 bp, Heterodera glycines
  SCN-specific regions: Sequence locations=1-72,110-110,142-142,168 -168,210-569
ccaagtttgagttgttgaatgcaataatcctaaaatgttccgcaaccaatacgatagcgacgttactgtgttcagcccgcagggccgtcttcaccaaattgattatgcagtcgaagcgatgagacagggcagtgcagcagtagcaattcgtagcaaagattatgctgttgtggtcgcacttatgcgtgcacaaaacgagctttcttcatatcagcagaaagttttcaaattggacgatcatctcggcttgtctatgtctgggcttatttcagatggacgcattttggcacgctttatgcaaagtgaatgcgccgagtttcgctggaactatcataatccaatttcggttgaactgctcaaccgtaaattaggcttgaaacttcagtccaatacccaatattacggacgccgcccatttggtgtgggactgctcatcattggatatgatgacaaagggcctcacgttgtgaaagccgaaccctcgggggacgtgtccgaaatgtttgctgcttcgattggcgctcggtcacaaagtgcgcgaacttatctcgaaaagaacctaccagaat

SEQ ID NO: 50560 - DNA, 613 bp, Heterodera glycines
  SCN-specific regions: Sequence locations=1-613
tgtgcacgaattgcactcgcgaattcccaaatattccgaattcggtgagcgtctccaaatgatcgttagttccgcaacacttcacaacatggtagtacaacggctggcgactcaggatatgtacttcccccaatggattgatctgaaagggcaggattcggatacggaaactgtacaccaggttgtctgtatggtcgatccatgtgaggacaaaagttggattcggcttcgttcaaagactggccaatcagttcataccgattctgtccacgcacgtgatcagcttcagaccggaagcgacaacccagaaacactgtcggaggcggtcaaagtgttaaaaggggaatatttggtgaaagcaatcgaagagcacaaaatggaccaagcgatcgttttctgtcgaaccaaattggactgtgacaacatggagaagtttttggcgccacgcgggtacaaatgcgtttgtttgcacggcgaccgaagcgcggacgaacggacgcggaatttgctttcgtttaaagagaacatagtgcgctttctcatctgcacggacgtggcggcacgaagactcgacatcctaggcgtgccctatgtggacaatgtgacattgcct

SEQ ID NO: 50561 - DNA, 578 bp, Heterodera glycines
  SCN-specific regions: Sequence locations=1-578
ctacaactagtggatcccccgggctgcattatctcagacgaggggtctccgcctcgttggacaagccgatgttgttgaagcgcaaggaggccaagacgtacggtaaaaagcagttgatcgaaggccgtttcgaggcgggccaaagcgcactgatcatcgaggacgtggtcacctccggtgccagcgtgttggagacggtggccgccctccgtgcggttgggctgcgctgtgtgcacgtcttttgcgtgttggaccgccagcagggcggtgagcagcgactgggccgggaggcggacattgttttacggagtttgctttccatgggttcgctgttggactttttggagcagtgcgggaccattgacgcgggcaaaaagacgcaaattgttcaccaacttcaaaacccgatctttgacgacagcgccacgcatttgcaggagcaaaaaacggagaaaaatgaagcagaatgcgtgccattggtggtgtcctcctccgtcgtgccgacgacgacatccgtcggttgggcccaacaatttgcggacggcacactgaaccggcggttggcacaaattatggtg

SEQ ID NO: 50562 - DNA, 458 bp, Heterodera glycines
  SCN-specific regions: Sequence locations=1-96,118-458
ttgagatgttttttggcgaagagattactaaaattccgcgggaagtcggcaaagaggacgtgtgtaaagcaatttctcatcaaattgaggccattgacatagatcagtgcaatttgaatatgtatttgaagcctgacacgggagtgatttcacttgaccaattccaagcgatgggttccaaaagattgacaatgctaaggaaactcgaaatgcttaaagaaaaatttggaaatgccaattcgcaggatgagtacaaaaaggcatttcgagaggacatcggtgctctgatgccattggtaaccaatttatgcgtaaatgccggactcaatgaagcaagaagagaggaccgcatttcgcattttatacttcgtcttgctttttgccatattccagaacaatccgattggtttgttcggttggaaaccgaactttttcgcatgcgctttcaaaacgagacg

SEQ ID NO: 50563 - DNA, 876 bp, Heterodera glycines
  SCN-specific regions: Sequence locations=1-876
tatcccttcaattctcatatttttcattgtctacagtctgatcttccgcgtcttcgtcgaaactttacaccgatggaaattcagcgtgatagccatttacgaagtatgaaagagcttctcagcacgatggacccgcaagtcgaccccaattcacacattgaattcaagcagaagacacacattctttgtgcccgctttttgggtggtgcttggaagaccgtctcattggaggacatgaagattcacagaattaaaggcggaatgagcaacatgcttttcttttgccgtctgactgaaaatcacccaccactaaaaggggagccggacaaagtccttctgcgcgtgtattttaacccagaaacggaaagtcatttggtggcagagtctgttattttcacccttctctctgaacgacacctggggccgaaactctatggaatattcagcgggggccgtcttgaagaatacattccgtcacggccacttacttgccatgaaattgcattgcccaccatggccaacaaaatagccaagaggttggctcgagtccatcaacttgaagtgccaatttggaaagaaccggaatatatttgtgacgcgcttgaaaggtggcttattcaattgaaacaaatgcccagtggttctcgtgatttcgatttgccggctgaaagtcacgaatgggctcctccgagcataaattgcgaagatttacagaaagaaattgagcacctgaggagattgattgtaaagagtcggagtctggttactttctgtcataatgatcttcaagaagggaacattctcttgcccaaagcacattctggcaatatccgaatcggctccgaatcggacgaaattttatctggcattgacggg

SEQ ID NO: 50564 - DNA, 490 bp, Heterodera glycines
  SCN-specific regions: Sequence locations=1-232,256-291,316-490
gttcatactcgcacaaacagcgagatggagaacgctcatacgaaaagtgaagacgaattgtttcggtttttcggcacagggccagacggactgacagaggaacaagcagacgaattgcgggataaatatggctataatgaaatgcccgcggaggaggggaaaaagctgtgggaattgattctcgagcagttcgatgatctccttgtaaaaattttactcctagccgcaataatttcttttgtccttgccttgtttgaggagcacgatgaccagacgagtgcagtcactgcgtttgtggaaccttttgttattctcctaattctcattgcgaatgccacggtcggagtttggcaggagagaaatgcggaaagtgcaattgaagcgctgaaggaatacgaaccggaaatggcaaaagtcatccgagcgggcaaacacggcattcagatgatccgtgcaaaggaactcgtcccgggcgatctcgtcgaagttt

SEQ ID NO: 50565 - DNA, 742 bp, Heterodera glycines
  SCN-specific regions: Sequence locations=1-584,606-742
gccatatatctttagacttttttcagataatcagttttgcgatctcaataaaacttttctttatttgtcaacttcaattgagagaaaagacaaaagcaattggattccgattaccaaggacagtgaagctgaccaacacgtcggtgtcattcaaaattttgggcacagctttgtcaaaaccttaaaggtgtcaatttcaggtgttgagtcttatgattccggcatttactatgcgtttagggcatatatgatgaatgaattgggattttcagaagatgtcaaaaagggtctctgtgaagcgtcctgctattatgtcgacgatgtcgaccaggatgattatacaaacagtggctttaaaaacagagcgtcacgttttgctgatggtgcaaaatgtgaaacaatggtgaaacttaattttgatctcgcccgtcagcccaattttttgcttaataactctgacgtgatttttagcatacaccgtaacaccgatgtttttctaattatggcaccgccatatgtttccggaaatgcagtcatagtgaacccgcacacatatcgtattaacatacacgatattagaatttatgtaaaaacagtagatgttacccagtcattaaataacataataagcaatcagctacaaaccaccccggccaaatatcctatgagaaaaattgagatcaggagtcttttcatcccgcgtggcacttctgatctttcacacaatgtttttacaagcatt

SEQ ID NO: 50566 - DNA, 617 bp, Heterodera glycines
  SCN-specific regions: Sequence locations=1-189,214-525,552-617
gagcatttaattttaagccttcaagccgaataaaatcttttttcttcgatggatcaacaggagaaaagttccggatggtttgcaaatgttgaaatgggtccaccggatgtgattttgggcgtaactgaagcatttaaacgcgatgacaacccgaaaaaggttaaccttggagtaggcgcatacagagatgaccagggaatgccttttgttctgccgagcgtaaaacaagccgaaaaagaattactcgaagcaaacctcgacaaagaatatgctggcattgccggtttgccggacttcaccgccaaggccattgaattggcgctcggaagagattctgaagttttgaaagcgaaacgaaacgcgacggttcagtcggtgtccggcacgggagcattgagaacgggcgccgaatttctctccaaatggtttccgcacaacaaagttgtttatcagccgacgcccacttggggcaaccatgtgcccgtgttcaaggttgctggctttgaaatccaaaagtaccgctattacgacccgaagacttgtggctttgatgagaatggctgcttggaagacattctgaacatcccggcgaagtccgtcattttgttccacgcgtg

SEQ ID NO: 50567 - DNA, 516 bp, Heterodera glycines
  SCN-specific regions: Sequence locations=1-516
attaagtttttaaagcttatattaatagcaatgactgaaggaggtgaagaagtgaatccaaaggcctaccctttggcggatattcaactttctcagaagttgcttgatcttgttcagcaggcaacgaactatcatcaattgaaaaagggtgctaatgaggcaaccaaaacactgaaccgaggcattgctgaggtgatcattttggcagctgatgcagaaccattggaaatcattttgcatttgccattgttgtgcgaagacaaaaacgtcccatatgtattcgtgaagagcaaggctgcacttgggcgtgcatgcggtgtgactcggccggtgatcgcaacttcgatcattcaaaatgaaggatctcagttgaagtctcagattcagaagattaaagaagatgtggaaaagttacttatttgattaaaaatttgcaagcttatcactgttttgttattccatcttgttttgttgtttcatgatttgttcgacgacaattaaaatgactctgaaaaa

SEQ ID NO: 50568 - DNA, 634 bp, Heterodera glycines
  SCN-specific regions: Sequence locations=1-634
attttgcagaactgtggaccgaattcgtttccaaaatgctattctttcaaaacggtccggtcgagcagtgtccgcaccaacagcagcagaatgccgcgccgctgtcccaccgccccacggcattttccctccccgcaacttcgcctttctcaacaatttcatcggtgggctcactgccgtcggagccaacaacgcccacagaaagaatgagcacaggaaatgtgatgatgatgatgagcccgaaaagaatggacaaaggaaacggaggagagaaaggacaaagacagaaagccccgggcaaagagcggccaaaggacggcaaagagcgcgtgcacaagtgcgaccagtgccaaaaggcgttccgcttcaagtccaacctgttcgagcacaaatcgctgcatttgggcagcagcagtcggaaccctttcgtgtgccctttctgctccaaaacgtgccgtctgaagggcaatctgaagaagcatttgcaagtgcacgtcaccagcgcggaggacttggaatgcttgtggaaacgctctttctcacgcagttccggtcgtccgagtaaaaatgcaccgcccgctccgttgccaaagcccggcgacgacctcggcatggtgccggtgctcgtctctca

SEQ ID NO: 50569 - DNA, 1053 bp, Heterodera glycines
  SCN-specific regions: Sequence locations=1-259,284-967,989-1053
tcaaatggcatctgatcaacttctttcatcccgagatagatttttctcattcagagttttagattcataaataatatatttgtcctggtccatccacaaaaaaataaccacaacatgaggctaaatcttaacatttgggtacactgataattttattgatgaattaatttccatctatttttcatgtcgattaaggcatattttggttaatgtacctatttatgtcgaacctctactgactccccattttcgcgcatctccaaaaataaaatttgaaaaatacgcctccaaaagacgacagatgactgtgacatcgacaaaaaacaattcttttccgagctcatttaaagacattactctacacgacgtatgggccagcaatttggaggccgaatttgccaaactgcgcgacctcatcgacgactatccattcgtggccatggacaccgaataccccggcgtcatcgctacgccggtgggccagttccgcagcaaggaggatttcaattatcaacaactcaggctcaatgtggactgcttgaagctcatccaggtcggcttcactctgatgaatgagaagggtcagctgccgcccgcccgtgacattttccaattcaatttgcacttcgatccgagcaccgattcgttcgcgcacaattcgctggaactgctcaaaacggcgggctttgacttcaacaaacaccagaacggagggcatcaaattggaggactttgggtgagctgctgaccacttccgggctggtggctgatcggcgcatcacctgactgacctttcacagctgtttcgactacggccacctcatcagggccattatgctggtcaaactgcccgaggacgaccaagacttcttccgctaccatcgcaaattgatcccgaaccgtttccacttcgagattctgttgcgactgaccgggtcgcgcgacaccatgctcaatggccgacttcaggagctggccgaccaactgcacgtcccgcgcattgccacatgccaccaagtcggctcggactcgttgctcactgcgatgactttc

SEQ ID NO: 50570 - DNA, 615 bp, Heterodera glycines
  SCN-specific regions: Sequence locations=1-615
ctaaattctgtttaatgtgtcaatgagcaacaacgacatcatttttcgaaatgaggaaggcgttaattatttggcaccatggacatattcctgtctcatcaaaacttcgatagatcggttgaaaactgctttatctgagaatcgtgaagccatacatgctttaaatcatttacaagaagtctttcgtcaaattgaccgtgcttctccctcctttctttatgatttctcaaaacttttgctgatcgattcgggcgttgcaggaactaatgtgcaggaatcgtaccttcgaatgcatgcaaacgcggccacagaagagctggaactgccacaatttgcacacattgcagaatttcaatatttgtcaatgagagctgtttcactgtgcaaggtgcttgccagaattccggacgaaatgactgataggttttaacttaattcaagccctgaattttgtcgggaccctgccctaatttctcaaatttacaagctccttttcgaaataatggctttataatttgtttataaatagcaattttttatgtcttcagaaggtcatttctggagaccatcaaagagattgcttcgtccattaagcaattgttggacacgacaaac

SEQ ID NO: 50571 - DNA, 460 bp, Heterodera glycines
  SCN-specific regions: Sequence locations=1-460
atgtgtttttggctgttggaagagttgggtccacctctgagaacatcggtcaaaaagttgtttgggttgaagagcacaacaaacgccatttcctgatggatttgctcgatgccagtgagcccgaggcactaacactgattttcgttgaaaccaaacgcggctgtggagatctgagttacatgctccagcaagaaggctaccattgcgtagcaatccatggcgatttgaagcaaatggaacgcgagcgtcatttggagaacttccgcaacggaacggcacccattttggtggcaacagcagttgccgcccgtgggttggacattccgaatgtcaagcacgtgatcaattatgacctaccgaatgacatcgatgaatacgtgcaccgaattggcagaaccggccgtgtgggcaacattggaatggccactagctttttcaacgacaaaaaccggaacatttc

SEQ ID NO: 50572 - DNA, 549 bp, Heterodera glycines
  SCN-specific regions: Sequence locations=1-119,141-476,514-549
ctggagctccccgcggtggcggccgcttttcaactagtggatcccccgggctgcaggattcaggcacggggcttaaccattttccaacattggctaattaccgtccctaactaattggcttttttccctcccacttaattgtgtaccatcaaaaatgccgaaggtggactttgactatttggacatgttttcacccatcttggtggcgtttatttttgcggtcatcctttttttcatctccttcacgtgcatcaattggtactgtatcacgcacaaggatgaccttacggtgttcgaaaagttcggcacccgcttgaatcttcgtcttggcccccattcaatggcagtgatcaaacgaggcggctacgcgtccacctacgcccgcgaggaggcaaagcggtcggaatgtaccggaccacaacagcaacaactgaacacgcttggggacggaaaatgccaaattagccacgcttgacaaaaatgattggcattttttcaaaatcattttaattttgatgaaattttctatgggttttcaattaaccaaag

SEQ ID NO: 50573 - DNA, 895 bp, Heterodera glycines
  SCN-specific regions: Sequence locations=1-895
ctcagagtgattctcctgttcctaattggctgcttaacatcggaccaatttcttgccatgcgtggaacaaggacaaaactcaattggctgtttcgccttccaacaacgaaattcacatattcgctcgtttggagactgtttggaacccgttgcacgtgctaagagaacacgacttgctgatcaccggattggattgggctccgaatactaatcggattgtttcatgttcgcacgacaaaaatgcgtttgtgtggacatgggaggctgaaaagaacagttggaaaccggagatggtggtcgttcggataaacagagctgccacctgtgtcaaatggtcgcccaacgaaaacaaattcgccgttgggacggcgtgaaaatgactggtgggtagcgaagcaaatcaaaaagctgattcgttccactgtcacctcattgaattggcatcccaacaacattttgttggctgttggcgcctgcgacttcaaaacgcgtgttttttctgcttatgtgaaagagattgacgaaaaaccaacgccaaacccttgggggaccaaaatgccattgggagaattgctcaaggagtaccagtcgaccggatgggtccatgacttggccttttctccctccggttgtaaacttgcctgggtctctcatgattcgtccattgctgtgattgacaagtccaattctcaacctcaggaaaggccaattcagcacaaaactgcctttttgccgttcacttctgtccgatgggtcaatgagacgcatattgtgacggctggtcacgactgttccccaatgcttttcactttcgacgggacggcgttgaattttaaatgcaaattggatgtgccgccagaaaataaaaacggttccaacgtgagctccgctttcg

SEQ ID NO: 50574 - DNA, 477 bp, Heterodera glycines
  SCN-specific regions: Sequence locations=1-327,356-370,392-404,427-477
gagctcacgcggtggcggcgctctgcatagtggatcccccgggctgcaggaattcggcacgagggtttgaggtagtgtaataaattcttattgtagtaaaaatgtccgaaaataagtccgaaggtggcgctgaaaagaagaagagcggtggattcaacacgaagaagtttttgttggacctcgcatccggcggaactgctgctgcagtctcaaaaaccgctgttgcacccatcgagcgtgtcaagctgttgttgcaggtgcaagatgcttccattcacatcaccgcggacaagcgctacaaaggcatcatcgacgtcctcgtccgtgttcccaaggagcagggctttctgtcgttgtggcgtggtaacctggccaacgtcatccgttactttccgactcaggcgctgaacttcgccttcaaggacacttataagcgagtcttcacgcaaggagtggacaaggagaagcagttcttga

SEQ ID NO: 50575 - DNA, 657 bp, Heterodera glycines
  SCN-specific regions: Sequence locations=1-657
ataatgacgcaatttctccccgacaatttgttggctctgtttgcgcctcgtccgccgattcaattcaaaccgccgccagatgatctattcatccaccgaaaacacatgcaaatggggggcatggccgagtgtgtccatggttttgaggatccgaaggacactcctccaaaacccaaaattgagacccgagaggagaagagagcgcgaaaacgcaaggaaaaggaggagctaatggcctacaaaattgagctttgcattgccacttggacacctgcggacaatccgaaggcgaccgttgacccgtacaaaacactttttattggccgaattaattatgaaacttcggagtccaaactacgccgtgaatttgagaagtacggcaaaataacgaagattattatggtgcacgacaaaaacagcaaaccgcgcggttacgcctttatcgaatatgcccataagtcggagatgtcagccgcttacaagaaggccgacgggaccaaaattgacggacgtcgcgtggtggtggactacaagcgtggccgcacgcaaaagaaatggctgccgcgtccgttgggtggcgggaaagggggaccccgcccaatgcgggagtccaaggcgaaaatgttggcgcgtgagttggcccgaaaagggggggga

SEQ ID NO: 50576 - DNA, 543 bp, Heterodera glycines
  SCN-specific regions: Sequence locations=1-10,35-543
tggggtatcctccttgtgactgactgactgactagtgaacatttcaagagcaaccagaacattgctacacaaatcgagttgtcactttgtggtatcgaccccccgagttgttattgggcacgcggaactacggcccggcgattgacatttggggcgcgggttgcatcatggccgagctttggatccgtgcaccaatcctttatgttaacaccgaacaatctcagctggagctcatttcgaaactgtgtgggtcgattaatccgcacagttggccaggtgtttgttggcgtttggcttttcctaaaaaaccaaatccgccaaagggtgtgacaagttgccttattacaacaatttgcaaggatcgttacagcaaaatttaccgagacgcgtgagagagcgtataaatccatttcttcagaacaatgagcaagccctttcgctcatcgattttatgctgacgcttaaccccgagaaacggccctctgcgtccgctgccttggaccacacttctttttcgaggcgcccatcccagcaataaacatt

SEQ ID NO: 50577 - DNA, 498 bp, Heterodera glycines
  SCN-specific regions: Sequence locations=1-498
agccctctaaaattcacgaaggtgtttttgctattgttcgtaaagttggtggtgaacatattcgtttgtgccgtttgataagtgggcaacgcgtgctaattgaacgactgagttttaatccgaaagacgcaattggacatttttatgggattttcgaagtcagcaatggtggtgacatgctttgccccattgaattcgcctcaaagcttttttttaccgaattttcaaatgggaattcagcaggagataggggtcacggaaatgaaagcactcaacaacttacaagcaatcaaattatgagcttaaaagaggatggaatcactacaaacgaattagtttccaaattggtcagcggaaattgccatttccaatctcgtacaaaattttcaaaagaaaaatatatgcgaaagaaagttcacaagcattcggaccgggttgttattttgcagcccaatattcgccttttggccgactgttactaccgaaaggacccccaac

SEQ ID NO: 50578 - DNA, 462 bp, Heterodera glycines
  SCN-specific regions: Sequence locations=1-69,94-377,399-462
taaaacaatttctattcggctctttccacaatttatcaacaacgtttttatcattatcacataaaaatgcgtttttgagccaaaatggaagtcgaagaaacgaaagcgacaaaattggagcaaatgtttgccaatgtatggcaaaattggagtcattttgtgctattaatggaagtcggcctttggaagcaaaggcagagtttcggccgatcaattcgatggactttcattccgacgtcggccgaatgctgtacaccatcgccattctgctgatgttttccttcgtcattttcgcccttatggtccgttccattagtcgttcgcgttcatccgccgaattggagacgcttttggatgccatgcgtttccgagaggaattggacattcagctgaggcaaaagcatcggctgaggaaggcgaagcgaaaagtgaccgcttggctgtgccgaggaaacggggcga

SEQ ID NO: 50579 - DNA, 520 bp, Heterodera glycines
  SCN-specific regions: Sequence locations=1-520
caacaatttattcatttcactttcaatgacaatgaaccgacttttgcccggccgttctctgctccccaaaatcatgcgaaatttttcacacagcaatcgcctcgccgcctccgaggcggacccggaacattacggctatttcccggacccaaccgaacagatgtggggcctggagagggaaatgcttgctgcccgcctgaagggcgaagatcgctactcacccaaaatttattaccgcgctgaacattcgaccaaggatgtcccaaatgtggtgcgtgtccatttggaggacaaagtcgtcggatgcctttgcgaacacgacggagaccatgtgaattattggcacatcagaaaaggcgacacaaagcgatgcgagtgcggacattggttcaaaggcgtgcaagcagacaccgacagtttcgactgaatgcggtggacaccgatttctcgctttgaagaggataggaaattgttttggttgattaaatctttattttttgttttgttttttcgttttcaa

SEQ ID NO: 50580 - DNA, 480 bp, Heterodera glycines
  SCN-specific regions: Sequence locations=1-480
gattaattcatcccagcaggaatctctttttttgtttatttccttcatttaatatacataattgtttcattccaaatggagggaatattcggcactcagcgggggggaggggacattctaccgaataacgacaacaacggcaatcacaacgacaggcaaccgttgctactcgaagaaaatgaaaaagccagctacgggtcgctggtgcctacagaggactcatttaggcaagacaaacattggtggaaaaggagcggaaaactaaaggcctcgaaacgacaacttggcatatttgcttattcctcctccgttgattatgcgctgattgcttttggtacggtcgcttctgtgctccacggggccggcttccccttactttcgattgttctcggtgggatgacctcagggccgaaaattccgattttgttcatggccaaacgccgcgtcaaaatgctactaattcctctgccatttcgccaa

SEQ ID NO: 50581 - DNA, 652 bp, Heterodera glycines
  SCN-specific regions: Sequence locations=1-137,159-652
gttgtgcactaaaagccaacatgatacaggcttggcgcacgcattttgttctcgaggaaggcatgttggaagtcgagtgcacttcacttacaccagaatacgtcttaaaagcttctggccatgttgaccggtttatcgactggatggtgaaagacaaacaaacgggtgcttgttttagagccgaccacttggttaaaaatcaagcggaaactttgattcgggacaaaaaaactgatgaaaaaacaaagtccgaacttatgaatgtgcttgttatgcttgatgggatgagctgtgatgacttgcacgaagtcattaagaaattcaatttcaaatctccgctaaccggcggtgacttgtccgaacccgtttctttcaatctgatgtttcccactgaaattggacctacctgtgatcagcgagcctttctgagacccgagacggctcaaggaatctttatcaacttcaaacgccttttagaatttaaccagggacgacttccttttgctgcagcccaagtcggttctggctttagaaacgaaatttcgcctcgacaaggacttatccgcgtccgagagtttacaatgtgtgaaattgaacactttgttgacccgaccgacaagagacatcccaaattcgagaaaattgcacattt

SEQ ID NO: 50582 - DNA, 517 bp, Heterodera glycines
  SCN-specific regions: Sequence locations=1-86,109-517
caacattggaaatggcttttccgcctccttttccgaatccattgcttcctcgccttccgaatcagtcggttcaattccctggacagaagtttggcttcttttctccacaacgtcaaagtattctgcccgggattccgctgctccgtccacgttttcgtccgaattttattccaagggaactgcggccacccaatccattggcaagacccaccgggccaccaacgaccacaacagtttttattgggaacatttccgataaatgtccggaccgaatcatacaggaagttctaaagaagtgcggttccgtgtgcaattggaaacgtctccaagactcacgcggaaaatttaaagcgtttggattttgcgactttatgtacccagacggagcaaagaaagcactgagtgtcctcaaggacttccccatcggcgacaaacgtctgaatgttaaagcggacgaacaaacggagaaactgctggatgaattctccaagaataagctcatcgccgccaacgagga

SEQ ID NO: 50583 - DNA, 747 bp, Heterodera glycines
  SCN-specific regions: Sequence locations=33-413,435-640,662-747
cctcgtgccgaattcggcacgagggtccaattaagtttctatgtccaaacaaattcgaacttgttgggtgtggcgtaagaacaaccgttggtggcgttatttgccgcgacgtaacgactcccacaacctaatcgacatggacgagctgggcgaacaatgcgccaccttttccgacccaatgcccgccgatccacccaaactttgggtggcgtggctgtacacagattcttacgggtcgggacgaaagatcagggaccaggtgacaaagctctttggcaaagacgcgaaaacgggcgaaatgcaagtgttcaaaaacacactgtcgaccaacaaacagttgtggaagataaagcatctgctcgaaatacggccggtaacatttccaaacggagagcccggggccggaagatgcgacacatttggagataatggcggatggacgctgtgtaatcgaccggcaaagtttgcctaatgtcgacgagtttcaactgattgaccgcagcaagccagttcagcccgcgttatttggcttctcgactgatgtcaaaggatgtggccaagcaggacgtgtacgaggacaccgtctacaacccggaaaatatcagcattggatgaaagaagggcggcaaaattattgcaaatttaagatgttctttttgatgtcatttgctctactccgtccatcctatatacttcattttgtttttgtctaaaaattacattttgttgcaaataaacttctcatat

SEQ ID NO: 50584 - DNA, 482 bp, Heterodera glycines
  SCN-specific regions: Sequence locations=1-331,354-482
tccacccgggccatggcaagcgagtggtgcgcgctgacggaaagatccaaatctacctgagcaagaaggcacagcgtggtgcagcactgaagcgcaacccgcgtgacgtgccgtggaccgtgctgtaccgacgaaagcacaagaagggagtacacgccgaggagggcacgcagcgaaagcgcgttaagcgcaccgtccaaattgcttctcgacccatcgccgacctcaccgtggaggcactgttggcccagcgcaatcagaagcccgaattccgtaaacagcaacgcgaggcggccatcaaggctgccaaggagtccgcccgagtccaaaaggacgagaccaagaagaagcagcagaagattgacaaaaaggcagcgccaacgaagacgaaggcggccaagcaggtgaaagcgccgaaacaatttgtgggcggaaagcgctgattttgtgacgaaaagatgggatgtgcttgtgtgaattcg

SEQ ID NO: 50585 - DNA, 419 bp, Heterodera glycines
  SCN-specific regions: Sequence locations=1-40,182-185,239-419
gtttgagcgatcgaattcaacaccctttcaatttggctatcatgcaaatcttcgtcaaaactctcaccgggaagaccatcacccttgaggtcgaggcgagcgacaccatcgagaacgtgaaagcgaagatccaggacaaggagggcattccgccagaccagcagcgccttatcttcgctgggaaacagctcgaggacggacgcaccctggccgactacaacatccagaaggaatcgacacttcatctcgtcctgcgccttcgtggtggaaagaactagaacgacgaacggaggagatgattgatccgtatcgatccatatattatgtaacttgagaccgtcctgtattgtgttccgttttattcatcatcatgaaatgtatttcaatgatcacggaacgataaacccatcaaaactgtc

SEQ ID NO: 50586 - DNA, 697 bp, Heterodera glycines
  SCN-specific regions: Sequence locations=1-697
gggctgcaggatttctggcacgagggtccatttaagaaacattcctttcattttcaaagatatttctgccatttgtttcgcggcttttgcacattccgtctaataaatgcaagcagtcacagaacaatgcttttgcaaacgatgggctttcagtctgaagaaaagcatggaaagcgagaatttcgaaaggcatttccgtttggccattcaatcggtcactgcggaagactatgaaaagatgcgtcagtatcggcaccgggaggactctctcgcgactttggccggtcgtctcttcctccgtaaggctgtccaatgcctttgcggtgtccgttgggccgacattgaaatttcacgaacggaacggggaaagcctttcattgttcgacccgagaacatttccataggactgaacgtttctcaccaaggcgactacaccgtttttgccagcagttgtaccaaccaagttggcgtggatgtgatgcgattggacatgtgccgaggcaataaaactgcggatgaatacatcaattcgatggcgaagtcggcttcggcgggagaattgcgaacgatgcgcggccagccgacagaacaaatgaaaatgaccgttttctaccgatattggtgtctgaaagaagccattatgaaggcgacagggcatggactcgtgaacgacttgagccgttttgatttcatcatc

SEQ ID NO: 50587 - DNA, 509 bp, Heterodera glycines
  SCN-specific regions: Sequence locations=1-179,203-209,231-254,276-509
taactcaacattttctaaaatttccaatggctggtggcaaaagaaaagcgggcaaggacagcggaaaagcaaagtctaagaaaatcatctcgcgcagtgccagggctggcctccaattcccggtgggacgcatccatcgcttcttgaagaagcgcacaacaagcaccggacgagtcggcgccaccgccgccgtgtacagcgcagcaattctggagtatctgacggccgaggtgttggagctggccggcaacgcgtccaaggacctcaaagtgaagcgggtgacaccgcgtcacttgcacttggcaattcgtggagatgaggagttggattcgatggtcactgcgacaattgcgggcggcggagtcattccgcacattcaccgttcattgatgagaaagcctccgagtcaactcaatcacagtcaccagcataatcattcgcagcagcagatgaccaacgttggcaatggcgacaactgattttggccaaatgaatatcgttctttcaat

SEQ ID NO: 50588 - DNA, 764 bp, Heterodera glycines
  SCN-specific regions: Sequence locations=1-418,442-666,688-764
cgcatccgaaagtggaagtgacaaaattgtgttccaaaagaatgttactgggcgaggtagccaggttttggatgacgccgagtttgttaaaatgtatgatcggtcgacttcgaaaaccttgaacacttcctcagccaatgacaacgcacagtcaaaccaacagaaagaacaggttcagaagtggaaagtcggtgatcaatgcatggcactctacgaagtggacggaaagtgttacccggccaaaatcgagcagatttcgcctgtaaaaaacacatgcactgtctcttacattggttacgaccaaaaggccattctgaagttggaggacattttgggtgaatccgatgttgaggctgccgatgaccatggcgatgagcgtgaagcggaagggacaagcggaacgactaagattgcggacaatgatgtgaaaaaagatgcatttccgatcccggatttatgtcctccaccaccgccatcgatgtttggaaagatagccgttgcgggcaatgagaaggaggcactgaccaacatgcttatgtcgtggtacatgtccggataccacaccggcttctaccagggtgttatgcatgaaaagacgacccgtcagaagccaaaatagataacgttgccatacggcttaaaaatcatctcactggttgctgtccatttttattgtctctcccctccctcagttattgtttaattttcttgttcagacataaattgccggtcaacatttccaaagcaataaacggatagccttt

SEQ ID NO: 50589 - DNA, 855 bp, Heterodera glycines
  SCN-specific regions: Sequence locations=1-282,321-560,582-729,751-855
gctgttctcgcgccgggcaagctccgtctgcagaagtggtacgtcgcatatccggacaaggcaaaaaagaaaatcacccgtgagttggtaaccaccattttgtcacggaagcccaaaatgtgcgcattcctcgagtataaggacacgaaagttgtgtacaaacgttacgcttcgctttacttttgctgcgccattgagcagacggacaatgagttgctttgtctggaggtcatccaccgttatgtggagctgttggaccgttattttggcagtgtgtgcgaattggacatcatcttcaacttcgagaaggcctacttcattttggacgagtttttgttggccggcgaaattcaggagaccagcaaaaagcaagtgctgaaggcgatcagtgcgcaggatttgctgcaggatgaggagacaacgcaaggattgtttgaagacaacggacttggctgatgatcgaccacactctaatcagatcagcagaaaaagcagtagcatcaatcatttttcaaaactttttcttccctaattaacccatttttcgtttcaatgtccaacaaaagttgtatttgtgccaaaacaccttaaattttcgtttatggcacaaaatgacaaaagcattttgttcaccgtcccttaattacctgaaaatgtttttagttcacaccaagcctaatgatcactaattctaattacctatcatttcttttttccgtgatataattgcactgtcttttttattttattctgtcgatcagtctcagatgagccaaaatatttgtttttcttgtaattctttcctgtccattttgttcacttcatttttcctttcgatttcattcctcctaaaat

SEQ ID NO: 50590 - DNA, 621 bp, Heterodera glycines
  misc_feature (487)..(487): n is a, c, g, or t
  SCN-specific regions: Sequence locations=1-225,247-329,351-621
ctcaggtgggattgaacctgggactccctgtttggtggcaaactcacagaccactaagacaaaaaatcaattagtttttgaactgggggctcaaaattgactcggtgtgttaaactgttttaagcaattttgaattacgactatgatcacaatttttcagttttttgttcccaatccaaagagtgtagttgacaattgaattatataaaattccatgaattttgctcacctttctttgttccaattaagtgttcttttcacgtgaaatttgactaacaaattgactcttcgagtctcttcatttattcatcaacattcgcaattcgtttgtttcttcactaatgagtggtgaattgcggcttgattcgagtcttgatctgatgcggcgtttgccaccgcaaaactgtgagaagcatttgaccgatttggtcgctcttgcgcccgacctttgcgagtctttgcttactgccgttgaccaaccgcttanagtggcgaagggtttgtgctgtgatgccaaaaagttactttgaagaggcatttctctgtttagacaaacaacggggagggaatatttgctctgcggttagtttagacattttgcaaatcgttttggaattgaca

SEQ ID NO: 50591 - DNA, 1036 bp, Heterodera glycines
  SCN-specific regions: Sequence locations=1-400,424-1036
agtccaagagaagacgacgtaaaggaatgccttcgggaggcgacgatgaacaacagtttgaggaggcggtcaaaccggcattggagtcccttttggcggatttgcaaaagaccaccgaagttcttcggcaaggcaaacatggcaaaggccgacggcaacagaaggaggacgaatccgccgctttgttggacttgaagaagcttcggaactctccccgccagcgaaaccaatcgccggcagcggtcgccaatttgcgaaacggaagaagcgaagagctgcagcctcgccgtgacccgatgcttgagggcgacaaattgggcatccacacgataccgaagggggactgtgcttcgtgcaaccaagcagtgattgggcccgtggtgatagcccttgggaagatgtggcatcctgaacatttttgctgcgctcattgcggagattccattgaaaatcggaattttttcgagcggcaaggaaaggcgtactgtgaaagcgattaccacgatttattttcacctcgttgttcctactgtaacgggcccatcaaagaacgttgtgtaacagcacttggcggaaagaattttcacgtggagcattttgtttgcgccgaatgcggcaaaagcttcggagacggcggattccatgagaaatccaattccgcgtactgtcgcgattgtttctaccgtacttacgcgcccaagtgtcagtcctgcaaacagccgatcactcacaaattcatcacggcactcaacacacattggcaccccgaatgcttttgctgtcaggagtgtggccaacccttccattgtgtctctctgttcgaccatttgggccgtcttctctgtgagatgtgtctccacacgcgcgtcggctccatctgcgcgcgttgtcggctgcccatcagcggccgttgtgtgtccgcgatgagtcaaaaattccatccggaacatttcacttgctcctactgcactgaccaacttgacaagggcaccttcaaagagagtgccgggcgacccttttgcctccgctgctatca

SEQ ID NO: 50592 - DNA, 191 bp, Heterodera glycines
  SCN-specific regions: Sequence locations=1-191
acggagaagaaactcagctgttgcaccagccattcatgctcaatcctgaacagactgtcaacgaatatttggaagcacatggggcaaatattgcggatttcttgcgcattgagatgggccaagaacacaccaagacaaatgacctttctgttcattgttagtataattaagtgctagtaaaatattgcttt

SEQ ID NO: 50593 - DNA, 481 bp, Heterodera glycines
  SCN-specific regions: Sequence locations=1-481
gttttcttttattcaaatttgataatggcagatgatgaagattatgatgggggagaaatggacggcgatgagtttatggaggaagagcccatagaagaccttgatgcggaacaccaagcgggagaagaagaggaaggcgcggagaatgtccaagttattaatgtttctgacaaagttgcatcatccaaccgagtgacaactccttttatgactaagtacgaacgtgcaagagttcttgggacgagggcgctgcagatagctatgggtgcaccagttatggtcgaaattgaaggcgaatcggaccctttggaaattgcgcgtaaggagctcaaggaccagaagattcccataatcattcgtcgttacttacctgatggttcattcgaagactggggcattgatgaattgcacattacggattggtgaaaatgattaaccgcgtaattggcattttttctatttatgtttaatgaatttttga

SEQ ID NO: 50594 - DNA, 610 bp, Heterodera glycines
  SCN-specific regions: Sequence locations=1-1,23-247,269-610
atttgacttttcttatttgaataaggcattcaagcgagcattggagcccaaattgccaagcaccgacatccggccaatcccggatgaacgctgcgttaacacagctcatctcggcgaggcagagaaagagcgcttggaacaaatcggcttgaaagccattgcggaaggtcgcgtggcggccgttgtgttggccggcgggcaggccagccgtctgggctctgcccagccgaagggcgttcttcgcctgggcactggacttggccaggacgacgtcgactcacttttgttcattcaggctgcacaaattgtacgccttcaacgcatggcggccgagcagttcccggccgaggctgcgaagagcggtgggcgcatcacttggctggtgatgaccagcaacaccaccaatgccgcggtgcatgaccatctgaatgccgtactcgccgagactggcctcagttcggaccaggtgctgatcttcacccaaaaagaaattccggcatttgactttgatgggaacgcactcatgaaaagcagcactgaattggtcactgctcctgacggaaatggcggcttttatgacgtggtccgcccgcttcttccgaactggaga

SEQ ID NO: 50595 - DNA, 427 bp, Heterodera glycines
  SCN-specific regions: Sequence locations=1-132,154-427
ttgtttatctttactcaacaatttgcggtttagtaattaaagacgctaaaaaatggcacaacagcaagcgataacgaagaagcgtaaagctgtgcaagacggaattttcaaggccgaattaaacaactttctcatgaaggagttggccgaggacggttattccggtgtcgaagtgcgtcgtgcaccttcccgtactgaagtgatcatcatggcgacgcgcacccaaagtgtgctcggcgagcgcggcaagcgcatccgcgaactgaccgcactcgtgcagaagcggtttggctattccgctggacaaattgagctctatgccgagaaagtgtccagccgtgggctttgcgcggtggcccaatgcgagtcattgcgttacaaattggtcggagggctcaccgtgcgtcgtgcgtgctacggggtgctg

SEQ ID NO: 50596 - DNA, 576 bp, Heterodera glycines
  SCN-specific regions: Sequence locations=1-437,459-522,553-553
ctttgttcatttattttgtttgaatgcgattctatgtcaaaaacatcgaagaaaaattttgtgacaaagcaactcgttaaagaaattgttattccagctgacaatgaatttgttgggaaaattttagcttcacgaggcaacaacctccacgaagttgaaaccgatgaaggggaaaacttccttgtgagtatgcccacaagatttcgaaagaaattatgggttcgtcgcggcacttatgtgattttacagtcaattgaagaaggagacaaagtgcgagctgaaattgttcatgttttggacccggaaaacattgcgtttttgatggaaaaagaagtttggccggagagatttattgtagaagctgcgcaattgaccaagcgagggcagcgaactgaagaaaatgacgattcggacctattccccgcaacttcggaatctgaaaattcggctgaagagagttcttccctcgtttctgaagatgtagctttgaatggacagacaaatgccttttgatgaaacaacgatttaaaagaaatttaattttgttgcaaagaatttttaaataaattttttaac

SEQ ID NO: 50597 - DNA, 488 bp, Heterodera glycines
  SCN-specific regions: Sequence locations=1-44,76-488
gtttgaggaaacaaatgacaaagttcgaagagaccaaatcaaaattagaggcagaatttgaaaagcttcgaaatttggaaaaagatcgttcaaaatgcatgaccaacagacggcagttggagagccaactgacagagaattccatggtcaaagaagagttcgatcggttgaaaagcgatgccggcgttttcaagctgattgggcccgtgttggttaagcagaatttggaggaagcgaaacaaaatgtggcgaagagaattgattacattcggacggaaatcgaaagaattgagtcattgctgggcgatttggagaaaaacatcgaagtgcaaaaggaatccgtcgaacgaatgcgcgacactttccgacaaacgctggcggtggccactgccccaacggcgaattcgatcaacgcttaatgagtgaatggacgaggaccgatcagactgattgcgagactgatcacttctttcccaacccgaccaaat

SEQ ID NO: 50598 - DNA, 475 bp, Heterodera glycines
  SCN-specific regions: Sequence locations=1-373,395-475
caacgcgtgagattcacctcaactcgccattcaacatccggaccatctacaacttccgcctgatcaacacgggctcaaagcgcattgggttcgccttcaagacgacgaagccgaagcgcatcttcctgaacccgccgtgcggcaccgtgggcgtcggcgacaccgtgaacgtgatcatcaccgtggcacccttcgacccgaacaacgaggacatcaagaacgatcgcgtgatcgtggaatggtgcaacgcgcccggcccgtctgacgccgtgttcaacttggactggttcaccgaaaatgcggttcgaaatgtgcgcctcaacgtcgtctacaacttgtagcggatgcaatatgatgatctgtatcgatccatttcatgaaatgtatttcaatgatcactgttatcttgagactgtcctgtattatgtgttccgttttttcatcatcatgaaatgtatttcaatgatcacggaac

SEQ ID NO: 50599 - DNA, 497 bp, Heterodera glycines
  SCN-specific regions: Sequence locations=1-167,190-193,217-448,470-497
gaccattcaacaaatttgattttcaacaatggaaggtgttgttctagaagagactatggaagagaatgtaatggatacagaattggacgacctcaaaaaaggagcagcggtaaaaaggggccgtggttttgaggggtcgcagaaaagtgctgtccaagtctatgaaactttggacgaggagggctccgtcggaggaccacagcgttctgttgaaggatggatagtttttgttacgaatgtccacgaagaagcacaggaagacgaggtgaaagatctgttcaaagaattcgggaatgtgatgaacatgcatttgaatttggaccgtcggaccggctatttcaagggctataccattgtgcagtacgaaagccaagaggaagcggcagaggccattgccgggctgaacggctacgactttttgggacaggaattgcgagtggattggtgttttgtgaagggcgggcgcgagagaaagcgatgaatcggatgagaagaag

SEQ ID NO: 50600 - DNA, 476 bp, Heterodera glycines
  SCN-specific regions: Sequence locations=1-132,156-397,419-476
gtctgtgttaatctagaaaaagtaatggcttcacgaaaaggaaacgtcaaggaagagcagccggctgtttctctgggtcctcaggttcaagaaggcgaaaatgtctttggtgtggcgcacatttttgcgtctttcaatgacacttttgttcatgtgaccgatttgtctggacgtgaaaccattgtcaaaatcaccgggggaatgcgtgttaaggacgaccgagacgaggcaagttcgtacgctgttatgctcgccgcgccaagatgttgcggaacgttgtaagccaggttggcattaatgctcttcatgtcaaattgagtgaaacgggtgggaccaaaaccaaaaaggcggggtttttttttcaggcagagatgagggcccacgagcgttcgggtatgaagattggtcgaattgaagatggcaggcctattcctttagactagaatagccaaaaaggaggcagtcgtggaagtcgt

SEQ ID NO: 50601 - DNA, 525 bp, Heterodera glycines
  SCN-specific regions: Sequence locations=1-105,144-177,216-225,279-525
gtctcatacatggaatggccgctcaaaacccgatgcgcgagctccttctcgagagagctcgtcctcaacatttgtgtcggcgagagtggtgataagctcacccgtgccgccaaggtgctggagcagctcactggccagacccccgtttactccaaggccaagtacactgtgcgctcgttcggtatccgtcgtaacgaaaagattgccgtccacgtgactgtgcgcggtgccaaggctgaggagattctcgagcgtggcctcaaggtcaaggagtacgaactccgtgccgccaacttctcgcaaaccggccacttcggtttcggtatcaccgagcacattgatctcgacatcaagtacgaccccaccatcggtatttacggtatggacttctactgcgtcatgggtcgtgccggtttccgtgtgtcgcgtcgccgccgcgccgtcgccaaggttggtgccccccaccgcattcaccaggacgaaaccattgagtggttcaagaagaactacgatggtgtcatcctc

SEQ ID NO: 50602 - DNA, 399 bp, Heterodera glycines
  SCN-specific regions: Sequence locations=1-209,236-399
gacggtcggcacggcgtcttcttccgcaacgatctcttcccgtacagctccggctcatccccggtcgcctccttccgcttggccgtccaccattcgcgcgctccctccacttgcggcaaattcaacgagtcgcttctcggtgaattggccaattcggccacgttgcagtcgtcgctgtgcgtttgcacgtccattcgacggacggccgcggtggtggaggaggaagaagaagcgacggagggccggaagctgaagcttaaggagcacccggtgaccgacgaatacaaagtgtcacatgagatcgtcggcattggcgaaagcggtaaagttatggcgtgtttccataaacgacgcggcgaaaagtgcgcgctcaaagtgttgcgtgacaatgcgcgcagt

SEQ ID NO: 50603 - DNA, 477 bp, Heterodera glycines
  SCN-specific regions: Sequence locations=1-377,407-477
ttttagattcaaatttgttttcgttgtttcatttcctttcattcgcaatgcctcagtacaatctgttcgcaaaccgatcgttgctcttcactaaacgtttcttcgccgtcggtcctcccggcactaaggccacatacaagcggacgaagccgcacatgaacgtgggcacaattggacatgttgaccacgggaagacgacactttcgtccgcaatcacaaaactgttggcagccaaaaaacaagcaaaattcctgaagtatgacgaaattgacaatgcgccggaagagcgctcgcgtggagtgacaataaacgcggcgcatttggaatacgaaactgacaacagacactacgcccacgtggactgtccgggccatgcggactacatcaagaacatgatcaccggcgcagcacaaatggagggcaccattttggtggtggccatcactgatggaccaatgccacagacccgtgaacatt

SEQ ID NO: 50604 - DNA, 482 bp, Heterodera glycines
  SCN-specific regions: Sequence locations=1-482
ctttccatggcttcagaatgttgtatacaggttttttgtcgggttcggcctttgaacgagagcgagaagaagaacagttccaccaatgtcgtcaagtttcagtccaaagacaccatcgtcgttgggggaaaaccgtacgcctatgaccatgtgtttgagccaagttccaaccaagaggccgtgtacagcactgccgcccgacacattgtgcaggacgtactcaccgggtacaacgggacaatttttgtttatggacagacttcgtcgggaaaaacgcacactatggagggtgttattggcgactccgagaaacagggcataattccacgcatagtcaacgacatattcactcacatctacaattttgttgacacggaaatggaatttctgatcaaagtgtcttacttcgagatttacaacgaacgaattcgcgaccttttggatgttaccaaaacaaatttggcaattcacgaggacaaaaa

SEQ ID NO: 50605 - DNA, 557 bp, Heterodera glycines
  SCN-specific regions: Sequence locations=1-325,347-557
gatatttaaattttctaacatgacacagcagagaaatcccaatgggatgaaaaagaccaacaaagaattgacggaactcaacgactgcttatccaaatttgcttatcttcggggttttcttccgtctcaagatgatcagcgcctattcgaaagtttttcctcggctcctccacagaaagaatatctgaatatcgctcgttggtacaaccatgttcaaacttacgaagatgttgaacgttccacctggccagataaatcgtctaacattgtcgaggaagagacagcaccaaagaaagacagagttggggaagattcgacgaaagtgacaacccaaaaacgatttgccgagatgtttggtcatttgcacttccacgaggtgggcaaaaacgacacaaccgaaggttatgtgcggacagagaacacagaacgacttctaagagagcacgtcaaagcggtgggaggaaaggttgtcacgcgttttcctcctgaacccaatgggattttgcatatcggacacgcaaaggccatcaacattgttttttgattggcaaaggcac

SEQ ID NO: 50606 - DNA, 496 bp, Heterodera glycines
  SCN-specific regions: Sequence locations=1-496
gttgagctttatgttttcatgaatcaacgaagcgaaatgccagcgcaactccgtttccaaccgtccaatgctattggaacgcaccagcgctcaattataactgcacaacaatttcaacagcagcctttttgtgtaaaacgcgcccgttatgattatgatttatacgaagggcaatcgcatcataatttccaaagacagcgttttgatcaaacaccgccctccgctattcatccaatgcgcactttccaaattcgtcatcgttcaacggataaaacgcgcgggttgcgtcattttgctcaaaaagtttgtgagaaagtgaagcaaaaagttcaaactaattacaacgaagttgcggaagaattggtcaatgaatattttgacaatattgctgaagtcccatctgacccggaaaaattacaatatgatacaagaaacattcgccgtcgtgtttatgatgcgcttaatgttttaatggcgatgaacataattgaaaaaa

SEQ ID NO: 50607 - DNA, 614 bp, Heterodera glycines
  SCN-specific regions: Sequence locations=1-10,32-614
catacctaactatttttaaataaaaaaattacaaccagcctgttgaatggggaattcgtcaactactgctcgatcggatgatccccagtcgacactaacagccggtgaaacgctttctgattacgatgagaacattatcaacagggggcgagtggcacgacgaaaagagtcgttttgcaagggtcttgcattcagcaaccgacccataagcatcaatgagatcgtatgcattcgattgagtgagatcggcactaattggagcggagttatgagattcggtgtcactaatgttgatccggccagttttcgcgacattgaattgccaaagttcgcgtgtcctgacctcacctctaagggcggctattgggcaaagtctcttgctgaacgatattccgtggaaggctcaattttgcattttttcaccaatgccaatggcgaaatgtattacggcgttaatggggtgcacaaagggctcttcttgagcggaattaatgtgcttagtccactgtggatcattgtggacatttacgggaattcgattgccgttgaatttatcgatccaagtgaggtgcaacttcaatcgaaacgaacttcgtccaaaaatagggctggat

SEQ ID NO: 50608 - DNA, 476 bp, Heterodera glycines
  SCN-specific regions: Sequence locations=1-476
gcgatattgaccaacgcactgatgcggttgttgtcctgtcgtcggtgatgcggacattggagagcaatcaaattgtggccgagcagaatctgatcctggccaaagtgccgattctacgcatcaaatttatcggcactttccacgacataacggttgacctgaacgtcaacaactcggtggccattcggaacacgcatttgatgtgttactacagctcttttgactggcgtgtccgaccgttggtgatggtggtcaaagagtgggcaaagcgtcacggcatcaacgactcggcctgctcctccttcacatcgtactcgctggtgctgatggtcatccactatttgcagtgcggtgcacagccaccggtgctgcccaatctgcagcaaatgtacccgaaacggttcagcgtacgtgcggatgtgcgcacgctgaacgtgtcgttgccgttcgagccaattccaaccgcgatgggctgg

SEQ ID NO: 50609 - DNA, 576 bp, Heterodera glycines
  SCN-specific regions: Sequence locations=1-405,468-576
ggtgagcgctcagagtgattctcctgttcctaattggctgcttaacatcggaccaatttcttgccatgcgtggaacaaggacaaaactcaattggctgtttcgccttccaacaacgaaattcacatattcgctcgtttggagactgtttggaacccgttgcacgtgctaagagaacacgacttgctgatcaccggattggattgggctccgaatactaatcggattgtttcatgttcgcacgacaaaaatgcgtttgtgtggacatgggaggctgaaaagaacagttggaaaccggagatggtggtcgttcggataaacagagctgccacctgtgtcaaatggtcgcccaacggtcggtttgaccattccttactcattcattggcccattctttaaaatgtctcattttttaaatacatttaatttaagaaaaatgtttatattcgttttaatttatttttattaagaaaacaaattcgccgttgggacgggtgcgcgtttagtcgctatttgttattacgaagtagcgaaggaatcttcccccccccccttctaattgttggcttttaattgga

SEQ ID NO: 50610 - DNA, 425 bp, Heterodera glycines
  SCN-specific regions: Sequence locations=1-79,115-115,172-180,210 -218,241-318,382-425
ggagctccccgcggtggcggccgcttctgcaactagtggatcccccgggctgcaggattcccggcacgaggcagcaatcagcaaaagctgaacacactccttcgaactcactgattatttgatccatctctgagagcaacttctgatcagccaaagatgccggaaagcgaaaacgacttcgatgaggaggcgcccaacgccaccatggagaccaaagtggcgggcggcggcgcggcgccgaagcgcgtcgggcgctggacgttgtcacaactgcgccagacggacggcatcatcccgtcccaggccggttggaacaatggagactcgcagaagttgatgaccaactttggtacgccgcgtaacaccaccaccaaagtcaaagtggagaatctggccgagattccggaggacattttgctgaaaag

SEQ ID NO: 50611 - DNA, 635 bp, Heterodera glycines
  misc_feature (72)..(72): n is a, c, g, or t
  misc_feature (200)..(200): n is a, c, g, or t
  misc_feature (264)..(264): n is a, c, g, or t
  misc_feature (581)..(581): n is a, c, g, or t
  SCN-specific regions: Sequence locations=1-107,149-264,372-372,433 -450,478-482,505-635
cgcttcttctcatcgccttcgccttcaaaacttagaagcaccaatcccaaccagaaaaaatgtgcgacgaanaagttgctgctctcgtggtggacaatgggtccggaatgtgcaaggccggtttcgcgggcgatgacgcgccccgcgcggtgtttccgtccattgtgggccgcccccgtcatcaaggcgtcatggtcggnatgggacagaaggactcgtacgtgggagacgatgtgcagtccaagcgtggtattctgacgctgnagtacccgattgagcacggcatcgtcaccaactgggacgacatggagaagatctggcaccacaccttctgctacgagctgcgtgtcgcccccgaggagcacccggtggtgctcacagaggccccgctgaacccgaaggccaacagagaaaagatgaccccaatcatgtgcgaaacgttcaacaccgccgggccatgtacgtggccatccagggacgggctgtcccctgtaccgcctccggccgtaccaaccggtcttgtgttagactccgcgcgatgggtgtacccacaccgggggccatctacgaggggttacgcncctgccccgacgccatgcctccggttgtgcttggggcgaggcggggacgtcact

SEQ ID NO: 50612 - DNA, 652 bp, Heterodera glycines
  SCN-specific regions: Sequence locations=1-652
tattgatgaaaatcgacgatggagtgacttacgctgtttaacagatagggcgtctacatttgccaattcaggattcgtccctggaatcaagaatttgaaagaagttcataaaatgccggtgctagttgttggtgctggtgggcttggctgtgaaatccttaaagacttggctttatctggtttccatgacattcatattattgatatggacacaatcgatctctcaaatttaaaccgacaatttctctttcgtgaaaatgacattggacgctcaaaagctgaggtggcggctgcctttatcgagaaaagggtgtttggctgtaaagttactccccataattgcaaaatccaggacaaatctctcgaattttatcgtaaatttttcattattatttgcggacttgactccattgaagctcgccgttggcttaatgcgactgtgtgttctttggttgaatttgatgacggaaataacccaaaatccaacaccatagtgccgttgatcgatggtggaacagagggattcaaaggaaattcacgtgtgattattcctttcatgacgccgtgtattcagtgcacgatagatctttacactccccaggtcaactttccggtgtgtacaattgctcacacacctcggcttcctgagcat

SEQ ID NO: 50613 - DNA, 641 bp, Heterodera glycines
  SCN-specific regions: Sequence locations=1-11,33-34,56-137,166-641
aaattcttctgcaaaattaagtgaaaaatcctcaaaaattattttttagatttaattcttaaatatgagtagtcagcaacaacagttggatgtgcttattgtcatagatggtaccaacattgataagccttgtgtattttttgatcttttcaaatttcaacatttaacttatttaatttaaaggttgatattttttcgagttctggctttgttgcttcttgtctcaattgggtttcaaagcttcattctcctaatgtaattgttgcgttacccaatcaaccgaatgatgtagcagccgaacttttaaaaaaatgggcttctaaattcaagcagcttcaggcatttggtgtttcaaattgccaatctttaaacgatgttcttcgtgaagttgattttcgacaaattcttagaaatgatttcatgctcatacaaaatttagccactttttgtttttcctatctgacgcgacaaatcgaaaaatttcgaaacgataggcggcaaaacaacaaaaatgtgctcacattgctttattactcaaaacgaaattatggaaggaaattcgaggaagatcggtctctgattggatacattgaacaaactcaaaaattaacacattatgagaacattggcaaacatagaac

SEQ ID NO: 50614 - DNA, 542 bp, Heterodera glycines
  SCN-specific regions: Sequence locations=1-138,160-542
gaccatgattacgccaagctctaataccactcactatagggaaagctggtacgcctgcaggtaccggtccggaattcccgggtcgacatcatcatcatcatggccgctaatacgactcactatagggcaaaacggagccgaggaggaggacggaggacgcgggaggtaccacggcttccgcggctttcgaaggacttcttcctcagcaacggcaatgaccagtcgccgcacttgctcaatttttggagctttggacaacgattttgactttttgtttaacataaatttgaagagtatcgccaaattgacccgtttgtgcgcgccttatctcgaagaaacaaagggtgccgtagtgaacatcagcagtttcggcacacagcgttccctgtccgactacacttattacagcaccataaaaaatgctttagacaattattgccgctcaatcgctgttaaatttgcaaagcgcgacattcgagtgaacaacattaaccccggttttatcatcggcgaaactttggacgaagacgacaacagagcga

SEQ ID NO: 50615 - DNA, 420 bp, Heterodera glycines
  SCN-specific regions: Sequence locations=1-336,358-380,403-420
ccatttaagtgttattattcgtatgttaaaaatgttgctgaaatttccttccattcatcggttctgctccattcgctctttgactcaacttcccaattcttatgaagtgttgcgagaccgcggtgacactgctgagctgagtcagctgaaaaacggctttcgtgtcgcctcttatgcaaacggacgtccgacagtgacggtcggtgtttggctgaatgctggctcgaggattgaaaccaatgattattaacggaatcgcttcactttttgaagggttgctgcacaagggatcagggaaacgaaattcggtgcaacttcaaacggagctcgccaaacttggggctcggcttcgctctttcactacccgggagcattcggccttttttgtggaatgtcttaaatcggacaccgataaagtgg

SEQ ID NO: 50616 - DNA, 461 bp, Heterodera glycines
  SCN-specific regions: Sequence locations=1-199,221-461
tttgccggaggtcgtggaagtcgaatgccgtctttgaccaatcaaatgccgaaggcgttgttgcccatggccaatatgccactttattggttttcgcttaatttacttcgactgaatcgcgtcagagattgccttttgattgttcccctggggcaaaaattgcaaattgaaaatgcgctgaaaacggacggcggtggacgatggccaacacttaagggaatggacatcgaagtggtggccattgacagtttggaggaggacgtggatgactggggaacagcggacgtactcaaaagactgctcgggaaattgaagagtgatcacattttgttgattagcggtgacttggtcagtgatgtccggctgcgtgacatgttcaagcagtacatggagaacaacgctgtcctgtcctgtctgctcaccgattcggctttgggtgggcctatccccgggcctaaaga

SEQ ID NO: 50617 - DNA, 640 bp, Heterodera glycines
  SCN-specific regions: Sequence locations=1-640
tttggatggtactgacggagatgaagcgctgaatttgaatgatttggatgaaaaagaggttcttggtgatgacgaggaggaccaacaccaaaatcaacacacaacaaaagaagaagtggaagacctttacgacgaagccatggctccgtccggtgcactctctgaaaagcgcgagtcggctgaagttatttcgtcgttgccaagttcgattcagcacaaatcgtcgtttgccatgcctatgatgatcaaatctgagcccggcattgctggcgggtcgcaaagtggcaaacgctactgctgctacattggcaatatgacttggtggaccacagacgatcaactccagaaactgattcaaaccctcggcgtcgacgatatgattgacgtgaaattctacgagaatcgcaacaacggacagagcaaaggttttgcgctggcagtgttcgccagtgaaccgtcggtgaaagcggtgatggagaaattgccaagcaaaaagctgcacgaacaatcgctggcggtgttgccgtacactaagcagtcgttggccaagttggaggaggccaccaaacgctacgaccagaaaagtcagaaggacgataaagtggtcaacattggcacagtgcgcattggcaccaatggc

SEQ ID NO: 50618 - DNA, 368 bp, Heterodera glycines
  SCN-specific regions: Sequence locations=1-62,85-321,344-368
gcgtcattggcactttcattgaatatttcatttcaaaatgagcaaaactcatccaccggaattgaagaagtacatggacaaacaagtcaacatcaagctcaatgggaacagaaatgtgtccggtattctgcgtgggtttgatccatttatgaacatcgtcgttgaagattgtattgagcacctcaagaccggcgaatcgcagagcattggaatggttgttgtccgtggcaattctgtcgtcattatggaaccgatggagcgaattgggtgactgtcgcagacagaaaaaaattggcagtgatcattggtctctagctttgttaattttactctttttgttcataaattttgctttataaaagaaaaaa

SEQ ID NO: 50619 - DNA, 541 bp, Heterodera glycines
  SCN-specific regions: Sequence locations=1-142,166-283,305-541
ttattgactctgaacattattgtttgtcatcgaaaaagacaaatggcgattagcaagggcactaaaattacgccaaaaggtggtaagggcggcaaaggaaagaagaagaagcttacgctaaagtttgtgatcgaatgcaaaaacccagtggaggatggcatcatgaagactgccacatttgaaacctttcttaacgaacggatcaaagtcggcggaaaaaccaatcaactggcggctaatggtgtcaaagttgaagccacgaagacaaaactggtcgttacatcggagcagccattctccaagcgttacttgaaatatctgacgaagaaatttctgaagcgcaatgctctccgggattggttgcgcgtggtagccagtgccaaggacacttatgagcttcggtacttccaaatcaatcaggaagatgaagatgaaagcgacaatgaagcatgagcgatttgccatttcttttgttgggtcgtattatttgttgcactttttaccagcgattaaaacttgttgaaagaagaaaaagagaaaa

SEQ ID NO: 50620 - DNA, 403 bp, Heterodera glycines
  SCN-specific regions: Sequence locations=1-44,66-403
ttttttgtccgcagaacgaatgtctgcgttaattccatttataattgttacactgttttgggctgtcattggtgcaggaggcccatttttggtaccaagtggtatgaacagagggatcattcaaacgatgatcgtactgaccgcagtctgctgttatatgttttggctgatcgtctaccttcaccagttgaaccctttgataggaccacaactgcccgtgaaaacgatttggtggattcacaacacttgggggaatgtgaagaattgatgatcgatgattgcagtgattttccacttttggatgtactattagtgaatcctctatttctgtgaaaaactggcatgacaaaaagacacatataattcttcaaccttttatttctataaaaattgctttattaaa

SEQ ID NO: 50621 - DNA, 456 bp, Heterodera glycines
  SCN-specific regions: Sequence locations=1-15,38-233,255-456
ggagcaaaagcccaaatgataacaaagaggaggaggaaactcaaagcgccaaagaggataagactgatcataaaacaaatgagcaaatgttgctggtgaggaccggactgaaactgaagcgtggcactctcttcaagaagaagcgaaatgttgacccgaaaacaatagatctgaccataaagaaggaacaagagggcccgcggaagacgaaagccgaattggcatttctcaaacggcaggaggagacggcgttcgaccgtttgtcaaagagggcccaaatcagtcaccgggagaaagtggagaagttcaacaagcaaatggaggaactgacggaattcaacgacatcccaaaggtgtcttggaccaaatgagaaggaaggaaaaatactactgtatcatatattacatttgcgatcacaatcagaaaaactaaagcaaatgcattcatttttagta

SEQ ID NO: 50622 - DNA, 415 bp, Heterodera glycines
  misc_feature (318)..(318): n is a, c, g, or t
  SCN-specific regions: Sequence locations=1-35,57-415
ctatcgtcaagatgcccgaacacccagccaaatccgcaacattgtctatcaaatgggagtttactcacatgcggacggctccgcttacattgagcagggcgagacgaaggtcctttgtgcggtttacggtccgcacgaatgtcgcttccgatcacgagccaaagaagacgaggccattgtcatttgccagtacagtcaggcaactttttcggttcctgacagaagaaacaggccgcgtggcgatcgtcgaggcaattccttttcccaccttttggagagggctttcgaatcagtcattttcacaaatttatatcctcnaagtgagattgatatattcttggagctccttgatgctgacagcgccagtttggtcttctctataactgcctcgctcccgttcgtaacgataagcatt

SEQ ID NO: 50623 - DNA, 522 bp, Heterodera glycines
  SCN-specific regions: Sequence locations=1-522
atgcccgaaaaattccacatattcatcgtgtgatgaatacaaacattgatggcaaccgtaaagttccttgtgcccttacagcgatcaaggtggttaagctaatattttttgagtttttttcatcttgaagggagttggtcgtcgttatgctttccttgtttgtcgcaaagccgacattgacattcacaagcgtgctggagaactttctgaggaggacatggaaaagctgactactgttatgttgaacccacagcaatacaaaatcccaagttggtttttgaaccgacagaaggatattcgcgatggtaaaaatcaacaggttttgtccaccaatttggagagcaaataccgtgatgactttgagcgcatgaagaagatccgtttacatcgcggtctgcgccattattggggtcttcgtgtgcgtggtcagcatacgaaaacgaccggacgtaaaggacgcactgtgggagtgtctaagaagaagggaggctaaaacaaccgtttggttaccgatcatgaagt

SEQ ID NO: 50624 - DNA, 321 bp, Heterodera glycines
  SCN-specific regions: Sequence locations=1-321
tggcgattgtgtttaggaaagatcagacgaaaagagatggtcagattgtacaaagtgaaaattatgcgttctgatggttccgtcattttcggacgttgcgacgaaccgagggaaatcattcaacttccggtggaccttcggacactcagtgacgacgagcgaaggatgcgaatagccgagcgaaagccaattgccaagaaagtggttgaggatacattggacgactccttcgactttcacaaatatgtgtctcaatggaagcgatgataaaaccctttctttgttcgttagatttttgaataataaaaatggtcaaattaa

SEQ ID NO: 50625 - DNA, 474 bp, Heterodera glycines
  SCN-specific regions: Sequence locations=1-327,349-474
atttgtggtggtttgttgctgcgtaagggtgcgtctgctgctccgcctttcgccgtcagaaatgccgtccaaatggcctctccgacgaaggtgatgggtccgcatgccttccattacaaatttgaacgttattacgccgctgcgattgttccgctttttcccctcgcttatttcgtccacgcgcccctcgtggattatgctttaactgctgcgattgttctccactcgcattggggcgtaatggctgttgtccaggactacgcgaggcccctggtcattggcaaaacgttggccaaaatggcgccggctgtcccttacatcgcttccgttgtgcttttggttggcttactgatgttcaattacaacgacgttggactgaccaaagcctttgaaatggtcttcagtttataggtgtcgatcatttgttaccgtagcattttaaatactgtataaaaattttatggaatatcaaaa

SEQ ID NO: 50626 - DNA, 444 bp, Heterodera glycines
  SCN-specific regions: Sequence locations=1-3,25-444
gccgtttctccctctttcactttttgcgtcgtccgttgcctttgttggtctttcgtcgttccctttttaaaccgccattggactcaccgttctgtggcatttaccggacaaatggcgaaatttgccggacggatgacattttggtgtgccaacgcaagatgaactatcaccctggagcaaatgtccgccatcaacgagatcggaaccagcacttgttgaaagcggtctgtgacggaacggttgtgatcacacgcgagcactgcgaagtgaacccgaagaacgagtggatgtacgcgcagtacgcgtaccgcgactttgagaacatttacaagctgaccttcaacgtgataccacgacggatgtccaacacatttaaactgatcagcgaagaatgaatgaccgacccgaaattttgtgtattttcgttgttttttatgaatgaat

SEQ ID NO: 50627 - DNA, 252 bp, Heterodera glycines
  SCN-specific regions: Sequence locations=1-212
gtcgaaggtggtgttatcacattgcacacgcgcaaagtgctcaacaatcgacctcttttccgtaaacagatggttgttgacattctccatccgaatcgcgcttctgtgcccaaatccgaggtgcgtgagaggctggccaagttgtacaagacgacacaagatgttgtggttgcgtacggtttccggtgtcaatttggaggaggtggtaggacagggtttggttgtgtgttcaactcactctgttacaccaag

SEQ ID NO: 50628 - DNA, 609 bp, Heterodera glycines
  SCN-specific regions: Sequence locations=1-542,564-609
aactcaccagacacttgctccctctgctccctttgttctccccaaattgatcccccgaaatgaccgtccaattgtccgcccttttgctccctctcctcattatcactttgttatgcaattttgcgatggccaatttgattttccacaacattgaattcgattcggactgtatgaaggcgatgtgcatggcggacagcggatgcgaacagcaaggctgtgccgaggatgtgtttggccggctcggctgcggctttttccgcatgaatatttggcagtataagcaatgctacgagccgggacgagagattggcgaactgtcggagaccgcgtggattcgctgctcggaggactacgaatgcgcatcgaaatgcattgtgcaagtggccagcagattcaggttgaaatgctatgggaaaagcgactgcgaaaccatcgcacggattcacgacggaggagcaaatggatgccgcaccggagaaacgcttccctattggttcaatgtgaagtcgttttgtccggactgctgacgcacccatcaaaatcagcagagaaaaaggcagagaaagaaaagaaacaaaatttggccattttcccctcttaaggcataaa

SEQ ID NO: 50629 - DNA, 522 bp, Heterodera glycines
  SCN-specific regions: Sequence locations=1-499
cccctcccaaatgtcttctcgcgcgacccccggtggcattggcttccaagtggtggcaaagcaagccagcaaattcaatgaccaagagggcaagctgatcctggactgggtcaaaaagctaagtggtgaaaacttcagcacggatgggagccgtgagaatttctataaattgttgaaggatggcactttgttgtgcaaattggccaacggcattcagcccggatcggtcaagaaaattcaacaaccgaccggcaatttcgcctgtatggaaaacatcaacgcttttgtgtcatttgccaaggcccaaggagtgccaacggaggaaacttttcagagtgtcgacttgttcgaggctcgcgacctgtactccgtttgtgtcactgtgctttcattgggacgaatcttggagaagaagggcaagccgaaccctttctcttgaatggtcagcacttcaaacggacgaagaaacgtacaatttgtcaccccaaatgtttatgaataaatgcttttaaatttaaaaaa

SEQ ID NO: 50630 - DNA, 765 bp, Heterodera glycines
  SCN-specific regions: Sequence locations=1-284,306-688,710-735,757-765
caaaatggcgagtccagcattgcacactttcaacgcactgctggcgacgggcgcttcgctcctcactttgatggccttttactacatgttgaccggccaaggagatcgttttgacattgcgtggtttctcactgagacttccccttacatgtgggctggcattgctattgccgcatcgctttccctttctgttatcggcgtcggatggggcattttcactaccggttcatcaattttgggtggaggagttaaagcgccgaggataagaacaaaaatctcgtgtccatcattttctgcgaggctgtcgctatttttggcattattatggcatttgtattcgccgggaaattggggaaattcaccagagaaactgcgacgcaagaagtcattgtgaagaatttggccgcgggttatgcaatttttggtggaggccttacggttgggttcagcgatttgatctgcgggttggcagtaggaattgttggctctggggcggcacttgctgacgccgcgaacccagtgctttttgttaagattctgatcatcgaaatatttgctagcgctatcggactgttcggcatgatcataggcattgtgcagaccaacaaattcaacattggcaccacctgagggacgactttgccattgcttctcgtgtttctgtactttaccctctgcggacaatgaactgttttctgctggttgtgtgatcatagaatttaaattcgcatattttacatcagtcgttttttaacttttaaaaat

SEQ ID NO: 50631 - DNA, 530 bp, Heterodera glycines
  SCN-specific regions: Sequence locations=1-359,381-480,503-530
agcaacaacgacatcattttcggaaatgaggaaggcgttaattatttggcaccatggacatattcctgtctcatcaaaacttcgatagatcggttgaaaactgctttatctgagaatcgtgaagccatacatgctttaaatcatttacaagaagtctttcgtcaaattgaccgtgcttctccctcctttctttatgatttctcaaaacttttgctgatcgagtcgggcgttgcaggaactaatgtgcaggaatcgtaccttcgaatgcatgcaaacgcggccacagaagagctggaactgccacaatttgcacacattgcagaatttcaatatttggttgttacacttaattgtttgggttatttaaacttcgaaatgttcgctgaattttagtgcgagttgagttttgttttccgctttgaaatattttccatttttttctaattcattcaaagtttgacttgtctgagtttacctcatctctccctttctctttccttcacctgaagtgatctttttttacaatgtgt

SEQ ID NO: 50632 - DNA, 515 bp, Heterodera glycines
  SCN-specific regions: Sequence locations=1-52,78-80,127-515
tggctgcgccaaagactgttgcacgccgtgcccgaccgtaacgggcgaccagcaatgttttcgccatgttcgaccagccacaaattcaggagttcaaagaggcgttcaacatgatcgaccaaaaccacgacggatttatcgatgagcacgacctgaaggacatgttcgcttctcttgggaaggaagtctcggaaaagttcattgaaaatatggtcaacgatgcatcgggttctatcaatttcacaatgtttttaacgctttttggggagaaaattgactggcactgaccctgaagaggtgatcaaaaacgcattccaatgttttgatgaggacaacagcggaacaattgcagaggatcgcttgagagagcttctcaccacaatgggagaccgatacaccgaggaacaggttgatgaactgtttcgtgatgcgccaatcaaaaatggccgctttgactacgtggaattcacgcgaatgctcaaacactggacgaaggataaggacgaggaagataa

SEQ ID NO: 50633 - DNA, 518 bp, Heterodera glycines
  SCN-specific regions: Sequence locations=1-292,314-357,380-518
gatggtggtgttatcacattgcacacgcgcaaagtgctcaacaatcgacttcttttccgtaaacagatggttgttgacattctccatccgaatcgcgcttctgtgcccaaatccgaggtgcgtgagaggctggccaagttgtacaagacgacccaagatgttgtggttgcgtacggtttccggtgtcaatttggaggaggtcgcagcacagggtttgcaaatgtgtacgactcactcgactacgccaagcgctttgaggccaaatatcgcttgttgaggcaaggcgttggtcagaaagccgagaagggaggacgaaagcaacgcaaggagcgaaagaaccgccagaagaaagttcgtggtgttaagaaagtgaaggttcaagcgggcgaaaagtgagcaaacggagaaatgacatagaaacgagggatggagacgatgtttggtgttgttgaagttgcggccgagaggcttctattgttattcttcactcgttgaaaaaatgaagatcaattcactgg

SEQ ID NO: 50634 - DNA, 864 bp, Heterodera glycines
  SCN-specific regions: Sequence locations=1-93,117-828,858-864
ccatgcccgtcctgaaaagggagttcgtccgatccgaaccctggaataaatttttggcttttccaaaagattatgactttgcgtttgggttctaaattaaaattttccattttactccaaaatgttggaatcagaaaaaatccttttcgcaattcttataactatccgattacttttgaacacgtggttttcccgccaaataatcagtttaagttgccaacaatgcctcctgagcccatttatgacgagtcattgggagaaacgaagcacaaattgactaagcagtttattgaagcgaggggatttgagccaatccacacggagttgatccacaagcagtacggcttggtggcgatgagcggtggttttatcaaagccgaagactttgcatggattcagcaggaagtgaatgagaaattagtcgataagcaattcgccatttggcgcgttgacgccccgtggcttccgcgggtgcggcgtccgccatcaacaaaaaagggcggtgggaaggggcccatccatcactacgagacaccggtcagaaccggacgggtcattttggagctcggcgggtacatcactgaacaggaggctcgttctattttgatgcatctctatttgcatatgccattcccagtggaatttgtcagccaagaattgatggacaaacgcaagggattggagatgaaagtgcgtgcaaataacagaaacaaattcgattgggacacacttatcaaatacaacatgcagaattgcaaggcttggctgagtccgtacgatgtctattggaagtgccgatacgaatgaactacggaattgtttttgttctttattaattcaaaataaaagtttgttttacaaata

SEQ ID NO: 50635 - DNA, 350 bp, Heterodera glycines
  SCN-specific regions: Sequence locations=1-350
cgggggttccgaaatacaggacatccaaaccgcgtgttctgttccgtcgtttcaaccgccccttctatcaatacacaatgcgtccgttggtgcagtgtccccgttgcagcgcttcgcatgagccatgggtgctgtgcatggactgctaccgcgtgttgcgcgacgccacggagccaatcaaacgacggatggtgtcgcataacgcatacattggccagcgacagcagccgatgccgcgatggactgacgaaaatggcattaatgccaacccgtaataattgttttttccatttgattgtattggccatttttatttcttaaatagttattgagcaatttttgttaaaaaa

SEQ ID NO: 50636 - DNA, 500 bp, Heterodera glycines
  SCN-specific regions: Sequence locations=1-470,493-500
agacagcactgtgctccaaatcgcggaatgcttttctcttcaaacgcctcgtcagccccgtccaaattgattgccgtccaatcaccggcggtggttttggccatccaatgaccaggcaaaagatgcaaatgtacagcccggaaatgagggcagtcaattaccaacaaaagcgcacccacatgcatgcaattctcaccaagaaaactgttgaagaccgagttatgctcaacttacatttgtttgacaaggtggacaatgacaaattgacgttcgactccgattttttcaaggatcttgggattgattcgcttgactttgttgagtttatcattgcgattgaggacgaatttgagttcgaaattccggacggtgactcggacagaatgcgaacgccacgagatgtttacaattacatttgcgacaagtgcgatgtgtacgatggaatgtatgacaaatgctgccgtcaaaaaattgttcttttttaaagctaggacataaat

SEQ ID NO: 50637 - DNA, 446 bp, Heterodera glycines
  SCN-specific regions: Sequence locations=1-446
ctaaaaatgaataaagcgtttgtcaaagcagcactctgctccaaatcgacgaatgtttgcctcttcaaacgcctcgtcagacccgtcgtccaaattggctcccgtccaatcaccggcgccggttttggccatccgatgaccaggcaaaagatgcaaatgtacagcccggaaatgagggcagtcaattaccaacagaagcgcacccacatgcatgcaattctcaccaagaaaactgttgaagatttatttatgctcaacttacatttgtttgacaaggtggacaatgacaaattgacgttcgactccgattttttcaaggacctcgggattgattcgctggactttgttgagtttatcattgcgattgaggacgaatttgagttcgaaattccggacggtgactcggacagaatgcgaacgccacgagatgtttacaattacatttg

SEQ ID NO: 50638 - DNA, 759 bp, Heterodera glycines
  SCN-specific regions: Sequence locations=1-12,34-674,697-759
aacaatcaaaatgaaaggcttcttcgccctgttcgtcttcgccttcaccctttcggtgttttctgccgcccatttgccgcctttggacattaaccaaatcccggccgaataccgcgaattgatccccgaggaggtgaccaaattctaccacgagctgaccgaggatgacaaaaaggcgctgaaggaagtggcagaacgccacgaggaattccaaacggaagagcaggcaatggaagcgctgaaggaaaagagtgagaagctgtacaacaaagcggtcgaactgcgcacccttgtcaagggaaaaattgaccaattggtgcccgacgcgaaggcattcgttatcgggatgatcgaaaaggcaaagggaatgcgcccgaaggccggcgagaagccgaagcttgaggagctgcgcacggcggccaacgagctgatcgagaagtacaaagcattgaatgacgaagccaaagagtcgctgaagtccaacttccccaagattacgagcgtcatccaaaacgagaaattccaaaccttggccaagagtttgctgaaacaggaggcaccggccgcctaaacggcggcacttaagaaggaacggactgatcactgattaattgatggaccattgcgcttaatcttttgccattattttgtaccaaaaaaacagacagaacagaatgtgtgcatattcacatacactgataatataatattataataacttttctcagtcttttgtaaatggctaataaattgaattgc

SEQ ID NO: 50639 - DNA, 619 bp, Heterodera glycines
  SCN-specific regions: Sequence locations=1-493,528-619
ttattcaaatggggcgacacaaaaagactcagaaattccgcaataagcttcagaaactgatcaagccaaccgatgacagaataaaagatgaaatccgcgtgaaaaaacctcccaaagaagatgaaaatgcacttaaaatcaaggaagcgtgagttatggggtggggttagtgaccaatgaatgcgaaatgatagcccgaagatttcggcagcgatgtttctcaaatacaacacacaactcgggccccccttccacgtcattatcgacacaaattttgtcaatttttctataaaaaaccgaatcgacattatgacggggttcatggactgtctgtacgctaaagtggtgccgtatatttcggactgtgtgctgggcgaattggagaaaatgggacgacggttcaaacttgcgctaaaaatcataaaggacaaccgcttccagcgactccaatgcacccacaagggcatttatgccgacgattgcatcgttcaacgagtaacacagcacaagtgttacattgtggccacttgcgacaaggatttgcgtcaaaggattcgcaaaatacccggcgttccgataatgtatgttcgtgaccatcggtacacaatagaacgaatgc

SEQ ID NO: 50640 - DNA, 214 bp, Heterodera glycines
  SCN-specific regions: Sequence locations=1-214
caaaattcactactgcaagcgtccggacaacagcacaaagtcgtgcaaagctcgtggttcagatcttcgtgtccatttcaagaacacacgtgagacggcgcgtgccatcaattggcacgtggcgaattctgagtgacccgaggacatccccgaaccacactctctttgtgcggcttgttttgttatttggtggcgataaaatttgttgaacctt

SEQ ID NO: 50641 - DNA, 452 bp, Heterodera glycines
  SCN-specific regions: Sequence locations=1-452
cgcgcagataaaggctcagatggcttcggccgcgccgcccctcggcccttctttggggcagcgaggcgtaaacgtggcgaacttctgcaaggagtttaacaatttgacttcgactattcgatttggtacaaatttgcctatgtctatccacgtcaaaccggacagaacttacgaaattgacattagcactccgaccaccgagtggcttctgcaacaagcggcggggatacgacgtaaccggcaggaggaaggagaaatcgtcggaatgatttcggtgaaacacgtatacgaaattgccaaagtcaaatctcaagacaaatctctcattggagtgccgttaaaagaaatttgtcaattggtcattgagagagcggattcgattggcatcaaagtgcaaaatgaagatttagacccggaagaatataggaaattcctggaacatcgtcaggaag

SEQ ID NO: 50642 - DNA, 257 bp, Heterodera glycines
  SCN-specific regions: Sequence locations=1-8,31-31,53-257
gcagcatttgttgttgtaaataactcacttcagtgattttcttcagaatttcacgaaatcgcatattcaacgcatccgcctttttcttcagtaaactatgccctttttgagcgcctttcagcctcgttttcatcacagtttgagcccttaatgattatttttggtatggatttgttataaagtgtaagcgaaaactcacatccgtgacggaaaaactgcaatccgatctttgccaccaccagacatgtttaaaaaaa

SEQ ID NO: 50643 - DNA, 685 bp, Heterodera glycines
  SCN-specific regions: Sequence locations=34-112,135-135,157-685
cctcgtgccgaattcggcacgagggtttgagaaaggattttttctttttttattattccggcggcacatcatttctagacaattgcctcaaaatgagtgtttctccgccgattgctttcccttcgccttctcattgccatttttcttccattgaaagaaatttctctccgttttctgtcaattctcagcccgggcttcgctatttgcgccacgccagcggagttgtggtgctgacgttggacaaaagccatgtgttgatgcgggatcagtgcaaaaacattgcccaagtgttgtgggacatgtcgttggcaaagacttcgtcggccaaaagcaatgaaagcaaagggcgaaagagaggcgtggaccgtagcaaattggagccgactggaaagggaaaaaagggtggtcttccgatgtcgccgcagacacgcatttgtatcattcgcgacagtgatggggtggactatgtgattcgtgcaggcattcgcgcaactctgctggaagtgaacgacgaatggttgacaaaggagcccaatttattgcgtacagcagcggataaccaaggattcatcgcaattttgatgccaccaatcagcggaaatggattgcgcaatatgaaaataccaaaggaatttgacgggacagaagggggagaacgacgggacagagaaacggtgtggggcgg

SEQ ID NO: 50644 - DNA, 528 bp, Heterodera glycines
  SCN-specific regions: Sequence locations=1-63,96-528
atttcaatcaatttctttactaaatctgacatcgaatctgtaaattttatcaatcatctacccgaaaaactttattttttggaatctgatggacaagtttttcacaatttgaatgatatcgacgacggaaagctcatccaattgcattttcgagcatgtggaggaaaaggagggtttggctcgttgcttcgtagcttccgaattcacaagtcaagcaaccaattgatgtgtcgaaatttgcaagggcgtcgactggccgatgtgagggaagaagaacgattgaagaagtacatagcgaagaaggcagaacgggagaaggaaaagcagaagaaaaaggacgaaaaaattgaacgtcttaaggcgggaggggaaacaaagcaccaatttgaggaccagaaacatttgcggaagcgcgacactctcctggacgaagttgaggatgcggttgaagcaggcatggatgcgcttgaggtgaaagcggcttcatccgaacacgaagtcagcgaaacaattgccgacactgagccg

SEQ ID NO: 50645 - DNA, 295 bp, Heterodera glycines
  SCN-specific regions: Sequence locations=1-74,107-254,276-295
caaaaacctcgaagaaaactgacccaaaagggggaaaagcggcaccagcgaagaagaaagagggcggaggaggagggaaggccaagaagaagaagtggtcgaagggaaaggtgcgcgacaaactcgccaacatggtcttatttgaccaagccacctatgacaaattgtacaaggaaatcatctccgtcaaatgcgtggtgaagcacggttcccaattggtgtacacacgggccaccaaagcggaggaagcctaagaaaagggggaaacggggcgatttggtttttcctttttttt

SEQ ID NO: 50646 - DNA, 406 bp, Heterodera glycines
  SCN-specific regions: Sequence locations=1-110,132-406
aacctttgaaatttaccgctacaaccctgaaaagccggaacaaaaaccctttctccagaaatatgacgtggatttgaatcaatgcgggccgatggttttggacgcactgatcaaaattaaaaatgagatggatccaactttgacttttcgtcgttcttgtcgagaaggaatttgcgggtcgtgcgcaatgaacataggcggcgagaacactttggcatgcatttgcaacatcgaaaagaaaaccaaatattccaccaaaacaggcggcaaacgcataatgatacttttgattagaatatgtattttatgcattagttggtaataaacacatacattgtgattgccacttccatttaatttgtgctaatttttgtaactaaaaaataaaaatggacaccttcaaaaa

SEQ ID NO: 50647 - DNA, 488 bp, Heterodera glycines
  misc_feature (261)..(261): n is a, c, g, or t
  misc_feature (278)..(278): n is a, c, g, or t
  misc_feature (442)..(442): n is a, c, g, or t
  SCN-specific regions: Sequence locations=1-127,151-296,320-488
ttgatataaccattggtggaaaagcagctgggcgtatcgtgatggagctttattcggacattgttccaaaaacggcagaaaattttcgttcgctttgtaccggcgaaaaggggatgggaaagagtggcaaacctctccattacaaagggtctaaattccaccgtgtgattccaaatttcatgttgcagggtggcgacttcactcgcggtaatggtaccggaggggaatcgatctatggcgagaagttcgtggatgagaatntcaaagagaaacacacncagcccgggattctctcgatggccaacgccgggcccaacacaaacgggtcacaattctttgttacgactgtgaagaccgaatggttggacgggtcacacatacgattcgggcgcctcactgatggagtgggatgaggggaagcgtgtgagtgctccagcggtangttgggggcgcggcccagagagattccaatcgttccctgcggtcgg

SEQ ID NO: 50648 - DNA, 421 bp, Heterodera glycines
  SCN-specific regions: Sequence locations=1-104,126-159,181-421
ttatcgctgctagaatctatcaaacataaaaaatgattgaaattactgtcaatgatcgtctgggcaaaaaagtgcgaattaaatgcaatccgacggacacaattggcgacctgaagaagctggtgtcagcccaaattggaacaaggtgggacaaactcatcctgaagaaatggtacaccacttacaaggaccacatcactttgcaggactacgaaatccacgacggattcaattttgagctatattatcaatgacttgctgcgcgcgtgttcattacttttgtgatttacattacattttcccaataaattgcgctgtgttttagagaattttgagttgttagtttcgaccctaatggttcgaggctaatggcatatttatgcatccttcactaatcaaataaacccaaagaacaaaaaaa

SEQ ID NO: 50649 - DNA, 573 bp, Heterodera glycines
  SCN-specific regions: Sequence locations=1-573
aaccgaatcgaatggaccaaaagtgcttagaattcttgagattgtaaaaaatgcacaacaaaagcatgggcttagacacgaaaattatcgacgttacaggggttattgttcccgtcggatcgaagggattcgaaaatcactgaagtttatgcattcgtataaatgtgcgcctaaaaggacagcaaaattcattgcgcgaaatgtttctgctgagttaatcggagatttaagatttctccaaattgccgtgttcgaagtcgaacgtaattgggcttacgcaatgcaaatgaaatttgagatggtcgatttgccactttctcgcaaaaaatttcacatgagacaaaaattgcgtcgggcagtgaaaagtgctcattttttacattcgcttattaatgacaatccgctggtccatgaggtcactcgtgttgaaactgtttcttacgtgtctttcatcttcggcagtttggaactcgaactgaaaaattggaaacgagccatcgaaacttttgacagagcaagaatcggttactccgaactgcttgaacaagtcccaaacagcgatctcagcgaaac

SEQ ID NO: 50650 - DNA, 583 bp, Heterodera glycines
  SCN-specific regions: Sequence locations=1-503,526-583
attttttaaaaatgtcactcactggtgggactgtaattgcgttagcctacaaaggcggagttgcgatggccactgaccgtacagtttttgcatccggtgttcatcgttttcagaacaatacgcgccaatatcggttgaataattattgtctgatttctttctccggagactttgccgaattccaatggttgcaaaatttgctggaacgccgtcagatggaattacagatcgacgcggggatggaccatatgaagccgaagatggtgcacgcttttctcacctcactcttttaccaaagacggagcaaaatgaacccatttctgaacacaatggttgtctgcggcatgcaaccggtcgagtttcatgccggagaaattaagcctttcatcggcgtcatcgacatgcgtggcaatgcctatgaagttgaccatgtcgcgacagaaattggcaaatatttgcttcgccaaatgttggagacgcgacaaacgcaggcaaatggagcggaacaaatgagcaaagaagaagcacttcgaatggtcgcagcggcgttggaggtgtccgtcagtcgtaacagcagaacggg

SEQ ID NO: 50651 - DNA, 368 bp, Heterodera glycines
  SCN-specific regions: Sequence locations=1-189,213-338,360-368
gggatgtctggtgacaattcggcacttattgcagcggagcaagcggcgtatggcccattttttggctcacttggcgtcactgcggcgatgattttcaccgcggccgggtcggcctatggcacggcaaaatccggtgctcggtctctacggaatgattgtctcactgctgctaagttcctcctgaacaatggaaggaagaaagaaggaaagaatggcacgtctgctgaacattgtgccgaccgtcgtgttttgatgatcaaaatgaccagccaccgtatataatagataaataccgtattttccatccattcttttttactgtgcccccttttctcattttttactattacattttaaaacgtccaaaa

SEQ ID NO: 50652 - DNA, 280 bp, Heterodera glycines
  SCN-specific regions: Sequence locations=1-280
gggcaagccgacgagtgtgaaggacgttgaccaacatgagattgtccagtcggtggccacctttctgaagaagagtggcaagatcaagttgcccgactgggtggacttggtgaagtcgggcaaaaacaaagagttggcaccgatcaatcccgactggtattacgagcgcgtggcatccctcgctctacgtctgtacatccgttcaccagcaggagtcggctaattccgcaacttgtttggtggaataaatattcgtggtgtttcacccaatcactttacc

SEQ ID NO: 50653 - DNA, 490 bp, Heterodera glycines
  SCN-specific regions: Sequence locations=1-16,48-490
agagaccaaatcaaaattagaggcagaatttgaaaagcttcgaaatttggaaaaagatcgttcaaaatgcatgaccaacagacggcagttggagagccaactgacagagaattccatggtcaaagaagagttcgatcggttgaaaagcgatgccggcgttttcaagctgattgggcccgtgttggttaagcagaatttggaggaagcgaaacaaaatgtggcgaagagaattgattacattcggacggaaatcgaaagaattgagtcattgctgggcgatttggagaaaaacatcgaagtgcaaaaggaatccgtcgaacgaatgcgcgacactttccgacaaacgctggcggtggccactgccccaacggcgaattcgatcaacgcttaatgagtgaatggacgaggaccgatcagactgattgtgagactgatcacttctttcccaacccgaccaaattgttgttgattgattcgtttgttgatttgt

SEQ ID NO: 50654 - DNA, 399 bp, Heterodera glycines
  SCN-specific regions: Sequence locations=1-179,203-271,293-399
tgtgactttattcccatcctaatgccaccaacgagtaaaaaaacaggaaaggctgtcgcaaagcggtgccgaaacggaacaaactcgactccttctccatcataaaacacccattgaccaccgaatcggcgatgaagaaaattgaggacacaaacacattggtgttcatcgtggacgtgaaggccaacaaacatcagatcaaaagtgcggtcaacaagccctacaacatcgaagcacagaaggtcaacactttggtcacgcccgatcatacaaagaaggcgtatgttcgtctagccgccgattatgatgctttggacgtggccaacaagattggtattatctgatttgattctgcgctttgtttttttgttttttgcgcataaattgttgctgttaaaa

SEQ ID NO: 50655 - DNA, 315 bp, Heterodera glycines
  SCN-specific regions: Sequence locations=1-106,129-202,224-315
ggccgagaacatcgaagaaatccttgccgaaatcgacggctcccaaattgaggagtaccaacgcttttttgacttgttcgaccgcggaaagaacggttacataatggccactcaaattgggcaaattatgaacgcaatggttacatttcgcgccccacgctcaaaggactgctgcatgaaattgcacccgatctcagcgacaagggtttggaggcggcggtggacgaaattgacgaggacggcagcggaaagatcgaatttgaggaattttgggaactgatggcgggcgaaacggactaaacgaacgatcagaaa

SEQ ID NO: 50656 - DNA, 624 bp, Heterodera glycines
  SCN-specific regions: Sequence locations=1-92,120-624
tggacccccgggctgcaggaattcggcacgagggttcgttatttaggcttttatctattgattggatgaattgttgacttaggtagtttacctattaatttttccacattttttgccatggcttcaattgacttgtcacaagaagttcgcctttatgacaacaatgcggagcgcgatcgaattgacaacatggctgaactgtacgcgatggtcaacgcgttggagtgcctggagaaggtgttcagccgggattatatccacgccaaggagtacacggcggaatgctcaaaactgcttgttcaaatcaaggtggctttgcgattggttcccggcatgacaattgacgagtttttccgctcatattacattcaatgcccggccgcgttggagcgtattcgtgaggaccgacccattacggtgcgcgacgacaaaggaaatgctctcaaatgcattgcggacattgtggagctgttcatcacattcctggaccaattgaagctgaacattcgcgcggtggacgaacttttccccaatctgaacgacctttacgcctccatcaacacaatgagtactttgccggacgatttcgacgccaaactcagggtgaaatcgtggcatgacaag

SEQ ID NO: 50657 - DNA, 395 bp, Heterodera glycines
  SCN-specific regions: Sequence locations=1-205,229-395
gagaacgctcatacgaaaagtgaagacgaattgtttcggtttttcggcacagggccagacggactgacagaggaacaagcagacgaattgcgggataaatatggctataatgaaatgcccgcggaggaggggaaaaagctgtgggaattgattctcgagcagttcgatgatctccttgtaaaaattttactcctagccgcaataatttcttttgtccttgccttgtttgaggagcacgatgaccagacgagtgcagtcactgcgtttgtggaacctggtgttattctcccaatagatgcgactcaaccaactgagaattaccaagagtttgacaatctttacttggacatgaacggcattatccatccgtgcacacatccggaagaccgacccgc

SEQ ID NO: 50658 - DNA, 518 bp, Heterodera glycines
  SCN-specific regions: Sequence locations=1-19,41-518
taaagattcaacccctgcctaaatagtttttctttttcaccacaaatggcttcttcaacagcttcctcttcctcggcaaccaatgaacaacaaaaaatagtgaatggctttcaaaagcttcgtgaattgcaacaggcgaccatcaacgaattaaacaaaattcaaactgagcagagggaacacacgactgtgcttaagactgtgcagtctcttgaaccgaatcgcaaatgttttcgacaagtgggagacacacttttcgaatttacggcgtcagaattaattgtgctattggaagaaacaattaaaaggttcaaacaaagagtggacgaattggaaaaccaagtggtcaaagttggcgaggacatcaacgcgtacaaagaaaagcacaacatccgttttctgagcaacaaggacgtgatcgaattgcagaagaagcaagctctgtccaaaatttcccagctcgaccttggcccgggtggaaaatcacaataagacggacggaatcagttgctagcaaa

SEQ ID NO: 50659 - DNA, 432 bp, Heterodera glycines
  misc_feature (324)..(324): n is a, c, g, or t
  misc_feature (375)..(375): n is a, c, g, or t
  SCN-specific regions: Sequence locations=1-114,142-220,246-432
aaagcatccggagaaactttaagaaagtacatcgttgttggacgtaaactcccaactgcagatgacccaaatccgacactgcatgaaatggttatttttgccagcaaccacgtcgttgctaagtcccgcttctggtacttcactagcatgttgcgtcgtgttaaaaaaacacacggagaaattattgcatgtgaagaggtcttcgagaaaaagcctggctgcgtgaagaactttggcatttggctccgctacgattctcggactggacaccacaacgtggaccgcgagtatcgcgatgttggtgaagcgggtgctagtacgcantggggtcgcgacgggggcggtcgtcaccaccctcaaacggatggcgtgcanatcatggggagggaagccatcagggtggctcactgcaaccgggccatggtggaacag

SEQ ID NO: 50660 - DNA, 490 bp, Heterodera glycines
  SCN-specific regions: Sequence locations=1-64,86-458,480-490
ttgttattgtatttcttttccattctcggacaaaggccgaatcggatgaggaaggcgccgctgaccaaaacatttgggccgttttggtcgcggggtccaacggatggtggaattacaggcaccaggcggatgtttgccatgcgtggcatgtgttagtcgaccacggagtgagcccggacagaataacgcaaacggaatgccataacaaagtgatgcacactttcaacaaaatttgttttaatttctcaaagagtccgtacgttatgaaatatgcaaaaacattggccaatttgtgcgagcgaagggcggacacggcacaaatcgtggccattttgaaggaacaatgtgctcaaatggaaaagatggaagttcattagtcaaattaattaccaattgaagagataattggttcattgaaacggacgatgcgatgacgtcatccattcatttatcatttggataatttgttaaataaaataaaggccaacgg

SEQ ID NO: 50661 - DNA, 773 bp, Heterodera glycines
  SCN-specific regions: Sequence locations=1-685,719-773
ggaagaaactgagggcaaattattgcaaatccgagaaattttccacgacttgctgatgtccctcgaactgcaagagcacgtgcaatgggccgacatggtacagaaattctgttcccttgccggaatgtttgcgtcgctgcaacaactgatgagaaagccgggccataacaatttcgatgacaatgttaaactgatgaaaatgacacaatttgtgccgaagaatgtttcacttgaactcgacccgaatttgacgcatttaacggagggacgactctcaaactttggccacaatatcgttccgattttgctgagaacgaagctaaagccggaggtggaggaagacgagctgaacatcgaacgcgaccggtcgaagggagacattcccaaacagatcaaaacattgaactcgcacattgacatgctttgtggaaagttggctgatttcacaaaattgcacgtggtggacagacgcgaggcaccaagttattcacaagaagaaactgtaaaattggtcaaagcaatttgtctcggcagaggaatttatccaaaagctccctcttctgctcatcccgggtccgcagatgctggacgaagtacgagcagttctcagaaagcgaaatgattcttagatttttatgtatttttttacattatattgtttttggtggcttaaatttttgatacgaaaaaaaaaaaaaaaaaaaaaaaaaaaaaaaaactcgagggggggcccggtacccaattcgccctatagtgagtcgtattacaattca

SEQ ID NO: 50662 - DNA, 527 bp, Heterodera glycines
  SCN-specific regions: Sequence locations=1-416,443-527
gcaaaggaattttcatctcaaggcttgtcgaagggggactggccgaatcgacgggcttactgagtgttggcgacgaagtggttgaagtcaatgggattgaggtgaatggaaaaaagttggaccaagtcgctgatatgatggttgctaatgcacacaatttgattgtcaccataaaaccggctaaccaacgcaattccctgtagcgtaaaggaaaagccgaccaattcgcagttcaaagccaataccatcaatatttcaccggagatggttcttcatcatcagccgttgggaaaattggcactttcggaagcggtggaggaggaaaagtttacccgactgggcacgggtcgtctctgtatcatctgggaacggacagacaccaccaccaccaaatggatgaattttttgatgattacgctgaggatgaagatgaggatgaaatagtggaccacacaaagacagcgttaaaaatccattgaaaattatgcaagtttttctatatataatgacaaataaaaacttaactg

SEQ ID NO: 50663 - DNA, 514 bp, Heterodera glycines
  SCN-specific regions: Sequence locations=1-42,70-104,160-160,246 -306,328-328,372-384,419-420,445-445
ttctttccaatttcatcactttttctttcccaatgtaattgtaatatcatccttttaatattataatttagcgattgaattcaataccccttcaatttggctatcatgcaaatcttcgtcaaaactctcaccgggaagaccatcactcttgaagtcgaggcgagtgacaccatcgagaacgtgaaagcgaagatccaggacaaggagggcatcccgccggaccagcagcgcctcatcttcgctggtacatcaacttttaaaccgttgcagcatcatttttatacataacccttattttcagggaaacaactcgaggacggacgcaccttggccgactacaacatccagaaggagtccactcttcacctcgtcctgcgccttcgtggagggatgcagatcttcgtcaagacgctcaccgggaagaccatcactcttgaagtcgaggcgagtgacaccatcgagaacgtgaaagcgaagatccaggacaaggagggcatcccgccggaccagcagc

SEQ ID NO: 50664 - DNA, 561 bp, Heterodera glycines
  SCN-specific regions: Sequence locations=1-15,41-55,79-100,125 -143,169-187,217-561
tgcgcccggcttcgatggcatgcaaattttcgtgaagacattgacgggcaaaacgatcactttggaggtggagagctcggacactgtggacaatgtgaagacgaagatccaagacaaggagggcgttccgccggatcagcaacggctgatcttcgccggcaaacagctcgaggacggacgaacgttggccgactacaacatacagaaggagtccacgctccacttggtcctccgtctccggggcggaaatgggaagagaaacacgggtaagaacaagaaaagcaataaaaagcttgatcagaattgatcagcagcgaacgcaccatcacatgattgattggcacagtgattttccaccaccaaattcacaacacttttcccttttccgggttatctttgatttccattttcggttattgttttctgtttttctcctctatcttttgtaaaattctgttattttgatccttagttttatcatttatcatcgcatatatagaagttatcatagtccatatttctgtccctttttatttatttttttgactataaaacttttgg

SEQ ID NO: 50665 - DNA, 492 bp, Heterodera glycines
  SCN-specific regions: Sequence locations=1-175,217-454,477-492
acatcgccgatcagctgctggcattcagcgacgcgcacatcgctttggtgttgaaccgtcctgagaaaaacgaaaaactgagcgaattggccacggaacactcggagaatgtttcacagtttgacagtttcggtaccggcgacaatgcgcggatacgcgtctgctgggcaaatcgttgtgcgatggcattgtggcatttcaaatgggccaattcgaacgcacattcgacttggtctatccgatccgaacgcaattgtacaaaatcagtgggagcaatgcgcagcgagacattttcacccaaatgcttcttcacgcggcacttcgctgcgcggacaatgagagacggtcaaaagcgactgtcttaattgaggaaaggaacaaaatgaagccgaattcggcggtcattgaacgattgcttcaaaagcataagcaaacagcgcacaacaattgttgaattgacacattttcagcaaattataaaataaatctttt

SEQ ID NO: 50666 - DNA, 1498 bp, Heterodera glycines
  SCN-specific regions: Sequence locations=1-121,143-834,856-1311,1333 -1364,1418-1438,1460-1498
gtccaaataagattgaccaatcaaaaaaaaataataatgttgagccgtttctctaaaattattgtccgtggatatgcaaaagatctcaacctgaaggaagtgttggcaaacaaaattcctgaacacaacaaaaaggtggtcgaatttcgtaaggcccatggctctacagttgtgcagaacatcaccgtcgacatgatttacggcggaatgcgttccatgaagggcatggtcactgaaacttcggtgttggacccggaagagggcattcgcttccgtggctactcaatcccggagtgccaacagaagttgccaaaggcagagggtggtgaagagccattgcccgaaggcatttggtggttgttgtgcaccggcgaaattcctgaccagaaacaagtgaacgcgatcagcaaggaatgggcatcgcgtgccgatctgccagcccatgtggcccaactgttggagaatttcccgcccaatttgcatccgatgtcccaattcgtggccgccattgccgcgctgcaaagcgagtccaaatttgccgaagcctactcaaaaggtgtgccgaagagtacctactgggagtatgcgtacgaagactcgatgaacctgctcgccaaactacccaccattgcggcaatgatttacagaaatctctaccgtgatggttcttccgtgggtgtgctcgacccgaacaaggattggtccgctaacttttgccatatgcttggctacaccgaacgcgaattcgtggaactgatgcgtctctatttggtcatccattcggaccacgagggtggcaatgtgtccgcgcacacgtgccatttggtcggctccgcgctgtccgacccgtacctgtcatttgccgcttcgatggccggccttgctggtccattgcatggactggccaaccaggaagtgcttgttttcttgacaaaaatggttgccgacattggacacgagtactcggagcagcaactcaaggaatgggtgtggaaccatctgaagagtggacaggtggtgcccggctatggacacgcggtgctgcgcaaaacggacccccgctacacgtgccaacgcgagtttgcgctcaagcatttgccggacgacccgatgttcaagctggtgtccacactgtacaaggtcacgcccgacattctgctggagcaaggcaaagcgaagaacccgtggccaaatgtggacgcacactctggcgttttgctacaacactacggcatgcatgagatgagctactacacggtgctgttcggtgtcagtcgggcactcggctgtctctcccagctgatctgggcgcgtggcatgggccttccgttggagcggcccaaatcgcacagcacggacggactgatcaaattggcggcggcggcgacagcagcgaaataaatattttagaccaaaacaaaaagagaatagaaccaaaccccaattattattattattagatgtattatggttgttaaagtgtgtgtaacttgtgaac

SEQ ID NO: 50667 - DNA, 314 bp, Heterodera glycines
  SCN-specific regions: Sequence locations=1-43,66-277,300-314
agacatggagattctctgggatgaaaaaatggcacgtgaactgggagataaggcacttaaagatacaattcgacaacgaggatgtcgaattcaaacctttgtcagcggactgcaaggttgttcatgagttcataggcggctacatttttctctcaatgcggagtaaaggccaaaaccaaacactggacgaggaagggttccatcgcctgactggaggatggggatagaaaattttatttgtaaaccacaaccgccatttcaatttgtcatagtttctcacatttaaacaaaataaaagcgacaatatgcaaaaa

SEQ ID NO: 50668 - DNA, 545 bp, Heterodera glycines
  SCN-specific regions: Sequence locations=1-161,183-324,346-545
accatgattacgccaagctctaatacttctcactatagggaaagctggtacgcctttcggtaccgggccggaattcccgggtcgacatcatcatcatggccgctaatacgactcactataggggaaaaagcaaaaggagcaaggcctggggaattggagaaccccagcatcttccagaaaatcattcttctcaacaaagagattattatcatggaagagaatttctgttgctttgtgttcggatggattaacatttaccttttcttccacacggcttttcgttataaatttgaaaagtacgtatacaaagttacccgtgaacgatttggcaaaatgaaggcttacattgacaatgaattgaaggaagccatcgagttccgcaagacttcaaaggagcaggccgactcgttgaaagcagtgcatgaaaactttcccacaattttccaagagaatttggcgctgcaacttgaagcgacctaccgaaaaaatgtggactacgcctggcaagagatgaagcgtcggttggattacctgcaggaagtgca

SEQ ID NO: 50669 - DNA, 523 bp, Heterodera glycines
  SCN-specific regions: Sequence locations=1-21,43-523
aattcgaatttacaataataaaatttttggtttagaattaaaatgctgtccaaatttgcaccaattgtggtcagtcgaacggtttccagcggtgtccgtcgtttgtccgccctttgcagcatttgctctgtacgctcgcgctccactcgcactaatcgacccccttaactcatgtaatggtggccctggcccggcatgaaaaagaattgcgtggacgctttgccgctttcgctgatcagcaccgtcgaactgactgacagttggttggttttgcgtcgactttgcttgttgatgaagtccaacacccattgaatggttatcgtcctactatgaacgcactggtcttcgttgctcagttccaatgttgacacatatttccgacgcaaaaccgaggcaccaaccgtcgacaatttgcgtccatagttgaacaaaacaccgacacacatcaatccggcaccgccggtgaacaacggatttgaggtgaacgcgtcgaaaaggcccccttttggggcatttgcgagtg

SEQ ID NO: 50670 - DNA, 542 bp, Heterodera glycines
  SCN-specific regions: Sequence locations=1-542
acctgattacgccagctctaatacgtcaactatagggaaagctggacgcctgtgctaccggggcggaattcccgggtcgacatcatcatcatcatcatggccgctaatacgactcactataggggtttccaggaggtaatttctccgaatatttataacgcaaagctgtgggagcagtccgggcattggcaccattatgcggagaatatgttccggttcgaaattgagaaggagcagttcggactgaagccgatgaactgtcctggacactgtctgatgttcgactacaaaccgcacgcctacaacgaattacccatccgttatgccgacttcggtgtactccaccgcaacgaaatgagcggcgctttgtccggtctgacgcgcgtccgtcgctttcagcaggacgacgcccatattttttgccggaaggaccaaatattgtcggagatttcgggctgtttggattttctgaattttgtctacgtggaagtgttcggcttttccttccgtctccatctgagcacgcggcctgaagagggcta

SEQ ID NO: 50671 - DNA, 425 bp, Heterodera glycines
  SCN-specific regions: Sequence locations=1-258,280-425
tttattcacacataattcaatgttggaagttgttctggaatatttgccatcgtggattcgcactcttaattcgttcatcgattatgagggtcagcgtaagtctgaacgtttttttccaggttattttgattgtccacggtgtgcttgggttttttgctggttatctcactcaacagctgtcggtgactatgtacagcgtcggagttggatttctgatctcttgtctgattgtgcttcccccttggccgttttaccgtcagaaccctttgaattggcaaccaaatagtccggtagaggaagacaaagctgcgaatccgtcatcatcatccggcaataagaattcaaaaaagactcgttgagtgtgatcataattcgatacggtttccttgtacactttcttattgttgataaaccgcttctgttgc

SEQ ID NO: 50672 - DNA, 435 bp, Heterodera glycines
  SCN-specific regions: Sequence locations=1-346,371-435
tctgacattaattttggaccctaaatttgtgaaataatttgcttattctcaaaattaccatccaaattgcttattgcatttaatacattgtcaaagcgaggccatgaagcgagtgtgtgtcgggatttggaattgttccaagtgtcacaagaaagtggccggcggcgcctacgtgtacgccaccaccaccgcggcaacagtgcgaagcaccatccgccgtctgcgcgagaccaaagagtgatttgccgaatcccaacggcggagaacaatggtggtgacgacgacttttgcaccccactgccactgttttttgttgttatgtgttgtttttgaatgaaaatgggaattgtttttgctttttgacatttcaacatttaaattatataggtagaagcaatatttccctgggctatcaaatttagcttatcttttgaa

SEQ ID NO: 50673 - DNA, 534 bp, Heterodera glycines
  SCN-specific regions: Sequence locations=1-534
tccgggggcggcgctctagactagtggacccccgggctgcagattcggccgagggtctccatcgacgaaatgattcagtccggtctctgccgactcacccccgacgaattgtgggccgtctgtcagccggaggttggcttaggcagggaaaagatcactctgcgcaaaggcgacggactcaacctgtacatgaacagagatttggcttccatttatgcgcgacatcgtctttacaacgcggacaaatattactatttggtggactatggccagaccaatcactttaaccaattgcgacttttgctgcgcatccgtggcgacgacgacttggcggaccgaatggaacacgtctctttcggtcgcatcatcggcctgtccacgcgcaatggcaaaaacgactcggtggactttctgattgaccagggcgcgcgcgaggcggatgcgtatgtgcacgcgtcgccgacgatgcgcgcggagccggccgaattgggcacaatttgccgacggttggccgagtcgacgctgctctttgag

SEQ ID NO: 50674 - DNA, 454 bp, Heterodera glycines
  SCN-specific regions: Sequence locations=1-273,307-454
tccccctaaacaaaggcaaaagccaaacagatcaacaaataaacacgtcagattagggtcgattcggaatggcacaatatgtgccgtggtattacaaacgctcaccgcccattttttgtggcgtttgtgtgcccgtttatttgggcgtttggtccgttcgtaagttcatcgttgtgcttggctttctgctctttctgatcggcgttctgctactgctcggtcttctgctcatttgcgtggccatcgaatgttccgctgcgtttgtcccccttcttttcttcgtttatttgtttttcttttcagtgccggtgctttacttccgttcgccttagtgcttatcattgctgggctactacttttgcactgcggatgggctgctcatcttttggacgttggcgagggaatgccgtacggtgaatattcgacgacaaaaacggtgagcacttcggccaga

SEQ ID NO: 50675 - DNA, 557 bp, Heterodera glycines
  SCN-specific regions: Sequence locations=1-16,38-148,170-467,489 -522,544-557
atgctgacgtgttacgaaatacaaaaaagaggaggatgtgctgtgttacactttgcacctgtatcagcgatcaatgatgtgcgaagcaccacccagctcgacaagcgttgtttaaatgcaaaatggccggtatcgcagcaggaagactgacggaggagcggaaagcctggcgcaaagaccatccattcggtttcatcgcacgacagtgcaaaaaggaggacggcacattggacctgtacaattggatctgtgccattcccgggcccaagtcgaccatttgggaaggtggtctgtacaaattgcgcatgatcttcaaggacgacttcccatccacgccgccaaaatgccgttttgagccgcctctcttccacccgaatgtttatccgtccgggacggtctgcttgagtctgttagacgagaacaaagactggaaaccgtccatcactgtgaagcagttgctgctcggcatccaggaactgctggtgtctccccacccggaggacccggcacaggcggaagcgtaccaaatttatgtgcaaaatcggcccgagtatgag

SEQ ID NO: 50676 - DNA, 572 bp, Heterodera glycines
  SCN-specific regions: Sequence locations=1-572
ttcaagaagggctttataccatcacacaacttggacaatcacttgcgcagctgcctctcactccttcttttgcgaaggtcgtcatcagttcaattcgtggcggacttcttccttttgccgtcactttggtgtcggctctctccgttcgtgaaccattattgttcatttcaagcacaaaagaggacggaacggaagagagacgaaaaagaatgtccgaagtgattaagcaaagatttctttggtgtgctgttggggaggctcgactctttggtgatttgacagtaattctgaacactgttggtgctgctgactatgaggaagagaacgctcgcgcaatcgaagccctaggacttcgccctaaggccctaaaggaaatcaacaaacagagacatcagctgacgcttcttctgaacaaatccgattctgtggagaagttgcccgagaagttcagaatggatgcaccctcccaagaacaactgaggagattaaggcatataatggtgaaatgccatccggataaattggcaaagaaagttcagtcattggatgcaccaaagggcgcatataaaaca

SEQ ID NO: 50677 - DNA, 543 bp, Heterodera glycines
  SCN-specific regions: Sequence locations=1-214,236-256,279-543
accatgattacgccaagctctaatactcatcactatagggaaagctggtacgcctttcggtaccgggccggaattcccgggtcgacatcatcatcatggccgctaatacgactcactataggggagaaatgcagtttcttcttttggattaaactacctaggtatccaacaaaaaaacattttagtccgcttttaaaaaaattaattgaacccctaatcttattagtcacagaaatattgcaagaatggctccaaaagagaaagaggttggaaagggatggagctttgctcattttttttggcatctaattaaaaaggaaacacgcaatgagaaggagagacacattttggcaaacggacgattggcactttcgtttttggcagttgcttttgccggatttgcccttctgtacgactacttttttccatttccaaagtcaaaaattattcttgcggtttgctccattagctatttcgtcatgattatggtcctccaggcgtaccaatggtacgttgagaagctgacattctttcaagcggagg

SEQ ID NO: 50678 - DNA, 537 bp, Heterodera glycines
  SCN-specific regions: Sequence locations=1-82,123-537
cctgattacgccagctctatttcttcactatagggaaagctggtacgcttccacggtaccggtccggaattcccgggtcgacatcatcatcatcatggccgctattacccctcactataggggggcattgatcagatgattatggtcggacattctttcggtggctatttggcctcgtcctatgcccttgagcatccgtcgcgggtgcgacatttggtgctggtcgacccttggggtttccctgaaaggccacaaattgaacaattgcacatcccaatttggatgcgtgtcttcggcagattgctctctctgttcaaccctttggccactttgcgtgcggctgggccttttggcgctcggctggtgaaaaaattgcgttccgaccttgggattcgctatgctcaccaggacccggacgccatttacgaatacatttaccaatgcaatgcgatggaacccacgggcgaaattgcatttggaacaatgtccaagaattttgggtgggctaagcgaccgatgattaatcgtttcggtggg

SEQ ID NO: 50679 - DNA, 694 bp, Heterodera glycines
  SCN-specific regions: Sequence locations=1-694
gacagcaacaaaatgggctgggaaaaagcttaaacggagtggtgactaacaaaagcgcaaaaagtttgacggagggcaaaatggcgctactcgaagaaggaaagacggaacagaatggagacgaaccatcgacaaaagtgaaaatggcggaaaatggaggcggaggaggggcagaggtggcccaaaacaaatttggttcctcttcaattcgcccggcttcatctgtgctcagtttcttccgttcctcaaaaccggaggatccgtacgcctcgaaactgttcacttttctgcaggtgctcacagcctgtttttccggatttgcacacggtggaaacgatgtcagcaatgccattgctccgctcgtgtcactgtacaccatttacgatgaaggcagtgtccatcagaagggcgagacttccgtatatttgctgctttacggtgctgccggaatgtgcgttgggctttggctgctcggccaccgagtgatctacacggtcggcgaaaatctgaccaggataactcctcccagcggcttttccatcgaatttggcgccgctctcacagttcttttcgccagcaaattgggtctaccgataagttccactcagtgcaaggttgggagtgtggtggccgtcggactggtccaagcacatccggtggtccattggactgtgttcaggaatatctctctctc

SEQ ID NO: 50680 - DNA, 346 bp, Heterodera glycines
  SCN-specific regions: Sequence locations=1-268,336-346
ggagaattgcgaatgtcgtcgattcttttaattatttttggttttaaaatgctctcaatccctaattaacggatgtgatttgagttatgtatttaaaagccgtaaaaatgttcagaaatttaccgcaaaatcatcagagagagaatgtccgccggtcgtgccaacattggcaaaccggcgccgaatttcagcgtctaagcggcggcggactttgactttaaaacggtgtcgttggacgactataaaggcaaatatgtggtgctgttcttttacccggaggatttgtgggttttttaaataattaattaaaaaataaatttattttttaaatttttggccatttttc

SEQ ID NO: 50681 - DNA, 482 bp, Heterodera glycines
  SCN-specific regions: Sequence locations=1-85,109-109,142-149,206 -274,310-397,424-482
atttaattctccacagtcaaacaaccaatctgcaaaaatgtccggacgcggaaagggaggaaagggacttggaaagggaggcgcgaagcgccatcgtaaagtgctccgtgacaacatccaaggcatcaccaagccggccattcgccgtttggctcgtcgtggaggcgtcaagcgcatctccggcctgatctacgaggagactcgctcagtgctgaaggtgttcttggagaatgtgatccgtgacgcggtgacgtactgcgagcacgcgaagaggaagactgtcaccgccatggacgttgtctacgcgctgaaacgccaaggccgcacgttgtacggatttggcggttgagcgggacgggaagaacggaggaggagaggaatcatcaaacaaaactatcccaaacggccctctttagggccacaaccattcaaatggacggatatgctttatcaacttattttaacgataaatttgatctttt

SEQ ID NO: 50682 - DNA, 603 bp, Heterodera glycines
  SCN-specific regions: Sequence locations=1-86,111-365,389-603
ccatgattacgccaagctctaataccactcactatagggaaagctggtacgcctgcagagaaccggtccggaattcccgggtcgacatcatcatcatcatggccgctattacgactcaatatagggaggaaatcgccaaaaaagcaaaaaaggctcccaaacaatgatgaaaaagagggaaagaaaggaaaaggaggaggtggttttctctcagccggttgtttgggtgaaacagaaaaaacgtaattttttgtgtaaaattatgggatcgccgggtcgacggtggtacagaattttggccatttctaatttgaatccgtctccatttttcagtcgttctcgctcgcgtgatttgccctcctcacgcggtggtggtggcggcggcggttactacggctcgcgtcgtttccatgacggacgcgacaacccaaatccgaacccatgcttgggcgtgtttggcatgagtttgcataccacggagcgcgacctgaagcatttgtttggccgttatggcgaggttgattcggtgcaaattgtgtacgaccgtctctcgggacgctcgcggggctttggctttgtctacttcacacacaccaaagacgc

SEQ ID NO: 50683 - DNA, 460 bp, Heterodera glycines
  SCN-specific regions: Sequence locations=1-231,266-361,383-460
cttcgattatttcactaaacaccccaaggacatgccccctctccgcgactatttgccccgtccgacgtgggtaaaacatggcaatgaatttccgttgcgacagcttttaccaggacattatgatgatcccgagtggcaccccaaagaccgcggttacgccggttcaccgcgttttggcgacaaaatacccgaagacatcatgatatatcgtagaagtcccaccgaagaagaagtgccatttctccacaaggcaatgcacaaattgatgtccatggtattttggtattgggttttctacacaatctattggcatcatcaagagcagtttacgggtgaatggtacttcccgtaccattacgaatggacggacgaggagctcggcgttccgcccgacgacgcgcctgacccggaggaacgccaattctggggccatccgggcgaactgatcggcacttaccgc

SEQ ID NO: 50684 - DNA, 384 bp, Heterodera glycines
  misc_feature (384)..(384): n is a, c, g, or t
  SCN-specific regions: Sequence locations=1-24,47-384
cgtggccagcgtgttcggcctcggcttccccccgttttggggcggtccgttccgtttcgtcgatttgtacggggcgcaaaagttgatcaagcacatggagcgctacgggaacatttactcggccgtgcaattcaaaccgtgccaactgctgtctgactacgccaaagcgggccgcaaattctacccaaaatgagcgtccgaagttggaactgtgacaacaaaagaattgggatgaatgagttcgttaaatgatcgatgatatatgctgccttttatttcaatgtttatagcgcaggacagatcagaaatttgtatttaataattatttcattagatcatttctggcgttttgacaccaaataaatttttcggtcctcaaaaaan

SEQ ID NO: 50685 - DNA, 399 bp, Heterodera glycines
  SCN-specific regions: Sequence locations=1-109,152-181,209-223,250-399
gttttctgtctgctttccattaaactaaactgtgctaaatatgtccggacgaggaaagggaggcaaaggactcgggaagggaggcgcaaagcgccaccgaaaagtgctccgtgacaacatccagggcatcaccaagccggccatccgccgtttggctcgtcgtgggggcgtcaagtgcatttccggcctgatctacgaggagactcgctcagtgctgaaggtgttcttggagaatgtcatccgtgacgcggttacttactgcgggcacgcgaagcggaagacagtcactgcgatggatgtcgtttacgcgctgaaacgtcagggccgaactttgtacggttttggtggctgagcagaacggtgacggaagagaacttcaaccaaaaacaatcccaaacg

SEQ ID NO: 50686 - DNA, 796 bp, Heterodera glycines
  SCN-specific regions: Sequence locations=1-299,321-762,795-796
cttcctgcaccggcttgtgcccttccgaaattcgttatttcctttcttttcgacctctgtttcgtcatttccgtcgtttctcttctgcccaaagtgcaggaacgaatgcccaattcggggctcatccaggccagtatgatgtcactgtacgtttgttacctgacttggagtgcgctcatcaataacccggacaaggagtgcaacccgtcgcttattcctcggcacaattccaccggcgacgcgggagggaatgtccaagtgatcaccacttcgctgcccgtcaattcgctcgtctctttggtcatttggttttgttgccttctctacgcttccattcgcacttcttcatacacggcactgggcaaaattggtggggcgatcagtgaaggaaatgccgaaggtcaggacatccctctgagcgaagcttcaatgtccgtcgaggagggcgaccgtgggacgacggggcgcaatgtttacgacaacgaaaaggggtccgtggcctattcctactcgttcttccacttcatttttgcgcttgcttctctctatgtgatgatgaccctcacttcgtggtacaccccgagcgatgatttgcgctatttgaacgacaacatggcatctctttgggtgcgcgtcatctcttcttggctttgcgctgcgctttacctttggactttgctggcgcccgtccttttccccgacagggatttcaattgatcaccaaacaaatgaaaatcggattcgaattctccaccttgtatcaaatataactttattataaatcacatttacaaaa

SEQ ID NO: 50687 - DNA, 433 bp, Heterodera glycines
  SCN-specific regions: Sequence locations=1-137,159-433
tttttaaaatttttaccagattaattctacagataaatgacaagtattcgaggtttgttgttcacgctcgcttctcccttgaaggcattttatgcaaatgtggcagtgaaacaaattgatgttacagggatgtccagcagtgttggaattcttcctacccatgtgcctacaattgcagtcttaaagcccggagttgtcaaagtccacgaacttgatggttgttccaaatattgtggaatcgttcaacattattcgaatttgtatcttgtgattgattttcaatgttttaggaaacgtctccaagtttttcgcttcttctggtaccctttcaatgaatattgacggctcgtgtcaagtgctcgctgaggaactttgttctcttagcgaactcaacgaacaggccatcaaaaatttgattgatgtcagccaaaag

SEQ ID NO: 50688 - DNA, 335 bp, Heterodera glycines
  misc_feature (335)..(335): n is a, c, g, or t
  SCN-specific regions: Sequence locations=1-141,183-335
accacggccaaaccgattcaagaattgctagggaacttattgaacaatttcagcctttcatttcatttcgtattcattaattagccgataaaaatgtgcgacgaagaagttgctgctctcgtggtggacaatgggtccggaatgtgcaaggccggtttcgcgggcgatgacgcgccccgcgcggtgtttccgtccattgtgggccgcccccgtcatcagggcgtcatggtcggcatgggacagaaggactcgtacgtaggactgcacttttgccgtcgtcactccccgaaaaatagtttcattttttgcgaaaataaaggctcaaattgttaaan

SEQ ID NO: 50689 - DNA, 404 bp, Heterodera glycines
  SCN-specific regions: Sequence locations=1-404
agccgaagacaaattcatcgtggatgaagtcaaatcaaatgaatgggtcaaggtcaactccaacttctcttcgttttttcgcgtccaatactcaccgaacatgctgcagtctttgctggatggtgtgaaaaaccgcgaactcggagtgttggaccgttaccaactcgccagtgacctctacgcccttgtaaaatcttctcgcgtatccgtttcacactttctcgcgttgctcactgtttgccaggaggaggaggattactttgtgtggtctgcaattgactcgggcattggcagcatcgctcattcactgaaacatttggacgacgaacgcaagctgttggaccgtttcgagcgttttgtgtgcaaaatgattgaatccgtcgctgccaaattgggctgggaac

SEQ ID NO: 50690 - DNA, 399 bp, Heterodera glycines
  SCN-specific regions: Sequence locations=1-399
cgttgtcttcagtttattgagatggatgccggcttttacagagggacctcttcagagcaggacatccgtctcactgacaaggaacgcaaattgttaaggcaaatgaagttcgaaaatgtgcttgaaacaaaggtcgacttggcaaagataaatcttgatgttatcaagccgtggataacgcttaaactgaacgaaattctcgggatggaagacgacgtggtggtggaatatgtgttcacgcagcttgaggagaaggagctgaacccgaagaaaatgcaaatcaacctcaccgggtttctgaatgcgcgcagagctcgcgaatttatggtattttttcatctcttggatcaccttttgtcattttaggcagaaatgtggcaaatgtttgtcgaagcccaa

SEQ ID NO: 50691 - DNA, 517 bp, Heterodera glycines
  SCN-specific regions: Sequence locations=36-171,312-330,507-517
ttttaaaattattttctaatcattaatatttaattcctaattatgttttatcaaacggtgtgccttcttttgctgttgagcgcatcgaatgatgttgcggtttttggacaggaagaaacaaccacaacatcgactagtagtacaagtacgagcacaactagttcaaccagtacatcgaccacaccaactacaacatcttcaaccagtacatcaactacaccgagcacaacaacttcttcaaccagcacatctacatcaactacgccaactacaacttcgtcgactagtacatcaaccaccccgacaacaacttcttcaaccagtacatcgaccactcccactacaacttcttcaaccagtacttcagccacacccactacaacttcttcaactagtacatcgaccacgcccactactacttcttcaaccagtacatcgaccattcccactactacttcatcaaccagtacatcgaccactcccactactactacttcaaccagtacatcaaccacac

SEQ ID NO: 50692 - DNA, 543 bp, Heterodera glycines
  SCN-specific regions: Sequence locations=36-171,349-420,442-543
ttttaaaattattttctaatcattaatatttaattcctaattatgttttatcaaacggtgtgccttcttttgctgttgagcgcatcgaatgatgttgcggtttttggacaggaagaaacaaccacaacatcgactagtagtacaagtacgagcacaactagttcaaccagtacatcgaccacaccaactacaacatcttcaaccagtacatcaactacaccgagcacaacaacttcttcaaccagcacatctacatcaactacgccaactacaacttcgtcgactagtacatcaactaccccgacaacaacttcttcaaccagtacatcgacgactcccactacaacatcttcaaccagtacatcaactacaccgagcacaacaacttcttcaaccagcacatctacatcaactacgccaactacaacttcgtcgactagtacatcaactaccccgacaacaacttcttcaaccagtacatcgaccactcccactacaacttcttcaaccagtacttcaaccacacccactacaacttcttca

SEQ ID NO: 50693 - DNA, 394 bp, Heterodera glycines
  SCN-specific regions: Sequence locations=1-394
tttcgttgtcttcagtttattgagatagatgccggcttttacagagggacctcttcagagcaggacatccgtttcactgacaaggaacgcaaattgttaaggcaaatgaagttcgaaaatgtgcttgaaacaaaggtcgacttggcaaagataaatcttgatgttatcaagccgtggataacgcttaaactgaacgaaattctcgggatggaagacgacgtggtggtggaatatgtgttcacgcagcttgaggagaaggagctgaacccgaagaaaatgcaaatcaacctcaccgggtttctgaatgcgcgcagagctcgcgaatttatggcagaaatgtggcaaatgtttgtcgaagcccaagacagccccgaagggattccaacgagtttag

SEQ ID NO: 50694 - DNA, 559 bp, Heterodera glycines
  SCN-specific regions: Sequence locations=1-228,250-401,423-559
ttggtcgttttaagatttggcaatcggttcatttcgcgctcgtggagccgtgacgacatcgcttcggtgaccatttcgttcaaggagaacttcggcacccaaggccggggaggctattttgacaaaagcggcatcatccgggacgtcatgcagaaccatctgatgcaaattctcacattggtggccatggaaaagccggccacactgagcgcagaagactttcgcaacgagaaggtcaaagtgttgaaagtgatcaaaccggtggaattggaccagacggtgctcggccaatacattggcaacccactgggaaaggacgatgactcgcgcaagggctatttggacgacccgacggtgccgcgtggctccaccacgccaacctttgccaccgccgtgctgtttgtgcacaacgaacgctgggagggcgtgccgttctttctccgctgtggcaaggccctcaatgaacggaaggcggaggtgcgcatccaatacaaggacgtgtccggtgacatttttcccggaggattcgctgaagcgcaacgaactggtcatccgggta

SEQ ID NO: 50695 - DNA, 515 bp, Heterodera glycines
  SCN-specific regions: Sequence locations=1-460,482-515
acctgattacgccagctctatactctcactatagggaaagctggtacgccttacgaaccggggcggaattcccgggtcgacatcatcatcatggccgctaatacgactcactataggggacacttttttcagcataatggaagtagaaaacgtaaagcttttcaaccgctggtcttatgaaaccattgaagtcaaggatgtttctttgcaagattatatttcagtaactcaacacccagtttatcttccacacactgctggacgttaccaagttaaaagattccgcaaatctcagtgcccaatcgtagaacgtctcgcatgttcccttatgatgcacggacgtaacaacggtaagaaattgatggctgttcgtattgtcaagcacgctttcgaaattatcaaccttttgactgacttgaacccaatccaagttttggttgacgcagttcaaaacactggacctcgtgaagactccaccagaatcggttcacaaggtaccgtccgtcgtcaagctg

SEQ ID NO: 50696 - DNA, 474 bp, Heterodera glycines
  SCN-specific regions: Sequence locations=1-474
gttattttattatattcgtttatactcctcgaaatttaacgcaattacacagctaaataccgctttaaaccatggcaaatccttcgattaacgctaaggcggcagttttggtggacaatccgcgggttgaatttgtgcaactcgactcattggtggtcatgaaaattgtgaagcacggggacatcgaattctatgccggaatgtccaaaattgctggcgaaacgtgccaaggcattctcaccggactgatctccgtcgaggacaagcggcttgaagtcacttgcgacgacagttggtctcctgaacagaccaaattggctggggtcaactttgccaatttcttcgaagaattgccaattgttgtgaagaacagccatctgatgaacgttctgttggccgagttggcactttccaccaaatgccaacgcgccgcttccatccgactcgaattgggcaccaaacagtcgctggaga

SEQ ID NO: 50697 - DNA, 435 bp, Heterodera glycines
  SCN-specific regions: Sequence locations=1-127,149-435
tgacatttacaatggttgaaccaaaaattccaacaacaagcgattttaacgaagaaaaccctgtaaaatcgacgccagaatcacattcgttaatcaagaatggattttttatgagtgaagaatatgggatgacaacgaaaagtgtctacacttcacaaatttcacaatctgtgataaaagctggactttattctaagaaaaatctgggagtgcatgtttctgcggcgggtagtctggaaaatgctatttggaatgcaattgaaatgggttgtcgttcatttgcgttgtttgtccggaatcagcgtcgttggaatgcaaagcctatggatgagtcagttgttgagcggtggaattgtgcaattaaaaagacaaaattcccgttgcaccaaatcgtcccacatggctcgtatttgctgaatgccgggtcacccgacc

SEQ ID NO: 50698 - DNA, 434 bp, Heterodera glycines
  SCN-specific regions: Sequence locations=1-434
agtggcaaaacggcgattaacatgtacatcaattgtccaggtggcagtgtgacggctggcctcggcatttacgacacaatgcagcacatttcggcccctgtcgccacttggtgttaggcatttttaatttggagtggtggaattcagaaaaaagggatttatttcaccccaggcattggccaggcgagttcaatgggcagtcttttgttgacggtcggtgccaagggaatgcgcacttcgctgcccaatgctcgcattatggtccatcagccgagcggtggcgcttacggcacggcggcggacattgtgatcagagcggaggagatcaaccgaatgcgaaaacggctcaacgaaatctatgccatgcacacgggccaaacggtggaaactattgaccaggcattggacagggatcgtttcatgagcgcactgga

SEQ ID NO: 50699 - DNA, 580 bp, Heterodera glycines
  SCN-specific regions: Sequence locations=1-8,30-62,87-132,175-280,303- 315,360-369,393-405,427-490,517-534
gtgcattctctgcctctctgctgttctttgtgcttcattcacacaaacattttcgctctcttcaaaatgtctggacgtggaaagggtggcaaagcgaagaccggaggaaaggccaagtcgcgctcttcccgtgcggggctccaattccccgttgggcgtcttcatcgtctgctgcgcaaaggtcactacgccgagcgtgtgggggctggcgcgcccgtctatctggcagcggtgcttgagtacctcgcggcggaggtgctcgaattggccggcaacgcctccagggacaacaagaagacacggatcaacccgcgccatctgcagttggcggtgcgcaacgatgaggagttgaacaagcttctctcgggcgtcaccattgcccagggcggtgtgctgccgaacatccaagcagttctcctgcccaagaagacccatggcgaaagtcagtgagcgcaggacggtggtggaacggcattgaagaaaaaactatcccaaacggccctctttagggccacaatcatgcaattgaacggattggctaatttttgatttttaacatttaaataaatttgctcctttc

SEQ ID NO: 50700 - DNA, 457 bp, Heterodera glycines
  SCN-specific regions: Sequence locations=1-457
tgctatttatgagtctgcatttaactaaaacttaaccaaacagaaaaaatgttcgtaaaaacattttcgaataaaaccgttgttttcaatgtggacccgactgaactgtccgtcgagcaactgaaggcactgatcgctgaggaggaggaaattgctgtgccggaccaaagacttgtctttgctggttgccagcttgtggatggaactctgctcaggacttatggagttgatgctgattcaaccatccaccttgacctcagattgcttggtggtgggaaaaagcgtaagaagaagcaatacactggcccgaagaagcagaagcatgttcgcaagaaggtcaaactcgccgtgttgaaactttacaaggttgttagacattacaattgggagaaaaggtaaaattttgaagattgatgacaatggaaagattcatcgacagcgtttggaatgcaattcg

SEQ ID NO: 50701 - DNA, 360 bp, Heterodera glycines
  misc_feature (358)..(359): n is a, c, g, or t
  SCN-specific regions: Sequence locations=1-29,52-360
tccctttttcggtttatttttgtcactttatttgtccccaaaagcagaaaatgccgcgccaagtgctcgaattgtccgattacttcgctccattagctgccttaattatgttcgctttggccatcctcgtcttctctttcttcgtgatcaatttcttttacatcaccgatcgggacgacttgacagtgtttgagaaatttggtgcccatttgcacctctgtttgggcccccattcgatgtccgacatttaccgagggggaccacgggattatccgcagccccaaggaacggacaaggagatgaacagctgaaaagtcaaactatctgattaaataaacgattgtcaatacgctaaaannt

SEQ ID NO: 50702 - DNA, 437 bp, Heterodera glycines
  SCN-specific regions: Sequence locations=1-230,266-308,330-380,402-437
tctttagaatgggaaagccgaagggaattagaaccgcaagaaaactgaaaaaacatcgtcaggagcagcgctggaatgacaagcgttacaaaaaaaccaatcttggaactcgttggaaagccgatcctttcggcggagcctgtatagccaaaggaattgttctcgagaaaattggcgtcgaagcgaaacagccaaattctgcgattcgaaaatgtgtccgtgtgcaacttatcaaaaatagcaaaaagatcactgcttttgttccaaacgacgggtgcttgaattttatcgaggaaaacgacgaagtgcttgtgtctgggttcggacgaagtggacatgccggtggagacattcctggagttcgtttcaaagtagtcaaagttgccaacacgtcattgctcgcactgttccgtgggaagaaagagagacctcgttca

SEQ ID NO: 50703 - DNA, 525 bp, Heterodera glycines
  misc_feature (7)..(7): n is a, c, g, or t
  SCN-specific regions: Sequence locations=1-130,160-525
gcggggnggcgctctaaactagtggatcccccgggctgcaggaattcggcacgagggtcctttagggacaactgaactcctatttcttctcgccggaagactttcgtcgtccgtttgtgctcagcccgtgctgatggagaaggaggaggagggtgaaaagtcgatgaacgacctggtgaccgcttcgtccccaacagaagttcgtcctgcttctcctcccgcttcttcctccgtctccgttccgccatcagcagctggtgttcccccgtctctctatgtgcgtcttcctcagcccgacgaccctttctatttttgcgccctcgccgttggcctcgccgcagttccgcccattacttttggcatttccgggccgcctcttcacgtttttgtgcaggccgacggcgtaactgatgcaccgaaggtggagttggaagacaaacagttgtgggaggaatttcacaaatttggcaacgaaatgatcatcacgacgagcggaaggcgaattttcccctcaatgagtgtcaa

SEQ ID NO: 50704 - DNA, 450 bp, Heterodera glycines
  SCN-specific regions: Sequence locations=1-299,321-416,438-450
gtccatagtcagcacatcattggaatggcgccggaaagtttggcttaaccagggaagaagggagctaaacgagcaactcaaatggaaatcgttgacaatggggagggaacggagaaggaatgctcagctaatgcggatttgaacgcttcacaagttgaccaatccgagctgacgagaatggacggagaagaaactcagctgttgcaccagccattcatgctcaatcctgaacagactgtcaacgaatatttggaagcacatggggcaaatattgcggatttcttgcgcattgagatgggccaagaaaacaccaagacaaatgacagttctgttcactgctagtatcgaaattactaaaaagtcgctgaaactgatgaatgtcgtatcgccctcacaatttcaatgttgtgcaattcaaatttaagaaattataaaattcgtcacacggtc

SEQ ID NO: 50705 - DNA, 480 bp, Heterodera glycines
  SCN-specific regions: Sequence locations=1-71,93-326,348-480
ttacagagacgagggtccatttaagctttacatcccgctgatcactttcggccctttttcatctgtccatcgccaaattggccccaatttggccatcatttttctccggcactttgtgccaatgttcgccgtgttcgcttttgtgctcttttggcacggtctctcccccaattatttctgttgggtttctctcagtgcaaccgcacttatcgctgaacgcattggacactcactgcccaaatggcacacaatttggccatatttgttcagaggcgactttcgtccgacttaaagccgcttctatgcttttcactgtgataccaggcatttttggcattttctttttcctcggcctcaacggcgtcggcgccttcgttttccgttctctccttttggacggtctctcgcaaattttgtccctccgaattttctcttcaaattcggctggctttgtgctgctccatttttttctgctcggct

SEQ ID NO: 50706 - DNA, 484 bp, Heterodera glycines
  SCN-specific regions: Sequence locations=1-143,167-484
cttaaagcgaaaaatgtttgaagctaaatttacaaatgccgcccttctgaagaaaattgtggaagcgatcaaagagttggtcagcgaagcgccatttgactgtacagaaaattctatgtgtctacaggcaatggatgggtctcacgtggcactgatttccctcaaattggacattggccttttcgaagtgttccgatgcgaccgcaccattgcacttggactgagtatgggcgagctcagcaaagtgctcaaatgttccaaatcggaggacactttgatgattcgctttgaggacagtgagcaggacatggtcacgttcacttttgaggacaccaaaggacggaagcaggacatcacactgaaactgatggacattgacaacgaacacttgggcatcccggaccaaaaatacgctgccgtggtcgaaatgccgtccaccgagttccaaaaagtgtgccgtgacattgcctccttctccgactcg

SEQ ID NO: 50707 - DNA, 480 bp, Heterodera glycines
  SCN-specific regions: Sequence locations=1-245,268-480
gtcctattaagcagtttttgtttccttacctcattgacaattttttcttcattttgtgctgttttcatcatgagtgacgacaactgctgcggctctgttggtgcccgttctccgactggctccatctcatcaagcggttccgctgattatgacgttgccctttcgccaacccaattgcttgcaatggccatcaagaaacgtcgtcacttgctcgaggacaagcagcgcgactaccaacgggagctgctccactcgcacctcatccagaacttgtgtaagttcctcggtgaaggtcgagcgcgagtgaggcgacaccgccgcagttcatcgcggcgtaagttggtgagacatcgtcgttgggacgacgacacgagtggaaacggtgacgagaggggccagcaagtggtccctgacgatagccgatcgccttcctcttcccccaatccatcggggattgtgtttgagtcgacggttcagagc

SEQ ID NO: 50708 - DNA, 422 bp, Heterodera glycines
  misc_feature (422)..(422): n is a, c, g, or t
  SCN-specific regions: Sequence locations=1-196,226-329,355-377,410-422
gcgcatgtgcgaccgtttgacccaaatccaagaccttgtcaacgatttggccaaccacatgtgcaattcggtcggtgttctgcaggcgagtgccgggccgtgcgaatttgggacagctccggagacactttacaaaatcgccaacaaggtcaaaaacttcgccgtcatttacttggtggacatcagtgaggtgcccgacttcaacaaaatgtatgagttgtacgacccggtcaccgcgatgttcttcttcagtctatcgtcaaacttctttgcctccacacattgctgtgtttgaacaatggactgcacaaattctccattctgaagggcaataatgaacaataacaacaacaatcaatcatcgcatatttgatatttttgaacactttttaactgtttaagaaataatcgtttgattttan

SEQ ID NO: 50709 - DNA, 807 bp, Heterodera glycines
  SCN-specific regions: Sequence locations=1-77,113-126,149-212,234-807
acaattattttcattcttttctgttctaccgtacattttgtttgtcaaatggttgcacttttcttctccaaatttgttgttgtcccttcctcctcttccctcggtgtctcttcgtcctctgccatcctttccctcgtctctcttctgtcccccgtcgccctcccccaccggcgttcatttgccgtggtgaataacgtcaaaatcgtcgacccgatggatgtgcgcaaggacaatgtgtctacgaagaaaaaggatgatggcgttgcggctgaagtacgccgcaagaagaaggtgtacgcgctggccgaattcttagaccgtcccgaaaattggggaaagttcggcgcattagacccgtccgatcggcccgggcgttcgtggaccgttgaggagcttcgcctgaagagcaactccgacctgcacaagctgtggtacgtgctgctcaaggagcgcaacatgctgctgagcatggaccacgcgtacaaagtgcgcctccgcaacatgccgaaccccgagcgaattgaccgtgtggccgagagcatggaacgacttgaggcggtggtgcacgaacggaacgacgcctttttgcacttggagacgggcgacagcgcgtcgcccccgaaacggacggtcacttccttcatgggcttcacctacgatgagtacgcaactgaacattatcttccggccgaggccaccggggagaagcagtacgagcagccgatgctggacgaccaggcccatctgatgcaggtgctgtggcgggagaaggagcagctgaagaaggaggtggccctgatggacgag

SEQ ID NO: 50710 - DNA, 439 bp, Heterodera glycines
  misc_feature (439)..(439): n is a, c, g, or t
  SCN-specific regions: Sequence locations=1-280,302-347,369-370,392 -409,431-439
tccataacgccctggggcgggcccgcctacctgcacaggggatcttccagaaaggacctgctcgccgacatggagccgaacggagttgacattttccgcgtggcgaaaaaaatttcgccgaacattgtctactttttgccgaaaaacacccgcactgatcagttaattgcattggcaggccccggaggccgtgtggagttggagcaaacggtgcttaacgagaagatcaaggcgttgcatgcttattttggcctgttggcggccaattgagtccctcgtcttttttcgcgcttttctttggttgttacactcacggattatctcaaattattatctctttgaattcgttgcttttccattttctcttgatcattttgaaaattttgatattgtttcaccttctcttgctacaaattttccaataaattttcccatttcn

SEQ ID NO: 50711 - DNA, 421 bp, Heterodera glycines
  SCN-specific regions: Sequence locations=1-106,128-421
tgtctgtccgtctctactccaaggcccgcattctcggctacaagcgttcccagcgcaaccagcagaccaaccaggtcttgctccgcgtcgagggcgtcaacaccaaggaggacactgagttctacctcggcaagcgtgttgcctacgtctacaaggccgagcgcgccatcaacggctccaaggtccgcgtcatgtggggccgcattgcccgccctcacggcaactctggtgtggtcaaggtgctcttcaagaacaccgttccccccaagtcgttcggtgcccgtgcccgcgttatgttgtacccctcccgcgtgtaagagtcgctttgtgttcttgcgtgcccaacgagcgatgcaatcacaatgcttccatgacaaatgcatgaatgattcttgtttttgccatgcatcattgataccac

SEQ ID NO: 50712 - DNA, 556 bp, Heterodera glycines
  SCN-specific regions: Sequence locations=1-415,438-556
gggaatagacataaaccacaaatatgaccgcaaggttagacgtacggcacccaaaagtgaggatccgtacctgcgcgttttggttaaactgtaccgcttcttggccaaacgtgtggacaccagcaaacgctttaatgctgttgtgctcaagcgtttgttcatgtcgaagcgcaaccgtccaccactttcaattgcgcgcattgtgcgctatgtgaaaaagccaggtaatgagaaagaactcgtcgtctgtgttggctccgtgacggacgacaagcgcatttacaccgttccggccatgactgactgtgcggtgcgctttaccgacggggctcgcgcgcgaatcatcgctgggggcggagagtggatcacttccaaaagtgggattgcgggccccaaaggccaaaaaaccctgcttgtgaaggaacaacaaaggcgcgccaagcgaaaaacctttccgaccgccccgggaaggcttgcaatccttcaaaacgttgggttccgcgaagggaagaattttaacgtggaccccgcccccaaaacttccgggtacaagaac

SEQ ID NO: 50713 - DNA, 402 bp, Heterodera glycines
  SCN-specific regions: Sequence locations=1-402
ctaaagccaccaaaaatgcgtttgtccttgctccgtgccagcgagaaacattttggcaatttgtcgaaggcttacggttggtattacgttcgcattgctccggttgaacagaaagtatggaagggctttttctttgatgcgtttgttaagccggtcaaagagcagttgccccactggtggatgttcttcttccccgtagtcacttactttttggtcaccgactgggccaagaaagagtaccgtcgtctgggacggatcaaagaattcactgacgaagaatgaatgtcgaattggccattcggactgttatttgtaggaaagaccaccgagtcgacagaatataaatcgaatgttttggtactgtcaaattgtgtgttatgtccaaataaatttattagtgtt

SEQ ID NO: 50714 - DNA, 683 bp, Heterodera glycines
  SCN-specific regions: Sequence locations=1-64,122-122,167-188,212 -218,303-338,369-381,404-428,482-683
ccccttaaaatcgtcgctgctctctccgcacttctcaaccccacctcctccatacacacttcaccatggctgaccaacttaccgaggaacaaattgccgagttcaaggaagcgttctccctcttcgataaggacggcgatggcaccatcaccaccaaggagctcggtaccgtgatgcgctcgctcggccaaaacccgaccgaggccgagctgcaagagatgatcaacgaggtggacgccgacggcaacggcaccatcgacttccccgagttcttgaccatgatggcccgcaagatgaaggattccgactctgaggaggagattaaggaggccttcaaggtgttcgacaaggacggcaacggctacatctctgccgccgagttgcgccacgtcatgaccaacttgggcgagaagctctccgaggacgaggtcgatgagatgattcgcgaggccgatgttgatggtgatggtcagatcaactacgaagagttcgtcaagatgatgatgtccaagtaaactcgtacaccactgtccctttgaccagatcccgccaagtccccctttgtcttcggcaccacatctttccccttgtttttttccgtcccgcatcctaactatgtcttcttgtctgtcattataatttgaaacgttttcgtgggtacaacaccctgtcccatttgtttt

SEQ ID NO: 50715 - DNA, 835 bp, Heterodera glycines
  SCN-specific regions: Sequence locations=1-156,193-523,545-835
gaagctcaacattgccgacccctcgagcggttctcgaaagacctttgaaatcgatgatgagaagcgctaccacgtcctcatcgacaagcgcatctcgcaagagattcccggagaccaggtcggctacgagttcaagggctacgtcttcagaatcaccggaggaaacgacaagcagggtttccccatgaagcacggagtgctcgtcaaccaccgtgtgcgcctcctcctctcggagggccactcgtgctagcgcccccgccgtaccggcgagcgcaagcgcaatgcgatccgcgggtgcatcatcaaccacgacagcgcgggtgtttcccttgttgacttcaagaagggcgaggacgacattggcggtgtcacagacgtgactgtgcccaagctccttggttcccagcgcgcgtccgagattcgcaagacgttcgaattgacgaaggaggacgatgtgctcaagtacgagatccgccgtgaggtgcccgagaagtcgggctagcccgagtccaatgcccctaagatccagcgtcttgtgacccccttgacgctccagcgcaagcgcgcccaccatgccgagaagcgcatccgcgccgtggctgccccgtgaggccgctgcttcctacaagaagttgctcgctgaccgtgcccatgagctctacgccaagaagcacgccaagcgtgtccagcgtcgctcgtccacccacgcttcgtcgaccgcctaaggtcggtgacttggaagtctgcgaaaagcactttttgtcaaagtgtgcgtgtgtgtgtgctgctctctttttggatcgggatatatacattcatgcttgcttgaaaaaaa

SEQ ID NO: 50716 - DNA, 554 bp, Heterodera glycines
  SCN-specific regions: Sequence locations=1-554
cgcggtggcggccgctctagactagtggatccccgggctgcaggaattcggcacgaggattcggttattcgtccaagccccactacacacctgagcccgacattctttacgaactgttgggccattgtccactgtttgcggaccccgattttgcccagttttcccaagaatttggactcgcatcgcttggcgcctccgatgaaatggtggagaaattggctacgctctattggttcaccgtggagttcggcatttgcattcaaaatggggcaaaaaaggcgtacggtgcgggactgttgagctcatttggcgaattggaatatgcgctcagcggacagcccgaattggctgcgttcaacccgccggagacgtgccaaaccaaatacccgatcactagctaccaacccaaatattttgtggccgaatcgttcgcggatgccaaaaacaaactcgcgtactgtatttgtcgcgctcgcgttttgagcatttttaaccctccccgctcccgcagtacatggtcaacgagcataccaagacagttccaagtcaactac

SEQ ID NO: 50717 - DNA, 775 bp, Heterodera glycines
  SCN-specific regions: Sequence locations=1-775
agccattaaaacttattcctttgcattcgacctacaagaacagcctatagactaaatttgaagtatggaaatgcaagcatcgcccggtcctgactgtggctttaccaccccctcaagaacatccacaaacagtaaatttatcgtcgatgtgcctctttcgacaaaacgtgaaaagcttttgcgtggaactccgactcgttttcgacttcctcctgtgcgtcgtctgatgaagtccgctccgaatattcaccacagattctatttggcacgtgaccatatcgaaccatttgcgcaaatcgtttcattcaagcgatcagaagacaggccttcacttagcaaccgatatcggcccgaattggaggagacttatctccaacaatgctttgtacttcagggcagattgggccaaggcgatttcggagaggtggtcagtgtgcgttccaaagacgacggcaaattgtatgcggtgaaaagctctttggacatttatcggaacagcgctgatcggcgtgaaaagctgcaggaagcgtgggaagagcgcggccgactttacattcagacggaactctgctctcaaagcttggacgacatggcgagggagcgccacgaaataccggagccagaaatctggtattacctgatcgactcattgatggctctcgaacacatgcattcccacgacatcatccatgttgacatcaaaccgtcaaacatcttcgttacttcggatggcatttgcaaacttggagactttggattggttttcgatttaaaa

SEQ ID NO: 50718 - DNA, 465 bp, Heterodera glycines
  misc_feature (2)..(3): n is a, c, g, or t
  misc_feature (16)..(16): n is a, c, g, or t
  misc_feature (464)..(465): n is a, c, g, or t
  SCN-specific regions: Sequence locations=1-187,209-395,417-465
cnnccccaggggcgcncgaataattgtgccctccgcccaaagcttataggaggatgacttgcagcaaaatcttcaccattgaggatttgccgaaaagtttcttcggccccctccaatcgaatgaatattggctgactttctctttcactgacgggaaagacaaaaaattgggctgcgcgaggctttgggtggacgtgtgcaaataccatctgcaggacaaacagcaaaagtgcctgagggacccaaacgcatttaagaatttcatcaacgaaatcagcagtcaggcggagcaaatccgacagaggacaaacagcggatgaaagaagcggaaaaagcacgcagaaacgggtcactcccccccctccccccacaaatcagcccaatttgaggagaacaataaattaaacaccatttataatgtgactgactcattttcaatttgcccaatgaactttcgaaatccnn

SEQ ID NO: 50719 - DNA, 526 bp, Heterodera glycines
  SCN-specific regions: Sequence locations=1-52,74-526
gcggccgctctaaactagtggatcccccgggctgcaggaattcggcacgaggcccctctgttcaccaaatctggaattatattttcgttagaaataatgcaaccatttgtccattggtcgaaatgcatattcaaacgtccattttctaattcttcaaaattattttcgtcgtcattttcaatggggtttaattttgaatttaccgaagaacaaaaacaactccaagcggctgtaaagaaatttactcaagatgaaatcattcctaaagcgtcacattatgataagacaatggagtttccatgggaagtgataaagaaagcacacgccaatggatttatgaacgttgacattccgtcggattgcgggggtcttgacttggaacttgtaagcaacgtgctgatcagtgaggtcattgggtatggatgcaccggaattggaacggcaattttgggaaatgacttagccgcgactcctctggtcattggtgccaaagaagaagtcaaaaagaaatttttatcccgtttga

SEQ ID NO: 50720 - DNA, 536 bp, Heterodera glycines
  SCN-specific regions: Sequence locations=1-357,379-536
cgggcggcgctctagaatagtggatccccgggctgcagattcggcacgagatctttaaattgtcctaaaaaatggtccaatacaaattatattcttttgatgggcgcggtttgggtgaatcaatccgtctgttgcttcactatgttggccaaccgtttgaggacatccgaattaaagacatggaagaatgggagaaaacgtacaagccgaaatttttttacggaaaggtcccagttttggaggttgacgggaagccattgggacaaagtgctacgattttgcgctaccttgccgaaaaatttggcttggccggcaaagatgaatgcgaaaaggcgaaggctaacgaaatcatcgactttcaaaaggatgctaacactgatttggccccctatttatacgtcaaaatgggattccgccaaggcgatttggacaaattgcgtggcgaagtgttcgagccgggagtcaagcacattttgccactgtttgagaaacttttgaaggagtccgggtcgggctacatgctcaagtccggcctc

SEQ ID NO: 50721 - DNA, 481 bp, Heterodera glycines
  SCN-specific regions: Sequence locations=1-43,65-481
aaagatgaatgcgaaaaggcgaaggctaacgaaatcatcgactttcaaaaggatgctaacactgatttggccccctatttatacgtcaaaatgggattccgccaaggcgatttggacaaattgcgtgccgaagtgttcgagccgggagtcaagcacattttgccactgtttgagaaacttttgaaggagtccgggtcagggtacatgctcaagtccggcctctcaatggtggactttcaagtggccaactttctgtacacgtttaccaagttggagccggagactatcaatgcgttcccggagctgatcaaatacgttgaccgtgtccatgcgctgccccaactgcagcagtatttgaagcagcgcccgcaggaccgctgatcagtgatcagaaaagacgattttgaagaatgagaaaatcaatcattgagattaattcgataagttatcataagacaaagctttttctctaattaaacag

SEQ ID NO: 50722 - DNA, 496 bp, Heterodera glycines
  SCN-specific regions: Sequence locations=1-419,442-496
ctctgctaaccgcctttttcaatgtgcgaccgtttgacccaaacccttgaccttgtcaacgatttggctaaccacatgtgtaattcggttggtgttctgcaggcgagtgccgggccgtgcgaatttgggacagctccggaggaactgaagaatgaacccaactgtcgcctcttcgctcagcaaattgcacggaccgccaaagacatcgaaattctgatcgattctttgcccgccgacgaacaatcgttgtccgtggaagagcatgagaaggcgttgttggagttggacgacgaacgcgcacgggcggccaaagagcttgaacaagcagtggaaaaggcggagaaactgacggatcagttgggcgaacttttgtcacgcattgcgcgccttcaaatggaatcgcgcccgatggcattttccacctgaaaacaaccttttcaacccacattttttttgtcgaatttatttgaatattaatacgcataaattaatttta

SEQ ID NO: 50723 - DNA, 469 bp, Heterodera glycines
  SCN-specific regions: Sequence locations=1-469
aaaccatctgtactatgtgaagatcaacaatccacaattttgtgggctcagatatgtgggccgaatttctccggcaaatccagtttatttgagcttccaatgcggcaacgccgttggcattgccatccatgagacaatgcacgcgctgggcctgcagcatgaacagctccgagtcgaccgtgatctgttcatcaacatcaattgggcgaatataaatccgcaaaactatgacacatttgcgcgctcggagctggtcaaatacactagctatggcgtccgatatgactacggttccatcatgcattacgccagcaacattgcgtccaaatcagctggactgaaaacgatgacggcaaagaccaaccccggtgccaacgatgcgcagatgggccaacggagagggctgagtgcaacggatgttgaggaactgaggcgaatgtactgcatgccgggttgcgcggatgccaac

SEQ ID NO: 50724 - DNA, 327 bp, Heterodera glycines
  SCN-specific regions: Sequence locations=1-280,302-327
caccctaaacacttacgtcgcttgcgaagcgattcagcaggtgactgcgccgtgcgtttggaatgaccagcagtgcgagctgagcatccaactcgaccggggcatcaaactgagcaccaccggcgacggccaaatgctgtggcagtaccctttcgaggccattcgcgcgaccggcgacgatgggcagcaatttttgtggatggattttggggaaccaattggtgaacaggtgagcgaacgaacggaacagcacgagaccctaaccaaaacgaagaaattgaaaattgttttttatggaatgatcatcctcaaaaactattaactaac

SEQ ID NO: 50725 - DNA, 337 bp, Heterodera glycines
  SCN-specific regions: Sequence locations=1-74,96-337
gaacctttctgctctcgtgggtggaacattgggtccgggaatgtggcacggccgaatttcgcggggcgatgacgcgcccccgcgcgggtgtttccgttcaattgtgggccgccccggtcatcaaggggtcatggtcggcatgggaaaaaagaaccctacgtggaaaacaaggccaatccaaccggggattttgaacctaaataacccaattgagacgggatcgtacacaatgggaaacaaattgaaaaaaattggacccaaccttttaaaaaagaagtgggtgccccccccaagaaaaccggggcttttcaaaaaggcccccgttaacccaaagggc

SEQ ID NO: 50726 - DNA, 524 bp, Heterodera glycines
  SCN-specific regions: Sequence locations=1-1,49-113,155-224,246 -267,353-430
aaactagtggacccccgggctgcagattcggcacgaggattcccatcattaattagccgataaaaatgtgcgacgaagaagttgctgctctcgtggtggacaatgggtccggaatgtgcaaggccggtttcgcgggcgatgacgcgccccgcgcggtgtttccgtccattgtgggccgcccccgtcatcagggcgtcatggtcggcatgggacagaaggactcgtacgtgggagacgaggcgcagtccaagcgtggtattctgacgctgaagtacccgattgagcacggcatcgtcaccaactgggacgacatggagaagatctggcaccacaccttctacaacgagctgtgagtggtggtgccatcgtcagcattggcattggcactcgccgtcggtcacttggccaatccgtccctttaaggcgtgtcgcccccgaggagcacccggtgctgctcacagaggccccgctgaacccgaaggccaacagagaaaagatgacccaaatcatgttcgagacgttca

SEQ ID NO: 50727 - DNA, 489 bp, Heterodera glycines
  SCN-specific regions: Sequence locations=1-73,95-101,125-147,169 -307,354-452,479-489
gagcattgtgtcgacaaactaatcttattacattgcgctcgaatatgacaattcactctcgtaaagtggtggcctactattatgatggtgatgtcggcaattactactacggccaaggccatccgatgaaaccccaccgaattcggatgactcacaaccttctgttgaactacggactctatcgcaaaatggaagttttcagaccaaaggctgcgtcactagaagaaatgactaaatatcacagcgatgactatatgtgttttctgaagagcataaaacccgacaatatcgccgattttggtcgtcaaatgcaacgcttcaacgtgggcgaggactgtcccgtgtttgacggtctatttgagttttgccaaatttcaagcggtggctcaatcgcggctgcaactaaaattaataagaaacacgtggacgtcgcaattaattggatgggcggacttcaccacgccaagaaatccgaagcttccggatttt

SEQ ID NO: 50728 - DNA, 337 bp, Heterodera glycines
  misc_feature (111)..(111): n is a, c, g, or t
  SCN-specific regions: Sequence locations=1-31,73-121,150-289,311-314
tgctgctctcgtgggtggacatgggtccggaatgtgcaaggccggtttcgcgggcgatgacgcgccccgcgcgggtgtttcggtcatttgtggccgcccccgtcatcaggncgtcatggtcgggatgggacagaaggactcctacgtggaaaagaagggcaatccaagcgtggtattcttgaccttaatataccgaatggagaacggatctgtcaccaattgggacaacttgaaaaaaattttggaccccccccttttaaaacaaatttggtgtcgccccccaaggaacacccgggggttttttcccaaagcgccccctttaccccgaagggcccac

SEQ ID NO: 50729 - DNA, 298 bp, Heterodera glycines
  SCN-specific regions: Sequence locations=1-31,73-298
tgctgctctcgtggtggacaatgggtccggaatgtgcaaggccggtttcgcgggcgatgacgcgccccgcgcggtgttccgtccattgtgggccgccccgtcatcaggcgtcatggtcgcatgggacaaaagactcgaacgtgggagacaagcgcaatcaaaactggtattctacgctgagtaccccaatgaacacgggatctaaccaattgggagaactggaaaaaaatgggcaccaaccttttacaaaaactgggtgtccccccccaagaaacccctggttgctcaaaaggccccc

SEQ ID NO: 50730 - DNA, 558 bp, Heterodera glycines
  misc_feature (10)..(10): n is a, c, g, or t
  misc_feature (15)..(15): n is a, c, g, or t
  misc_feature (26)..(26): n is a, c, g, or t
  misc_feature (28)..(28): n is a, c, g, or t
  misc_feature (36)..(36): n is a, c, g, or t
  misc_feature (42)..(42): n is a, c, g, or t
  misc_feature (47)..(48): n is a, c, g, or t
  misc_feature (56)..(56): n is a, c, g, or t
  misc_feature (58)..(58): n is a, c, g, or t
  misc_feature (60)..(60): n is a, c, g, or t
  misc_feature (74)..(74): n is a, c, g, or t
  misc_feature (92)..(93): n is a, c, g, or t
  misc_feature (103)..(104): n is a, c, g, or t
  misc_feature (106)..(106): n is a, c, g, or t
  misc_feature (108)..(108): n is a, c, g, or t
  misc_feature (111)..(111): n is a, c, g, or t
  misc_feature (113)..(114): n is a, c, g, or t
  misc_feature (118)..(118): n is a, c, g, or t
  misc_feature (124)..(124): n is a, c, g, or t
  misc_feature (127)..(127): n is a, c, g, or t
  misc_feature (133)..(133): n is a, c, g, or t
  misc_feature (138)..(139): n is a, c, g, or t
  misc_feature (149)..(150): n is a, c, g, or t
  misc_feature (154)..(155): n is a, c, g, or t
  misc_feature (166)..(166): n is a, c, g, or t
  misc_feature (174)..(174): n is a, c, g, or t
  misc_feature (176)..(176): n is a, c, g, or t
  misc_feature (179)..(179): n is a, c, g, or t
  misc_feature (190)..(190): n is a, c, g, or t
  misc_feature (192)..(192): n is a, c, g, or t
  misc_feature (204)..(204): n is a, c, g, or t
  misc_feature (207)..(207): n is a, c, g, or t
  misc_feature (214)..(214): n is a, c, g, or t
  misc_feature (221)..(221): n is a, c, g, or t
  misc_feature (226)..(226): n is a, c, g, or t
  misc_feature (238)..(238): n is a, c, g, or t
  misc_feature (242)..(243): n is a, c, g, or t
  misc_feature (246)..(246): n is a, c, g, or t
  misc_feature (252)..(252): n is a, c, g, or t
  misc_feature (256)..(256): n is a, c, g, or t
  misc_feature (262)..(262): n is a, c, g, or t
  misc_feature (264)..(264): n is a, c, g, or t
  misc_feature (266)..(267): n is a, c, g, or t
  misc_feature (276)..(279): n is a, c, g, or t
  misc_feature (282)..(283): n is a, c, g, or t
  misc_feature (306)..(306): n is a, c, g, or t
  misc_feature (309)..(309): n is a, c, g, or t
  misc_feature (319)..(319): n is a, c, g, or t
  misc_feature (321)..(321): n is a, c, g, or t
  misc_feature (329)..(330): n is a, c, g, or t
  misc_feature (334)..(334): n is a, c, g, or t
  misc_feature (342)..(343): n is a, c, g, or t
  misc_feature (347)..(347): n is a, c, g, or t
  misc_feature (351)..(351): n is a, c, g, or t
  misc_feature (353)..(353): n is a, c, g, or t
  misc_feature (358)..(358): n is a, c, g, or t
  misc_feature (361)..(361): n is a, c, g, or t
  misc_feature (372)..(372): n is a, c, g, or t
  misc_feature (380)..(380): n is a, c, g, or t
  misc_feature (382)..(382): n is a, c, g, or t
  misc_feature (388)..(388): n is a, c, g, or t
  misc_feature (391)..(391): n is a, c, g, or t
  misc_feature (396)..(396): n is a, c, g, or t
  misc_feature (400)..(400): n is a, c, g, or t
  misc_feature (415)..(415): n is a, c, g, or t
  misc_feature (422)..(423): n is a, c, g, or t
  misc_feature (438)..(438): n is a, c, g, or t
  misc_feature (450)..(450): n is a, c, g, or t
  misc_feature (462)..(462): n is a, c, g, or t
  misc_feature (495)..(495): n is a, c, g, or t
  misc_feature (497)..(497): n is a, c, g, or t
  misc_feature (507)..(507): n is a, c, g, or t
  misc_feature (516)..(516): n is a, c, g, or t
  misc_feature (521)..(521): n is a, c, g, or t
  misc_feature (555)..(555): n is a, c, g, or t
  SCN-specific regions: Sequence locations=1-524,546-558
gagattaaantgttngggaagtggtntnttaatgangtggangtgtnngaaatttnantngtggattatgttgnggtgaaagaaaagggggnnaaatatttgnngnanagngnnggtngttaanagnagaagngtttnngtaagggganntgtnnggtggtggaanggttggtntngtnaatgatgatgnangggttgaataanggnaagaaantgatggnggtgngtattgtgaagnatgnnttngaaatnattnatttgntnannggagagaannnngtnnaagtgttagttaatggtgtgatnaanagtggacctngngaggattnnaagngtattggnngtgngggnanagttngtngaaaggaagtngatgtgtngnttttgngtngtgtnaatnagggaatttggttgntttgtannggtttccgggagggnggttttagaaanattaaaaagatnggggaatggtttggggatgagttgatgaatggngntaaggggttnaagaatttntaagnaattaaaaagaaagaagaattggaaggggtgggnaaa

SEQ ID NO: 50731 - DNA, 462 bp, Heterodera glycines
  SCN-specific regions: Sequence locations=1-55,83-137,159-462
tgggctttgatcagaaataaaaaccgttcgccaatctctcaatttttactctgataagcgggcttttttaaataaactgttgtttccgagtaaacacaatctttggtgaccgatcaagcagcagttttcttctgtcgaatttctctttttcttctgctgatcactcactttccccctaaggcgtgtttccataaacgacgcggcgaaaagtgcgcgctcaaagtgttgcgtgacaatgcgcgcagtcggcgcgagttggcgctgcatttgtcggtgtttgggcatccgcacgtggtgtccattgaagacatgttcgagaacagcttcgacggattcaaatgtttgctagtgggggtcgaattcatgggaggaagagaagtgctgaccatctttgagcagaacggacgattgggctactcggaaaaatgtgtgggccgaattgtgagccaaattggaagtggt

SEQ ID NO: 50732 - DNA, 497 bp, Heterodera glycines
  SCN-specific regions: Sequence locations=1-229,251-497
tttgagtttagtttaaacgggttggcgagagtaatgcttctttcgaaaatcccacctcctttttgtattgctttgcgcgccgcttccacaaatccgccggctcgtggcccaagtgtaaaaacctttgaaatttaccgctacaaccctgaaaagccggaacaaaaaccctttctccagaaatacgacgtggatttgaatcaatgcgggccgatggttttggacgcactgatcaaaattaaaaatgagatggatccaactttgacttttcgtcgttcttgtcgagaaggaatttgcggttcgtgcgcaatgaacataggcggcgagaacactttggcatgcatttgcaacatcgaaaagaaaaccaaatattccaccaaaatttaccccctgccgcacatgtatgtggtcaaggatttggtgccggatatgactctgttttacgagcagtacgcttcggtgcagccgtggctgcaaaagaacaaaccgaccaaattagg

SEQ ID NO: 50733 - DNA, 469 bp, Heterodera glycines
  SCN-specific regions: Sequence locations=1-469
caagtttgagacaatttatgcgttttaccattcaattacttcaaaaatcgcaacgttgttataaacttctttttgcaaattacaccaaacaagttgcttctgtgtcgccgcttttaattcatcgtcaaaatttgataagtttttcggccttccgcaatttttgctcttcaattgagacgaaaaaggaggaaatcggccgaatcaaatcgcaattggcaatcatttttacgtgtaaagtctgttccacgagacaggggcctaagcaattctcgcgttcagcttatgaaaacggcgttgtgctgatccgatgcgatcactgcagaaatcaccatattattgcggacaatttgggctggttcagcgatttggacggcaaaaagaacatcgaagagattttggcatcgaaaggagaggcgatcaaaaaggggacggcggtgttggagatggaagtgccagcggaggaggaggg

SEQ ID NO: 50734 - DNA, 549 bp, Heterodera glycines
  SCN-specific regions: Sequence locations=1-454,476-549
tggagctccccgcggtggcggccgcatacgaactagtggatcccccgggctgcattcctcgacacgaggaaacgattgaaatgagttttggcaaggaatgcgttgatttatttgggacgaaggatctgtaccaaattttgaaattggacaggagcaaaagcaacttgagcagtgcacaaatcaaaaaggcctattatcgccagtcaattctgtggcatcccgacagatttgcatcggcacaacatgacgaaacgacgcgcgagttggccaagcagaaattccaagtgatcggcagagcatatgtaattttgggggatagtgagaagcgcaaagcgtacgacgaaacgggttcgctcgacgatgagaacgaattttacgaaggcaaagattggtcggccgtgtggcgaggcgttttcaaaaaagtcactccggaagagatcgaagcgtacctggccaaattcagaggttcacaggaggaaattgacgaggttaaggaggcgtatcagaagcacaaaggcaacatggacaagatcatgcaaagtgtggtcg

SEQ ID NO: 50735 - DNA, 480 bp, Heterodera glycines
  SCN-specific regions: Sequence locations=1-480
aaagctggagctccccgcggtggcggccgcatacaactagtggatcccccgggctgcatgtatcaggcacgagggtcagaagttgtcttgagattgggccgttgggcggagtgtttcacttggccatggtgctaagggactgtctgttcgagaatcagaaccagcaaaacttcaaagacgcggcggaggcgaagtatttcggcacgattagtcttgacgaggcgacgcgcaaaggctgcgagcagttacgatggttcgtcgtgttctcctccatcacttcgggacgcggaaatgccggacagaccaattacgggtggtttttctcgacaatggagcgaatcatcgaacagcgccgtgcggatggtttccccggcattgccatccaatggggcgccatcggagacgtgggcgtaatccttgagaacatgggcgacaataacactgtggtgggcgggacactgccgcagagaatgccgagct

SEQ ID NO: 50736 - DNA, 683 bp, Heterodera glycines
  SCN-specific regions: Sequence locations=1-36,60-277,299-510,532-683
tcccttaacggtgtttatctcttaaaattaccgcagaaaaattcttaaaacaaaaattcaagggccggatctaaacagaacaaaactgttgcatacatttacatgcacttttcggtttgatgttgcatcccatttaaaaagaacggtgaacaaagggcaatcgatacgcataaaaatcgatcgtttttcggagtggacggagcaggaccagacggacttctgcaaacaccttctgcagcgcatgtgtcaccaccaacacggccaaattgaccaatttttgggcccaatgcttcagcgggacttcattgcgttgttaccaaccggtttggcggagaatgtgctccatttgttggacgccaagtcgttgtgcgcctcggagtttgtcagccgccggtggagtcgtgtcattgtcaacggattgctgtggcgcaagcacatcgagcgccaagtgcgcaacgacgcgctgtgggccggactcgccatccgacgcggatggaagaagtacttcttctgctccaaggaccaggcgacacgcgcaatttctcagtcgtggagacagccgaagaacggggaggacgcgttggagttccagcacaaattctaccgcgaactttacccaaaaatcactgctgacattcggcaaattgagcagaattggcgcgagggacgacaccgattggagc

SEQ ID NO: 50737 - DNA, 247 bp, Heterodera glycines
  SCN-specific regions: Sequence locations=1-5,49-58,82-169,218-247
ctaccaaaaaagcacccttttaaggatccgcaaattgcccttccaacgattggtgcgcgaaattgcccaggacttcaaaacggacttgcgctttcaatcggctgccatcggcgctttgcatgaggcttctgaggcttatttggacggtctttttgaggacaccaatctttgtgccatccatgcgaagcgcgtcaccatcatgccaaaagacattcaattggcccgacctatccgtggagaacgtgct

SEQ ID NO: 50738 - DNA, 259 bp, Heterodera glycines
  SCN-specific regions: Sequence locations=1-259
gccaaggcccgagtcgtttcacgctgacgacggtgaacgttattatgtcggtgcggacgtgggccagtacttgaaataccatcgcggaacgctgtacaaacgctacccccaactgtggaagcgaatggcatcggtggaaggaaaacaagaggaaccctgaagtttggctttgccaccctcctacataactttgaaaattatgcttggccaaagctaaacaagggttaaaaactttttggacggaaaaaaggaaaaattc

SEQ ID NO: 50739 - DNA, 609 bp, Heterodera glycines
  SCN-specific regions: Sequence locations=1-510,532-609
caaaaacgagaagttcttgaacattgtcacggacattatgcagaaagtgatcacgaagaattccgaacaaatgacatttttcatcggaatgaacggacaccaaaaactgatcggactaattgccaattgtcgtcaggaggcactgttatggagagttaccaaactgatggacaaaattgtgcagatggacgcggaaagaatggtcggcgcgggactattggaagcattgcaacgccatttggaccatccgagccaaagactgcttcgtcaagtgctgtcgtgcgttcgaagtgtcagtcacgtgccaaccgccgaccgaacagttcagccacttctgcagaaactgctccaacttcttggtcagtttaggacgaaacgaacgaacgaaaaccataaatttgaaagagctttttgcttgcttaaggaacgagtgacattcgcctaaaagaaaattgtgtggacattttggccaatttgtgcgccaacaattcccaaaataaatccttccttgttgagaacggcgcggtgccatcgatgtttcagttgctctacgagttggactccgttaggagcggaggaggagaacagccgacgggagacgaccccttc

SEQ ID NO: 50740 - DNA, 398 bp, Heterodera glycines
  SCN-specific regions: Sequence locations=1-15,60-252,294-398
tattcgtgtgttggagtcttccagcacggaaaggtggagatcatcgcgaacgaccaaggtgcagtaaagaccggacgtgctttccctcaaaatattgttaccatcccgaatttcaggcaaccgcaccacgccgtcctatgtcgcgttcaccgacaccgaacgtttgatcggcgatgcggccaataattttgtggcgatgaacccatccaacaccgtgttcgacgccaaacgtctcatcggacgcaagttcgacgacccggcggtgcagtcggacatgaagcactggccgttcaaagtggtgcagggagagggtgctcgtccgaaagtgatggtggaagtcaaaggcgaggacaaagcgttcttccctgaggaggtttcgtccatggtgcttatcaaga

SEQ ID NO: 50741 - DNA, 672 bp, Heterodera glycines
  SCN-specific regions: Sequence locations=1-240,264-312,342-555,579-672
gtgatgcgttctccatcaccgaccgataatgacaaagcgcgttccttaaatgtgtacagacgtaaattggccgaatataaagaaattgagaatcggcttaaggaattgcggactaaggaacgcgaaagtcacaaattgttcgacaagtcggaaaatgagattaaatcgcttcaatcggtcggtcagattgttggcgaagtgcttaaacaattgacagaagagaaattcatagtcaaagcgaccaatgggccacgatatgtggtcggatgtcgtcggaccattgacaaggagaaactgaagcagggcacacgtgtggctttggacatgaccacgctgaccataatgcgccaacttccgcgcgaggtggacccgttggtgtacaaaatgagccacgaagaccctggcaacgtgagctatgccgaaattggaggtctctccgagcaaatcagagaactgagagaggttgttgaactgccgctgatcaatccggagttgttcaaacgcgtcggcataacaccgcccaagggctgtcttttgtacggaccgccgggcaccggaaaaacacttttggccagagcggtcgcttcgcagctcaactggaactctctgaaggtcgtctcgtcggcgatggtggacaaatacattggagagtcgtcacgaaggatccgcgaa

SEQ ID NO: 50742 - DNA, 429 bp, Heterodera glycines
  SCN-specific regions: Sequence locations=1-33,55-159,181-429
ctacaactagtggatcccccgggctgcaggatctcggcacgagggctttgcctaactatgcctcttcattggacttctgtggacactcgcaacgcacttttgtgcgccgccgttccttccattggcgccttcgtgggctcgacgatggccatcaaagatcaggaattggttcaatttctcaagaatcaaaactttccttctttcgcccgttgttgcaaatacaattatttgctggccaacactgccgtcaccattccgttcggttacgcttcttatttggtctacaaaattggaggaggttttgattacacggacacgactgttgcattgggactgtacggggcgacggtgctcagcggctgttttttggtgcccatgctcaagaagcaggatactaaggcgctgactgccaacgctgttgtccttgcc

SEQ ID NO: 50743 - DNA, 499 bp, Heterodera glycines
  SCN-specific regions: Sequence locations=1-468,490-499
ctttattcattcaatggacgaatattcaagggagccatgcccacatcggatttatgcggatgctgggagtgcttttgccatgggactgatcggcggttctattttccacggcataaaaggcttctcaagtgcgccgagaggacaaggacttcttaacatcgctcgagaggttcggatgcgcagtccggtgacgggctctcaattcgccgcgtggggtgggatgttctctgtgatcgactgcggcctcgtttatatgcgtcgaaaggaagaccctctaaattcgatcgctgctggcggtctgaccggcggtttgctctgtgcacgaatgggttggaaaacggcgctggtgtcggctggtttcggtgcagtcattctgacgatgatcgaaggggtgggcattttgatgaaccgagtgatggtggcgcaatccgacgcagcattggcaccttcccccgcttaattgtccaatttgttcattttgttgttttagtccggtttt

SEQ ID NO: 50744 - DNA, 156 bp, Heterodera glycines
  SCN-specific regions: Sequence locations=1-156
gtttgagcaaataaactatggagcattatgatcgtgcaattacgattttttctccggatggcagactttttcaagttgactatgcgcaagaagcagtgaagaagggctcaacagcggttgccgtgaaaggaaaaaattgtgttgtaattggagtcg

SEQ ID NO: 50745 - DNA, 483 bp, Heterodera glycines
  SCN-specific regions: Sequence locations=1-483
caagtttgagcatttttatataaacaaaataaatatgagcgcggagcggaaaaagtccgtcttatttttgttcgatgtggacggaacattgacggcgtcacgacagtcaattacgccgtcaatgctcgcctttatgcactcggtgaagagccgtgtgcctgttgctgtggtgggcggttcggacctggccaaaatttttgaacagctcggcggcacgcaacaacgcgaccaatgcttggccctgttcgattttgtttttgccgaaaatggtctcaccggattcaaaggcactgagccgatgccatcggagtcaatcagcaaacaattgggagaggcaaaatgccaagaactgaccaatttctgcctaaggtacatgtccaacattgagttgccattgaagcgcggaaattttgttgaacatcgcaatggaatgatcaacgtgtcgccgattgggcgcagctgttcccagtcggaacgtgacca

SEQ ID NO: 50746 - DNA, 576 bp, Heterodera glycines
  SCN-specific regions: Sequence locations=1-194,221-485,511-576
gttgcacaaaggttcttaccaatgaagactccgcttgacagttcttacgaccatttaatcgaatctcccaaatattttttccatccatcgtccgtttttcgttcccctttgctgggagcgacaaaaggagcgaagattggactttgggttgatttgacaaattccgacaatttttacaacgaggaagaggttttaaacaatggaagcaaatttctaaaaatgaaaatggtggggcacaaacaaacgccgacgcctgagcaaacgacggcattcattgaagcgattgaccgttttatcacgaataacccggacgatgtgattgtggtgcattgcactcatggtttcaatcggaccggctttctcatctcggcctatctgtacgaaaagtgcgacatgagtatcgaaatggcagtcagagaatttgcggagtgtcgtccgaatggcatttacaagcagtactacttggacgaccttcgcaagagatacggcgatgaggacgaagacgagatgacattccccggaaggcctttgtgggagaacggaccgatcagtgacgacgaattcaccaacaacgga

SEQ ID NO: 50747 - DNA, 473 bp, Heterodera glycines
  SCN-specific regions: Sequence locations=1-473
tggccaggacacattcttcgaccagggctgtgtccgtgccacgtgtctttcgtgcagtccttcgggccaattcatcgcctgcggttctaacacgggaattgtcaatgtttacgacctgacaaaactctctccgagtttggccaagtcgaatgcaccaagaccagtacggatgttcgaccagctgaccactttggtgtcattcgttcgctttaacaacgactcgcaaatgttggcttttggttctgcagtgaagcgtatgtccggtcgcgtggccaattgttcttccggaagcgtatttcaaaatttccctgctaaacaagagcacttcgccagcgacaaattcacaacttgcgatttttccccgaatagtgcctttttttcctttggcacaaaacaaggaaagatgagactttaccagttacaccattctgatgtttactaaattttgttgttattaatttgataaattttaa

SEQ ID NO: 50748 - DNA, 530 bp, Heterodera glycines
  SCN-specific regions: Sequence locations=1-221,243-507
caaaaggccatctcttttactagcataacgggagaagtgcgcacggaagaacgtcagtcaagggtggatgctttcaacagaaccaacacgggacccaaagtgatgcttttatcattgaccgccggcggcgttggattgaatctgattgggggaaatcatttgtttatgattgatttgcattggaaccccgcgttggagttgcaggcgtccgacagaatccaccgtttgggccagaagaagaatgtgttcatccacaaatttgtgtgtgcctcgaccattgaacagcgcgtactccaattgcaggagaagaaaaatgccatggccacctcagttttagaaggtgccgctaaaaagttgggcaatttgagcaaggatgacgtgatgtatttgtttgagttggagaaacgtcccaacaatcagcagaaagctggccaatcccagaaaccgacaacgagttcccaaatgtgagacgacaaatggggatttttattgtacgtgcattactcatttgacatttatttatttatttg

SEQ ID NO: 50749 - DNA, 677 bp, Heterodera glycines
  SCN-specific regions: Sequence locations=1-51,73-202,224-228,251 -473,497-677
attttgcacctttttgccaccttttaagcctaataattaacaaatagcacgacaatttaaagagttgcaaaatgaccgcctctttgcaacaaattcgagcccaacccggctggacggcggacaaatgcaaagagcaaattgaggtggccaagagcgagaatcggacattccaacgccaaacgctgcaggcgcatctggtccatttgctgaacaaagagcacaaattcaacgaggccatccaattggctgctcaacttgtgcgcgagctgaagaaggtggacgacaaggatttgctggtcgatgtgcaattggaggagagcattggcttttaccatctgtccaactacacaaaggcacgtgccgagttggtcagcgcacggactatcgccaacaccaaatacactccgcccgccatgcaggcccgtctcgacctccaatcgggcattttgcacgcggccgacgaccgcgacttcaagacggcctactcctacttcttcgaggcgttccaggcgttcgactcggtcaatgagtcggcgctcgcgcagcaggcgctgaagtacatgttgctgagcaaggtgatgttggaccagtcggacgaagtgcactccatcatgacggggcaaaacggcacaaaaatatgccaaaacggagacggaggcaatgcacgccatcgcaga

SEQ ID NO: 50750 - DNA, 562 bp, Heterodera glycines
  SCN-specific regions: Sequence locations=1-89,111-562
gagtactctacataaagaaacagaaacagacatttctgttggcaattacggctcttacggacttgttcaatcgtctgagaagcgggaggatgttgtttttgtagaaattgagaaaataaatgctgattttgacggaaaagagatttggcttcgtggccgtctccacgactctcgcggaaaaggcaaaaattgttttgcgaaaattcggcagcggattcacagcgtacaggcggtgttattcgtgggagcagacattagcaaacaattcgttaaatttgtccaaaacattcccaaagaatcaattgtcgatgtttatgggcttgtggcgcgcacccctcagccggtcactgcttgcactcaaagcgatgttgagattaaagtgcacaaatttttcattgtctcgcaagcagagcctcggcttccgcttcaacttgaagacgcggttcggcccgacaacgaccaagaggaattggccgtagtcaaattggacactcgtttggacaacagagtgctcgacttgcgaacgccaacgagtcaggcaattttccgttttgcgggcggg

SEQ ID NO: 50751 - DNA, 659 bp, Heterodera glycines
  misc_feature (614)..(614): n is a, c, g, or t
  SCN-specific regions: Sequence locations=1-130,152-456,529-659
gtttatctttactcaacaatttgcggtttaataattaaagacgctaaaaaatggcacaacagcaagcgataacgaagaagcgtaaagctgtgcaagacggaattttcaaggccgaattaaacaactttctcatgaaggagttggccgaggacggttattccggtgtcgaagtgcgtcgtgcaccttcccgtactgaagtgatcatcatggcgacgcgcacccaaagtgtgctcggcgagcgcggcaatttcatccgcgaactgaccgcactcgtgcagaagcggtttggctattccgctggacaaattgagctctatgccgagaaagtgtccagccgtgggctttgcgcggtggaccaatgcgagtcattgcgttacaaattggtcggagggctcgccgtgcgtcgtgcgtgcgacggtgtgcgtgcctccatcgtggacaggaatgcccgtgggtagggaaagtgggggcagagggaagagaataagagagagaaaacgggaggaaaaaagagagaggacagagggatggacgaggacaggctaaggatagcgcgcggcgacatcgccgaaggcaccacgaacgaccaaaaggcgggagacacgcgacagaancgagcaagataacacacagacgaggaagaccaacagcaacaagca

SEQ ID NO: 50752 - DNA, 418 bp, Heterodera glycines
  SCN-specific regions: Sequence locations=1-37,76-200,222-230,270 -287,310-418
cttttcccgttcttttttgtttttttcattttaccagaaaaaaatatcattttaataaaataatattatttatttcacctatgttaaaatttggtctttttcaataaaaattcagattttttcttacaatggaaattttttgcctttttttccccctattttttacaattttattccgttttgcacaccggatcattttgaaacaaaatataatgttccaaattttcgtcaaaactctcaccgggaagaccatcacccttgaagtcgaggcgagcgaccccatcgagaatgtgaaagcgaagatccagggcaaggagggaattccgccggaccaacagcgcctcattttcgcgggtacatccgcttgatatgccaagatattaaatgtttcacgtaatccttgtttttaggaaaacag

SEQ ID NO: 50753 - DNA, 491 bp, Heterodera glycines
  SCN-specific regions: Sequence locations=1-491
cttttgtaaattctttatcgtccaacactaaaacaattcactttttgaagaagtatttacttcttgcacacaattattgcactttttcgcgcgaatggtctgagatggaatatgaaaggcgcgctgaggacactttggtggcactcactgagtatttggacacattgccggaccgtgtcgattgtgaatctgccttcgatgtttcatattcaatgggcgttttgaccgcgcacataagcccacgaataggcacttatgtgatcaataaacaaactccgaacaaacaaatttggctttcatcgccagtttctggtccaaaaaggtacgacctcagcgacaaaggccggtgggtgtataagcatgatggagttacgctacacgaattgctcgagaaagaatttagacacattttcaaaaacgatcaaatttcgttacatcagagttaaagatttatcgttttttataccgatataaattttatttggtaaaaa

SEQ ID NO: 50754 - DNA, 530 bp, Heterodera glycines
  SCN-specific regions: Sequence locations=1-530
gatcgaatgtggagctgtacacttgcacttcttcagagtgctcttccatcgactttctctttctcgtgattacatgggtggtgtatttctccattccaatcgcgcttccgcgtccccatcctaagctgatggcacgtgggcttcccccttcgacacagatccttatatgatcgtggagtgcccatcgtccgtatcttaagctctccacaaatttcgaaccgtcaaacaaataaaacttcggcactgtcaatgccccggggcacgaccaaaacggcggcacagcgaaggggcgggcggagaccgcgagaagcggaagatcaccagctaacggatgaggacaaagaccgacgggcgaagcgacgcgagcgcaacaaacaagcagcggcacggtgccgacggaggcgggaggagaaaatgcaaagtttgcaggaagtgagtgccaacaacgaaaggaaggcaaagggacggaaaagtgccactttctgtcattggttttttgagcaggtggacgaattgcggaagcaaaatga

SEQ ID NO: 50755 - DNA, 481 bp, Heterodera glycines
  SCN-specific regions: Sequence locations=1-7,29-245,269-481
tttgagatttgtttttgtgctttggtattccacgggttgttctccactcaatttgtgaagaaactgcacagcaacagcagtgaaaatggcctccggcgtgaaagtggacggcgagtgtaagcaggcatacgacgagctgcacaacaagcaccagttctcctttctgatcttccgtatttcggacgacgacacgacgatcattgtggagaagaaaggcgagaagaacgcgccgtactccgattttgttgaggagatgaagaaagtggtgggcgacggcaaacagtgccggtacgcggcggtggacgtgcacgtggaaattcagagacagggcaccgaagggtcgtccaacctgtccaaagtggtgttcgtccaatactgtcctgatgaagctccggtgcgtcgtcggatgctttacgcctcttccgtgcgggcactgaaggcgactttggggctggagagtctgctccaaatccaagcggcc

SEQ ID NO: 50756 - DNA, 487 bp, Heterodera glycines
  SCN-specific regions: Sequence locations=1-487
tttgagtgcgattaacccccttttttgaactgtttgaattttctgatcagtttgtttttacatcattcaatggacatcgttgacgaccctttgtccgagccttgccatgtttgtggtgacaaatccaccggcacacattacggcacggtttcctgcaacggatgcaagggcttttttcgccgtactattttacgaagtcagaagttcacttgtcgtttcaacaagcaatgcgtcatcgacaaaaactatcgctgtgcgtgtcgcttttgccgcttccaaaagtgtctgagtgccggcatgaaaaaagaagcaattcaatttgagcgcgatgcgattggttcgccgcttccgttgaaaaggcggcgcgtcgccgacgacggccgggccgaccattccccgtcaccgaccggtggacggacagcgaccgatggcattgggacggcggtgggccgacccgtaatggcacaaggggacggaaagggtcaga

SEQ ID NO: 50757 - DNA, 623 bp, Heterodera glycines
  SCN-specific regions: Sequence locations=1-4,27-151,176-208,230 -326,350-623
attatatgtgggtcctttttatttatcgatgataaaattgggcgaagccgcaaatgtcgggccgtaactgtccgaatttggcttgggcaacgcaaatgtccgtaggccgcaaatgtctggacaccaaagtttacattgtctagccccttaaaactttttaatattttatttttgcgtcgatgtttgtggatgcatctcccctatttcctgtttataaatttccctcctaatttgtaagggaagtgtaccacaccccgcggatgcaatatgtgctgtccgtcttgtggtcttccgacaacaaatttgtgttgtccggcagtgatgacatgaacattcgcctgtggaaggcaaacgcagccgaaaaacttggcccgctctgtccacgcgagaaagcggcgatcgaatacagccagaaattgcgcgacactttccaaggccatccggaagtgcggcgtatcgtcaaacatcggcatgtgccgaaagctatttacagtgccacgcgggagcacagaatcatacgtgaatcacagagaagaaaggacaaaaacaggcggaagaacacgaaaagtgccgcaacagaaccatttacgtcggagagggcgaaagccattgtcagcgaaggg

SEQ ID NO: 50758 - DNA, 535 bp, Heterodera glycines
  SCN-specific regions: Sequence locations=1-252,274-485,510-535
tatcgtttaatccacataaatcaattgcgcaaacgaagtccaaatggcagaagtcggaaactcgtacagaccgccgctaagcgaagagaaacaaaacgaactccgcgcaattgctcagaaaattcttcagccgggcaaagggattctcgctgctgacgagagcacaggttcgattggaaaacgcttcgatactattgggttggagaatacggagaacaatcgccgtcgctaccgccaacttttgtttaccacaccgagctttggacagaatcttagcggcgtcattctttttgatgagacattccgtcagtcaaccgacaacggagtccgatttgttgacgtcatcaaaaaggcgggagccgttgctggcatcaaagtggacacgggagttgtgccattggccggcactctcgatgaggggacgacccacggactcgacaaattgtccgaccgctgtgccgagtacgaaaagggcggctggggctccgccccccggcggtgtggcgtgggcgccgcgcggcccgaaccacgccat

SEQ ID NO: 50759 - DNA, 326 bp, Heterodera glycines
  SCN-specific regions: Sequence locations=1-326
ctaaagcctgccgctttttcattgttgtttcaaattctgtaaatctcttcaagcagaaaatgacgtatgacctcgagaccgctgaaagggctgcctatgcgccattctttggctacattggtgctgcatcggcacaaattttcaccgtgttcggcgcggcttatggcaccgcaaagtcggcggtcggcatttgttccatgggcgtgatgcgtcccgaattgatcatgaaatccgtgatcccggtcatcatggctggtatcatcggcatttacggcctcgtggcggcgagggcgctccccggcagggcgacctgccgcgtgggtgga

SEQ ID NO: 50760 - DNA, 475 bp, Heterodera glycines
  SCN-specific regions: Sequence locations=1-475
tgaaaactctgcaaccagcaaccaacatcattttgcacatcggtgctcgcgcaatgagctcaatgtccgccgctggcggtgccattgccgcatccgtcgaacaacaaccggcggtggagccagatcgatccacattctaccataaagatttgtccattgtccgtgccactgctggacaaatgcagcccaagccgctgggaacggttgatcagatcaaatttggacatcacttttctgatcacatgatggaggtcgattggtcggacaccgcgggatggaatcagcccgaaattagcccgttgcacagtgttcagcttcatccgggcgcaaaagtgcttcattatgcgattgaactgttcgaaggcatgaaggcttaccgtggcattgacgacagaatccgattgttccgtccagaaatgaacattgcacgcatgaagcgtaccgcggcacgtgcggcacttccggattttgatgc

SEQ ID NO: 50761 - DNA, 410 bp, Heterodera glycines
  SCN-specific regions: Sequence locations=1-167,189-410
aaatgtccccttctctttccgttgccaactcaaatgtctctcgaccgcttggccaaccaaaagtagcgggcttcaaagataaggataagccggaaagtgttcgtactagcaacattgtggcagcaaaggctgttgcggatgcggtgcggacgagtcttgggcctcggggaatggacaaaatgatccaatcgggcaacggagaagtgacaattaccaacgatggggcgactattctcaaccaaatgtcggttgtgcatcccaccgcaaaaatgttggtcgagctgtccaaggcacaggacattgaggggggggatggtaccaccactgttgagggggtaggcggggcgagcatcaaccctgccgacaaacttcttggcgaaggagggcgtccgaacaccaatagcgacgcc

SEQ ID NO: 50762 - DNA, 436 bp, Heterodera glycines
  SCN-specific regions: Sequence locations=1-46,70-125,148-247,274 -283,307-394,422-436
ggacactgtccaagtggtggcggtcaacgacccgttcatcgaactcgactacatggtgtacatgttcaactacgactccacccatggccgtttcaagggcaaaatttccacaaacgccggcaatttggtggtggagaaggaggggaagagcgcgcacaccatcaaagtgttcaacctcaaagacccggccgaaatcaaatggggcgaagcgggcgcggaatatgtgatcgaatccaccggagtgtttaccaccattgagaaggcctctgctcatcttaaaggcggtgccaagaaggtggtcatctccgctccgtctgccgatgcgccgatgtacctgatgggcgtcaacgaggacaagcacgacccggctaacgacgacgcgatcagcaatgcttccggcaccaccaactgcttagctcccgtggccaaactgttg

SEQ ID NO: 50763 - DNA, 430 bp, Heterodera glycines
  SCN-specific regions: Sequence locations=1-83,116-240,263-266,288 -352,376-396,418-430
atatgccgccaaaaacctcgaagaaaactgacccaaaagggggaaaagcggcaccagcgaagaagaaagagggcggaggaggagggaaggccaagaagaagaagtggtcgaagggaaaggtgcgcgacaaactcgccaacatggtcttatttgaccaagccacctatgacaatttgtaccaagaaatcatctcccgtcaactgatcactccccacgtttgtctcgaacgggtcaaagtgccccccttcctgggcaaggggggcctgaaaaatttgccccaaaggggtgtgtcaatttggtgggagaaacccggttcccatttgttgtacccgggggccccccaacgggaggaccttaaaaagggggaaaaggggcgattttgtttcctctttttttaaaaagggatttttgaaaaaagaatttttttttt

SEQ ID NO: 50764 - DNA, 457 bp, Heterodera glycines
  SCN-specific regions: Sequence locations=1-19,41-457
aagataaataatcacaagcgaaaatggtcaacccgaagggataccgtcgcggcactcgttacatgttcgcccgcccggtccgcaagcacggcgttgagccgctttcaacattctaccgcgtgtacaagcggggcgacattgtcaccgtcaagggcaacggcgccttccagaagggcatgccgttcaaggcgtaccacggcaagaccgggcgcgtgttcaatgtgaccaaacatgcgctgggcgtcgtcgtcaacaagcgtgttcgccatcgcatcatcccgaaacgcatcaatgtccgtgttgagcatgtgaaaccgtccggctcccggctcgagtttctgcagcgatgcaaagcgaatgacttgcagaagaagcagcacaaggagggcaacgcaccgtttgtggcgctgaagcggaagccgaaggagccccgggtggcgcacttggtcaaagtgaa

SEQ ID NO: 50765 - DNA, 529 bp, Heterodera glycines
  SCN-specific regions: Sequence locations=22-117,143-217,239-436,460 -529
gggtgcctacaaatacatgcaagaattgtggcgcaagaagcagtcggaggtgatgcgctatttgctgcgcatccgctgctggcaatatcaccaaatggaggccatccaccgctgcacgcggcccacgcgtccggagaaggcgcgccgcttgggctacaaggcgaagcaaggctttctcatttaccgcgtgcgcattcgccgcgggggtcaaaagcggcaagtgaccaaagggcaagcgtacggaaagccgaaaacgcgtggcgtcaaccagctgaagaacacgcgcagtttgcaggccgttgcggaggcccgtgccggccgccgattgggcgaacttcgagtgttcaatacgaactgggagggccaggactcgacctagagaatcctcgaagtcattatccgcgacccatcggacaaaaccattcgtcgtaacccggacaccccatggatcaccaaaccctgtgaggagaatttcgaagaggggggactctcgtcggccggccgcagaggccgagggctcggcaaagga

SEQ ID NO: 50766 - DNA, 509 bp, Heterodera glycines
  SCN-specific regions: Sequence locations=1-284,307-509
gccaaaatgtatcttccttctaatgatccttttgtactacttatcacaccgaggtgtctgccttttctagccaaaggccgcctattcggccttactttggagtggcgtgtgatattacacctgattgtttacggtgtcgggcacaaaatatcagggaccacctgacgaagcttttcggcaaaaacgcgaaaccgggcgaaatgcaagtgttcaaaaacacactgtcgaccaacaaacagttatggaagataatttatctgctcgaaatacggccggtaacatttccaaacggagagccggggcaggaagatgcgacacatttggagataatggcagatggacgctgtgtaatcagccggcaaagtttgcctaatgtcgacgactttcaactgattgactacagcaagcaggtcagcccgcgttatttggcttctccactgatggcaaaggacgtgaccaagcaggacgtggacgaggacaccggctaccacccagaaaatatcacgctt

SEQ ID NO: 50767 - DNA, 449 bp, Heterodera glycines
  SCN-specific regions: Sequence locations=1-35,58-449
attcacactccgtattcaatcgatatacctttcaatttgtctttactatgcctcttcattggacttctgtggacactcgcaacgcacttttgtgcgccgccgttccttccattggcgccttcgtgggctcgacgatggccatcaaagatcagaaattgcttaaattccttaagaatcaaaactttccttctttcgcccgttgttgcaaatacaattatttgctggccaacacttccgtcactattttgttcggttacgcttcttatttggtctacaaaattggaggaggtgtcagttgcaccgactcaaaaatcgcattgggactgtacggtgcgacgctgctcagcggctgttttttggtgccaacgctcaaaaaacatgataccaaggcgctgactgccaacgctgttgtccttgccggactttccgtcgccacttctgtggctttt

SEQ ID NO: 50768 - DNA, 466 bp, Heterodera glycines
  SCN-specific regions: Sequence locations=1-352,379-466
tcgcatcctgctccgtgcaattcggctcattgaggacttgatgacaccgcgccaagacatgacgactcgacccgacgcgaggatttatatctgcaatgctcttccctatttggtctctactgccattgaacttttggatcttgccgagcaacaggatgaggaaggagcaaacgttgaccttgatgcccactaaacaaagtgtgccgtcatcagaacatccacgcgtgccacttactttctgcccgttgttggtcttgtggacccggaagaaatgaaaccgtccgatttggttggcgttaacaaggactcttatctcatcctggaaaaactgccacccgagtacgactcacgcgtgaaggccatggaagtggacgagcgtccgaaagaaacgtactcatacattggcggatgcgatagtcaaatcatacaattggttgaagcaattgttcttccgatggataaaaaa

SEQ ID NO: 50769 - DNA, 223 bp, Heterodera glycines
  SCN-specific regions: Sequence locations=1-31,55-223
tcttccgccgcaaagaccaactgacaagccgttgcgtttgcctcttcaggatgtgtataagattggaggtattgggacagtgccggttggacgtgtcgagactggtgttctcaaggctggaatggtggtcacttgtgctccgcaaggcatttccactgacgtcggatcggtggcaatgcgccaccagggcgtgccacaggggcttgggcgacagagtgggggg

SEQ ID NO: 50770 - DNA, 223 bp, Heterodera glycines
  SCN-specific regions: Sequence locations=1-223
cgagtcggcctcaaacagcgattgggcccggtggttttattatttgggacgcatcgaagcgttgaagggcaccgacgccgagacgtacaaagcggcagagaaacattttgaggtcgcacttcgaaaggcaccacaaaacggcgccggcggcttcttacatgatttgaacaaatgggtcgtgctgcgcagaggggtcttttttcaaatccccgagcgcggaatc

SEQ ID NO: 50771 - DNA, 394 bp, Heterodera glycines
  SCN-specific regions: Sequence locations=1-277,306-394
caacgctatccatcaatgcgcgagttgcgaagggcaattgacgaacaaaggctgttccaaattttcggctccggcaccgcctgtgccgtgtctccggtcggtcgtatactgtaccgtgagccgggcacgggccaaatggaggagctgttgattccgacaatcacttctagcgcccatgtgatgcaaaggctttacaaaacgatcactgacatacagtatgggagagttatcagaagtgattggacgcggacagtggcataatggcataatgcctatcattatttaaaatttctttaattattttagaatcattgtggttgcaaattatatgtaaaaaaatcacaaatatatgtaagaaatatgtacaaaaactcaataaaaatattttaatgtg

SEQ ID NO: 50772 - DNA, 436 bp, Heterodera glycines
  SCN-specific regions: Sequence locations=1-57,79-326,349-436
gctttggaaaaattgtttatcaaaagcactaacaaaaaacatttgctcatttttttattgaaaatggattttgtcggcgttaaaaatcacacgccaaaagttgttcagccccaaaagagtgacgcgattgacaatggcacaatttcgccgttcggcaacggctcggcaccgcgacgaaagcctttttcctggattcttccactgagaaatcccttcgtcggttccgcgtgtgcaaatgtaaaaatgtgttggaccgattggtgctcaaattggacggccgacggattttgttggccattcccgccgccttcaatctgaggtaaaagtcgtcgtcctccaggccccagccccaaaattcgttggacattccgttcacctttttaaaatcgtccaaagtgatcaccagcacactgccgaagaaatttttgtagtcata

SEQ ID NO: 50773 - DNA, 574 bp, Heterodera glycines
  SCN-specific regions: Sequence locations=1-194,223-237,259-319,341-574
aagcaacaagagcggcggattctacacgaagaagtttttgttggacctcccatccggcggaactgctgctgcagtctcaaaaaccgctgttgcacccatcgagcgtgtcaagctgttgttgcaagtgcaagatgcttccattcacatcaccgcggacaaacgctacaaaggcatcatccacgtcctcgtccgtgttcccaaggagcagggctttctgtccttgtggcgtggtaacctggccaacgtcatccgttactttccgactcacgcgctgaacttcgccttgaaggacacttataaccgagtcttcacgctaggagtgcacaaggagaaacagttcgtgaaattcttcaccatgaatttggcttctggcggtgccgctagcgcactacgctgtgtcctgggtacctcgatggactttgcacaaacgcctctgggaaacgggtgctgtaaaggtcctatgcccgcgcagtcgaagggttgggctggactgcctcatgaacaactctcagacggaacggggcccattggtttctacgggggacttattccactccccccagggattgatatt

SEQ ID NO: 50774 - DNA, 488 bp, Heterodera glycines
  SCN-specific regions: Sequence locations=1-488
tgtgcatttggacaatgagcgggtattgaaagcactgtaccatcttttacaaggcttttcagccagtccaccgaacattttcgtattttgtggcccttttctcggcattcaacgggcgcacagttacatggagcaggcggccaacgcgttcaggcattttgcaaacattttgtccgaattttcgcacgcttaccacgccaccgaattcatttttgtgccaagtgctgacgatgcgcctccgttgcaaatttttcccaggcccactttgttgcagttgatacaaaaatgctttaaggaggctaaaaatatgcattttgccaccaacccatgcaaattggtcttcaaggaccggcacattgtcatctttcgtgacgatgtggtggagaaggtgtgccgttcagcagttttcatgccaaaaaacgcgatggccagccgaataccaaaattgttctgtgacacaatttgggcccaacgccatttctcgccgt

SEQ ID NO: 50775 - DNA, 259 bp, Heterodera glycines
  SCN-specific regions: Sequence locations=1-259
gcaaattgtccctgaagtaattcgtcagcaatttttggccgccgatttggaagagtccgtccgattgagggaggaggcgaaaaaaggaccatttcaaaactcaaattgttggcgaaatgtgcttctctttgtgctgctccatttcggtgcccttgtcggtttgtgccatttatttcttcttgcaaattgggccaccatcggatggtgcatttttcctatggttccccccgggggcgtttggggaattatgggggggggg

SEQ ID NO: 50776 - DNA, 675 bp, Heterodera glycines
  Genomic contig location: Contig_ID=SeqID_2; Location=1233..1907; Strand=-
  SCN-specific regions: Sequence locations=1-142,188-210,260-382,425 -479,536-596,627-675
atgtatcacatctatcggcagctgctgctgcacgaacatccagccacgcatctgcgcctgagctgctactgcactaacaaccgcgactgtgcacacctcacacttctacccctcgtgctgctcatgacaaaggggcggtatgattttttaaaaattattttcgatttatatatataataatattattcgataaacattgtctgcttcatcaaattatcaaaatattaaaattaatttacttattacaaatattaaaaatctgcatttgatattcatttaaaagaaataaacttttcaaaaaagtattagtataaatattaatacaattaataatatcatattgctttgttagattcaactttttatgcttttttgatttgattttatttataaatttatttaatgatttattttttaattaattggcgtttattcgtagatgtttactttactattttaaccttttttttatcatcgccatatattatttttaataagatagagataatttgaatttaattttttattaattaaacgctgtgaacgaaatgttccggcaacatttcggctgtcgctatacattagcaaataagttcatttaaaatttaataaatataatttttttagttccttttttaatcattctgtcaatacttttcttatctgttaaataaa

SEQ ID NO: 50777 - DNA, 1447 bp, Heterodera glycines
  Genomic contig location: Contig_ID=SeqID_2; Location=2584..4030; Strand=-
  SCN-specific regions: Sequence locations=1-136,158-205,234-628,650 -913,945-1418
atgcacagtgtgccaatgctttggcaaaatttgtacttattcgttggcacaaccgccgtctcatatcgattggaatttggagttatgccgagcttggaacgtgagaaatatgtcttggcattttataaatgtacaccgaaaaatgatttttcagttattcgtgcgtctggagtatccgatttttttaaaatgtttctattgagagcaaattttttccttttaaaatttctttagcaatttttgttacaataatttaaaaatgatcaatatccaatatgagtttgtccacattttaccaccgccactcaattaattaattaactactcaatgaattcataagcaaaacgttctgcagttgcgccaataagacgttgggttttgagtctgctgcagaagaaacaatacagaatttgtcattaattttcaaattcaaggacatgattatgaaaataaaggattaaaaattgttgtctgcttgataaaagaaggagaaaatcattaaatttaggaatttaaaaatgcatgggtagaacatgcataataaaacaaaagcaattgtatcttaaaatatatgcaaggccaagatttttaacctacctaaacgaacttaagacattatattacaagctaaaagatttaataaatttttaacaaaattctatcaatatagcggttttaaaagcagtcgcacatccgtttttatgacttttctatccgtttttagcaccttcaaatattctcaatcgatcggtgaccaagtgtactctagcggtgatctgctacatttgccaaacgtcagtttaacttacgcgcaacaattttacttcatcgtttgctaattgcaggtctcaaaaatggcactttgtttaacctgatcaatatttatactaaaaacatttatcaatcttaaccttttaaaatttaattttactattttttttatcaggagctccaataattctccgtaaattggatgttattgtggctcctgcattctgccacaagccatgttttcgatgtcatggaatgcgtctttttcgcaaaacagtttggtagaaactcagaattggcactattttttcggactgtttccttccattttattaattattcattgttttttatctgtttattacattcaatatcacttaattaaaatgaaaagctttattaaaaagcatagccaaatttttagaattcaatgaataattgtggaccaggttgacgatttttttaattttgtaaaaaaagaaactaaaaacttaatcatatacaagaatttaatttccaaatcttaatataaaaaatttttatgaatgaatgtaaacactgctcataagcaccggacaaatattaactaaaaataattttattacttttgaactaattccatccacatgagcaacattttacaaccttaaaaatttttaaaaatatttaaataaa

SEQ ID NO: 50778 - DNA, 4831 bp, Heterodera glycines
  Genomic contig location: Contig_ID=SeqID_2; Location=7659..12489; Strand=-
  SCN-specific regions: Sequence locations=1-85,108-205,250-434,504 -545,567-629,750-1523,1566-1750,1791-1889,1915-2341,2380-2479,2546 -2646,2678-2702,2729-2767,2892-2972,3021-3089,3139-3289,3341 -3382,3404-3488,3510-3819,...
  SCN-specific regions: Sequence locations=...3842-4259,4281-4348,4371 -4395,4421-4609,4642-4831
atggataatgagaaacagcaccaatttcttcttttgtgtttcctcgagaaacacgaaaatgacgaggacaaattttcggcttttgaaaaattgaaagaaaaatttgggtcagcaactacacacagaaagcaatattttcgttggtggaattactttgagcgcggcgattttacgtttttttcagaccgtggaagtatgtataatgaattaattaatttaaaaaaaataaattaaaaaaacattataatacttagagccaactccgagtccttctccagcgcgaaatgctcgagaaaaatgtatttaaaataatttaattcattcaagcaatattaaataatgcttatcaacaatattaaaaatcacgttttaaggcacaactctaaaaaatacgcctacgtcttcatatggaaaaggcaaaacaattatttgacttaaaattaaaaaattaattataaaggctaatagtacataaaattgatttaattttaaaaaattttaaacttcaaagtgaaaatggatattacttattttgttttgggaacttttaaattgaacattaaaattgagaatgcattaaattaaaaacggctgatcacttcaattctgcatttaacagcttttccaacaaataattgaatttaataataaattaatttaaaaagaggtttaaaattcttaattgctttgaattcatatttcaattaatttatataaataacaactttatttatatttcaattaattttgaggcgttttggtcgattattcatctgaggaatcgttttgccatgacgattatcccgcctttgatccttatggaaaagggattttggacggcaacgtatcggacgaatcaatttgctttgacgattatgccgctttcgatgagccaatttacagttctcgtgaacatgacaacgatttgggaattgtgagagcacgtatgaatcaaaaaacattacaaaaacattttaaaaatattttagcggaattctcacagccactttttgagaaaatgccgtcgttgcttgaaaaattcacaaatgttatggatttgtcggaatgtgagtgaaataattaactgtgaattaaaatggtttaaagaaagacaacccaataatttgactttttcttgactattagacttatccgattagcttaaataatattcaaattttttcaaaattttaaagtagcacagttaaaacacccgttaatgctaatgatttttaaaaccaaaatggtctcgccaaaattttataattatgaattgtttttcgtattcgtctaatcagaatgatctctagcctcaacaaacaagcagccacgtgatcagcgaactcagcagtttgttgcaaaaaaaatttgcgttttttgtgctcaacaattgaaagtaaatgacgaacgtggcgtattggactgtgggcactattttcatgcacaaaagccatattatgattggtaaatttattcaattaaatcagttcttttaaagaaatttaaatttcagtatttcagagaatttttttattgaacaaaaaaaatattattaaaatatttttcactttacaataaacttaccattcgagattttttggttgccattagatttagtcctaaatgaggcattttaaatttgttaaatcaaataaaaaagttaatttgtctgtaagcgactgctgccggcaaatttgaggaatttttattaatttgttaacagattttgtcctaaagaagggccagtggctttttgtgtaaaataaatcatttgggaaaatgtcaatttccaacaaattgccaaaaaattgtattttcatcaaaaagtttgacaatcgaaagtcaacaatcgacattaagactcatccctgatcaactattgctatgtaaattatatttttaacatttaagggtcgccgatggagggtttaagcgatgcccaaaatcgacttgccgaaaagctgcatacaaaaagtgcgttaaatgcagaacgggtttgggaaatggcacaacacttcatgtgcgctgtgattgcaaggaatctgctgctactctattatgcacatctgatcaacatcgaatgtaaataataatgcttaatatgcaatagtacatttgaatttttattgcaaaaaataatgggtttaaatggaaattaatgtagaaaatgattacagattgtgggaaacaaatggaagatgccaattttgcaacaagccctactcagattattgcaaaatttgcaacaattttttttcatttgatcacaataccggttcaatgccaaagacggtttatctatattgttgcgcaacacgtttccactattcttgctggtcagttatttatttaaaaaagtttaaagtttatttttataatgatttggtctatgtttagttataatttacaacaaaaaataaatttcaaaaaacaaaattgaataagcataaaataaaagctcattttactatcttttatgattttttaaaaatagtttataaattttgtattggttttataatttcaataagatttaaaaataattcccttaatggacaaatatttaggtttacgcccgaaccaaaagattgttgtccattcgattgcgaaaatccttgggaaggatatgatgtattgctggataagtaaaatatatttaattaaaatattaaatattgaaagcaaaaattcgggacggaatttaattgaatttttaaaatatagaatgggttttccgtccagaaaagagtttttaacattctcacagaatttttttttttattttagaaattgtaaattgaaaatgtaaacattttatgacaaaaatataaaaaatgaaattcaattattaaaaaataaattttttatacttatgaaatatacttttcaatgatttgttatgcattgatttgttagagcggcttttttttcaaaaacacatagaaaaaagagattttgtcaataacgatgtcatattaaataaaatataaattagaggaaaaacaaaagttttaaaaattcaatttgattcatgattaacaaagccgaattctatccattccgagtaaatataatgaaatttaattgggtttttatttaaattggtaaaataaagaaataaaaaattattattatttagccaatcttgctgtgtgtcagctccattgagtccgaaactcattgaggccgagcggaaatattgtgaaagaaatggccaacattttaaacctgtctttgccaatttattgaccgatgttatcggaaacgatccattgttcaggtctgtatgaaatattttaaaaattaagaaaaccatttaaataattaaatgaataattttgactaaaataagaccggtaccggtacaatttagagtaaagcataaattaaaaaaggaagtatttttgacgaaaatttttaccggtttcagtttggtgaaggtcttagtgcataaaagcatattttgggagttttaagaattaattcatattttgcatttttagaaaaaatttcggccatttttgtaaattttcatagaaaaatgaaaacgttaaaaacacacccccccccccccctaaggatgaattttttgggaatttaaaagtttgagcttttttctgattttatatacaatttttggcgaattttatgattaaaagccattacattttagttcactcagtttggttttttacaatgcatgttctgaaaagcattgcgccaatttgcgtaccgtttacgccgaaaccattcacatcttatgctccgatcccgcttctgcaggcgtcaatttggaactgtgcgaatctaaagaaaagtttttggagaaaattgagtttggcctttgcgtgaaagccccagaaactctttttgaccatgccacaaaaatggttcaatcaaattactccaacaaattttgcgcacttattttggccattgcattcaaacgcccaatcatttggattgagccatcagcaaaaccaggaagcattgtcagaatgtcgcgcgaggatgccaaaagacttcttcctcaatgggatgatcagagccggccaaaaacagtgtcctattatttgccaaatgggaaaataatggtaatatatgaatatattaatcttttcataaattttcctttatggattaatagtaaatatggggagctttattgattaaacaattttgtcaaaattaatttaagaaatgagcacaaaaaagtatttccgcgcttaaatttttaaatttcagtgtcactatctgtcacttacaaattttacaaaatacaccctttaaaaatgaaaaactttctcaaaaattcatttcaaaaatttatcattttattctgttgacatttttggttttaaaaataatttaatcacaatacagatttggcttaattttgttatttaattgcacagattttgtcatttttacaccctaaatttgagttaagagattgaaaattttttttgcttaattgactgaaaattatgccagcatatataatttatcgcatttttttcactatttttggcactgttttttcactattttagttaattatttcgagattttcataagtaaaagttgctgccttaatactaaaagttccaaataaattttaattattttttcaaattttaaggaatccacgttgcatcacccaaaaaataaaaagccacagcgagcaattgaagagctgttttggacttttcaaatgaacattcaaaaaacgacctacacggtccaaaatcctattttgatttggcataatggctatggcctagcttgtcctattgttttgtctcgtcgcacacctccaaaaattatttaa

SEQ ID NO: 50779 - DNA, 517 bp, Heterodera glycines
  Genomic contig location: Contig_ID=SeqID_2; Location=6908..7424; Strand=+
  SCN-specific regions: Sequence locations=1-81,104-143,165-445,469-517
atgaacactttcccaacttcatttgaagacccatccaaggtgggaacagttccaaaatttggtgctatatttatagtgcccaatttataaaaaataattatttgtaggtattcaataaactttttattggactctcaaaacacttttttataaagaaacatttcaaagttttccgtcttcagaatttattcaaaaaagaaataatgcataattaagttagcattgttaagcatttgttaaatttcaaagttgattaaaaaattataaagatgcaaaaaataataagaaattaattaaaggtcagattttaagacggaatacgtatgaagagtaaagaattaattgaaatatgagttaaaataaggcatgcaaaccaacaacaaatgtcaaacaaatgatggatattaacttggttaattaaaagtttaaaaaaatgctgatcgagttaaaaattgattaaatatgaaagaagaaccaacaatcgagtatgaatttgattaattataaaagtataaaa

SEQ ID NO: 50780 - DNA, 1067 bp, Heterodera glycines
  Genomic contig location: Contig_ID=SeqID_2; Location=14307..15373; Strand=+
  SCN-specific regions: Sequence locations=1-292,314-569,591-856,885 -917,939-964,989-1067
atggataaaaagtgaataattaaaaacagagggaaacaaaaactactcggaaaatcagttggtggaatttgttgatttaatttatttacgtttaaacacattttttctggatgtgttttacaatttaatttaataaccggaaaatgcgcactttccggttgtgtttttgttttgaattttatttacttttaaacccaattttttccggttgtgttttacaaatgttagttaataaccggaaaacacttttttgcgtgcattttttaaaggttatatagtaaccggaaagcacttttttaaaatttattaataaccggaacacatttccatttagttttttccggatagtttcaacggtttaagtaaaatgcggaacctgtttaagtacaaaacctaaaaaaaatacatacaaaaatacaaaagcatgccgtcttaggaatttgatcaaacatattgacactttttattccttttaaatctttggcattttgttttttaagcaaacaattttctcctcttttttaaccgtcgatgactgaacttcaaacatttatccttttgcaatttaatagtttttcatgtttcaaaacagggattgcacagaattccgacttcagacattttggggtcgaaattcagatttcaaattgaaaaaatgtgggaatttttttaatgttttctgaattttttgccatatattttttaatttttgtgtatagtttttactttattcacagttattttagttcaatttcaattctttttatttcgttttcgcgcactttcgcaaatggcaaattcgaagcgtgacagagttggtcagaatttattattcttcagccaaatttgtcgataattgtttcattttgttttttctttcagtttctctcacaaaaatgaagaagagccgcgagggcaaacaaaacactttgaaagaagcaagaaaaaaaaatgcattttttgtttgaaaattttaacaaaaattttcagggcagagaatgcgttgagcagtacaaacattatttgtcttctcgacgaagagtttgggctctgcaagactggtggag

SEQ ID NO: 50781 - DNA, 934 bp, Heterodera glycines
  Genomic contig location: Contig_ID=SeqID_2; Location=16190..17123; Strand=+
  SCN-specific regions: Sequence locations=1-250,279-514,557-810,832 -878,900-934
atgagcgcactttttagaggccaaaacggactgacgttcaccaatgcgaaagcaaacgaagtgcaaaggtcggcgggggaaaattccaattccttttcgtacatttatttctttctgtttttggtgggggcgcattttggtggaacatttttttaaaggtttctacgaattcgaagcacttcccttttttacatttttgtttgtttttcccgttccaatttttaaaacagaaagtttatcaacttttttctttattttttttcaaattttttaattttccaatttcggcccggcaaatggaatgttttttactcacaaagcgacagaaattttaaaaaaatcctaaagttttgaaggtgttcaattgcaatttgttgctctattttttgcagtttggcgtccaatcgatgccggattttcattttggttggccataccctttctttttcctatttggtcaatccataccaacggtacaccccaaaatacagctgtgacataacactgccgggtctaatttttttaaaaatttatccaaatttttttttcaaaaattccttgaattcatcattaaatttagaaaaaagcacgtgcaatttttttaaaatttattccgggctgtgttttgtcattttccgccataacaggcccgtagcctggttaattcaaaaaaaaactgtttttttaaatcttaagcaattttcttaacaaatgttttaaaatttcataaaaaattgacctgtgggcaccgcacttaaagacactaccggacctccattttacttttttttaaatttagatgcaaaaacgaaaatattttggtgaagaaaagttctttggattcgcccctctgaaattttcttttttctgaccgctggtattaaaaaatttaaaattttctaacgatttttcaaaatttcatcatgaattacta

SEQ ID NO: 50782 - DNA, 965 bp, Heterodera glycines
  Genomic contig location: Contig_ID=SeqID_2; Location=18264..19228; Strand=+
  SCN-specific regions: Sequence locations=1-297,319-353,375-519,541 -588,610-822,844-965
atggtaaaatatttaaaattgaaatgcgttttttggtaatagtttagatgctatccccttttttaaaaaaataaattcaacttttaaataagtcataaagaaatgagtgtctttgattttttacagaaagcaactacaatagttttccggtttttgttgccttttaaaggattgtttccggatatgcgaaatctaatgtattttttctgtttttttattcaattaaccaaaagcagaaagtgttttccggtaaatgtaaagtcaaaaacttgaaatgttttccggaacaatagaaatagttttttggaaaagtaaaaatcgcaaacaaaaagtgttttccggaaaagtaaaaaccacaaacagaaagtgttttccggaaaagtaaaaaccacaaacagaaagcgttttccggaaaagtataaaccacaaacaaagagtgtttccggaaaagtaataatcacaaacagaaagcgttttccggaaaagtaaaaaccacaaacagaaagcgttttccggaaaagtaaaaaccacaaacaaaaagtgtttccggaaaagtaataatcacaaacagaaagcgttttccggaaaagtaaaaaccacaaacaaaaagtgttttccggaaaaggaactaaaatatgattaaattcataattttttttgctgtttattaactaaaaagtgttctatttttttaattgacaaaaaaaaatttgtgaaaaaggtttgcatggttgtttaacaaatgttatttaagtgccggaaatgcgcaatttcaggttgtaaatccacattttccggttgtaaatgcatatttaccggttgtgttttacaaattaaatttatgtgccggaaatgcacattttccggttggaaatggacattttccggttgtgttatacaaatgtaatttaagtgccggaaatgcacattttccggttggaaatgcacattttccggttgtgtaa

SEQ ID NO: 50783 - DNA, 327 bp, Heterodera glycines
  Genomic contig location: Contig_ID=SeqID_4; Location=950..1276; Strand=-
  SCN-specific regions: Sequence locations=1-327
atggaagacgaattgtcattggaagtgcccgcggcagtggcagatgccgacttgtctttggaagtgccagaggaatggtcagatgacgatttggtgttcgctccagatgccttggcagatgccgacttgtctttggaagtgccagaggaatggtcagatgacgatttggtgttcgctccagatccattggcagatgccgacttgtctttggaagtgccagaggaatggtcagatgatgatttggtgttcgcagttccagatgcattggcagatgccgattgctttgaagcggaagtggtcttcttcgaagttttgacagagccgtaa

SEQ ID NO: 50784 - DNA, 1877 bp, Heterodera glycines
  Genomic contig location: Contig_ID=SeqID_5; Location=582..2458; Strand=+
  SCN-specific regions: Sequence locations=1-451,474-791,824-1155,1182 -1201,1227-1816,1845-1877
atggaccgacggtaagaaaggatttaaaaaattgcaagttttcatttacccaattttcttatgtttcagttggatttgtggcgacgtgtggatggacattctcccatcttttgaccatgctcaactcggactcaaaatggcattgctttccgaccgtttcgatgttttggtggacaaacatttcgatggaaaaagcgaattgacaatttggagacgtatcagaattcgcaaggacaaaggaccaaaagcgaaactgtctgtggcgatcgatggcaaatttgtgggatttccattgccggaccattcgctgccaaacaaaatccgttttcgtttccttcagattcagtagatcaaaaactatacagaaaccaattaatatggttggtcatcttcatcattgttcccccttttcagctacattgaccattctgtgctcacatttatccgttcaaacaagccaatttgggacagaatgggcaccaaatttgagttttttgcgaaaagcattcgccagttgggctttaccagtggcgatgcctttgacaatttgcgtcgtctgatctcgccgacaattctcactggtcttgaccaattgaattcaattgattccaatgaactgttccccgatggaattgctgacgatggaccaaatgcaactgctggccaagctttggtcaaatggcttcacactccgagcaaaaatggccaaccgaagcgattgtatcgcaataattattttggtccacagaatctcgaatgggtcaacaacttcaaagaggtgtgtctagccatattttctataaattgtttttgtttttccaaatttgtttagacatttatcagtgccaccacttctgtcagttacaatattcaactttattttcatgtgaacacaattccaactgaaccatttgaattggtgaacaaacggacgaatgaaaagctgacactgaaacaggagatcgacgaattcgacgtaaatgtgtataattggctgttgcaacggtgcccaattggggagacggcgagggtgccagcaattaaatggggagacagcttaaatccgagtgccaatttgaacagtatcagatttgatctgtggagtttcgataaatccattgagtgagcagcagcaatagcatttgaattttatcgaaaaataaaatatttaattaattttaggccattgtcgccaccaacggaagaagaaaaagaagaagaagaagcggataaaagcaacggaaatgtcgtctgctgattaagtgtacggaaatgaataattaaattgattaattgtatttgagaaatgaattttcgattgaaacgattatctagagaatttggaaatccattaagtagttaagggttcactcatccccccgcttagaaaaaaataattaaaaattcactagggtaataagaaaggttgcgatttttagtgacgaaaaatctcgagagtttttctaaattttctcgcatgagagtcaatttcaagtacgtacttgccattcaagtacatacgaatccgagctaacaaataagcaagcaacattcaaatcaaaggcaagctttcgtgcatttgaacgtgcatcgatcggtgagaattaccaaatccggaaaaccccgatcagagagtccgcctcagtttcctagcaattaacaatttttcaatcatcgatattagcagggaacggatttttaggttttcacctacttttttggggggataacatatgctgagataagcgcaaaaaacacattttcttcgatcacttttcgatttagagcgacttttaaacaattattatgacttgtgaaatttttaaaaaacttttaaaatatttctgctttaacagaaacattattatgaaaaagca

SEQ ID NO: 50785 - DNA, 600 bp, Heterodera glycines
  Genomic contig location: Contig_ID=SeqID_5; Location=2654..3253; Strand=+
  SCN-specific regions: Sequence locations=1-17,40-485,507-600
atgaacagacggtaaggaaaatttttaaaaattacaaattttccatgtttcagttggatttgtgcggatgtttggatggacattctcccatcttttgaccatgcccaactcggcctcaaaatggcattgctttccgaccgtttcgatgttttggtggacaaacattttgatggaaaaagcgaattgacaatttggagagcaatcgaaattcgcaaggacaaaggaccaaaagcgaaactgtctgtatggaccgatgacaaatttgtggattttccgatgccggaccattcgctgcccaacaaaatccgctttaaagaccttcagattcagtaaatcaaaaattatatagaaaccaattacttaatattagggttgcaaccccgaaccccgacatttttggccattttcggggaaaaccccgaaccccgacgcttccaaccccgaaccccgatcggggtcggggttaaatatacactcctaagaacggaatttttgtgggggaaaaagcaaaacatttatacaaaaattgatttttttaaccatcttgacaaatttttatgaaatatagtaaattttgcttttttaaaccaaaaataccta

SEQ ID NO: 50786 - DNA, 3957 bp, Heterodera glycines
  Genomic contig location: Contig_ID=SeqID_6; Location=36..3992; Strand=+
  SCN-specific regions: Sequence locations=1-270,292-392,414-455,477 -1278,1307-1551,1574-1771,1793-1847,1869-2288,2310-2392,2415 -2418,2455-2771,2796-2797,2901-2946,2968-3491,3524-3854,3881 -3900,3926-3957
atgccaattgaatcatttgaattggtgaacaaacggacgaaagaaaagctgacactgaaacaggagatcgaagcattatccaacggaataatttataattggctgttgaaacggtgcccaattggggagacggcgacggtgccagcaattaaatggaaagacagcgtaaatccgagtgccaatttgaacaatgtcacttttgatctgtggagtttcgataaatccattgggtgagcagcaattaggatacggagaatccaggaaaaaaatatatgcatttacaaaaataaggaagccgtgtaaattatgtatgtattgaacaaaatcagcaaaacacccttccccattactctctctttatatacgcataaattaatgcgttatggccattattttggccaacaaatcattttaatctccccccatccgttcatccgttttcaaatctctcacttttattttggtagatatataaagaggtcgaaaagacatttttgatgcagaatagagaaaaaatgaacagacggtaagcaatttcttttgaaaaacagcatgggtaaatgaaaatgaaattcctcaccgtctgtgcatccaaaaagtctttttgacccctttatatattcagtagttcttaattgttgtgcgtaagaaagcattttggtaacctttcaaaaagacgaagaagaagcggataaaagcaacggaaatgtcgtctgctgattaagtgtacggaaatgaataattaaattgattaattgtatttgagaaatgaattttcgattgaaacgattatctagagaatttggaaatccattaagtagttaagggttcactcatccccccgcttagaaaaaaataattaaaaattcactagggtaataagaaaggttgcgatttttagtgacgaaaaatctcgagagtttttctaaattttctcgcatgagagtcaatttcaagtacgtacttgccattcaagtacatacgaatccgagctaacaaataagcaagcaacattcaaatcaaaggcaagctttcgtgcatttgaacgtgcatcgatcggtgagaattaccaaatccggaaaaccccgatcagagagtccgcctcagtttcctagcaattaacaatttttcaatcatcgatattagcagggaacggatttttaggttttcacctacttttttggggggataacatatgctgagataagcgcaaaaaacacattttcttcgatcacttttcgatttagagcgacttttaaacaattattatgacttgtgaaatttttaaaaaacttttaaaatatttctgctttaacagaaacattattatgaaaaagcaataaaaaaacaaaacaaaaaattggcgttactttttttcaaaaaatgcacccctcagaatcgatttttcaaaaagcaaagatcctggacccatgatttggcggacgatcgaacatttttacgcttgaatactacatatcttcaaatttcagtacttcttgaaagggaaaagtgtgctctaaaattgcagcaaacaatgaacagacggtaaggaaaatttttaaaaattacaaattttccatgtttcagttggatttcggtcggggtcgttttcgcgtggccattttcgcgtggccgttttcgcgtggggacgttttcgcgtggccgttttcgcgtggggtacgttttcgcgtgagtacctgtttaggactgaaattggtcggatttgtgcaaaacatctatgtttcgaatcccgaacccgaattcggacaaatttcttaacttttttatttcttgcggctagtatcttctacaataatttgtcagtttggtcggatgtgcgtcaaacggaaaaaataattaaaattggttctagtcggttttacgcgtcccatgacattttacgcgtcccataacattttacgcgtcccatcacattttacgagtcccaacaacactttacgcgtcccatgacattttgtgtccatggcagggatggcattccgaggccccaaaaattttcggaaatcggaattccgtgccatccctggtctcatggtattatagttgtcctaataactaagagaaaaactatttttttttgttaggtattcagtaaagtttttaactataaatttcgttgttaaacctaaggttatcatgacaactcatacacaggcaactcgaacaatggcttattgttagactaggcctaagtttaggcttttgtaaatttttttttcttatagttgaatttctgttgacatcaataagtgtgcttagagttgcttttgcacttctcttttatatgcaaccacgcgaaaacggccacgcgaaaacgtcctgtcccgtaatttatagacgtattgaacccaattttattttctttgaataaaaattcaattttttgactaaatcatgaaaatttacaaaaaaaagaaaaaaaataaaaatttaccagaaattcataaatttttggtgaaaatatgttacaaaatagaccttaaatttcaaaattcacccggcgctgcctatcggcatcgccggcgccacaaaaaaacctattttttcttaaaaaaaattggcccaaaatcgaaaaaatctatcattttttggacaaaatctgttaacaggcccatccaaattttcaaaatttttcacggcggcgcctatcggcaccgccgaacccatttctcctaaacgtctttagataaagagcgccgcaaaaaaaagaccaaaaaaaaaagatttatacagattttcgctgaaaattggccattttaaatgctttaggtatgtgtttttaattaattctatacaaaatatttatgataaaaaaaatataaaaagcacataaaattattattacgaaatttaaatatttttaagcaaaaatttataaagttttttgactatttggcataaggcaaaaattgaaaaaccccgaccccgaaccccgaacgatttggcaaccccgaccccgacacttccaaccccgacgtcggggttgcaaccctacttaatatggttggtcatcttcttcatttttccccttttcagttacattgaccattctgtactcacatttatccgtgtcaacaaacaaatttgggacagaagtggcaccaatttggagttgtctatttcaaatgaacaaccaatttgggatgttttcgcccatgaaatttggccaatttttgcggcaaacattcgccagttgggctttaccagtggcgatgcctttgacaatttgcgtcgtctgatctcgccgacaattctcactggtcttgaccaattgaattcaattgattccaatgaactgttccccgatggaattgctgacgatggaccaaatgcaactgctggccaagctttggtcaaatggcttcacactccgagcaaaaatggccaaccgaagcgattgtatcgcaataattattttggtccacagaatctcgaatgggtcaacaacttcaaagaggtgtgtctagccatattttctataaattgtttttgtttttccaaatttgtttaacatttatcagtgccaccacttctgtcagttacaatattcaactttattttcatgtgaacacaattccaactgaaccatttgaattggtgaacaaacggacgaatgaaaagctgacactgaaacaggagatcgacgaattcgacgtaaatgtgtataattggctgttgcaacggtgcccaattggggagacggcgagggtgccagcaattaaatggggagacagcttaaatccgagtgccaatttgaacagtatcagatttgatctgtggagttttgataaatccattgagtgagcagcagcaatagcatttgaattttatcgaaaaataaaatatttaattaattttaggccattgtcgccaccaacggaagaagaaaaagaagaagaagaagcggataaaagcaacggaaatgtcgtctgctga

SEQ ID NO: 50787 - DNA, 1482 bp, Heterodera glycines
  Genomic contig location: Contig_ID=SeqID_6; Location=7492..8973; Strand=+
  SCN-specific regions: Sequence locations=1-431,454-770,803-1134,1161 -1180,1206-1296,1318-1482
atggaccgacggtaagaaaggatttaaaaaattgcaagttttcatttacccaattttcttatgtttcagttggatttgtggcgacgtgtggatggacattctcccatcttttgaccatgctcaactcggactcaaaatggcattgctttccgaccgtttcgatgttttggtggacaaacatttcgatggaaaaagcgaattgacaatttggagacgtatcaaaataagcgaaactgtctgtggcgatcgatggcaaatttgtgggatttccattgccggaccattcgctgccaaacaaaatccgttttcgtttccttcagattcagtaaatcaaaaactatacagaaaccaattaatatggttggtcatcttcttcattgttcccccttttcagctacattgaccattctgtgctcacatttatccgttcaaacaagccaatttgggacagaatgggcaccaaatttgagttttttgcgaaaagcattcgtcatttgggctttcacgatgccgatgctttgaacaacttgcgcagtcgcatttcaccaacgattctcactgatcttgatcaattgatttcaatcgattctggtgctctgttacgcgatggaattgctgacgatgggcaaatgcaactgctggccaagctttggtcaaatggcttcacactccgagcaaaaatggccaaccgaagcgattgtatcgcaataattattttggtccacagaatctcgaatgggtcaacaacttcaaagaggtgtgtctagccatattttctataaattgtttttgtttttccaaatttgtttagccatttatcagtgccaccacttctgtcagttacaatattcaactttattttcatgtgaacacaattccaactgaaccatttgaattggtgaacaaacggacgaatgaaaagctgacactgaaacaggagatcgacgaattcgacgtaaatgtgtataattggctgttgcaacggtgcccaattggggagacggcgagggtgccagcaattaaatggggagacagcttaaatccgagtgccaatttgaacagtatcagatttgatctgtggagtttcgataaatccattgagtgagcagcagcaatagcatttgaattttatcgaaaaataaaatatttaattaattttaggccattgtcgccaccaacggaagaagaaaaagaagaagaagaagcggataaaagcaacggaaatgtcgtctgctgattaagtgtacggaaatgaatgattgaataattctatttgagaaatgatctatctcaatttgttgtgcttttttctctcagaaatgcttttgttaattgtttcgttccaattatataaaacatttattttattggcttttttgttgaacatttattaattatcaatgaaacgattatttatagaatgtggaaatacagtagtttttgtttccttcctcctcgcttagaaaaaaattcactagggta

SEQ ID NO: 50788 - DNA, 324 bp, Heterodera glycines
  Genomic contig location: Contig_ID=SeqID_6; Location=10836..11159; Strand=-
  SCN-specific regions: Sequence locations=1-324
atggaagacgaattgtcattggaagtgcccgcggcagtggcagatgccgacttgtctttggaagtgccagaggaatggtcagatgacgatttggtgttcgctccagatgccttggcagatgccgacttgtctttggaagtgccagaggaatggtcagatgacgatttggtgttcgctccagatgccttggcagatgccgacttgtctttggaagtgccagaggaatggtcagatgatgatttggtgttcgctccagatccattggcagatgccgattgctttgaagcggaagtggtcttcttcgaagttttgacagagccgtaa

SEQ ID NO: 50789 - DNA, 924 bp, Heterodera glycines
  Genomic contig location: Contig_ID=SeqID_31; Location=1521..2444; Strand=-
  SCN-specific regions: Sequence locations=1-616,649-821,855-924
atggacttcgccgacatcgctgaagaggatgacggcagcgaggaattcgagatatcatccatcatgttgtacgaccactgcgcgtgtatgctctgtggacgtatcagattcttttatctgatcgactacgctacgccacacgtcgttacgaagtggggcgggtcctacttaaaggacgaaaatgtcctaacgcatgtaaaattcctgataaagccataaattaataataagcataatttctaggccggcttctgcctcggcagactgctcacctttgtgaacgccttcgcaatggatggcaaccggcttaacgcgcaaaaagcgcgccaagtgtaggagaaaattaggcataaattcgataatttacaaaaatttagcgtttttgcaaaaaatggacgtgggaatgaggacttttccttatttggaataattgatggccagcgtgttgatgtggtaatgtgccaaaaaatttagcgcaaaatgagtgctcactcacatgttcagaatcgcctatttgccactcccgtcgccactccggaccccacccccgtcccctcaccggtggttgaggttgaggtggaaacaaccgtcgttgtgagcatggatgaggaggacaccaacgaacagcagcagcaccagcagcaacaattgacacattgcgccccggcaacacagcaccaacaaccgccgccgatgctttcagctgccgtccaacaggcgatcagcactttgcaaatgcgcatgccaccactgcccgtcttcccaccattcgcaatgcctttggtacttcctccgctacagttcgcttttcaaccgcatctgcaacaccagcagcagcagcagcagcagcagcaatttgcgcctccggcactccaaattgtcccgctcgatgatgccccggcgcctctgccgttgtgcgatgtt

SEQ ID NO: 50790 - DNA, 4356 bp, Heterodera glycines
  Genomic contig location: Contig_ID=SeqID_31; Location=13624..17979; Strand=+
  SCN-specific regions: Sequence locations=1-59,89-535,557-1881,1903 -2160,2213-2593,2616-3350,3372-4018,4056-4162,4184-4291,4313-4356
atgtcgttggaagatcacaattattgcggcgagttgggccgcaacgaagaaacgcccacaaagagaagaaaaagaaatgatgatgatagggaacagaaatttcaaaaaaactgcattcgcactctgagcgccgacaaacagtacaaccaaaagttcaaagtgcagagcgtaaagtcgacttttgtcatcgaaaatttgcccgccaaccccgagtcaatgctgcgcgcattgttcgctcactgcatgtcaaccgccctggacgagtcacagcagaacgggatcacaccggatcaattgggcgctacaatctcttcagatctgctaaatccgagcatatggattcccatacgccgcatttccgacaacaccgccgactcaattatgaaccgcttccttgaggtggcacagtcaaaatcgcgggagggctctctgtggggctcgccgttcactgtgaccatcacaacgttggatgttgcgcagctacctcatcggcaacaggtgcgtggcagtgggaaaaggacagcaaattcagtacaacatatcatcaaagaaagtgctcttctgcggatcaacaacaacgatgatgcatattgtcttttttacgctttggagacaagcaggaagtaccacatcaaagagatgagccgacagaccttttctaaatatattaatcggcagaatgggcgacgactggaagacgtgtttggactgatgagcagcgcaaacattcgcaccgatctgagagaatatgacgcggttgtctatgtgccaattgtcgtggactattggaatcggaaatacgccacagcaaaccagcgatttaaggtgttcatttttggcgctacaggcagctatcggccaaaatttcaatatgggccggacaattacaacgtcgaaatcccgctctaccatcacaacggccatttcgacggaattcgaagcggggtgggcaaagcggtgtttgggcgtgactactactgcttttcgtgcgagtgcccctacgataatgccaatgatcattcactgcagtgtaaagcaaagtgcataaactgcggtcgcataggagtggggcgaccgtgccgagcggatgacaacaacgacaattattacagagaatgcacagcatgcggcaaggatttcatgagccaagactgcttcagtcaccatttgtcgagcaatgtgtgccgacaattcaagaaatgcaaacagtgcggagttgtgtggaatgtcaaacaaaaccgacgaaaaggacgcagcggacacgtttgcggtgagaaattctgctacacctgcaaatgttaccataagccggagcggggctgcttcatacagcagttgaaggcgcgccgccccacaaagtacagactgatcgcctttgactgtgaaacaacacagaacacgcgaattgagggcgaccgcagacttcattccgtcaacttcatctcatgctatgtcgtctgcaccaagtgcataaacgaaaatttatggcgaaattccctacaagcgccatgtggcatttgcggtcggcagcgcaccgtcacattctcccaccgcgcctatgaacgcacacaaaccgatgcccaattcatcactccttgtccaatggcggcctttgctcaatggctgctcagcgaattcgatccgcgctatcccacaatgctcttcgcccatttcgggggtcgctttgacaacattatgctgtttcggcagttcttcctcaacgggttttgcccgcaaatgatccgccgtggtaacaaattatacgaaatgaaaattgcgaggggcgaaaaaaacccggaaatcatcgtaagagacagctggaaccttatgccggtgccactcggcgctctgcccggagcgtttggactcaatgtgcaggataaggagttcttccctcatttggcgaatgttgaggcgaattatgggctcattctgcagtcgctaccgccaaaagctgactacttatacggcggaatgacgcccgaccgacagcgcagattcgaccagtggtacgcggaacaccaccatcagcagttcgacctgtgtgaacagctcgcggcctactgcaccaacgacacgcgcatactaattgaggcgttggtcgcttttcgcacggagttcttgacgatcagtgacccgctggagcggcatggatgcttggatgacgacaacgacgacgaagatgaagaggaggaggtggatgacgacaatgcatttgaagtgatcggcggtggcattgacataacgtgggagccgatgaccatcgccagtgcctcaatgagacactttcgactcaatcacctcaagcgggatcagctcgccattgtgcccgagtgcggctacgacactacaaacacgcaaagccttgtagcgctcaaattcatggactggtacgccaaaaagaacggggtgagcatccagacggcacactcgcccggcggagagaaaaaaattggccagtacactgtggacggatacatcgcggcgaccgacaccgtgattgaggtcaacggctgccactggcacgcgcacgaccacccgcgtcaccgctttcagccccaaacagtgatggcgaatgggaaaacggcgcagcggatacgggaggacgatgcgcgacggatggccttcatcacatcccaggtgcaacaagtgctcgtattttgggagtgtgaaatcaacgcggagaagcgcaacaacgacgaaatgaagcgcgcctttgcgcagtacaaggacagcggcccaattcgtttgaaggactgctaccatggaggacgtgtgggtccacaacgactacactacgaggtgccagaggggtggcggatgaaatattacgacgttcgttctctctacccccacacgaatgccgtgacagcataccccgtgggtcacccaacacgagtgaacatcattggtgaggcagagcaggcggttgactggcgacgcgccgaccaggtgccggtccgaggcattctcaaagtgttcgttgtgccgccccatcacgttgatgtgcctgtactgcccgtgaaatttgatcagcggcttcttttcccgctgtgccgtacctgtgctttgcaacatccgcatggagccgtcaatgaagactacgagtgcacgcatcgcgaggatgatgagcgggggtgggtgtccactgtgacgtcaatcgagttggaggaggcgcttcgcaacgggtaccggtgtacggcctactatcgctccgtcgagtgggacgatacgcggtggagcgaccgcgtttttcgaggctacgttgcagaattcatggccatgaaaacacatgccagcggcttcccggacgaaattggtacaaccgaggaagatcagcagcaattcatagaggaatgtgaggacaaattcggaatccgaatcgagcgggaaaagatggtgcacaacaaggccaagcggaccatcgcaaaactgtgcaacaactccctgtgggggcgcttctctttgcgcaatgggttgtccaaaacgattgtgaccgactcgcccgcggaactgcgcgctctgcttgacaacccagcggtggaggtcagctccgttgaccagctcaccgacgaatgcgttctggtcacctatgcggccggaaacgaatgggtggaggaacacgagtgctcaaacattgtgctctctctttggacaacatcggtggcgcgcctacacttgttgcggctaatgcagacggttgcgcgcgcaccaaactctgtgctcatctacaccgacacggacagtgtgtgtttcgcccatcgtgaggcggacgggtgccctctggagacgggaccccatctaggcgacctttcggatgaatggccggaccacgaactcgtggaatttgtttccggtgggtgcaagcagtacgccctgcggatgcggcaccgccaaagcggggaggagaaaacggtgctcaaagtacggggcataacactgagcgccgatgcctgtcagcttctccactttgacacattcaagaggagtgtcctacgctacgcaatgtgccattcaaatgaggatgatgaagaaggagatgatgatgatgatgacatttgttcaattttgattgagtaccccaatttcctgagacccaacattaaggacgggactgttatttctgttaagctgtcgaaacgctatcgccctattgtaactaagggggttgtgggaatgaatgcaattgtacatgattttggttttataaaggcgtaatttatacggactgcactttttaaaaatgcataattaacaaatagaagattacaatttaaaataatgaagcgtgagaagttgcaaattttaggtagaaaaatgcataatttagtaagagaagtagcagttttggaaata

SEQ ID NO: 50791 - DNA, 865 bp, Heterodera glycines
  Genomic contig location: Contig_ID=SeqID_31; Location=2950..3814; Strand=+
  SCN-specific regions: Sequence locations=1-186,209-603,642-770,799-865
atgcagtggattaaatttaactgcacgctttgtccgatcggtctgcattgtttttatccgcgcaagtacgcaaagcctgtgctttgtgcgcatcccagcgtccgtaacatcacggactttttgagcaccggtcagcttgacgaagcggcaacgacaacaacaacaacaaccgcacttccgacaactgcggaggtgtcggcggcggcggcagaatgcgcacctccgcccgcgcatttgaccgcgtggatcgcggtgtgcacagcgctggtggcgcttttggtgattgcggaggtctgttattaattttggtcatttatccgctaaacccctattcctcaattaagcttgtgcgcgccggattcaaagtgcgcaaatttttgaaggaccgcgccttcaaaaaggggatgctgcgccgacatcgccagcgtgagtttctcgctattacattttagcaaattgtaattaacaatttgtacaggaatgagcgccgcaaggcgcaaccgccagccggcaagcgcgccgactccgctgattttgccggctatgttggccggcgtttctctgcgcccaacgggcgtcaatttgactgtggaccgggtgggcaattttaattaaattaaaatctttatatattttaatttctcactcattaaaattacaatttaaatttaaaggcagcggggcagcgccgcgcggatggtacggacgaagagcccgtgtacgatgaggtgccgcttgacaccgtggaacaaaggcgtgatgaagaaaatggggaggaggatgaggaagatgatgacagtgatttttagtgattcggcaagcgatcactcaccatttaactaatcgatcgatttttcactttaaa

SEQ ID NO: 50792 - DNA, 676 bp, Heterodera glycines
  Genomic contig location: Contig_ID=SeqID_31; Location=4204..4879; Strand=+
  SCN-specific regions: Sequence locations=1-179,202-444,469-642,664-676
atggtcaccaaggagggaatcaccttatggtgcacacgcatagaaaaagctcagtttgtcccttttgatgttgtctacgagcttcccggtcattgttttttccgcgtgaagaataaggcaagggtgttcagcgttccatacagcgaactgtcgtcctcagacaggtgcgcccagcctctaccaccaccaccaccaccaccaatgacaacagcaaaacatcaacggacaccggacgacgaggaggagaagaatttgagacgtaaggcaaaggtggcgcttgacttagtggaagctggtctagcggcagacgcaatgatgcaggatgggacgcgttggaagaaagccaaaaccgcgatcaatgtgctggccaatttgcttttggcggaatcattaacagatgtctcgccaacttttgagcaacaacaacaacaacagctatcgtcaaaagaggaggagaagagggaggaatgcacaaacaacagcagtgctgcagcaacaactgaatctgctcccgatggtgatgtaatggacgatttcgtcaatagcattcaagcggcgacaagcaatatgcaatagcaaaaaaagcgcaaaactcgctctgccctatatataaaagttgattactgctcgatttgtcataattttttgaaaatgttaaattctcaatcgttcagta

SEQ ID NO: 50793 - DNA, 534 bp, Heterodera glycines
  Genomic contig location: Contig_ID=SeqID_32; Location=78..611; Strand=+
  SCN-specific regions: Sequence locations=1-196,234-340,362-470,492-534
atgccggaccacgaactcgtggaatttgtttccggtgggtgcaagcagtacgccctgcggatgcggcaccgccaaagcggggaggagaaaacggtgctcaaagtacggggcataacactgagcgccgatgcctgtcagcttctccactttgacacattcaagaggagtgtcctacgctacgcaatgtgccattcaaatgaggatgatgaagaaggagatgatgatgatgatgacatttgttcaattttgattgagtaccccaacttcctgagacccaacattaaggacggaactgttatttctgttaagctgtcgaaacgctatcgccctattgtaactaagggggttgtgggaatgaatgcaattgtacacgattttggttttataaaggcgtaatttatacggaattgtactttttaaaaatgcataattaacaaatggaagattacaatttaaaataatgaagcgtgagaagttgcaaattttaggtagaaaaatgcataatttagtaagagaagtagcagttttggaata

SEQ ID NO: 50794 - DNA, 472 bp, Heterodera glycines
  Genomic contig location: Contig_ID=SeqID_32; Location=1537..2008; Strand=+
  SCN-specific regions: Sequence locations=1-15,72-168,201-472
atgccggaagaatctaacaacaacagcacaaactacaacaataataacatcagcaacatcaacaataacaatgagaatgctcaattatggaagcttgtacgtaagaaatatattctgaccttcaatctttgttacggctgttctcaaaaacttttcgagtccactaaaaacaataacaacaacatcagcaacaacaacaattatgcttttgaaactgatcagtttggaggcgttaaggtgcaatttcgcatgtgtaagggatgtgtttggttgaacatgaagctgagcgatttaaatagtgcacccaaaagtggtaataatcatatgaaaacaactcgcaactttccaaacacaaacaatgcaacttactctactgacaataattttggctccttcttcaataacaccaacccgcagaataacgcaaatgaatggatttgacaaaatttagagcagatcaaaattgtaacaa

SEQ ID NO: 50795 - DNA, 960 bp, Heterodera glycines
  Genomic contig location: Contig_ID=SeqID_32; Location=2631..3590; Strand=+
  SCN-specific regions: Sequence locations=1-65,87-151,205-208,230 -482,506-960
atgcccctacaacagcattatgagcatcagccttgggaactggacccaccgatgcccgaacagcatttggaaattgggccacagctcccggatgcgtgggaactggttccctatcagccaccaccacaatgggctcaagttgtgcatgtggaacaacagcaacaacaacaacaacaccaccagcaacaacaacagcagcagcaaggcgcgtgggacgagggatgggaggagcagctttcgccaaatgcgttagcgcagatccaggacgaggcggatgggttgcgccaggatttgagtaagaatttcgggtcggggtccctcccataaaaggaaaattaagtgattgagagatttgttcgtgtggggcagccgcagcctacgtggcccggttaccatagatgttcggaaaattttttttttattatgcactaattaataattaatttagcattttggctcgacgagggcacggcaggcattcctgaccaacaacaacaacagcatccgatgcagggatgggaaactccgcgcacccactttgagcgccccgtgccgcagagaacgcccagcccttcgggagattcgccggcggcactgatcagagaattaaatttctccgatcagtgcctcctgtgcatgggtgagcacgggttggactgcgaagtgaccgttcgcggcaacaactgcgggtgtgtcacaatttgtgacacgtgctgcgaaaatggctggtgggcgaggtatgcggatgctgcgcgcgagcagtccgcgcggcagctcgaggacagcctcgacccgtggactgggctagtccgcttagatgaggacagtcagaggcgttgggtaaacacacaaaacattgattttctgataaaatttaatttggttcatgttttcaggtcgaggggcacgatgtgcgccctaagtgtctcggctgccagacgagccgaatcgactacttga

SEQ ID NO: 50796 - DNA, 405 bp, Heterodera glycines
  Genomic contig location: Contig_ID=SeqID_33; Location=943..1347; Strand=-
  SCN-specific regions: Sequence locations=1-123,162-221,243-305,334-405
atgagcgccgcaaggcgcaaccgccagccggcacgcgcgccgactccgctgattttgccggctatgttggccggcgtttctctgcgcccgacgggcgtcaatttgactgtggaccgggtgggcaattttaattaaattaaaatctttatatattttaatttctcactcattaaaattacaatttaaatttaaaggcagcggggcagcgccgcgcggatggtgcaattgaggagggcgaggagcccgtgtacgatgaggtgccgcttgacagcgacattgtggtcgagatgcgcgatgaagaaaatggggaggaggatgaggaagatgatgacagtgatttttagtgattcggcaagcgatcactcaccatttaactaatcgatcgatttttcactttaaaataaa

SEQ ID NO: 50797 - DNA, 779 bp, Heterodera glycines
  Genomic contig location: Contig_ID=SeqID_379; Location=2666..3444; Strand=-
  SCN-specific regions: Sequence locations=1-27,49-296,318-779
atgtgcccggaccagccgcttcacccatggcgagttcccttctcagctggtgagtccaaccaagccattcgctgctaaattcaccgcgccaaacaaagtttactccccaagggttgcgcaacagtatcactctatgttggacagagacagagatattttagactttttcctaagttaccgatgcccatcgctggtttggcgaacatccaacagcgaataggcatgttccggcgacagtccaacctgccgatattccgcctccccaataatgcgttcacctttaattctggatttaattttcacagtaaggacattgtatttactttggaaaatgggacaacgaagggtcgaaataaatttgcaaaaaaactgacctgcaccacaagaacatgtcatcaaaaagaacagctgtctcgcacttaacagcttagcccaaacgatgtcaaagtcggagtcactcaaaaattcaaggtctataaaaagggttggctgcccggtgagggttgaaaatcctaaaaaaaggcatgtagtaaccgcccaaaccactaaatttatttataccttctgaaattagtccggatttcaggatggcataattgccattatacttcgcaagtgccttctcaattagcgacacccaaagttggcctctcctccccaccgcaaaaatttggcgtttagttgaccgatgacaagggaaaaaatcgtcgacgataatccgccgccaaattccgtgaatacaaagccttaaaaccgattatcggtatgatcaaaataaa

SEQ ID NO: 50798 - DNA, 2372 bp, Heterodera glycines
  Genomic contig location: Contig_ID=SeqID_379; Location=1..2372; Strand=+
  SCN-specific regions: Sequence locations=1-170,193-762,784-1031,1053 -1533,1555-2187,2209-2372
  Gene Ontology: Mol. function=calcium ion binding; Cellular component =intracellular; Biological process=digestion
aattgggagcgcagggacctcgccatagtttggttacggcccaaccaattcacccgtgacggtcaacagcccccgtggtccgtgttcaacaacccccaaccgacggacattgagcaaggtcaccctactcccgcttcaccaattcgcatctcgtcatgtgccattgtttaggtctgcttggaaattgctggcttttgtctgcgttggctgtcatttctcaacggcccgacattctcgagaagttgttcattacgaaagagtacaatcatagaggggtctacgaagtcaggtggtgacaactttattttgatcataccgataatcggttttaaggctttgtattgacggaatttggcggcggattatcgtcgacgattttttcccttgtcatcggtcaactaaacgccaaatttttgcggtggggaggagaagccaactttgggtgtcgctaattgagaaggcacttgcgaagtataatggcaattatgccatcctgaaatccggactaatttcagaaggtataaataaatttagtggttttggcggttactacatgcctttttttaggattttcaaccctcaccgggcagccaaccctttttatcgaccttgaatttttgagtgactccgactttgacatcgtttgggctaagctgttaagtgcgagacagctgttctttttgatgtcatgttcttgtggtgcaggtcagtttttttgcaaatttatttcgacccttcgttgtcccattttccaaagtaaatacaatgtccttactgtgaaaattaaatccagaattaaaggtgaacgcattattgaggaggcggaatatcggcaggttggactgtcgccggaacatgcctattcgctgttggatgttcgccaaaccagcgatgggcatcggtaacctaggaaaaagtctaaaatatctctgtctctgtccaacatagagtgatactgttgcgcaacccttggggagtaaactttgtttggcgcggtgaatttagcagcgaatggcttggttggactcaccagctgagaagggaactcgccatgggtgaagcggctggtccgggcacattttggatgcctcttcaacaatttgcgttctatttcgactcggtcgaaattgcgcagctgagagaacattttggatggacagcgacgcgctatttgatggacatcggatgggaccagcaaaattcatggtgaccaaaagcattcggtgccaatgtatatgttttcatttagcatgattcgaccgataattgatgaacgaaccgaactctgtgcgactcttttccaacaaaatgctcggaccacggtggaccaagttgacattatgttgctgctccataaacaggaagatgggacaacaacacctggtaactttggacggcatttttcatcgactgccattcatttctttattatcaggtgaactgatttgccggtcaccgcgtcgaattacgccgagtgtgcgaatcgaggacacttttttgccgcctggagagtatttgctctgtgcccattcattttcaaaatttggaaaacaaatgattccggggactattgtcatacacaggtgacaaaaatttagagtatttaaaaattaggataccgattgatttctcttacaatttaagttcacgagaaatttttacaatgaaacttcggaccacaactctcgacgacttgcgccagtcaatgtgttctttgctgctcaaagaaggcgtcctccaaaatgtttgtttttggttatttgactgactttattattagggcttatatttatagttgctaaaaactgccgaaatacttaattgaaaacagtttttttcaaaaatactagaaaaatagcttaacaacagctaaaaaaacgtttttcgcgcatttaaggttacggggagctcagaaaaaaaatagtgaaaaaattaaaatatcagccctatttattatatattgtcctattttgagttttctgagtttatcacacatgttctccatgatgatgctggtttggcttacatggtagacaatcacagccgggacaattatttaaaggtcgtgttttggattatgaattaattcgttttgtttatcttttttgctcaaagaatccatttcttcctatttgcgcattatttttcgaattaattcccatatttctcatttaaggtccattccgattgtcaaaactcaacaaatgttctttccactagctcttctttgcttgcgttcgattccatccctccgctgcatcgacaggtccttccttccctttctttatcaacttgccaatatttggttttgccggggactccaaattattgtttatggacaatgatttcggtcgggtcacttgcccaattgg

SEQ ID NO: 50799 - DNA, 929 bp, Heterodera glycines
  Genomic contig location: Contig_ID=SeqID_380; Location=169..1097; Strand=+
  SCN-specific regions: Sequence locations=1-194,217-786,808-929
  Gene Ontology: Mol. function=calpain activity
atgatttcggtcgggtcacttgcccaattggagcgcagggacctcgccataatttggttacggcccaaccaattcacccgtgacggtcaacagcccccgtggtccgtgttcaacaacccccaaccgacggacattgagcaaggtcaccctactcccgcttcaccaaatcgcatctcgtcatgtgccattgtttaggtctgcttggaaattgctggcttttgtctgcgttggctgtcatttctcaacggcccgacattctcgagaagttgttcattacgaaagagtacaatcatagaggggtctacgaagtcaggtggtgacaactttattttgatcataccgataatcggttttaaggctttgtattgacggaatttggcggcggattatcgtcgacgattttttcccttgtcatcggtcaactaaacgccaaatttttgcggtggggaggagaggccaactttgggtgtcgctaattgagaaggcacttgcgaagtataatggcaattatgccatcctgaaatccggactaatttcagaaggtataaataaatttagtggtttgggcggttactacatgcctttttttaggattttcaaccctcaccgtgcagccaaccctttttatcgaccttgaatttttgagtgactccgactttgacatcgtttgggctaagctgttaagtgcgagacagctgttctttttgatgacatgttcttgtggtgcaggtcagtttttttgcaaatttatttcgacccttcgttgtcccattttccaaagtaaatacaatgtccttactgtgaaaattaaatccagaattaaaggtgaacggattattgaggaggcggaatatcggcaggttggactgtcgccggaacatgcctattcgctgttggatgttcgccaaaccagcgatgggcatcggtaa

SEQ ID NO: 50800 - DNA, 263 bp, Heterodera glycines
  Genomic contig location: Contig_ID=SeqID_380; Location=1976..2238; Strand=+
  SCN-specific regions: Sequence locations=1-62,98-115,143-263
attgttgtgtatttgctacaacaataaaaatgtttggtttttaaccaaaacaaatgttgtccaataaataaataaataatttattaaacaaataaatgaggaggaggacagcaggaaataaataataataaaataaaataatgaaatggtggaatgaatgggagaatgcccggagtgagggaaagggagacatatttatggggctggtcaaggggcggggcgagagacaataagagagggagtgaaagggaaaatataatcaa

SEQ ID NO: 50801 - DNA, 1833 bp, Heterodera glycines
  Genomic contig location: Contig_ID=SeqID_380; Location=2296..4128; Strand=-
  SCN-specific regions: Sequence locations=1-175,197-553,575-576,598 -612,635-1132,1154-1833
gctgttttgaaagcatcagcggaacaaaacaacagttctgctgcattagcgacatcaatcgatgctcgcctttcaacatttgagtatgaccctgagttagggcatacattcgacgtttggctcaagcgctacggccagatcatcgcccaggacggacacgcactcagcgaccagtccaaagtgcagctattgattggcaaattgggcgaagcggaatacaagcggtactgcgacagcatcgcaccaaagacgcagaacgacttcaattgggatgagacgaccgcaaaattgaaaaaattgtttggagaaacccgatcattgtttctccgtcgctttgattgcttccaaattcgtcaagaagcgcaacaggacgttccaagtttgattgcacaaatcaactcgtcctgcgaaaacgcagatctttcgctgagcaaagaggagctcaaatgcatgattctcatcattgcattgcgcgacgaattcaccgatctgaggcaaaaatgccttcagcgtttggaagacagtcgaacgagcggacggtcaacctcactgcaagagctaggagaagagtgtcgcaaataccaaattctaaaggaaagcgcgctctccctcggctcaaatccctgcagcaccagtgccatccgagccaaaccgcagcaaatccgggacaagcagaagtccaaatcaaggccacagcaaagccagaaaggacatttccagccgaataattcaacggctattgaaaaggaagtggacctgcctgatcagccctgctattcatgtggaggcaaaaatcattggcaaaaagactgttggttcaaaaattcgacgtgcgaaaagtgcggacgaattggccatatcgcaaaaagatgcaaaaacggcacagaaacccgacgtgttcgtgccgtggccacaaattctgggaatgacatgcacattcacaccgttttacttcagccaacatgtaaggctattgaaggaagtagtaacaaatggtggagaattgtcaccgaaatcaatgggatggaaaacccaatgaatgtcgacaccgctgcacaaatcacggtgatcacaactgattcgtggcaaaagcttggcaagccaaagctgggcaagaccaccatcgcagtcaaaaactgcaacgaaaaggcattcgcaattaaaggaaaattcaattgccaagtttcgtacaacggacgaacagcgaaactgattgcgtacgtcagcgacgaaatccatcaggatttgctcggcatgccttggatcgaagagttggaaatcattccgaaggaacttatgtttccaaattcttcgcaaatcaccaattcggtgccaatgaagcatcagaaaatgccggcagtcaatttcaaaaattttggtaaatttcaacagaaacaccaaaatatggaacggcaattcaacgacaaatacggcgccaagcccatcactttccaaaatggagagccagttttcatttggaatttgaaaggcaataaggcaaattggttgccggcgacgattatcgagagagttggcaactctccgacttatcgagtcgacgttcagacgctccgtcgcgcagtacatcgtcatgccaaccaaattcgccgtcgtttcccaatggaaatggagacatcgcaaattggccaagcaaatggaaatattttggctgggaaccaaccaaatcggacccccattaaggagattgaaaaagccaaatctccaattggccaaaatcaaaatgcgccgcgaagatcaacacgcgccaagagggcacctcagcagctgaacatggacccgtcgaagcggaagtacgatgtattccggccatga

SEQ ID NO: 50802 - DNA, 663 bp, Heterodera glycines
  Genomic contig location: Contig_ID=SeqID_3542; Location=561..1223; Strand=+
  SCN-specific regions: Sequence locations=1-319,342-550,572-599,621-663
atggcttcagcaaccggcggaaaagtcactttcaaaattactttgacaagtgatccaaaattgccgttcaaagtgtgagtgaaaagtataacaatgcaattcggccaactttgcttacgtttgtctgttcagactgagtgtccccgaaaatgctccgttcactgccgttttaaaattcgccgctgaggaattccgagtcgacccatccacaagtgccataataaccgacgaaggtgatttctttcagaaagtcaaatccacatttatccagctcgggataaaattgaaaaaccagccgaattcgaattagcgactgattgaaacataaaatcaaaagcaaaatcgcattttcattatttttaggcgttggagttaatcctgcgcagaaagcatcggacattttcatgaagtacggctcggaattgcgactgattccgagagacagagttggccaaggcgaatgaaagaggaaatgggtctaccgacacacgcggacatatcatttggcaaaaagggaaactgacaggaccgtctattgagactattgtgattgtttctttgttattttttggtagctaattattcggagaggctgggaattttaaaatatgtttaaattcgttaaggaaattgagattccgcttctaaaactcacataaagca

SEQ ID NO: 50803 - DNA, 1899 bp, Heterodera glycines
  Genomic contig location: Contig_ID=SeqID_3543; Location=1..1899; Strand=-
  SCN-specific regions: Sequence locations=1-163,190-296,348-393,415 -912,934-1216,1238-1899
  Gene Ontology: Mol. function=alanine-glyoxylate aminotransferase activity; Cellular component=peroxisome
atgctcagtcgaatgttgtcctcggctgttgccgtccctcggatgtgtgaatcaaacaaaaaattgttgaggaaaggcgcgactttcgttggtcttctccgtggggtcagtcactcgccaattcggcgtccctttttaattgattctcctaactcatttcttatcaaattttgtgttttataatctctagtatatattgtatttcattacatttcctttatcacagttaataccttttatgtattataattcaaattcaatcccaaactacttgcgccgatttaattcaaattagcaaataataaataacgtaattaatatttatttattcaaataaatttatatttgcttcgaaaatacaatttatttttttttttttgatttcaccgttttgttaattaccagattttcccctattagtgaatgtccagctcagctttcactgccacagttgcgcctcctcatcggcttatgcgttcgttgcatatcaacgaaaaaaaattgttcggacctggtcccagtatcatgccagcactcgtccaggagggactcgttcatccgttgctcggacatatgcatcccgagttattcgaatgtgactcatttgatttcttacaatcaatcgcttttctttcagattatggatgatgtgaaatccggcatcaaatacatttttcaaactgagaatgcgctgtccttcgctgtttcgggcactggccatgccgggatggaatgtgccattttgaatctgctggagccaggccagaccattttggtggtgcaaaacggagtgtggggcttgcgggcagcgaatttggcggagagacttggcattaaagtgcatcgattggtcgtaccggagggagaagtgattaattggacgattttgccgaggttcgtaggaatttaaaaatctgcagatgaattatgctgcctttcccttaggctgtggataactaccgtccccaagtggcattcgtttgtcatggtgaaagttcgaccggagtcgtccatcccttggagcgttttggcgatatttgcaatgcatagtaagtaatttcatgtcaaactatcaaatctctaaaaccatttacgtgtatccacactttccaatctgtcccccttagtgacgttcttttcctcgtggacaccgtcgcctccatttgtggtgcccctttccatgccgatgcgctgaaagtttctcccttttttcgaattttcttgcatttttatatttgaaaggttgattgtgtgtatgccgcaactcaaaaagtgttaaactgcccgcccgggttggctcccatttcattcagcgaaaaagcactgtaaaaattagtcatattaaggaaaaaaagtttaattcagggagaaaataacgaagcggaaaacgcgagtgccctcattttatttcgacgcgttagagttgggcaattattggggctgtttcgacgagccgagaaggttgcaatttttattgcaaaatgcaaacaaaaaacggaaaatttgaggacgtttaataaaccattcaatttatagataccatcacacggcgcccatttcgttggtttatgcgctacgcgaaggtctttcagcagttgcccaggaaggaattgggcacatggtaaaccgacacaaaatcaatgcaaaacttttgtatgacgcgtttgaccaattgggactggaattgtttgtccaaaaagaggtaattaaggcagttaattgttttgctatatatccgaaaaaaattgtcaagaataatcgtttgccatgtctcaccaccgtacgcgttcccgaaggtgtcgactggaaggcggtgcaagacaaactgatggtatatccgatggtttactatattgctttatcaaaaaattcaaacaggcccaaggattgaaattccgg

SEQ ID NO: 50804 - DNA, 91 bp, Heterodera glycines
  Genomic contig location: Contig_ID=SeqID_3543; Location=2527..2617; Strand=-
  SCN-specific regions: Sequence locations=1-91
ggattatttttcaaaacacctcgtagactgggggataattggagactgcgggattaatagagactgggctataattagagaatatacggta

SEQ ID NO: 50805 - DNA, 176 bp, Heterodera glycines
  Genomic contig location: Contig_ID=SeqID_3544; Location=68..243; Strand=-
  SCN-specific regions: Sequence locations=1-176
atggtgcacaaggcgctcaactcgttggaccagcccgagcagaagcagttcattgagcgctgtcttgagctagacccggcccgtcgtgctaatgtcactgaactgcttgatcgtcttggccctcctgagccggacccggacgacacactcgctcaacatccccaacacgaagacgg

SEQ ID NO: 50806 - DNA, 1625 bp, Heterodera glycines
  Genomic contig location: Contig_ID=SeqID_3545; Location=2512..4136; Strand=+
  SCN-specific regions: Sequence locations=1-3,25-43,124-151,178 -179,231-231,392-442,506-506,549-558,580-585,680-1106,1128-1625
atggaattctggggaaaaaagaatcaagaaaatggcattatgagaccggctctgatcgtttcgtcctttcctaacgactttggaatggaaattgccaatgttgtttatgttgctcctgacgaggttgcataataataatagaccgactttaaattaaacatttccatccttttgtttttagatcctttaccctgtccctcgttcgttgtacactttggatccgcttcagcatgcgtacatgtcaaaatctcagtgcaataagatgaccactgttcagtcagaagactccgttgtcactgtccaagttgattcgaaagcgtcgaaagtcacttgtatgatgaagggcgggactggcttatttggactggataagcgcgggtcggattggatggtaagcggtgacaattcgtcgtaatacacttaaaataaattccgtttcgcagatggatgtcgatgtggccgtctccgatgagcaacctcgtcaagtctttgtttgttctccttttttgccgggcactctgatgaagactttgatcaacttaaacgacgtaagtgggcagtaaatatttttgtttaatttacctacaaaatgtctccgttttaagtacttgccaaacaaaccatatagaggcactgtcaaattaaatgtttttcatggaactattgcaagctgggcttctaagggaatctgcagttttgtttggtggcaaaagcagttcaaagaggcagacaggtacacagtcatatatgaaagccttttgagctaaagatattcatggtagcctcaagtttgacttaggaaagagacccaacgatggatccccggcggaactgtcactatttaatgttttctcctagggcttgtttcgagttttctctcacaaacatttacgaaaccgatgagccgaacattgccgttgtatatgaagcggtaatatattttatatactaactacaaaaaaggagaaagcttttagtcatggcaaagtgtaaagcgttcaattgtccttactcccgcgcaagttggcgatgttccagatgacgaattgaatttattgctgccggtgggacatgtccatcccattgataactgtcaagtaattctattttcttttacaaataaccaatcctttttaagtcgaaacaagggccgtgtgtgaaaaagtttattgaaaatattggcaatcaacagggaaaacagccgggctccatcgttacttgcgttgtcagtgaaagcaatgggtcggacaaacaacagaaacagaaagattccgtgatggcttgtcatttgactgatgactccctcagaccagtttctgagattctttcggctggatcctttaagcagatcatgaaggttgtcaacggggattccggtcaaaatgcgtagatgaaaaaggttaggaaatttgtatacctcttacagttagctatttctctcaataagtcattttctgttttaaacaaattattcaggtatccacagtgaaattggatgggaaggatggaagagattacactgattcgccttttattattatataaccttttgccattttattggttgaaacacattcacacaaaatacaacaattggaaagtgaaatgaaaagcaccatggcaaa

SEQ ID NO: 50807 - DNA, 1030 bp, Heterodera glycines
  Genomic contig location: Contig_ID=SeqID_20300; Location=435..1464; Strand=-
  SCN-specific regions: Sequence locations=1-14,52-108,257-259,281 -362,384-491,515-632,663-687,709-789,827-875,898-908,933-1030
atgaaattattccctatattatttctaattgtaatttttaatattaaatttgatcaaattggagcagaaaagaaaaagttgcaacaaaaatcatttgatgaaatatttggagaaaaatgggaagaaaaagaagaaaaaaaactaaatgaactcaaaaaaagagaaataattggaaaattttataaaataaaagagaaaattaaggaaaaaggaagaaaatattcaacaaaagaatggaataaaattgaagaaaaaatagcgaaaaaattggggacaaatcgcaaatatatttatgaatggatcaaagaatttggtcttcaaaaacaaattcataaaaactataaatcaacaactgatgaagaaaaaattgtaattgtgcaaaaatttattaaaatgacaaatgaatataagcaaaaaagaaaatattcacataaagaatggaagcaaaattatgcggaaatttgtaaggaaattggagttagccgtagaacaatttacaaatggaagaaacaatttggcattcgcggtaaaataacggatgaagaaaaaatgggaaagatgaaaaaacaatttggagaagaaatgtttgagaattgaaaaacggatgtagaaatttcgttgagtccctctccgatattttatttttattttgaccaggtgctagcgcgtttgttaaaactgccaatgggtttgaaaacaaaaaatgggtaaaataattaaattaatagcttggctcaaattcaaccaaattaatatttcgtggtatccattcaatagctttaattgctctctttcataatataattttcttatatttttaacttaagtataaaagaagttatggtcacaaaattgcaaaaaatcttaattcagcattttttgttcattaacttttttgaaactcaatgaaattttccaaaaatttaaatatccatatagaaatcttacgtctatcgacatatatattaatcttagattaaattacattttagagacataaatattttagattgattattatcataataaa

SEQ ID NO: 50808 - DNA, 679 bp, Heterodera glycines
  Genomic contig location: Contig_ID=SeqID_20301; Location=71..749; Strand=-
  SCN-specific regions: Sequence locations=1-30,55-679
atgcgttcagtttccttttgtgccaacaatcaccagcagcaacaacaacaaatgttgccccatttcgacatcaccggccccgaaatgttgcagttcgtccacagcagcaaccgatgtcctgacgaacggctgaatggccaaggtaaatgaccattttgagatttatattaggggccaattttgaaaaaacaaacaaatcaatttttattatctgagtaaacgttttgagattctctgaaacccgtcgggggataaattggaatttttgacagactagccgaaaattggcaatttttagatcaaattttaaaaattttcggggaattgagagcgatgccgcttacttttactgatctcatcttatcaaacagtttcagatgaacggcatctggcggagaaatgtcgtaacaaaaacatccgcaacggcaccaacattggtaatgatgaacactttggcgacgctgatgccggcatgtcggctgacgctgttgagcggcgcggttggtgccgttttgcggccagtttcggcctgttggcccgacttcggcacgcgcccaccaattttcaccgtgaaattcggcacctcgacttggcccagagccgtgaagtgcataaagtgacggtcatttatgtggccaaggaccaaccagtaaacggcggggagatcaaagggctataa

SEQ ID NO: 50809 - DNA, 1531 bp, Heterodera glycines
  Genomic contig location: Contig_ID=SeqID_20301; Location=1149..2679; Strand=-
  SCN-specific regions: Sequence locations=1-479,501-528,550-627,654 -688,710-902,961-1131,1153-1263,1285-1327,1349-1531
atgaatggttcaattcgttggccaacccccaacagaatgacggtgccattccgtcgcttcagcaagcgaaggcggccagcgttcggcaaaagtcgtcctcattcggtgccccgattgaccagtttcaggtaacagcgaccaccacatgctgaccgagacggaatcggagagggagggagggggggatacggaatgagtgccgaaaaaaaattttttttttggggggggggatttgccacgtccgtccatgcggctgtttatttttatttcgaatttcacatcatttttttgttgttggatcaccaattttccttactctgaccattccccccccccccctcccaaaggtgttggagcgtgccgacgcgccgctcttcgagcgactgtttgcgctgatgttgggccaacagagcaccaccaccgccacgcttttgcccgttttctgtgctatctgtcctcctccatcaccttgggcttccactctcaacttgtccattcactcatccaatcactggcgcgggtatttactgtttccttttttcagggatttcttaatttatgggattaataagtttcgaaaatctttcaattttggtcggtccttaattcgagtttgattttttttttcattttaattttaattccaaaaaacatcaattatttttccaaaaagtgccaatttttccttgtttcaaaggtaaagcatttgcgcattgccaacgagctgaaatggcatttgtgtgcggtgttcgcacggcactccatctcgctgcactggtccaacttggcggacaaatttgtggccaccggcgacgactttttcgagggctttgtcattcgactgtccggccaatggccattgcccggcttcccggtcacccaatggaattcgttgccaccctcaacaaccgcaacagcgacaacggcaccacatgaccaccagcaacaacaacagcagcaggcaaatgttggggacggtgttggcggcgaccaactgcaacagcaacaaatggtcaccttcatggagacggagggtgccgtgctgaagtgagtgggggggggggggcagaaacgctggcaaatcgggcagcaaatggcacaggcgtattgtatttattgaattgaacaccaatcaaatttgaggagttttgaaactggagtaattcgtgtttccccaccctgttgtttcataaaattttataaaaatactttgttttttacgtaaaagtttaaaattcaattttttaaaggaaagtgtaagagacaaaagaaaattaaaattttgtagatgaggttttctttcgaaatttaaaacaattttttcggcaaaggctttaattgggaaaatgcccacccaattgcattcgttaattaattgttgttacacaatttttcagtttggacaaggacagcaacagtctttggtcgcgtacccatgtcggccgacactgttaccgtatgcagccaatttgcatggaggaggagacggagtcgcccgtgtaaaacattaattctttttgctaaaattaaa

SEQ ID NO: 50810 - DNA, 300 bp, Heterodera glycines
  Genomic contig location: Contig_ID=SeqID_20302; Location=688..987; Strand=-
  SCN-specific regions: Sequence locations=1-152,193-194,216-300
atggcaatcattaagaattggtgtcccgacgaaaaaaatgttaaaattttggcaggtattttttctaggcttaaaaaatgcgctgatcacgaatctgagctcagattttgaaaatcattgatttttatctaagatttttcgtcaactacttgatttttttcaattttttaaattatttttaaaaaatttttagcaatgaattttgggttaaaaaatactctgatcacgaatctaagctctgactatgcatgaaccttcattttgtctatgatttttcatcaagtgtcataaaaaaataaa

SEQ ID NO: 50811 - DNA, 637 bp, Heterodera glycines
  Genomic contig location: Contig_ID=SeqID_20302; Location=1402..2038; Strand=-
  SCN-specific regions: Sequence locations=1-421,447-637
tgggaatcgctggacggattggcccgtctccccgatttggccaaactcattctccgaggcgctccgctgcccggcgcccgcggcgtggacagtcgcgagatgatcatcgccaaactgccccaaattgtgtgtaagccagcttataatcaacaaaattaattgttccgttctatgtaaccttgaaaccccccgcccgtcttcagactgatttggaccgttgcgatgtgtcgccggtggcacgacgttccgccgaattgctttttttgagccgattcggtgccgaccccatcccggccgaacaccgcgcgacgatcgcacggctggcgaccatttactccatttcaaatggtaaggttcggttccacttaaacaaggggtgggcctgcatttacacatccgtttttgaccaattgcccccatatcctccttttatcctcccctttttgagatggcgacccctccagcgccgtttccgtccctcgccctgcccagcccttctccaccattcactccaaaaaggtccgacttgagcacgcgggtcgcagcatggagcgcagtctgtcccttgcgctgcccatccacaaagtcgtcggtttgggcgcccgactgttcggttttgctcccgacacattaacag

SEQ ID NO: 50812 - DNA, 158 bp, Heterodera glycines
  Genomic contig location: Contig_ID=SeqID_20302; Location=1..158; Strand=+
  SCN-specific regions: Sequence locations=1-158
ccccccctttcgcgtgttaacctaatacattaagtgttgtttgtcgtctcttaatgaattaattgcttcttttgattgtttgttctctcttgacaatgcattttgttccaaatttgcctgtctctctcaagtgatattccttttaaacgattctttgt

SEQ ID NO: 50813 - DNA, 2234 bp, Heterodera glycines
  Genomic contig location: Contig_ID=SeqID_20303; Location=28..2261; Strand=-
  SCN-specific regions: Sequence locations=1-137,159-297,357-397,419 -528,550-564,586-762,784-1995,2017-2234
  Gene Ontology: Mol. function=zinc ion binding; Cellular component =nucleus; Biological process=chromatin-mediated maintenance of transcription
atggcaaataaatttgtgcttgtaccacaagaaatttaccggggtctcacctctgcgacggacacgggtgacatcaatttggatgctgtacgacacgatttgacgcgtgccagggctgaacgaacaaacccttcagctaaaaatgtcagctacaatcaacagcttaggcgatacttgcaaatgagacgggaggtcgcggacaaaccagcacgggttgagctagtcaagggattgagtgttctgatgaggcgaggcggtgctgatgatgaagcagaagttgtagatacaccaccccgccctcctcgtcctcctcctccaccaccgcctcctggtcagcatcctcctcgtcgtccaccaagccctccaggcccaggtccgtccccgccggggagtcctccgccgcgtccacagcgtcctccgagaccacctagagctgctgcgccgccctctcggagagatgggcgtgtggaggaatggcgaaaaaagagaaacgacatacaacaacggcagccggttgtgcgggaccttcttgctgaagcagctgctgctccgctacccgaaagtgacgaagaggatgactacatgttggagagcggattcgctctgccagcaccatcacaatattatggcgatttgcccgttctgcctgacaacgcggacgcaattgaggagatggacactgcacagcacaggattgcaaccagaagaaaattacatgatggcgatgacgatttgcatcgcaaaaaataccgggcctattatcctcctcccccttctcgcccacccccgtctcgtccacagccaaaaattgaaacacctcgacctccaccgcgtcctagcctcaagaaagaaccacaaccactgctcgatcctcggccatccacatcacaacaagttgatcgcaaacctaaaagggagccaaagttcgatctggatccgcgaccatccacatcacggcaagccgggtacaacccccctgcggaaccaaaacatgaacagaaaccgtcaaaaaagccacctcctcgcgccacaccctatcatattccgaaaagagagccaaaaattgaagaaacagtgccacggcaccagcaacctcctcctgctgccccacaagtgtcgtctgttccgccacctaggagagggaccaaacgtcgccaccccccggaaaatggtgatgagagtggtgagctgcgcatacgtaaacgagtgaggcaagcgcgaagagtacgagtgtattactcaccagagccgggtccatcaacatcagcacaaagcgatgaacaacaacaacaacgtgaactgtttgccattccgtcaaatcagctgaccatggcacagagaattgagctaatatacatcaaatgcaaccgttatgccgatcgtatgggtgtccggggaaacgcaattatcaacactcaaaatgctcagccattggtgcgaagcaatttgcgaacggccatcaggtatataattgacagaagagcgggtcgacctaccattagaccaccgggagcggaccaattggaggagcggcttaggcaggacccaattttgtattcattaacggctccaccaaagagaccatcgcagagcacaagcagcaggacgtcaataaagaaggaatttcagccgaaaaaatggaaatgatcaacaccactcttgacaagctgtacaacgatccatcctctcctgctgcgtttgccggtgttagtgcactgtggaaggaggcgcggaaaaagttaaaacaactacggaaaaaggatgtacaacactatttggagggacaccgcacgtacaccctgatgcgccccaggcgggtacgatttccgagagcaaaaactgtagctgctggcttcatgaccgacgtccaagtggatttggctgactttcaagcgctttctcgtcacaatcgcggtcaccgatacctgctggttgcggttgatgttctctcaaaacgcctgtttgtcgttccactcaaaaataagaaggccgaggagatgctggatgcattcaaagagcttgtcaagcaaatgccaatggtcccacaccgcattttctccgacaaaggcaccgaattcaaaaacaaattgctcaaggaattctttgaggaacgggagattgagaaacatgagcccgtgcattcgtcagtgaaagcttcagttgctgagcgggcaatccgaaatgtgaagcagcgactgtacagatactttgccgaaagggaaacgctgaattgg

SEQ ID NO: 50814 - DNA, 780 bp, Heterodera glycines
  Genomic contig location: Contig_ID=SeqID_20304; Location=41..820; Strand=-
  SCN-specific regions: Sequence locations=1-8,30-64,102-254,293 -450,514-543,565-780
atgtcatgcactttctgctgcttctttggggcgtgtacttttttcagttcggtaaatttgggtcaatttttaaaatgaaagaaaaaataaaaattataattcgacaaatttatttagcaaaacgaaattttgcatcactgtgtgtttgatctacagtactgcttattcaatctttgccaattatcgacctgcattacgctattccatgtgcttgcaaaatttgcaaaccttttttccaccagcaatgattaccgtattttattgtttttttatttataatttaaatttttatcatttaggaacctgatttaattacttcactaattctgacaattggtactgtattcttaacaattactacgttaactcctcccatcctctactgtatttgtgtcatttatatggtctttggtatagttaagaaaggtaaatattaatttcacgggatttaattaaaattaaaataaagaaaaaaatgaaaaaagaatataaaaattgcaaaagagattaaaaatttttctatttccgcaattatttttaaatcattgaacttttgttttaatgaaaatccttcgcttaacggtccaacaagttttataatttggtttttcagcgtttttctcctccacggctaattatccgcctccagcatcaaataatgccattgaccatttgttgcgcgaacggacacgtttgtatcttatttgtcttcttggcactttgccaccatttattctgttcttacttccaatcgtgcaacaaatgctggccattcagtag

SEQ ID NO: 50815 - DNA, 611 bp, Heterodera glycines
  Genomic contig location: Contig_ID=SeqID_20307; Location=162..772; Strand=-
  SCN-specific regions: Sequence locations=1-77,99-471,493-611
atgaagaaatgtctgtggattgtgctatttatatacagggatgaatcttttgcgcttacaactttcgattttgcctcaaattgcccctataaaaggagcatattttggctgaccattgcatttccattcgctgtttcgtcgcttccttttcactgtaagtgccttcgccccttgccacttgataacacatactgctgatggtacccccccccccccgccactttttttggcagaaaactttttgtttttaagaaggatcagcgatcccaaaaatccttacaacggagtccgatttgcggcccgacttttgcggccccagcatttgcgcctatgtccaaaatcggattcaaactaaaattttttcaagccctgctcttcatggcttatttaaaaaaaaattttctgccaaaaaaggggggatgccatcaagcaatatcaccgcgcccgttcgtcattttcctccattctgtcgttcttcacctccattcatttcagcctttttgctgcaactcaccagtgccgagaacacccgccgccgactgctgtttttgtgtgtgccacttttttgtgttgtgttcgttcgctgccgagccgagacgactccgtcctga

SEQ ID NO: 50816 - DNA, 448 bp, Heterodera glycines
  Genomic contig location: Contig_ID=SeqID_20308; Location=1555..2002; Strand=-
  SCN-specific regions: Sequence locations=1-174,218-340,362-414
atgccaaagtttaatgagcggctttcgcgggattggtcgataacaaaagcggaagtgccggtagcacaatagatttgttttcgatttttatttttaagctcaattacagggaatttcgttggaatttttcacattttgggctcgcggggggccaagcgatgtgacaattcaggcaaaataataataaattaaatatttttagttaatttgtttttttccaattaggcccttgtccatggcattgacccaaagttcaaattctcccgaatctgtgacgagtcgtcgtttgtgtccgttttccaatttgtctcaaagtcaaatgaccacaaaaaggaggagggcaatgaaaagatacagcttgaacttcacgcacagtgcttcaacaccacgttaacaggtggaaaatgatttttcaatttattgaaaattaattttttttttaaataaa

SEQ ID NO: 50817 - DNA, 1128 bp, Heterodera glycines
  Genomic contig location: Contig_ID=SeqID_20309; Location=101..1228; Strand=-
  SCN-specific regions: Sequence locations=1-84,106-285,307-380,403 -414,437-461,483-603,625-862,887-1128
atggtggacaagcacgagcgccggatccatgagctgctcatcaccgattttgtgcgatggtggactctgaataacactgacggaggtggtggtggtggtggtggtcataacggcggcggtgagaacagcacggcaacacactcgttgaggagcaactttgtcgggtttttaccagaacaaaaaacggattttttcattgcggccgaccatgtgtacctgatttggcgtagacgtgtatacaagttccgtgttgggcactacttcaatgatccttcctcgcagctacagtttttgaccaactccagtgacattcgcttcaacttcctcatattcgagagagatgatgacgccaaattggaagacagcactgatcgtagaaacagcagagcagcagcagaagcatccgcaggactaacaccatcatcacagatgatgaacagcattgagcggctcctgctcgctttgatgtacctctttgatgtggcagtcatctgcattgccgtttgtgtgatccgactactgcgccgtacaacatcaaattcgggcccggacaacaccagccaagctcgcagcaacgatgtagtacacactacggaaatgatggcactgacaagtggtgaatatggtctgatccagtcactttcgttacctaactcggggggcggagctttcgcctctgtctacaaataatccagtgtacgctgtgacgcgtttgtcgacagcgaagctatgtctaaccagtcaaccactatttaagccgagcattttgtaccattgacttgccggcttgtttgatgattgttagtatttgttctgttgttattatttttgttgcctttctttctattgctgccccggctgctatttaatgcaaagagcaataaagcattttctacaaacatttgcgctccaaactgttgaagagctgtacgcatattttaaagaggaaattttgagctccccgggcgaatattacccaaacccgctcgcagagttcgtttgtgtgcacattgccaacgaggatcacgctgaccaaccggtgcttgtgaacggcacacttgacctgatcgaaggcgtagaactctactccacatgttatccgagaacggaaacggggaccatcgattg

SEQ ID NO: 50818 - DNA, 3003 bp, Heterodera glycines
  Genomic contig location: Contig_ID=SeqID_3546; Location=275..3277; Strand=-
  SCN-specific regions: Sequence locations=1-343,366-1740,1763 -2236,2258-2310,2332-2676,2700-3003
atggctcacatcagaggcccgcacgccaactggcgagatggacactggctgtgggactggcgcactctggcccagctctacaccatcacgttcaacaaccgaatggaggcccaaaaagtccagtacatgaagcagctgcagggaagacgacgtcttgtccttccaggctcaatcatcaactggctaagcgctctcagggacaacaaaggtagggcaaacatttcgagtttaataatcaaatagctgctatttagggtacaagggcgacattggccgagtctacatgaccgacgagcacttccgcgggtcccggcagtactaccagcgcgagtacgccaactgcatgaccatctgcagagaagttggaaagccggaccttttgatcactctgacgatggatcccgaatgtgatgaactggaagagatgctgccaactgacccagatggccaccgccagcagtggtacgaccgtccggatgtgatttgtcgtctctttgtcgacaaattcaaagagctgcgtcatgaccttaccgtcaaggaggtcatggggcccgtccgtggctggttctactcattggagcatcagaaacggtaaactgagtcctttggttttgaatatttatgagtcatttttagtggcctcccgcatgtccatttcgcactgattttggactgggacagaatccgaagtggcggcaccatcaacacgccagaagactatatcgagcagtacatctctgcagaaatcccggacaacccctcgggccgctcatccgaagtgttgctcaagcgagagctttacaaaacactgaggatgaagcacatccacacgtgctcagctcgaagatgtttggttgacggaaagtgcctcaaacgttttccggttagtcaatattttacttcacttttatggttgtcaagcatatcaatttagaagccattctcgtacgacaatgtctacaacgaacacgcttacccgcggtaccggcgacgtcctcctgcccctgacgccagggcagcagctcgacacccagagcaatatggacgcgacttccagtacacggacaaaagcggcaagacgattcgggttgacaaccgttacgtagtccccttcaaccccttcctcacttccaaatacaaagctcagttagtaaatcaaattttggttgaatctttttactttttcaccttcatttagtatcaacaccgagtttgtggctggagaaggctgcacaaaatatctgtgcaagtacgtgatgaagggcgccgacatggcgttcatccaagtccaaggcggacccgacgtccgacagaaggtggactacgacgagtttcaccagattcgtcttgcccgctacatcacctccatggaagcgatcctctcgctttggggcacaaagcttgtgggacgctctcatgaggtacggagtttgcttattacacccacatgttatgggattgctcctttaggtggacgaattggacgtgcacggtccgagcgggcaccggattgccgttgagcagggctttgacgatgaagaggagaatttgaacgccatttgcgaggcggcccaggccgaagaagagcgaaggctgaggggcgaagagcgcgtcactcagctgaccgcatacttcgcgttcaacgaagcgaacccgccaattggcctttcgtatgccaactgctacaagaagttgcgctatgacagagccaagaagcagtggaagctgtatgttgatgcgccagtgccaaagttctgccggctcaagaccgtttcgcccagcaaccgcgaactcttggtagaacgccaagcacattaacaatttgatctttttttttctattataggcaattcgactgcttctgttggttgtgcttgacccaaagggatgggagtcattgcgcaccgtcaacggcaacgtgttcccgacctttgttgaagctgcgcaagaacgtggactcctcactgacgaagacctctggatgaagaccatcgatgacgccttcagaatgaagaagtccatccggcagcgcattcgatggcttgcagtcttctttgcgacagcgaacctcgccagtccttgcacaattttggacaaggttcttgcaaatgcggacaagtggctggtaaacacaagcgttgcgagagcctcggccgaagagcagaagcagtacgtcctcaatgccatggaatggttcctgctcgccaatggcataacgcccgactcggagccgagggaggatggcacctatgagtccgcttgcgaacacattggtctgccacgtcctcagggccttgtgctcaccaaggacattttcatgaaggtactgcaactgttaccaattatgtgaaaaccatatgcctttattagctcgccttcttccgtgatgatgcgcttaacgagcatcttcatgtggacttccttccggacggtcaacgacgcggtgaaatgcgccaagactaccttcaaaagtacatctccggtcccaagcccaatgaagagcaacaacagctgattgatgctgtgcaaactgcgctggagcacgtccaacaagtcatcgatggacaatgcccagacttttcgccagacatccagcgtctcttcatggtcaccggtgaaggtggcgcgggcaaaacgttcacgtataatgtgagatcacttccttatttttccacataaattcctttttctttgtagaagatcattgctcgcgccaagtccgctggcatcaacttcctgcccatggcgtcgaccggcattgctgccgaactgctgtacgagggccagactgtgcacaagcggctttgccggcttaagcaagttgattcgtcaacttcgcccaatgttgacaacgagagcaactttgccaacatgctccgcaacatccacggcatcctgatcgacgagatcagcatgcagcacagggatgtcctcgagtttgtcgaccggcttctgcgttctgttgccacgcaacagttcaaggacttgccttttgctgggaag

SEQ ID NO: 50819 - DNA, 2918 bp, Heterodera glycines
  Genomic contig location: Contig_ID=SeqID_3546; Location=3329..6246; Strand=-
  SCN-specific regions: Sequence locations=1-706,729-927,950-1247,1269 -2223,2245-2918
cccaggcggttccgctggaaaaacaacaccaaacgccgcaggagttgcaagctgcaggcgacccaactggtgaaagcgagccgttacgaactccaacgaggaacgaagaacaacatgcattcctcctggacttcttcaaaagaagtccagagcaaaaacaagaagcattcaaagccctgaagcaacgctttggcaagagtgctgtttcaccgcaagcttatggtcgatggtggaagaattttggactcggacagatcatattgaaccaatgcggaagtgagttttttatttgtccgctttcaagctatattttctgtttacctcattaggaacatcggaacgcagttcgtcagcccgtgaaagcgtgtcgccagcgcaatcggctcagtcggaagaaccactgcaagcgccgcaggaactggaagctgctggtgatccaactggcgacagcgagcttacaagtgctgctgtacgactgaaggaactggatgagggcttcggtaaaagtgtaaccaatattcacttatctttattcccacattatagacactccatcatcgaaacaatcgagaagtaccagaagaatacagaagtcgaacaaatgtgttttttgcacaattcctttgaacgatgctgatggctatgcaatgttgaattgcggacattcgtgccactttgaccagccctttgccgaatggtacttaaactattacttttattaaattaaacgattcataggtataccgatgtgccgaataagaaatgcaaatttcgttggtgcaaaaagaccacatttcttaaatgcggtgactgtcggcaaaaaattggcatgggcatttatgaaaccggctgttattgcacggacgcatctgcaccagtttatcacgcggatgaattggaagcgaggtgctctttcataatgcaaatttgttatttttgttttattataggctcaaagcaagtggtggaaaatgcccagattgcggcacgcaacaccctggcttctgcattttgtgtcagcggctgttcaagctgcaggcaaatgggcttcgtcagagcaaggtgttcctgccttgctgtgactcttacactcacttcgaatgctggtagtgtttaatcatttcggatttttaccccatttccttttggcaaattaggtattcgcccgcaccgaagcagagctgcccagcaaagtgcacaaagccgtggcaaggccttcaggacatgcattaccagtaagcgacgactcatacatttctttcactagtatttgcatttgtattttagtcaaatttgtggtgtcgaaaatgctgctccgttgcgtgcagttccaaagccaagaggcatcattggtgcacgcccgctgaaaaatgccaaggctgcgtctcctacagagtccattccatctactgttgacacgacgacggccgcggcttcggatgtttccgccaatgaatcccaagcgctgacggactcgcatcttatgccaccaccatcgttggctcctcgccgcagcacacggatcagccgacaagcgtccatcgcaagcaatcggcccagtcctgtggcgccgaagcccattgctccagtgacgcactgttgcggaaccattcggtccgctcactttggatatggctgcggttcgaaaaaggcaaaccatctgccttcatattacaactcgcttcgggaccaagtcagttccaaatatgaattcagtagtcatgttctttctttataggcacaacacaattgccctcactgcaatgctttgcttttgccttccgaagcgattggaccaaccgcctattcaaagtgctgcgcaaaaggacgtgtcaacttggcggaccgctacaaagcgcttcgtgctcggccagccgaattggacaacatactccaaaacccggcgggacaatacaaaggctggagggattcgctctttcgcaacgtgctaagatacaacaacaacttggcattcggaaacatcaagatcacccgaagcgaagagcgcatcgaccaccatcggatcgtgaagtgcaacaacatgataaactacatgttgtgggatttcaacccacccgatggtggcaaaccccatctgcacggacaactgttcacgattcctccagccgatgcacgtactcgcctgggtgaaatttctcgggaacattcactggacgtaagattaatttatgcttcaaaaatattggttttatttttatactacttcaggaagaactgatggaggccctttacagcgtcattctcgcaaaccacaagcttgctgtggtttacgagacggcagcggagacgtaccgtcagctgccggaagaagaccgagtgcagtttcgaatgctattggtggatactaaccagcggggcacagagcgcaaattgaatgcaaatgatgcgccggcaccggacaatttgcatgttgatgaccgggccaacctcaagcacatccatcctggacggcttgaggcagaaacggaggctggaagtcgccttctggctcaagtaagcttcggcgcttgatttcatcatataaacagttcccaatttttctagatttttttggactgcggtgcgaatatcatgccgccgagcgtgtacgacgtggtgctcacgggccgagaacgcaccaaaatcgtgtacatgaagtggtggaacaggaacattgatcctgcaaatttcccactgattttttccttcgaacaatttggatacggtagagtattttttgtaacggttaagcattggtgcaattttcctttatagaatatggaactaaattggcgttgcgggagcacgaacgtttcgactcaacgtacaagcaaatcagggacaaaaacaacaacgtcctgcttgatgccgccgaagaccttggcgaagaggaggagttcctcggctctgaactctag

SEQ ID NO: 50820 - DNA, 1066 bp, Heterodera glycines
  Genomic contig location: Contig_ID=SeqID_3547; Location=297..1362; Strand=-
  SCN-specific regions: Sequence locations=1-389,420-946,968-1066
atgtcagagcacatcgacacgtgcgcattggcccgccttcgtcacctgattaaggagatgaagaagtttgccgctggtgccaaagacaacttggcccactctcgtggcgtcggcatcgccgtccaggtgccaaagccgtggccggtggcagaggaggatggttggacgggcgtcaccatcccgggctgtgaggaaaaatcgcccgttgctgagccggctatcgctgaactgtgagtgtgtgcaaaaccttctttttcacaaaattctttccttaacccgcatttttaggcgtaagccgaagaagcagaagcttccaaaggtggtgactgacaagcgccagccttggctctgcaacaatgatggccggccgattccgggactggctccggtacattcagtcattttcttttttcaaaatattggttccttttttaggttgcgaaacagttgccggtggctccgcttcgcaagttgccaactgacatgccgcgtcccaaaaacgtgtaccatacgatcgttaagggcaaggtgaactgagtgcgaattgcaatcctttatttttttgcctattattttcaggctgtcgcgtcaagcaagcttttggagctgtcgaagatcgacaagccacgcgtgccgatcggctacgcgccaattgctcgagccgaaaagccagcgcttcaaaaccgtcctgttttgaacgctgtgccgaaaccggtactccgcgaaccgagcgaggaaatgttcgtcgttgtgggaaaggtgtgttctgtgttttttaaatcaattatcgttactgaatttttttcactttaaggccatcccaaaatcggccatggagaaggccaggaaaatgcccgacgtggtgaagaaagtgccgccaaccgtccgccacagaagaactgtgtggaactcctcttcggtcagcttcgtcgtcccgtgcttttatgtgcttcaacagtacatcaaagcaacgacttccgcggttgcgtcttctgctcccgctttgaagtcgtcatcgatgagctacgctcaagctgtaatcatcattctttctttttgcaaatag

SEQ ID NO: 50821 - DNA, 1831 bp, Heterodera glycines
  Genomic contig location: Contig_ID=SeqID_20312; Location=70..1900; Strand=-
  SCN-specific regions: Sequence locations=1-201,224-322,349-770,794 -968,993-1007,1040-1149,1171-1310,1332-1707,1730-1831
atgcgaattgctcatttgtttttagcttcgaatgatttccgagccgttggtctacggaatggcactttttcaggtctctttttaacgaaaattcaaactccaatttttggcataattgagagtgtttgatcatttgttggatcaggtgatcagcgagttgctcgacattcgtaacatcggtcgtcgccgatggcttcacattttggtggctgatttttcttttattcgattcgcttttccgctctggtctcttctcattgctgtttttctttatttatctgatcgcttcttcttttgttgctttaccccccccccattcttttgataatttattcatttttatgctttgttcctcctcttattttttccttcctcttttagtcatttgtccatttttatgctttgtccctccgcttattttttccttcctcttttagtcatttgtccattttgatgctttgtccctcctcttattttttccttcctcttttagtcatttgtccatttttatgctttgtccctccgcttattttttccttcctcttttagtcatttgtccattttgatgctttgtcccccccccccttagacttcgttcccctccaaaattttctacaaattggccctgttgctggtccttctcattttgcccgtccgttttctgtgtggcgttgccgactcaatgcttctgctggacaatatgttctccgtcgccacagtcatcctcacttctctccattttttggcactttcatttcagcgtttgtctgatggcttttcacctcccttttcagtattattgtcgcgccgttaaatttgttgggccatttgtgttgatggtaatattccaatccgattaatccgctatactccttattcagatctacaaaattatcacccaggatttggtaggtccaacggcgatcacttcaaccgcaaaacaatcggcgttttgcttttcagttccgcttcttcctcatctacttcatctttctcatcggcttttcccagggtttgtcccttcctttgtgccaaatttttgccccgcgggggtcaatcgtctttcatccgtttgccaatttgtcccttctaaggctttttcgtgatttttcgcgcctgtgaaagagcgcggattgccgccggttcgcaaggcgacccaaacgacaacaaagagaacattattggcaatccggtggaggcactgatccgtctgttcataatgacagtgggcgaattctccactttctaccaggatttgcacacgtgccaaggtcacacttttgccatgctcattaaaccaattataataataattatccactttttgccattttgttttagcccctcttctcggaaacatcggcaaagtattcattccaccgcttattctcatttatttcagcttcccattcgatgtcccccacagattctgttcttcatcttcgagctgctggtcagtctgatgcagttcaaccttctgatcgcgatgatgacgcgaacttacgaaatgatttacgccactgaaaaggaatggaagagacaggtggccaagggattaagcggctaattagggggccaattagggaaatattagtcggctaatcgcaattgagcacaataaattgggttgggtttaatttggcattctttcagtgggcgcaagtgattctgatgatgtgagtcaccggtgtaaatgacaggcaggttaattggtaattttatttttagtgaactctcaatccatccgaaaaagcgtttgatggctctgttgggatattcgcgtccaatcgggacaaacaaacgcaaaagggcatttgttgtgagcagaaag

SEQ ID NO: 50822 - DNA, 1365 bp, Heterodera glycines
  misc_feature (1027)..(1027): n is a, c, g, or t
  misc_feature (1033)..(1033): n is a, c, g, or t
  misc_feature (1050)..(1050): n is a, c, g, or t
  Genomic contig location: Contig_ID=SeqID_20313; Location=1601..2965; Strand=+
  SCN-specific regions: Sequence locations=1-342,364-562,584-752,792 -960,982-1365
atggctgtcgtcgacacaaacattaataattcagtaagagaaagtcattttataataattgggttaaaaaccaaacgagtaaattcagctgtatgccgagttcaaagatgctcgtccgagttggcttctcatcggttgtgccctccctttgggaattgtcgccgccttcggaatgcttttcaatttttgcgttatttttgtgacaattcgctcaaagtccgcatttatattttaaattccgtttcaattattctaatcctttttttggggctttgaatggcactgccaattttctgctggcactttgctctttcttcgaactgctccatcagcatggccattttctgtttgtgttcgtcgctttttcgggcttaaatttcatcgaatatcaaacggccgcacttttcgcggcactttccgtctttggaatgggtgggacaaatttaaaagtgaaaatcaaaaatcgtgccaattttaggtggcattgccatttcaatgtttttcactgggcttgaccgactcatttgtgttcttttcccggaaaagtaaggcataaaaaaacatcccaaattaattgacttaattatccaattaaaaaaggcactccaaaattaatttgcgcttttatttgggcgcaattacttttgtctgttttctgttctccgctgcgttactttacacactctttttgactgctaaacagctcaaaggactgatgatcagcggatgtatcgtcgacattgtccaagtccaaaaaaaaaaaattatttatttaaattgaattttaaaatggaattcattaaattttagggtccatccgttgcatttttcgctccttccaatttgctcacaaatctcgtgaccactgccatttatttggccatcggaatcgccgtcaaagccaaaactggtgatgatatttaataaaaacgctttttcatcccaattaaccttcattttttgcttcattttcagcttctttcgccgcccaagcgaatctttcccgccgcggcgaataatcgccgcncttttngcgttcgcttttcgccnatcgtcggcgtcaacatggggcggctatgggtgcttctgcgcccctccattccatcgccgatcaccgcgtggctttggcaagtgatcaccggcattccactgaatgtcattgccgcatcgaacggaccaattctgtactttacgaggggagacaatagcaaaaaatgaaatgaaaactcaagcgtaatggcattttggcgctaaattcgggactgctgcttaatgacaccgagtcgagaaaaacttcccgttttttttgagcttggtatcgacttctcgaggccaattacaagtctctgatgatagtcttgcaaa

SEQ ID NO: 50823 - DNA, 1151 bp, Heterodera glycines
  Genomic contig location: Contig_ID=SeqID_20314; Location=609..1759; Strand=-
  SCN-specific regions: Sequence locations=1-208,231-385,407-710,753 -1005,1027-1089,1117-1151
  Gene Ontology: Mol. function=transcription factor activity; Cellular component=nucleus; Biological process=skeletal development
catcctcaaattcttcggttggtggcacttcagcgtcagcggatgatcggcgtaaaacatcgcgccgaaaccgtaccgcgtttagtgagctacagttggaggtacggtaggactggcgcgtgacaaatgggcaaactcagacaaatgaaaattgtttgaattagccatgattaaatttgactaaatttctttaattttaaaatgaataattggaaaatgccaatttaaaaattatgaactaattcgcaatttccaggaactcgaaaaatgtttccaaagctctcattatccggatgtgaacaccagggaccaattggcacgacgaattaatttgcccgaggcgaaaatccaagtgatcaaacgaattaatgttaaacaaacaaatttaaattaaattaaattaaatcgcaggtttggttcaaaaaccggcgggcaaagcacaggtgaaaattgcgattatcataaggcgagggaaaaaaggccgaattttattgccaaattacctcaaaatgaaaaatatttagttcaatgttattcaaagtcattacgagaaaaccggaaaaataaaatttcggcgggttttcggtatccgatcgaccatttaatacccaaaactacccctccgtcccgctgtttatattagctctgttatgtacaatcattacttttgggattaaatccaaaatattcgaaataattttttagtttggtaatttttttaagtaataaatttaaaaaattttaatttttatgcactttcttatgctttcaattagaagattttgcaccaagatgggcatgtagggggagggactctctctgttcgtgccgtggcgccgctggaaaaagaattttgatgttttaatgaattgggattaattgaacaaatttgtcagaattttctgaaatccgattctgaaaaatagaacatcggaaccctaaagagaaaaaattcgcagattaaaaatttgctgcaaaaaatacgcctcctaaatagcggaaactaaacttaaaatttaaataaattttcagaaaatttttgcgcaaccaaccagcagatgatggggaggaagaagcatcagcaacggccaacaacaacaatatcaacaacaacaatggacaacaagaagcggagagcaccaccgtcattt

SEQ ID NO: 50824 - DNA, 1230 bp, Heterodera glycines
  Genomic contig location: Contig_ID=SeqID_20318; Location=361..1590; Strand=-
  SCN-specific regions: Sequence locations=1-361,383-403,444-589,611 -928,950-1124,1146-1230
acaggaaaatcatttgttcaatctgctatttttcattttcttacctgggtttaaaaaaagtgacaaatatggcttttagtgctttagcagcaacattgttaaagaacggtcgaactgttcacaaccgcgtttaaattaccattagatttaaatataaattcatcatcgtcgattgaaaacaattctaaagaagcaaaagaagttagagaaacggatattttcatttttgacgaggcaccaatggcacctaaatttgtaattgaaataatcgataagaaattaagagagatacataagaacaatattatttttggtgggaaaattatgattttaagtggtgacttccgtcaatgtttgccaataaaaaataaagcaacaaaaaccgaaattttagatttaacactacaaaaaagtgagttgtgggttaattttaaaatattccatttgagaaaaaatatgcgaacggaaaatgaatcacaaaattttgcaaaccaaattttggaaatagggaacggtaaaggtaatgatgaaaacggtatatgtcttccaaaaatttgtgatgttgaagacaatgatttggttgatgaaatttttggtgaaataattaaaacaaatgattattcgaaattatgcagccattgtattttagcaccatataacagagaaatcaatatttataatgatcaaatttaaaaaaaatttccgggtgaggaatatgtttttagaagcattgatgatgctgaaagcaagggtgcgcctattcttccagaggttctcaataaacttcaaacaaatagtcttcctgaccatgaacttaaacttaaaattaattctgttacaaaattaataagaaacattaatgtaaatatgggcttatgtaatggaacacgtgtacaaatacttgatattgaaaagaatgttttaagagtaatgattttaacaggagaccgaattggagaaattgattttattccaagaataactttaatagaagataaaaaacttccttatgttcttaaacgacatcaatatccattaaaattagctttttgtatgacaattaatagtgcacaaggacaaacttttgagaaaattggtattgatttaacacgagatgtttttgctcatggccagttgtatgtagctttatcgagaacaagaagttgggaacgaattaaaattaagtattcgagcgaaaataaagaaaaaacagtcaaaaacattgtttgg

SEQ ID NO: 50825 - DNA, 1441 bp, Heterodera glycines
  Genomic contig location: Contig_ID=SeqID_20319; Location=658..2098; Strand=+
  SCN-specific regions: Sequence locations=1-407,429-922,958-1441
atggccctcacgcgaaaatggccacgcgaaaacggccctcacgcgaaaacggccacgcgaaaacgaccccgaccgtggaatgggtcgaagcgggtcagttccgtctggccagttccgtcttcaaaagtcatgaaaacatgttttagggtgattttcggttttcgggccctagaagccctacaaagcgctttgaaatcaattaaaaattgcaatgatcagtgatcactgactgatcaggtttttttgaattatcgccccaaaatatcgctatttggcattatgagtcattgtctaacactgacactgggtttgacgttttactcagttataccaacctaaccttttaaaaagtacgaattagaaaatgaaataggaaaatttatcatacctaatactaacaccaaaatttcttattaatttttaaaaattctcaatagtgtcgaatttactcactgtcgaaatggtccagtgtcgaaaatgctggaaaacagtgaaagtttttgaaatagttcagtgtcgagatttctctatgtcgaaaacgtagtgtcgaaattacttagtgtcgaaaatactcagtgtcgaatttacccagtgtcgaaattacatagcgccgcataaaatatgcactaaaaatccgccaaatatgcaataaaaacccgaaaaatgcccaaatatgcactaaaatatgccttaaaaacggtgctgggtcgttacttaaaaaaccatcattatgaaaatttttgtcgaaaaattatttataactttgctcgaaagcaaccaaatttttaattattgatatcatttgatagccctaagtgttctctatcagtctgcaaaatttcaaaaaatttcgttaagtttcaaaaaagttatagctcgaggaactcaaaaaaccttgattttcgacatttttggccataactttttttaaacttaataaaattttttgaaatttaacaggctcataaagaacatttagatctatcgaatgatagcaaggattaaaaatttggtctttttagagcaaagttataagcaaaaattttcattatgatggttttttaagtaacgcccattatgatggtttttaagtaatgacatagcaccctcgaaacgactgagcttttgccgctttctttttgagggttatcccatgtgctttatcccactttttcccatactccaattccttctgcgcgcatcatacaagagagaaagagaggggggggggataagagaagaaacagacgagaggagatagccgagtgactgttacgaaaacacggatttcggaattgggaccgggggaaagagccaaatttgcgagaccagcgggaatcaagtaaaagtcaacccgttaattgggggatattaccaaaatatatttatcccataattagttaaaaccgttaattgctttccacagtccattcaacgccaa

SEQ ID NO: 50826 - DNA, 629 bp, Heterodera glycines
  Genomic contig location: Contig_ID=SeqID_20320; Location=2148..2776; Strand=+
  SCN-specific regions: Sequence locations=1-169,191-254,281-466,509 -546,582-629
atgtgtaagaatggaggaatgagaggccaagtgatgctttctctgatcagcaacttgaagaaaaatatgaggacggacttgagaaaaagagagtgataaaagccatgatttaatttgattataattactttttctgtgcaaatgcgtcatgtgagcataaataatttggatttacaaattttacactcattgtttcatcaaatcctcttaatcccgccctagtgaagatttttttagaatttctaaaatttgatgcttgaaataaaaatgtaaaaaattgcagcaaaatatccttggcttaagcataatgtcgctgtaaatgtttattgattttttttaagaatttgctcagtttaatggcttaaaatctaaggctttttccgcgaaatttcaattacactgaagtgatggaaatagaaaaattttccttttaagaacaaaaatttattttattttttctcgagcgttttttttttgaaattttaatattaaaattttcattttattaccgtttttcccgtgttcgtataaatttttgactgattgaatatatttttttaatttttaaaattaaatattttcaattaacgtctccgaaacatttaaaatatgaggactaatttgcatga

SEQ ID NO: 50827 - DNA, 331 bp, Heterodera glycines
  Genomic contig location: Contig_ID=SeqID_3548; Location=579..909; Strand=+
  SCN-specific regions: Sequence locations=1-331
aatcggcttcgttgttgcatcgtacggagagacaccggcgacagcgggcgcagcctccgctgctcaagactcacaattaacttgcgaaacggtggtgaaaggcccaacacaattaacttgcgaaccgatggtgaaaggcccaacttcatcagctcataatgacattgccaattccgaggctcgaccaaaggcgacgactacgagcagcgatttcgagcggatgaaaggcgaactcctggaactgttctcgaacgaactgcagaacctcaagcgggaacttgcgcaaacaatccgagacgaagtggccaaattgtcagccgatcggagatga

SEQ ID NO: 50828 - DNA, 1556 bp, Heterodera glycines
  Genomic contig location: Contig_ID=SeqID_3549; Location=140..1695; Strand=-
  SCN-specific regions: Sequence locations=1-94,116-181,203-493,516 -691,714-844,867-889,911-1245,1267-1298,1337-1420,1462-1556
atgaagctggatgttaagatttaccaacattttataaaaataagagaggtcaacaagaaaagtaaagtgcatccaaatttcgatgagaacttgcaatcctctggattgacttccatcaatggacaatgcaaaaaggacttttctggtctgagcaatcgcaagaagagtaagttaggactttcccaattgtttgagtggttttgttgcctttcaggtgggtcttcttccagttcaatagtggctattgacaatgagaacagtgcacaaaaaaatggttgcgaaacatcgttacgggagacagacaatgggaaaaggtcattcaattcgattctcgtaaacaatggcagtattccggcaacgaattcttcgctttcgcctccggaaggaacagtcactaaaaataagcgcatctgtgcaggaaatcattgctcaaatacaccaaaaactgtgacttcaaactttcttggacatcgaaaacaaatgggaaactgtgtgattggaaatgcttctgtgaacaccggtgatgcaggtccgatttacgaaagaggcctcaaaagacacatttctgatgacaatgtgaatgaatttggagcaccaaacaaaatgcgaggtatttcatcgcgagtcagccttttattttttaaatttaccatacaaagagatcacagattttgatactccaaacccgaaattcaacaaagttaacctgaattgaaagaaaaagatttaaatcttgaagaaacttctacttttgcgtcgcgtttttctatttaaaaacttccccggcggcgcgggttgccactcccgaaatttttttctgttacgggcctggtccggaagaattttagaaaatttaatacaatttaacagtttcaccacaatttctaatattgtttttggaaaaaattttcgaatttttggtggatagagggtttggggcgggggtcttattctatttaatttcttctacggttttctttcattgagttaccaaacaacatttgaatggaacgtcctttgctacatcaatcgggcagaaaatttttcccaccaaatgcacaaatcactcgccgaatgtcattccatttaaccgtaagtgaagaaaaaatctcaatctttttaaactcgaaattaagctctgcacacaccggacaattcaaagaataaatgttcgactgaactgacaaccaaagacaatttgcaatgtgatttcattcagcaaccaaataatggcgaaactccaattttccagaacttttttccatcggttaacagggtaataatcgcgagaacacaatattagaataaaaaatttaaaataagtcttggaaaggccgatttttcatatattaattactgaactgttcgaatttcacataagccgaatgaatttgggcaattgtgaagatcattggtcccgaaattttttaatttaattttttttatcttaaatttttttaacaattttctaggggtgttttgaggcgctgagcacgaatccggcctccatttcgaccaattccgaatccctaacccgaacatttttcgagaattaa

SEQ ID NO: 50829 - DNA, 1101 bp, Heterodera glycines
  misc_feature (50)..(50): n is a, c, g, or t
  misc_feature (74)..(75): n is a, c, g, or t
  Genomic contig location: Contig_ID=SeqID_3550; Location=1..1101; Strand=+
  SCN-specific regions: Sequence locations=1-20,42-244,267-586,608 -941,965-1101
  Gene Ontology: Mol. function=ATP dependent helicase activity; Cellular component=nucleolus; Biological process=ribosome biogenesis
tccaatattttttaatcagctatattggattataaattattaggcagtanaatgtgagaaatcgtcgagaaggnnaggagaaaagtgatttctgatcatttttctgctgattttgcgtttgaaacggatgttgaaattgactctgagtgccaaaaaggggaaggcgaagggacggatggcacgacggtggaccaattggatggacttcgacgctttctaaagaaaaacagcatacagacgaatttggaagagaaaatcaaacaggaacgaagatggatctggggaaaagaacgggggaaaaaggtaatcactgaattcaaagggattttcacaaatttacgattggataagcttaagggatttttaattttccaagtcataatttttgctcgttacaggttgacaatgatgagtttattgttagcagtaataaatcccgcaattctgatgcgaattgcactgatttgtttgatgacggagagaatgaaattgagttgttgcaagaagctaccgacaaaacgggtgctttttttgttatttatttggtaactaatgaagagttaaatattttcagatcaattagatttgaaattgaaaaacaaaaagtcaaagtccgttgggtccgaccactttttcgatgtccgttcaaatcaaattgctgcatcagcaaattgtgctcatctctctttcaccgatctgaatttgagccgacctctgctcaaagtcggcctttcatccatttccaccttattttcccgtttagtccatttctgaggccggttttcaaaacccgaccccaattcaaacggcttgtattccggtcgccttagctggtcgtgatatttgcgcaagttctgcgacgggcaccggtaaaacagccgcttttatgctgccaattctcgagcgtctgcttttccggtaggaaacggatttacaaaattaatatttttctgttttgcttttagtccctcacggcgaacttctgtcactcgtgtgctcgtgcttgtacccacacgggaattggcaattcaagtcttccaagtcagccgacaacttgcaaaatacactcaagtggaaatttgtcttgctgcaggtcgaatt

SEQ ID NO: 50830 - DNA, 1060 bp, Heterodera glycines
  Genomic contig location: Contig_ID=SeqID_3550; Location=1195..2254; Strand=-
  SCN-specific regions: Sequence locations=1-1060
tgtatctcgcaacagtgacaaccgaacgggagagaaccggctctttgatgattctgaccataccacaggcattctcgatgtttttcgggccaatattaggctcaaaaatcgccatttatacaacactgcgtttctcacaaattgtcaatggctgtgttatggccacacttctcatcccggtcattctgattttccttcccaccactcattcagtgcctcgccttgccacagcacgacttaggcctcaggcaactgctctctattttccaattccaaattcaaacaaaattcaaggattattggcctatgacaaccaaaaatggagcattgcgcgagggacttattttgcgcggtcttttgatcgttgcatatgtttgttatgaactgattgcgcggaattttgtacttcgttcgtacatgcacgcgactagtgacaacgcggaagtgatggtcacaatggggtaataataatagtaattaaacggtgccaatcagtgacggccattcagtgtgtcacttgtgctcacgcaattcatcattttgccatttctgcaaagacacgtaagcccaaaaacacttttgcaattggcatgctttgctcaactgtgtgcgtacgccggcatcacactgaccaactcactgtaccaatatttgctaataaccgcaattcacacgggtgcctatgccattgcttatgcggaatcgtctacacaaatcacgaggcaaatccactcaaagggaaacaagaatcacaatcagttgccaacaatttcagtgcagtccagccgagtgatttgggaaaggcaaccggactggcatcgatggtccagtggactgcgcatttccttgtgcccctgtacacctctcacctcgtcaattattggcattacacttacgccttttacacgaggtacgaagaaagaagcaccaacagaccaactaatttgaacaattaagtgctctaattatgctcattaccatcggctacatcagtgtgtacgcaaaacaaacgaacgcgcggctgaggacccttttgccaagtcttatcacaacatagaca

SEQ ID NO: 50831 - DNA, 143 bp, Heterodera glycines
  Genomic contig location: Contig_ID=SeqID_3551; Location=671..813; Strand=+
  SCN-specific regions: Sequence locations=1-143
  Gene Ontology: Mol. function=ATP dependent helicase activity; Biological process=ribosome biogenesis
ggggactggaccttaaggcccaggaggcggctcttcgccttggcctggacattgtcatcgcaacgccaggccgactgattgaccatcttcacaattctcccaatttttcattggcaaatatcgaggcaaatttgtcttgctaa

SEQ ID NO: 50832 - DNA, 2272 bp, Heterodera glycines
  Genomic contig location: Contig_ID=SeqID_3552; Location=794..3065; Strand=+
  SCN-specific regions: Sequence locations=1-290,316-508,530-1131,1153 -1669,1691-1691,1715-2116,2141-2272
  Gene Ontology: Mol. function=ATP dependent helicase activity; Cellular component=nucleolus; Biological process=nucleobase, nucleoside, nucleotide and nucleic acid metabolism
atgaatatgccggccactttacagcattacattcaccgagttggacgaacagcgcgggccggcaaagcgggccgctcagtttccctaatcggtgaacatgaccgcaaattaatgaaagaaatcacaaaagtgaaccaaatctctaattcctttcaacttatgcaacggaaaatcgagccaggttcgtctttacaagtcaacgtcggactgtcatcattaaacttttcagatgttatcgaggcatactgcaaaaggatccaggaaatggagccgagcatgaaaaaattaatggaagaggagcaaatggagaaacaattaataatggcggagaattcaataaaaaaggcagaaaaacaaataaaatcattgggcggagatggcacgcagccgaaggtattttcaattgaaagcaaagttaggctggtcgaaaacaaattttagttgtattcacggaaatggatcggtggcgcagaaaagggacagaacgccacagaaaagctccgaatccgatcaaaagggaagagaagggaggcgaagaaacggttaacggaagcactccctaaacgcccaactgctgaatttgcatccaaacaacaccaaaaaagcggaaaaaagagtgagcaaatacattcaatggggctttattgcaggattaattcataagatttaactttttttgaatgaagtttacgatgaaaatgcattcaaatttaagaaacgaacacattcagaaaatctcgattagtcccttgaaatttccaaaaaatagtcctgtaaactgcaatagagcctgcctttaaagcaaccttttaaaccaattaaagaatctgcgttcttcactactgaaatcgcgagtgttagtcaaagggcgataaaacgcgtgaggaatgggtgagaatttgtttttaatgtttgcttaaaggcttattttagtccggatgacatcgactttaagcgagcgaaaagagagaaacaaagggatggtatcattcagaagaggacaaaacggaagtgaaacgaaacggtcgtttataatgttacaatataaaaatcaacaattctttgatttggtctgttgttctatgctaattttctggataaaatcctccatttcttgatggtacacgaaagtgtctttgctgaaggcctcctttacagtcctcttcagaactttgaatccgtgcatccacgcgaaaataccttaattgaccaaacagtcagttgaagtatatttcagcattagttcacccgcaataactgcaattgtcgcaacatggggcttaaacggaattgcagaaatgacacgcctgacgatcatccttccgcctccgaacttcctcaacaattgcctaccaaatacagtcatttgctacaataagcaaatgcaatttatttaaaaggcaagggaaatgaaagaacaaaatttattggcgtggaagccaaaagaaaggatcgaaaaccaatcaaaaggacaaatgtttatcaaaacaaagcatcgaaacaaacgcaaatcagtcgtagccctccacaggcagaaacggaacgggcttttcaggattgtaagtggagtgattccatcgccaactcccgcgcaaatgcttcggcgcgtaaagaatggcagtgcacgggtgctgcccttgcatttcgcaaatgcattgctggcaatcaaagaaagcaattttgtaatttcgtttgggtttgtcaatgtaaatgtgttattaccctttcgcagtcgcagccgaattcggccgggttctcccttttgtaactgtccattttcattcgcttccgtacagtctctgtcatgcccaatgttccgattaatgcttcgcttatttgctccctcgtacggcactccaaatcaaaaacaacttctctgccatcgcctaaacatctttatataaatgcaggttttcctctaaaattgtttctgtcgaatcatttttacctaagaaagcttgcgcaaatggcgtcacacaaacatccacgagtttcacgaattgaacgtgagggttcttgaattggagttgggcccagtgccaaaatacgaattctttggccccttcctgggccacgtttgggaaattgtggaaagcaattgcaaagaccttaattcatttatttatttaaattaattattcgtctttcatattaaagccaaatgttaaaaaaaattaccttcacttcctcacgcaaatgtatttttccctgagtaaagaaacaaatatagaaattgttcggaacagtgacttaatccaacctggccaagata

SEQ ID NO: 50833 - DNA, 336 bp, Heterodera glycines
  Genomic contig location: Contig_ID=SeqID_3552; Location=1806..2141; Strand=-
  SCN-specific regions: Sequence locations=1-196,218-336
caattgttgaggaagttcggaggcggaaggatgatcgtcaggcgtgtcatttctgcaattccgtttaagccccatgttgcgacaattgcagttattgcgggtgaactaatgctgaaatatacttcaactgactgtttggtcaattaaggtattttcgcgtggatgcacggattcaaagttctgaagaggactgtaaaggaggccttcagcaaagacactttcgtgtaccatcaagaaatggaggattttatccagaaaattagcatagaacaacagaccaaatcaaagaattgttgatttttatattgtaacattataaacgaccgtttcgtttca

SEQ ID NO: 50834 - DNA, 758 bp, Heterodera glycines
  Genomic contig location: Contig_ID=SeqID_3552; Location=2353..3110; Strand=-
  SCN-specific regions: Sequence locations=1-177,202-603,627-627,649-758
  Gene Ontology: Mol. function=structural constituent of ribosome; Cellular component=mitochondrial small ribosomal subunit; Biological process=protein biosynthesis
ggtccttttatgcgtggcactatgccgctccgtcggactttttattatcttggccaggttggattaagtcactgttccgaacaatttctatatttgtttctttactcagggaaaaatacatttgcgtgaggaagtgaaggtaattttttttaacatttggctttaatatgaaagacgaataattaatttaaataaataaatgaattaaggtctttgcaattgctttccacaatttcccaaacgtggcccaggaaggggccaaagaattcgtattttggcactgggcccaactccaattcaagaaccctcacgttcaattcgtgaaactcgtggatgtttgtgtgacgccatttgcgcaagctttcttaggtaaaaatgattcgacagaaacaattttagaggaaaacctgcatttatataaagatgtttaggcgatggcagagaagttgtttttgatttggagtgccgtacgagggagcaaataagcgaagcattaatcggaacattgggcatgacagagactgtacggaagcgaatgaaaatggacagttacaaaagggagaacccggccgaattcggctgcgactgcgaaagggtaataacacatttacattgacaaacccaaacgaaattacaaaattgctttctttgattgccagcaatgcatttgcgaaatgcaagggcagcacccgtgcactgccattctttacgcgccgaagcatttgcgcgggagttggcgatggaatcactccacttac

SEQ ID NO: 50835 - DNA, 823 bp, Heterodera glycines
  Genomic contig location: Contig_ID=SeqID_20321; Location=28..850; Strand=-
  SCN-specific regions: Sequence locations=1-404,429-495,525-823
atgggaaattcctgcttaatttctgagtcagtaagaccaataaattcttcctcaaatggtttcgttacattcttccgtcaatcaagtaattaagtttaattacttatttaccaatattacaaaattaatcaattaattttcaggtgatagccaattattcgtaaaacgtaaattagaaaataaaaaacaatcgccgaccgaagctttccctaaacaaaagacacaaatgtcaattgctctgcctgaacaaaagaggagctataattttttgagctcaaaagaccgagaattgtaagtcattttgaacattttacaaaaaaatgaatctgcaaattaaattacacatttattaagcattattaaagttgttcttaaatttgttaccccattaatgtttttctgtcatatttattaaaatatttaaaaaaccggcggtaccgaaagcagcgcgggcgaaatttttgcgtgagattttctcaaagcttttatgtaacaaatttattttatttttaatgagagaaacatagaaagaattaatatcaaggatataccaagccaagccccagacgtccacaaacatttttttactgccaaacatgtcgggcacccaaccatgctaataagagatagcatcatttatatgctgaaatatttttaggatttttttatgttggcgtaatgacatagcgacaagccgaagagatttgttccacaagacaatgctgaaatgcattcagtcaagcccgaaaatgaacgaggttatcgcctgcggctattattgctacagagacctgacgaaatggccaaaactaaacagaatatg

SEQ ID NO: 50836 - DNA, 648 bp, Heterodera glycines
  Genomic contig location: Contig_ID=SeqID_20321; Location=1443..2090; Strand=-
  SCN-specific regions: Sequence locations=1-164,198-592,614-648
atggccaaagagatggaccaggacgaccgaatgattgaccaactttcagacggacactgttataggcaccgccgccttcgcctgcgcatcccacttttcaggtgagaattagcgaaatataaattctagggattagataaaattgacaagtcaaacacatatgccaaataaatattttcaaaaaattacaaaaaccaagaattcttagctagatcgttttaaccggtcaaaaatcgtcggcccggggccgtgctgacattttcaaagcattaaactaaaaatctctaaaatagataaatatgctatgaaaatcatatatttagtttaaatcattttgcaatttgccttaattgatttgtcgttcattttgtaatttttcccatcacagatatatcttcgttatcttcgtaatttatatttttatcgtgctcatttcggtaacaacgtataaaagtacaccgagaaacgttggcaaaaatcgaaaattgttgtccgtcccattcccaaaagcataatttgtgcagcaataatgaatgaatgcccttctctttccgttttacacaattaatttgaggcgtgcctttttgcacgcttttttgaaaaaatttgaaataacttcaacaacttatgttttcgatttttaataaa

SEQ ID NO: 50837 - DNA, 51 bp, Heterodera glycines
  Genomic contig location: Contig_ID=SeqID_20323; Location=28..78; Strand=-
  SCN-specific regions: Sequence locations=1-51
atgtctttctgtgccgagttcgcccctttcctttggcactttttttgccgg

SEQ ID NO: 50838 - DNA, 359 bp, Heterodera glycines
  Genomic contig location: Contig_ID=SeqID_20324; Location=46..404; Strand=+
  SCN-specific regions: Sequence locations=1-185,208-214,236-359
gtggactacaaggcattcgcgcatttgatcacgacttgcgcagcggaggagttggccaaagtgggctaagcggggccatggacggacgggggaggaaggagtggcggggccgaggccaacgagtgacctgccgattcgggggaaaaccgatcatccatcccgtcgttctttccatccttacgatcgatcacccttttccccctcgcccattgtatctccttttgttctctttctaatcgctccctctccaaaatgtgtgtcccggctggcgagaatggcagcaccttctaattctataaaatgcatcgtttgttttcgcttcactcagtgcacttccaaataaaatcgaatggatgggt

SEQ ID NO: 50839 - DNA, 548 bp, Heterodera glycines
  Genomic contig location: Contig_ID=SeqID_20325; Location=118..665; Strand=+
  SCN-specific regions: Sequence locations=1-358,387-548
atgccccaggcaatcgcaaaaggaatggacagaaaggatcagaacttttacaaggacagacaatcgagacggaatatcatggacatttgggcacacacaaaaaacatcgagaaagacagcttcgcaatgggaaaatttgagggtaagcgaatgggggggggatttggacaatttgacaaagaacggcggacactcacagagatatttggccgactcatccgattttacgaaccaaaagcattgctgccgaaggacgtggtgtttgagctgcactgccgcgatttcatcaatcggcatgccatcagcgacaagcattacttaagggtgagtaggtaggcaatggcacggaaagaacggcaaaaaaaagttaaaaatttaaaatttaaggaaattggcaaaggattgtatttggacctgtgcgcatacggtgggtcattagcgagtacggtagtcactcgccgattgtacagaccacagttgtcgtcctaatacggtgtacagttgtcgctcatttgtggccactctccgccccctccacgccaatgtga

SEQ ID NO: 50840 - DNA, 594 bp, Heterodera glycines
  Genomic contig location: Contig_ID=SeqID_20327; Location=2460..3053; Strand=+
  SCN-specific regions: Sequence locations=1-107,146-594
  Gene Ontology: Mol. function=transcription factor binding; Cellular component=cytoplasm; Biological process=chromatin silencing
atgccaaacagcggcgtacaaaatcactacagaaaacgcgtcgcatattactacgattgtgagtttgtttcaattgctggtacaaatgaagttggtcccccatattggaataagtttttctgaaaatacagcatttgctggggtgcaagattccaaaacccatcatgcgaacttatttttatgacttgtaataaaacattttttgcgaactgtggggcgggagcagctttcctattaccaaattcccttttgcaattaattattttaagccaatgttggcaactattattacggccaaggccatgtgatgaaaccgcaccgaattcggatgacccatcacttgttacttaattatggtgtttatcgtcacttggatgtttatgtgcgtactttcgtcgttctttttgattgccattcatttctctgtttcagcgtcccttccccgcctcccttgaggacatgacccgctttcacagcgaagagtacatggacttcctccgttctgcaactcctgagactttgaagcagttcaacaagcaaatgttaaaatgtgcatttattttccgttttggactttgtacgttttccctttag

SEQ ID NO: 50841 - DNA, 812 bp, Heterodera glycines
  Genomic contig location: Contig_ID=SeqID_20330; Location=1549..2360; Strand=+
  SCN-specific regions: Sequence locations=1-258,282-282,306-812
atgagtaatttgggaccggaatttttgaaaaacaaaaccgggcataagaaatgccgaaaaagttgggatcggcactttgattttcaaacaaactctcaatttcttgtcgatattccatgttgtagcggagaatttccatcagactctgatcctgtcgatggcaagtcaaatttggagcagttgccgtgtaaatgcacgccttcgtctgtccaattggcaccatacagtcgggctcggcggcacaaagcaaagccatgcaaatttaaattattatattttaactttcatagggagaaaaattctatattttaaagggttaaaagggatcggaatcgacctttattttttgaaaaaacttgacccaaacatgaaaatatccgaatatcgggcccagtcctatggaaaatacaagccgggaccaaacttaatttcgacactctgtcaagtcgacactttataccgcctgtcgacaacagttggccgatcgattggaatgaaaccgcaaaatctaatcaaagtatccattatcataataataccggatattagcccaaaattgatgtaaaatggacgattttttaatgaattacaaaaaagttcgaagttttaattctcaatttattatccttttaccatttcattatttgccgcgtttgctcggatttgtgcataatcacaaagtttgtttcgaactgtggcggggtcaatttttgtgcttttgtcatatatttcagtcaatgtgtatgttctgttaagctccaaaatgggtgtacattggcaaaaattcggaaatttcctggaaaaaagcgaaa

SEQ ID NO: 50842 - DNA, 163 bp, Heterodera glycines
  Genomic contig location: Contig_ID=SeqID_20330; Location=1642..1804; Strand=-
  SCN-specific regions: Sequence locations=1-163
atggctttgctttgtgccgccgagcccgactgtatggtgccaattggacagacgaaggcgtgcatttacacggcaactgctccaaatttgacttgccatcgacaggatcagagtctgatggaaattctccgctacaacatggaatatcgacaagaaattgaga

SEQ ID NO: 50843 - DNA, 855 bp, Heterodera glycines
  Genomic contig location: Contig_ID=SeqID_20331; Location=260..1114; Strand=-
  SCN-specific regions: Sequence locations=1-229,267-855
  Gene Ontology: Mol. function=ATP binding; Cellular component=Golgi apparatus; Biological process=intracellular protein transport
gtcgtactgggcgacatgggtgggacttggcattgcaatttgccattctgaggtcatttaggggtcggaaagacgagcattttgctgcgtcacgacggacagggcttcaccagtcagatgagctcgacactcggcgccagttatatctgttcacgatcgtcagtcactcgagacaaataattccctttttggcacttttacaggagggcgaataatgggcgcgaattcgaacttcaaatttgggacactgccggccaagaacggttcagatcgatggtaaatggtcaatggaggggacggggggggtggcacagaatttgtgatgatttgtccgtcccttttgtcccaggtccctctttatatgcgaaattcctcggccgcaatgctcgtctttgacatcacaaatcgccaatcatttagggatttggcatcgtggataaaaggtgagcctttcagtcgacggaagcccaaaaaaacacaaatttgttgttattttgtagaagttgaacgcatcgacgaaacgggcaatgttttgctgtttattgtggcaaataaatgcgacctgaaagaaatgcgaatggtcagcgaagaagaaggacggcaatttgcggaaaagcaaaacgcacattattgtgaaacatcgggtgggtaaagtaaaaggagcgacagacaaaaccaaaagggaaatcctttaaacttcgattggatgtgccaaattttcagcgctcagtggcaaaggcattgaaacggttatgtcctcaattgcggaatgccttttacaagtccttgtccctccggcttcgttcgtccgtccattgtccttttccaggaacagcagcgactgctgaaaagtgc

SEQ ID NO: 50844 - DNA, 924 bp, Heterodera glycines
  Genomic contig location: Contig_ID=SeqID_20333; Location=328..1251; Strand=+
  SCN-specific regions: Sequence locations=1-47,80-94,116-161,184 -386,408-924
atgcgcaagcctttgctttccggtgagccgaatgcaatgacattgttggaggaaatcacggagacagaagaaacggagaggggggacaccgatgaacaacaacaaaacaacagctcacaattcattcgcactgacaatgagcaggtgtggtttagtggtcaatgaaatgggctcccggtaaattggacaccagaaaattggacaccagaaaattggacactagaaaattggacaccaatggaaaaatggacaccagaaaattggacactgttgtaaataaaaatgaaaataaacaaaataaattactaaacaaaaattttggcttggcctaaaagatctttatcttaatctgccatatgttgtttataagcgtaaataatatggaaatgaatttgttattatttttgtaacttcaggagaagaaaaacatcatatcattcataaagaaataagttttattactcatttctggtgcattttttggcccattgatcaatcgtcacccatttctggtgcattttttggcccattgatcaatcgtcacccatttttggttaattttttggcccattgatcaatcgtcacccatttttggttcattttttggcccattgatcaatcgtcacccatttttggttcattttttggcccattgatcaatcgtcacccatttttggtgcattttgtggcacattgatcaatcatccctcatttaacccatttattctactcaaatttattttcacctaattcttgattttttttaaaaaggaaatcttagtgtccaattttccggtgtccaattttcctttagtgtccaaaattccggcggtgtccatttttccgcttggtgtccaattttctggtgtccaattttcttgtgtccccttttccggtagaataatcccccttcgccattttgaa

SEQ ID NO: 50845 - DNA, 177 bp, Heterodera glycines
  Genomic contig location: Contig_ID=SeqID_20333; Location=489..665; Strand=-
  SCN-specific regions: Sequence locations=1-155
gatcttttaggccaagccaaaatttttgtttagtaatttattttgtttattttcatttttatttacaacagtgtccaattttctggtgtccatttttccattggtgtccaattttctagtgtccaattttctggtgtccaattttctggtgtccaatttaccgggagcccatttcat

SEQ ID NO: 50846 - DNA, 767 bp, Heterodera glycines
  Genomic contig location: Contig_ID=SeqID_3553; Location=1822..2588; Strand=-
  SCN-specific regions: Sequence locations=1-183,206-728,752-767
atgttgtcgtttattttcgacttggccactgttattcttggtgccgtcttgccgatgttccgtacttggaaggttttgaagagtcgcaaatcaagacaattagtgagtgaacttcatttccttgggttattaaaatttttcgacagttaagattcctctctcaaaatattggattgttttcgcagcatgggtttccttcgaatctgtggccaatttgttttcgttgccctatttcattccggcttactcctttctgaagttttctgttgttctttacacttatctcgtcggttacgagcacatttaccaaaaagtaattaaacatattggcatttttaaattttagacttcttttagttcgtaagtccatttctccaggaatatgagccgaaccgagaagttttgatggcttcagctcaatattacgcgtcaaaagccactcaacatgcattagcttatgcttggaatacgatcacttcatgctctccaagtaaaattacgaaaatagactaaataatatcggtttttaaggatcgaaggcaattacaacccaggcgaatggtcaaaggaatgccgaatttcgctctgttgtacgaattgttgaacttgaggaacaggaggaggatttcgtcgatataatagagcaagatgagcaatttgaggacttagaggccgattctgacaacgaaatgacatctaattcgccgattcactgatttacgatctcataacaacaaaataatttatattttttgccttgcaataaa

SEQ ID NO: 50847 - DNA, 213 bp, Heterodera glycines
  Genomic contig location: Contig_ID=SeqID_3553; Location=2933..3145; Strand=+
  SCN-specific regions: Sequence locations=1-19,164-213
atggtgcgaacacgactccaaaaaacaaacaaatcgaaaaaaactggaggagaagcgaagagcaaacgaaagggagagaaaaaaatggaagaagaagaaaaccaggaaaaagaaagtaaagaagaaaaaagggaggaagataaggaaatgacaagtcaagaaacaaaggacatcacaatattgaagacagtttcaagtacggatttggaagag

SEQ ID NO: 50848 - DNA, 1367 bp, Heterodera glycines
  Genomic contig location: Contig_ID=SeqID_3554; Location=68..1434; Strand=+
  SCN-specific regions: Sequence locations=1-12,34-855,878-1036,1058 -1238,1260-1367
gcgggaaatgaacacaactgccaaaaaacagctgaacaaccgaatgacgcactcgaaaatgacattgacaaaaaagtgaccgattttcaaacaatggtggaaacgacagaggaggacaaccgaagtggcactgccaccttcgaaagctttggcaacagtgccgagccgacaccaatggaaacgacaatttaccattcggcaaaagaatcctcggaaattggaacggacaatggacttctttcaaaaatggcggaaagtccgccgaaagtgccgccactcactcccccaagcattctgcgaaaagtgaactcccctggtggcaatggcgtcaaaaaggtagcgggaaagggtgaatttggtcaaatgcttcaatagattcgacgcgtccaattcaaagaagacgaacttggtcccggcagaattcgttttggtcgctccttttcggcgtcaccatacccaaaacgggtacaactgaaaacggatgggcagggcactcatagcattacagttttttatgcttttagctgcttgaacatctcgaccaaagcacaagcgaaggcgccgccagtccatcggctgacaatgagtcacccgccaagcgaccgatgaaagcgttcggacagatttggcccatcgccagcgccggtcgaccatcgacgaccactccaacgcgttggtccaagtcggccagaaggcttttgccaattcatggtgatgccattggccgttccaaataaatctcatttttcgtccattttagaaaggggttcgccttacgatgcgccggagagtgtgcaaaaggcgcagtcgtcggacaacaaatcggaccaatctgagaacaacagcaacgacaaacagcagcacgtggacgagcagctcgagaaactgccacggatggacgagcagcaaaaagacgatgaaatcgttttggttgggtcggcgaatgtttgcgttgtccttccggaagaggtgagatgaccccgatgatattataaaatcattggaaaatttttttaaaggaagccaacgaaaacagacatcagcaaaagcgggatttcgagcaaccgaacgaaacgatttcaaatgattctgacaaaacagcgaccgatttgggcaccgtttcgaaggaatctgaagagaatgccgtgcaaagtgaagcgatgtttcataagaaactgacgacggacaacaaatccgaaacatttgagagaatcaaaaacaaattggacgaacaacaagagaaattgaggcgacaaatggaggcattggtggaggagtcgacgaagcgaatgttggcaattgttgcggaagaattggcaatcgctgaaggattggccaacgcaatgccaacaaacgacggacaataa

SEQ ID NO: 50849 - DNA, 79 bp, Heterodera glycines
  Genomic contig location: Contig_ID=SeqID_3554; Location=2331..2409; Strand=-
  SCN-specific regions: Sequence locations=1-79
gaatgtccacgtgccacgaagtgactgtggcccggcagtgcggcatgcgcgtgttcggcttctctctgatcaccaattg

SEQ ID NO: 50850 - DNA, 590 bp, Heterodera glycines
  Genomic contig location: Contig_ID=SeqID_20335; Location=443..1032; Strand=+
  SCN-specific regions: Sequence locations=1-505
atggacgattttcacatttccgctggaacaaaaaattgcaattattcaattgaacaacaatcattcagcttcgaagcagtggagaaataccacagcaaagattttgcgattccaatcatagcattaattgatgaaaacttcagcgaaatcgacgtaaaattgacaggtcattaattcattcattgtactgtagagatacggtacagccaacgaagatttacattttgagggacacaaatagcgaatgcaccaattcattaaaaaccacttatgactaagctttggctttagaatgaaccgaattttaattttaaaagttcattcgttttgtcggcgcatatttccatcataagaagtagacataaatattgtttgaattttaacaattaatatctgttataaaattttaaaagcatttttcagatgcaaataacagaagtttaatggaatttcacattggcacaaatcggtctctgaatgtcacatttcccgacgtaaaaaatggaaaaatattaatataaaatacataatatttatttttttattttaaacattattttaaaatataattatttttaataatattttaa

SEQ ID NO: 50851 - DNA, 247 bp, Heterodera glycines
  Genomic contig location: Contig_ID=SeqID_20335; Location=1093..1339; Strand=+
  SCN-specific regions: Sequence locations=1-164,186-247
atgattctgtgggtggcactgcgcaagaacagttacgaaattatgttgaatgacacggcgttggacaacagacaattttggccaaatgattggtgggaggggtcgggacgagagaatgtcacacatatcgtggtaaaaactgatttctacaaaataaaaatatttcataaaattacagattttttcgaagattccatttttgagttttttgggtattaaattctttttctactccaattcttaatca

SEQ ID NO: 50852 - DNA, 418 bp, Heterodera glycines
  Genomic contig location: Contig_ID=SeqID_20335; Location=2412..2829; Strand=+
  SCN-specific regions: Sequence locations=1-418
atgtcggaaatcggaattccgtgccatccttggtgtgcacccatttggacaacacttggcgagcagttgcatttggcctatcatcagcaatttgatcggggaacaggtcatcagattggatttaattcattggtcaagatcagtgaaaattgtcagcgaagtgtggcgacgtaaattgtccaactgattgccattgtgtcgggacacgttgaattttattttacgacaatttttttgtttgattcacttcgttgaattgatgatttcttcgccgaatttccatgcgatgacagtgtgccaatgctttgaatggacaagcggtggccaaatggcttttcacgccactgcaaaacaatgtgccaaaggtgttcaaatgctggttgaaggaggattattggcattttgcgtcatagattga

SEQ ID NO: 50853 - DNA, 1628 bp, Heterodera glycines
  Genomic contig location: Contig_ID=SeqID_20336; Location=50..1677; Strand=+
  SCN-specific regions: Sequence locations=1-729,753-935,957-1435,1460 -1539,1593-1628
gttttggttatcaagcaacaaatttgtgcgcatttgcactatcagaaaattgaaacagcagctggtgttggatttgtgtgtctcgatgttaaggccgctttggaatttcggctcaattcggccaaggacaatttgatcagcttcgacgacgaattgttgatcaaactgagcggggaccacggccaagggtttaccaaattgaccatcagtttcggccaagcacttcgaaacaactctgcatccaaccatttcattgctgcagttttcccggccaaagacaccagggaaaatttggaacaatatggtgctcttctctggccccaaattgatcaaatgaatgcattgatcaacagaccgattaagtggtaaaaagggtgaatatttttttaaaattgtctgaaggtttctcggaggtgatgtgagctttgtgtgggcactgatcggtcattgcgggtcagcagtgacttcatttccatcgcctatctgcaattgtcatcgtgatcgattgctcaccgaaggacagcagtgtcaaacccggacaatcatgcagacaacacaacagtcagaacaattctccaaggccgtggaaaacggagagaaagcaacagccgcagttcggtccagcacgatgggaattgtcaaggcaccgctcatgaagacaattgaatttgatcggattattccagcaccgtttcacgtgttgcaggggttggggaacgcacttgtccgagaacttgagcagcaaactgatgccacaattgccgttcaacaatttctgcgacagataggggctcggagggaacaatttcgtaaaaaggacatgacgggaaataccataagaaaagtcctcaaacgtgcatcggaaatggaacatctctttgaatcgacgtggccaaagacaatttgccaagctctaatgcacttaggccaaatccaaaatttcacaaaagtacaaattttgagcaattcactcccaaatttataaatttaggctcaaccactttcgccaaatgacttggacgcatttgaacaccaaattgagcagttccgtggttttctgacccaagaacaacggatgcgcgacttcctatctcagaaaccgaaggcccacttattgctcaatcatttcgtcccatttgctcggcaacattctttcctcggcttgctggacgagcagggtggcagcaaacattaattaactcaaattttcaaaaacattaggggatgaggcacttcattcggtttggagaaggctggagcaatggtggaaatgcatgccggacgcggaccaaattctacaacaattggagcaccattttgtcagcaattggctccttgacaccggcagaattgctgagatgaagcaggcgagttttgagtggcgtgggaaggggttaattttcccagaaatcatttgaattttaaacattttagaggctggaagaacaaaaagaagacgacaatttttcggagcattcggatggtgaaaatgatgaagactcggtcatcgatgttattgggtgatcaaattttgttttgttttttaaatttacttaaaaaaattttagaataatatgacttaattattttttctttattcgttgagaaaaacgtgaaatattgcttaa

SEQ ID NO: 50854 - DNA, 1546 bp, Heterodera glycines
  Genomic contig location: Contig_ID=SeqID_20339; Location=327..1872; Strand=+
  SCN-specific regions: Sequence locations=1-640,662-788,811-1137,1159 -1199,1227-1256,1278-1330,1352-1359,1381-1546
atggaagtcaatcgaattcttctccgacttcccattccacgcacaaagaattgcgaaccagaagaagactattgcggggagggcaaatgcatgtttagtcgtaagttcagcagaggccaatcataattacgaatgacaaatggcaaaactgtatatgtatttggacgataaacgataatttgtttttgtcgtaacgacatgttctgagaaaatgtgctaaatttgtcgtccgttttgtcgttcgtaattatgactggctcccctaattgaggatcgataaatttcgcctccttctaaaaatccgctcaaatttcagctgctgacggagaaggtgcaaatatcttcatgcatgttcagtattgtacgaatgaaacattgtgtgagaaaggggttgaacaggatattatcagtaaggaagacaacacggtaactggacgcttaacatgcgacaaaaggacttgttgcgagtggaatttgtgcaacggttcgcctttttttattagtgccgtggggggagcacgaaaatgcgatgccacaaaaatgagcaagaaaattttaagggttttaattaagtggggatcatccctgaaatttgaattttttattgcttttcgcacaatattgacagtgggcttagttcaaaaggaatttttgaaaattttgcttgaaaatctaaattaattacggaaaaaccctgaattgaccacgtgaatcgtgaccgtgaccgaaaaaccccctgaaattcacggtaaccatgaccgtgagtcacggcacatctctattatcttttaatggacattttttaaatatcgatgcggtatcgctttttcttgaaatcaaaaattttctcacggtgtcggattttcagggacccgtgctgcggtcggctgtcatttgcgctctttgtgctgggctttcgtggcaatgattatcgcattttgggctggtaagattaactttttggacatttgtttttaaatttttgaaatatttgatttttcaatatgtatttcgcataattatcaaataaataatcccatcattaagcatcatttgatcttcgctactaatgaggcaaacgtcggaaatgaaaccttttcaaagaaagaacgcatcttatataaaaacatattagtaaagaataaatttgtaaaaatttatcgcatcaaaaatcaaaatgatttacattttattttctgaaataaaatatattaataaattatatacccgccggaaggaacaaaacccgcgcagaatttttaattgaattgttctttcatgcatttttgtgggaaaagcaggaaaaggagtcattcagcaagagcagtggatttatttaaaattggagatttttgcaagaaatttttaaaaattaattatgattttagagcttgagccgaaaactgtgggtgattcaacaaactcacaattataccacttcgtttgaaaagaaaaaatattattttaagggtaatctaaaaaaatctcacgtgtttttagggaaagaaaaattttaattttaaacgataccaccaaaatttaaata

SEQ ID NO: 50855 - DNA, 1026 bp, Heterodera glycines
  Genomic contig location: Contig_ID=SeqID_20341; Location=61..1086; Strand=+
  SCN-specific regions: Sequence locations=1-29,66-281,317-523,545 -666,701-959,981-1026
atggtgaggcagttcgcaacacattcaggtaaaaaattaaatttagatttaaatcataattttttccagaagggttctctctttgccgcttttgcctcccgacattatcagaagagctttctcaattatcgtggcggcgtcttctcctcctggaatgccagtgttcttcctttacttctctcgaacatacatcggcttgacacagcgccagttgttggatggtgttaacgcatttggagataatccactcaatttttcacccattggcaatcattgtttgtttaaatttatgcattttatttccaaaaatttaatttttagctgcactcgggacaacaatttcgaccatcaattcggaacacagctatgcggctaccccagtacagtccggcatcggctcaccggaaccaactcttacatggacaaccactgtgagtccacgggagcagcttgttcaatactcgttgagcacgctatcgacttcggcagcgccttcaggcagaattatttaatcaatcatccgtttaaatttaataaaaaaattcagttccagcgtgggaggacgaaatcgttcgtgcgccacattttccaattccgctttggaacatgcactcacagacaacatctgccctcgctcgtacaaacaacggactggaggcaactcatcttcattttatggtctttaatttattaaaaacaaattgaaaagaaacatttagaaaggcctctgtcaccaccccgccctttcggacttcatttgtggggttaatgaaagcatcgacagacaggtggacgctgcccgatctgctcgccatttcattcacaagcgacacaaacgatacatcctccaggatgctgtcattatgtgaattttggcggacgcgtcgtacaacagcaatggtgaaattagtgatctgatgtcggcgcttggtctccaagttgaaggatatgcgggaaaattgagagattttgaaaattacgatgattcaattgtccatgttccgtgatgattttattgaatgttta

SEQ ID NO: 50856 - DNA, 1850 bp, Heterodera glycines
  Genomic contig location: Contig_ID=SeqID_20343; Location=534..2383; Strand=+
  SCN-specific regions: Sequence locations=1-14,139-341,363-574,599 -622,647-915,956-957,979-1140,1163-1237,1261-1266,1288-1301,1470-1850
  Gene Ontology: Mol. function=tyramine receptor activity; Cellular component=integral to membrane; Biological process=olfaction
tcttccatctatcgtcccccttactcttccttctatccctcacctccccctctcttccgcccattcatcctcttcccccctccctctcatccgtttcctcccttcctctccctttcccttttttcactctgtcccttttgcttctgcgcttttcaataagtttaatggcctttcgcgacacactttggcatcgcttcacttttccatcccaaaaagttcgtcgttcgctgcgaattacgtgctcaaaatggtataaagtgagggaaacacgcccaattacgcgtttcatgcgccagcccaatgggcaggcaaaacaaaatggtgccgcggcattttatgaaggggcggggaaattcccccaagttccctttccaaatgatggcacagaaaaaatgtgaaaaaacaaaaattggactaattttaaagcttttttctaatattttttaatcaattaaagatttgctgaattcttattgtgcaaaaaaacaaaagcaattagcaattcctttgcaaaaagcgttaagcgatgggaaacgacgttttttgagccatccctcaggggatttccattctcacgtttttcctttttattttcttccatcttctggactccgttccaaacaaaaaatctatgtttttagttcttaagtctcctattaccgtatttttccgcttccttacagtttccttctcttccgcgtcctttcctaccgtattcttccgcttcctacagtttccgtcccttccttgacctctttttgcgcttccatcggcggatggatggcgccgttcggtcgtccgccgcttcgtctccgtccctaagcgatgttctgctcaattttccctcctcaccttctcagccaagcgaattgcagttgttcatctacggatttatcctggtaacttctctttctcttttatttttttaaaattttatttgtaattttatttaaatgcttttccttccccaaaggttctcattccgaccgccactattctgggaaatggcctcgtcatcgtttctgtcctccgattcaaagctctccactcggccatcaattttctgattctcggcttggccatcgccgatttaggggtcgctctgtttgtcatgccatacgccgtctacgtttacgtatgcttcttcttttcttctatagaatgccttttctaattgtctgtttaggtccaaggcggtcgttggctgctcggttagtctgttttttgtcttttcccagtttgccaattctccctctccccaggcccgctgatgtgcaatctctacctgagttcggtccgtttctctctctctctccctccctctctctctctctccctccctctctctctctcgaccctctttctctctctcacgttccctcccctctctctctctcacgttccctcccctctctctctctctctctcacgttccctcccccctctctctctctctcttgctctctctcctccgcttgatcagttcacttttcctctcttaaggacgtcgcgtgcagtaccgcttccatcattctgctcgccctgatcagtttcgaccgataccaggcgatcagtcacccgattcagtactcgcgccaggcccagaacatcgcccgcgtggtgcggctattcgtcggcgtttgggtgtactctctgctcgtcgccagtccaatcgttttgggtccctccgcttttggcattccgccgagattggcttttcattgctccattaggtttcaacgaccctccgcccgaggaaagcgctttccggcgcctttgagcccttccagggccgcttctacaacccggggtctccctgttgccctccttccgcccccttccttctcccc

SEQ ID NO: 50857 - DNA, 397 bp, Heterodera glycines
  Genomic contig location: Contig_ID=SeqID_20344; Location=175..571; Strand=+
  SCN-specific regions: Sequence locations=1-296,337-397
atgagtaaacttaatgaatgtaagtttaggcaagccatcccacagccatgaattacttacataatttgaaagttcattttttagccaataatgggcctatggaaatgaagttttcggaatgattttcgagtccgagcagatgagggcaattttggaccattctcatggttcctgtttatagaaaacaactgctggtggagctgagtgaaggggggggggggaagaattggcccataaaaaagcattgggccgtctcttttgctccttccagcaggcattgaaaatgaggcagaaaagagcatatggccaaagggaggaaaaacaattttgctttttatctaagttttactttacaaacattttttacaaatcgaaccaaaattagttgaaattttca

SEQ ID NO: 50858 - DNA, 99 bp, Heterodera glycines
  Genomic contig location: Contig_ID=SeqID_20344; Location=1809..1907; Strand=+
  SCN-specific regions: Sequence locations=1-99
aagacggccaaatttctcagctttttggagcagttcacactgtgcacaatgttccgcatttttggccgtttcgtcggcacttatcccatcgcatttctg

SEQ ID NO: 50859 - DNA, 461 bp, Heterodera glycines
  Genomic contig location: Contig_ID=SeqID_20344; Location=1035..1495; Strand=-
  SCN-specific regions: Sequence locations=1-296,340-435,457-461
atggccaaaagtgatcggcaatcgaaaaagagccaaaaagtgatcggtaatgaagacatgatcgataaattggtcggtcgaagtcagctaatggcggcagagccaaaaagtgatcggccggtgatttctccaagtttgatcaaatttttaatttgttgtctttcgtgctgttgtttcgcaaatttacggcaggtggacaaagccaaaatttggccaaaaaagaaaagtgtgagatttgtatggccaaatggctgtaattataaagtattattgcggaattgagaatctgttgagggaaaatttatatataaatatattttttataacaaaattaaaaaaggcaaaaaaaatttcaaagaatgagggcgaattttagtcattgctcagaagtgaaattaaaatttaaaattcacacttattttatttagcctaagggttttctttttataaaaattaataaa

SEQ ID NO: 50860 - DNA, 845 bp, Heterodera glycines
  Genomic contig location: Contig_ID=SeqID_3558; Location=1297..2141; Strand=+
  SCN-specific regions: Sequence locations=1-374,403-411,438-845
  Gene Ontology: Cellular component=axon; Biological process=olfactory behavior
atgggctccgacttccttcaggtgttctcctacttccttgccaatgtgtccgattttgctcacccctggggtcagtcattgtgtcaatctgtcgccactaattaagtcgcttttcctacccaaaataattcccccatcattcgtttcgctttttcattgctccttttacgttaagcctatcgcctgcactgtcacagctgcatgagtccctatttggaggatcagttccaattcatttcgcacctctaccgacggcccctcgtgttcagtgaaaagtgcgaccacggccaattcgactggcgatacatcgccacgaaaaactgttcagatgcatgtgtaacactgcgaatgaacgacagagtgggcggtgagtggagacggacagacagacagagacaaaaagggaattttagagagaggggaaaaaaggcaaatgaggaggcgaaaagaatgattgataattcacacagttttagtaattgcttctgttttcccaggccggcgccgtttcggctttatgcgcgggtgtctctccgacattatccaccacaatcgaacggctgtccgatttggcgaactcgccaggacagcaaagtcgggcgcaacaatatgctcggctatccgactaagggatttgttcatctcttcggacaggtcataggcaatttctgtcgaaattggcataaacttatccattgtttaggtatgccttcgatgcgcatgatcacatcgaactttgtgcttgcattcggtccaattgcaattccgccaccaaaaaatttggcattaaaaatgccattttgggagtgatcagcacaataatcagcttcatgtttttaataagg

SEQ ID NO: 50861 - DNA, 1206 bp, Heterodera glycines
  Genomic contig location: Contig_ID=SeqID_3558; Location=2263..3468; Strand=+
  SCN-specific regions: Sequence locations=1-4,122-123,189-197,219 -402,446-460,482-580,602-713,735-1206
atgaaaagaaaacaaagaggtggaggaagaagatgcgagagaaaaaggacgaaggaagaaagaataaaggaaaagaagagacggcaaagacaaaaagcaaaaacagacgaaggaagaaagagtaaaggaaaagaagagaaggaaaagacaaaaagagtaaaggaaaagaaggaacggaaaagaagagacgaaggaagaaagaagagcagaggacaagaagcgaaaacgccaaaccaagacaaagacgggtcgaactttgtaaaaagaagaagtgttatgttcaaaacctcaaaattttaaattgctaaatttattttcattcttttttattttcacatgaattaaacatgaaccagaatgtttaaattatttttgcgagtcacaataattccccacatcgacttccatttttcctttcttttcaaataatgaaaatatttattaaacaaaaaaaatgcaacaaaatattgtcaatgacttacgaaatcaaaggctgtgtgtgctttatcagtcctttggctttcatttttgggccccaatttttgcctttattgtcctgaaatcgaagcattccgatgaatttgctctttgggatggaatccggatgggtgctgaagttgatttcacacctaaaaaacatacgttcactaataataatcatggaatgggtcggtcggacttcgtttccttcgccaaaatgcgactgcgcggactgtcctcccccgcctcggccattcctttggctgtgattccgtttcgttttgcctgcaaaaatggaacggactgatcatttgcatcggcactctccgcgtgctcctctcacccattcacggcacacgtcccacagaaaagaggtcggcgcgtccgttttgactgcccgcggattgcagtgggagatggagcagcggaagcccgcgttgagcagggcggaccggaagacgttcattttgggcgaggggcacttcatgacgaccatcagctggtcgtgttcgtagaagaggggcacgtcgggcagttcctccgacagaaccgtcagaaggccctccaggcgttcacgagtgccaagtctcagctgccccgcattcgggcctttcaatctgaagccaatcgcatccgaattagtaattcattgacatcaccgacattgcgagcagtttcccgacgaattcggtgtcccacgtcggcgccacccaaatggggccgccc

SEQ ID NO: 50862 - DNA, 839 bp, Heterodera glycines
  Genomic contig location: Contig_ID=SeqID_3558; Location=2757..3595; Strand=-
  SCN-specific regions: Sequence locations=1-599,621-732,754-839
  Gene Ontology: Mol. function=tRNA (guanine-N2-)-methyltransferase activity; Cellular component=mitochondrion; Biological process=tRNA modification
gcgtgcgcttctccaccgcccatttccagtccgaattggttcgtctccccgcgggacagtccgacgcgtcgatggacggacgaatggtggccaaatgcgcgcattgtggggggacggccattcacacgggcggccccatttgggtggcgccgacgtgggacaccgaattcgtcgggaaactgctcgcaatgtcggtgatgtcaatgaattactaattcggatgcgattggcttcagattgaaaggcccgaatgcggggcagctgagacttggcactcgtgaacgcctggagggccttctgacggttctgtcggaggaactgcccgacgtgcccctcttctacgaacacgaccagctgatggtcgtcatgaagtgcccctcgcccaaaatgaacgtcttccggtccgccctgctcaacgcgggcttccgctgctccatctcccactgcaatccgcgggcagtcaaaacggacgcgccgacctcttttctgtgggacgtgtgccgtgaatgggtgagaggagcacgcggagagtgccgatgcaaatgatcagtccgttccatttttgcaggcaaaacgaaacggaatcacagccaaaggaatggccgaggcgggggaggacagtccgcgcagtcgcattttggcgaaggaaacgaagtccgaccgacccattccatgattattattagtgaacgtatgttttttaggtgtgaaatcaacttcagcacccatccggattccatcccaaagagcaaattcatcggaatgcttcgatttcaggacaataaaggcaaaaattggggcccaaaaatgaaagccaaaggactgataaagcacacaca

SEQ ID NO: 50863 - DNA, 618 bp, Heterodera glycines
  Genomic contig location: Contig_ID=SeqID_3559; Location=77..694; Strand=-
  SCN-specific regions: Sequence locations=1-618
  Gene Ontology: Mol. function=tRNA (guanine-N2-)-methyltransferase activity; Cellular component=mitochondrion; Biological process=tRNA methylation
atggatggtgctgaatcagtcattttgcagtgcgcaactgagaaaggaaatggcgttggtccatcagtcgcggccgattgtgaggcgaacaaattggccgaagtcaccgagggattggcgagaatcaccgcgacggcggagggcggcgagactttctacaaccgagtgcaggagttcaaccgagacttgacgtaaggcttcaaaagccgagcgaagggcgcgtctctttccaccttaaggagtttagggtcgtcgttttgagggcattcgctgccgaaatacccaacgaaaaagagccgaaaacggaagaggagggcccaaaagccaaacagaggaaaatggacgagggaaaagcacccgaagcaaatgcagcgcaatccgtaagcattttttagtcattgaaagtgcccattttcgcctcccagcagccccgtgccttttctgtgctcgatgccttgtccgcttctggtctgcgcgccattcgcttcgcgttggaagtgccaaatgtgacgcgagtggtggccaatgacttctccgagaaggcattcgaagcaatccgtcggaatgtgcagctgaacggcgtcccagacaagtcgaggcggtcttttccgacgcaat

SEQ ID NO: 50864 - DNA, 127 bp, Heterodera glycines
  Genomic contig location: Contig_ID=SeqID_3559; Location=772..898; Strand=+
  SCN-specific regions: Sequence locations=1-6,29-127
tttttgaaacaaaaggggggacccttttgttttgcaaaatttttttaagataaaaaaccatgataattttttatccggggttttaaaggtcgctaatcacgaatctgacatgtattttgactaattt

SEQ ID NO: 50865 - DNA, 1100 bp, Heterodera glycines
  Genomic contig location: Contig_ID=SeqID_3560; Location=1424..2523; Strand=+
  SCN-specific regions: Sequence locations=1-343,367-488,523-863,980 -1100
atgtcattgtctgatcagatttcccttaatttgtatttcatttaccgtccagaaattgtttgcgggtgttccgatgggaggcaatgcattgcattagtgccaatgcgttgcagacgcggtttgactgggcagcggtgagagtgggcggcaaaatgaacgggtaaatgctaatgatctcttggagaagcacgctaaaagccgaaggaaatgcagtttcagttggaatcaaattggagcagcacctcactgtcccataagagaaccacaaccaaacggcgaggtcctccactccctcgcgacgtttgctgaacaaaatgtgtgattatttaggcatttgaaaacggatttttgaatttggaaaaaacaactaccaaattcatcagttcttttctttttatttatggatagtgggaactaaaattttattaataaaaacaaaaaactgttcacattttaacaggatgttttttattatgtcgcattcatccaaaatttttataaaatttgttttggcttttatttgacagagtctgccttaaattgcgttaaaaagaacggcaactccccaacctaaccttatctgcaaaagtgcattttctcgcttttcgtgctcccttagttcgcgaatccagtgacaaatttgttccgcgtccttttctttgctattctcttctttattattggacgacgctgttgctgaagttgtcgttgtcgaggtcgactgagcattggcaatatttggcgatagcaatttctccattcacttatacaaatccgctgaaaagaaaatggaaatgatttttactttatttaggcgatcaaaggctttttaaaggaagttgtttatgtcagaccatggggtaaacccaactcatccaaacccaactcatccaaacccaactcatccatacccaactcatccatacccaactcatccatacccaactcatccatacccaactcatccatacccaactcatccatatacccaactcatccatacccaactcatccatagcacgatacgagtcgtcaccgtggcatttaatgccacgactaagactgtacaaccaaaaaatgccacgaccgagaccgcataa

SEQ ID NO: 50866 - DNA, 593 bp, Heterodera glycines
  Genomic contig location: Contig_ID=SeqID_20345; Location=228..820; Strand=-
  SCN-specific regions: Sequence locations=1-128,425-433,465-493,515-593
atggcccttcacattctttccatgtttggcaattcatctcattttgtgcgtgttgtgcaccatttcaacattccatttgttagccatggctattcacaaatatttgagcatttgtcagaaaaagttggtttaataatgtttaaaataataaaattatttttatttaaaaatttaaattcttttaaattaatttttatattcaaaattgtaatgattatatatttttaaatttgaaaattttcaaataataagacttgtaattttatgaaaaattaaagcatttaaatgaatattcaaataaattgtaatagtgaatttttttttaattatttattaaattaattaatttaaataataaatccaataatttgtattgatccaaaaactaaaaaaataacaattttataaaaagaattaaaaatatcaattcgacaatatatttttttaattaaattatataaatacaaactgtaaactcttgtataagattacaaaatgattttaaattaaatttctttagaattgctctccagcgaagcacaatccgatcgacaaaaatgaagcgtttgcatttgttgatcatcggtttatgg

SEQ ID NO: 50867 - DNA, 304 bp, Heterodera glycines
  Genomic contig location: Contig_ID=SeqID_20346; Location=546..849; Strand=-
  SCN-specific regions: Sequence locations=1-30,52-168
atgggttatgaattgcatcattatttttgcttttatacatttatttttaatccattgtacatcggacggtgttcagcgggtccttgcaaacctagcaatggtagatccttctaccgtacagcaatagtagatcattctaccgtactttgtctggaccgttgggatgccattatataataattaaaagtttttaaaattattttgataaatattgaaaaagtaattattattttttatttagtaatatatctataagtttaattttcatttatatttaattttaattataattaattaaaataaa

SEQ ID NO: 50868 - DNA, 150 bp, Heterodera glycines
  Genomic contig location: Contig_ID=SeqID_20348; Location=812..961; Strand=+
  SCN-specific regions: Sequence locations=1-150
tgccattttccgcttgtgccgcctgtacaattgaatgaaagtgatcggattagagatggaaaggacggccaatgtgcacagttccaacggcgtataggtcagcttgaacagattggcgccccacagcggacttttaacacgatcacctga

SEQ ID NO: 50869 - DNA, 2181 bp, Heterodera glycines
  Genomic contig location: Contig_ID=SeqID_20350; Location=172..2352; Strand=+
  SCN-specific regions: Sequence locations=1-715,737-953,975-2181
  Gene Ontology: Mol. function=amidase activity; Biological process =amino acid derivative metabolism
ctgacatcaaaggaactggtcaccgcttacatcgaccgattgaaggaggtcaacccgctgatcaacgcaattgcgcacgaaaactacaaagcggcactaaaactggcgaaggaagtggacacggaattggcaaaaatggattcaaaaaagcgaaaatcggtaatgggtttaattgatcaaaattgattggactaatctaatggcattgtttagttggctttctcgaaaccgttttatggggtgccgttcacttcaaaggacaacctgaaaacaaagggatttgtgaccattgcgggcaatcgctatctgaaggaaggcggaaaagtggccacggaagacgcgctaatcgtaaaacggtggcaattggatgaaattaagccaattaatcaaataaatagccaactttaaatgcattaaacaacatttgatgctaaaaggttcccaaattgggttttttatggaaaattttccggtcaaaggatgaaggatgcgggtgccattcttgtagccatctcaacgctgcccaatttggcgatgagttacgcatgcgatgacaccgcttacgaaggagtcaccaacaacccacacgacacacgtcgcattccaggcaaaacaaacagcaaatgcaattaaatgctaattaacgagttcttaattaccaatcattcgccgctttttcaggcggaagcagctcaggcgaaggagcactgatcggcgccggcgcgtcactgtgcggaattggcaatgacatggggggatcagttcgaatcccggccaacatgaacggagtgttcggcctgagaccgaccagttttcccgaccgtaagtgatcattggcataaatgtgctgctgatcagtttaggttttgtcagcaatgctgcacataactgagtttcaattaacgacaatcagtaattacggaaggttttaacaaatccgtgacccttaatccgtcatgactgtgtccaaaaacgccgtaattccaatgaccagaaattgcttgtagcctttggtttatatagtgtacccattggttgaactgaatgaatgatattctagcaaacattaaaaaaatttctacacgtgtttatctgtttctgatcatcactcctttcccaatcagacgttgtgccagccgaaggaattgtgccggacagccttctctacaaaccagcgcttaacatgctcaccaatggccctctctgtcgctatgcctccgatttgccattggcacttgcggtaaaagaattataaatcaaactaaaaccattaactaaattaacaaaaacattttatacaaaagttgatcaataaagcaattccaaactgtctaattataaaagcgcgatcaaatgaatttaaatccgctttctttaatttcatttaaaaaaattcttatttttaatgtcaatgaattttgaaggtaatggccggtaaaaaggtgaacagcttccaattggacgtggaatttgcgaaggatttcaagctgtactacttggaagacctcaatgttttgatcactcatgagttgaaagccgagcaaagatttgccgttcgaagagtaaaagcattcactaaattatgctaaattaaaatttgcaaaaccatttcaggtcaaatcgtattttgagtcgaaatacaattcaacggtccaaaaggtggagttcactttactgtcgcgttttctcgaactgttctatgccgacccgtggaaagccggagttccggtgtgcaaatcactcaaatttggcactaataaattgatcgtaattaatttacataatttatttctggcagaccttcgatgagctgaaaacgacgtaccaagacattcaggcaggcgtggcaaacgacacttttttcgcgttgcaatttgaggcgttgaagcgatttgctgtgccaaaatcggaaaatgaacagaaatgggtgggaattttaacacaaaatttcgatctgttactgattagacaagttttgtgttccttcaggtgctgctcaaaaaggagaagctgcgcaaacaagttgcccaattgctcggcaaaaacggactgctgctgaccccggtttggccaaccgatgtgccattccatcacatggaaccgttcgtcgctttcgacctcaaatacacaatggtaggccagtgaagggtgcttgctataggtgccttcttcaatccgccc

SEQ ID NO: 50870 - DNA, 1124 bp, Heterodera glycines
  Genomic contig location: Contig_ID=SeqID_20352; Location=63..1186; Strand=-
  SCN-specific regions: Sequence locations=1-10,34-114,146-192,217 -885,907-939,989-1014,1036-1124
atgaaaattcaaatattattatttattttaattctcaaaatttatgctggcggaataaaggaagaaaaaagctttgacgaaatatttggccaaagatgggacgaaaaatcggaggaaaatggagagaaagaaactgatcaacatggaataattggacaaaagaatgatcaaaatgagacaaaaaatgatgaaaatatcgcacaaagattatttgcagaacaatttgatcaaaattttgatgataattcggaagtgcatgacgagcagagtgtactattgtccacaaattgtgatgaattggaacaagcgccagtaaaatttggacaaatttgtgatcattttataatttttgaaaataaaaagaaaatagaaattgtggaaaaatttgataaaattaaagaaaaagttaagcaaatgggaaagaaatattcaaagaaagaatggaataaaattgaaagaaaaattgcaaaaaaattgggtgaaaatcaaaagaaaatttacaaatggaaaagagaatttggaatgatgaagaacaaaaattattcagttgaagaaaaaagaataatgttaaagcaatttgatcaaatatatggcaaattaaaaatgaaattaaatggaaaattggaaggaaaaaggacaaaatgccaaaaaataatagcaacacatttgggcataagtttaaaaagcatttataaatggaagaaacaattaaaaaatggaaaacctttgaaaaatcaacaaattgatgatgaaaaaagggaaattgttgaaaaatattttaaaacaaaaaatgaatttatgcaaaatgggaaacattcacgaaaggaatgggaagaatttagagcaaaaattaaacaaatatttggtgtgaattatttgacgactgaaaaatgggcaaagaaattaaatttcaatcaaaatatttcaaaaggtgaaatgttttttatataaaataattttaaaattaaattatcttaaattttatatagcgaaacattttgtttttcgatgcagttttaaagcaatttctgttattttcgtacttattttcttagttttttgtcataatccaaaaattgaaagacccaatctgacagatattacctcaaaatttcaaaaataaa

SEQ ID NO: 50871 - DNA, 622 bp, Heterodera glycines
  Genomic contig location: Contig_ID=SeqID_20352; Location=1840..2461; Strand=+
  SCN-specific regions: Sequence locations=1-217,239-622
atgaacaaattgagtgagaacgccgccttctcgaagcatcttggagtacagccgatctgtttgccatctgtagtcactgattttggatttggcgacacgattgaaaagttctcgaaaagcttttcagtcgtcaacaatcagtctttatcggcagatccggatctcttcaagccgaaagagggaatggtgaaaagttacgacaatttttgaaagacatcggaaactgctccaagatttcaaattagaagaattcgacaaggccaattcaactgcctcatgctgcttactacattgaaagtctcaaaatgattctgtcttatgcagtgaattttggccatatttacagcagatggggacaaaactcaagtataacaacattatggaagaattacagatttatctttccaccattgcgaggctattgaacagccttctggcgttggagaaaagagagggaatattctggggagggatttggggattgagttcggggatggatttgaggggaataatttccgaattcaatatcactttacgattaaagtcaaatgctaactgctcgtttttgtaacgacagctttaaagccaagggtaatcagaagttggggaatttatcaggaga

SEQ ID NO: 50872 - DNA, 1155 bp, Heterodera glycines
  Genomic contig location: Contig_ID=SeqID_20353; Location=358..1512; Strand=+
  SCN-specific regions: Sequence locations=1-125,153-795,819-1155
atggcactgaaaagaatgtttttggcacaaaaggcacttcgccaagaagcggcgaccgaagcagcggaagggacggaaaacggaaataacacaacgaaaagccgagtgaaaggacgccgaaaactgagacagcagcagcaacaacaacagtaccatcatcagaatgtgaatgcattccaatggatcggaagcgacggatgggccgaccgattggacgtggtacggtaggacacggttgggtaacagtcggacagttttgggttactgttggactggctttaagcagacattaagtatttgcccaattgaatgttcggataaatttttccctttaatgtggcaacgaatctagtcacttctcggatcaaacattcaatgccgccgacttaaatggtcactaattgcctttgctaattaggtggagggcgtggaggaggaggcggccggcagcttttccattcgaatccattcgccaaatgtgcgcacctttgagccctattactttgcgcttaacccacacaatcacacgcgcaacccgtggttccgcgagttttggcaacaaaagttcaaatgtttgctgacggtgccaaaggacgacacggtcagccgacagtgcaccggacaagagagtctggccaccgggtacgagcaggacccgaagctgagccaggcaagaaacagtagaattggggggatgacacaattggggaaggggcacggcacaatcaacgggggaccggtagagactcatccgcccatattattgagattaagatatggcaccaaaaataggcattaaaaagggcaaaaattaaattaagcaaattagccaattccatttttctatgatttcggaggggatttggcaatttttatgcaaaatcatttgtttccattttctttcgcttgtgctaatctctcattgctcaggtgataaacgcgatcagagttgtcgggtaagttctatttgtattaaggaaaacctattaatgaaatttcctcggaaaagctatgccctccgggagatgtacaatgacaagtgccattcctcgcggcaaaatgcgaccgccaacgcacttctaaatgcccaatttgggttgccatgccccgaaatggaaaccatcaacggcacacttttgtttaggcaaaatgaga

SEQ ID NO: 50873 - DNA, 372 bp, Heterodera glycines
  Genomic contig location: Contig_ID=SeqID_20354; Location=3..374; Strand=+
  SCN-specific regions: Sequence locations=1-64,213-262,284-372
atggccaagcttgccaagctgtactcgctgctgacggacaaggagttgagctcgctgtcccatacgctgcagttggcgcgaccgtccaccatcactgccgccagcgcaacggacgcgacgagcaccagcgactactgcacggagtcgtcgccaccgccgccgccgcaacagtcgccgactgtcgcctccggcgctggcgttgctgccgctgcatttgttcaaccgccgcaacacaggccaacaaagagggcatttctggaggacaaccacaacgactacaacacgggtgggcaaaaagggacataatttatttaactaaatggggcagggcttgcatttaagttgatcccacatgaaataatttgaaaaaaa

SEQ ID NO: 50874 - DNA, 183 bp, Heterodera glycines
  Genomic contig location: Contig_ID=SeqID_20354; Location=482..664; Strand=+
  SCN-specific regions: Sequence locations=1-13,38-64,86-161
ggtgcaacgacggatgttcttgtttgcagaaccaacacatcattttagtctctcgaaaatttcgtgaaattttatatccatttattgatacaacacacttttgtttttactaaacaacatatgtatgagggaggacgagggtgatatgatgatgatatgattaaatgattaattatcccccaa

SEQ ID NO: 50875 - DNA, 444 bp, Heterodera glycines
  Genomic contig location: Contig_ID=SeqID_20354; Location=665..1108; Strand=-
  SCN-specific regions: Sequence locations=1-41,84-444
atggcgtccaggcggcacataataaaaatgagtggtgagagataattaaacaaaaatttaaatcgaattttttttaataattagcacattgtcgtgtcaaatatggtttattcgatcaactgaatttgatgttcccctttgatggagtggtgggtttttggcttggcaaaactcagggacaacaggagcccatttcaaatatgggtatgatttttgaggccccaaagggccggagaatttaattcttgccacatttttatccaataattcagacagatttgtaaacaaaccaatgccaccacaaagctcaaaaaaaaaaatggaatcagtcctttataattacattttgtgattgattgaatttgtatgttctttgtcaagaaaagaatgaatttccatccacaacgataaacacacataaaattcaaagtgcaatagaataaa

SEQ ID NO: 50876 - DNA, 89 bp, Heterodera glycines
  Genomic contig location: Contig_ID=SeqID_3562; Location=1747..1835; Strand=-
  SCN-specific regions: Sequence locations=1-38,61-89
aatgagtcaaaatgtcccccctctaaaaattagtgaaaaaactgaaaattatataattatatgccttcatacgatctgcttttaaaatt

SEQ ID NO: 50877 - DNA, 1693 bp, Heterodera glycines
  Genomic contig location: Contig_ID=SeqID_3563; Location=395..2087; Strand=-
  SCN-specific regions: Sequence locations=1-115,138-228,250-498,520 -1034,1056-1334,1356-1693
ccagatcgaaaaagaagcattggctctagtgtttgcagtacagaaattccaccgaatgttattcggcaggaaattcaccttatttactgatcacaagcctttgcttgccattttcggttccaaaaagggaattccggtttattccgctagccgattacaacggtgggcgttgatcatggcaaattatgatttcgacatcaaatacacgaatacagcatcatttggacaagcagatgtcctctcaaggctaatagccaattatccaaagcctgaggaagatgtgttgattgccaacatttgcgtcgaaacggactgttatattaacaccattttacagtcgcaaaccgatcatcttccagtaacggcacaagaaattgcggaatcaacaaccaaagatgagacactccagaaaattgttaattttgttatttctggttggccaacgaagtgcagggaacccgaaattgcaccatttcatccgaaaagaaatgaaattttggaaattgggggctgccttctctacaaaagtcgtgtcatcattccaagccaattgcgtggccgaattttaaaggcattgcattttgcgcacccgggaattgtgcaaatgaaggccttggcacgccagtatgtatattggccaggaatggattcggaaattgagaaagtcgtacggcaatgtgatgagtgccaaagtgcacagaaatgcccgattaaggcaccattggccccatggacagtcaccgacaaagcgtttcaacgcgtacacatcgacttcgctggaccctgccaagatggatttgtttattttattctgatggacgccttttccaaatggccagaagtctatcaaatgtcttcaattacggccaaatacaccgttttcacaattcgatcgataatccatcgtcttggcattcctaaggaaatagtgtcagataatggcacacaattcaaatcagctgaatttgccgctttttgtcaagaattcggcatcaagcataccttttcaccgccatttcacccgcagtcaaatggccaagtcgaacgatttgttgacacctttaaaagagcaatgaaaaagtgttcaaaagacgataaaaattggaccgaaaaggtgctgctcgcttacaggacaacgccaaacaatgccattgatggctattctcccgatcaattattcttcggacggaaactccgaacgaaattggcattggtccttccgaaaggacaccgaaacgattcggagaacatcgacaaaattcagcgcgacaaaagaagaaaggactattcgaataaaatggcaaaacaattcgatgaacggcatggtgccaaagaaaaagtctttttccccgccgaaccagtcctccttttgaactacaggaaccaaaaaacttattggctccatggtacaattgtagagcgagtcaggaactcgcctacataccgagtccatgtaccagttcttggtcgaattgtccaccgacattcgaaccaacttcgtcgaaattgtgttttcgaagagaattcgaaacacaatcctggtcccgatcagcagccaattccaccagtcaacggacaagctcaaaatttggcgcatcaaattgctgatccggtcgatcaacggactgatcaacaagccgcaaatgacccgccgacaatggctcttcgacgatcgcagcgtaagccgaagccg
